(12) United States Patent
Sastry-Dent et al.

(10) Patent No.: US 9,909,131 B2
(45) Date of Patent: Mar. 6, 2018

(54) OPTIMAL SOYBEAN LOCI

(71) Applicant: Dow AgroSciences LLC, Indianapolis, IN (US)

(72) Inventors: Lakshmi Sastry-Dent, Avon, IN (US); Zehui Cao, Carmel, IN (US); Shreedharan Sriram, Indianapolis, IN (US); Steven R. Webb, Westfield, IN (US); Debra L. Camper, Indianapolis, IN (US); W. Michael Ainley, Carmel, IN (US)

(73) Assignee: Dow AgroSciences LLC, Indianapolis (*) Notice: Subject to any disclaimer, the term of this patent is extended or adjusted under 35 U.S.C. 154(b) by 567 days.

(21) Appl. No.: 14/531,748

(22) Filed: Nov. 3, 2014

(65) Prior Publication Data

US 2015/0128308 A1   May 7, 2015

Related U.S. Application Data

(60) Provisional application No. 61/899,602, filed on Nov. 4, 2013.

(51) Int. Cl.
*C12N 15/82* (2006.01)
*A01H 5/10* (2006.01)

(52) U.S. Cl.
CPC ........... *C12N 15/8213* (2013.01); *A01H 5/10* (2013.01); *C12N 15/8243* (2013.01); *C12N 15/8273* (2013.01); *C12N 15/8274* (2013.01); *C12N 15/8286* (2013.01)

(58) Field of Classification Search
None
See application file for complete search history.

(56) References Cited

U.S. PATENT DOCUMENTS

| 4,769,061 | A | 9/1988 | Comai |
|---|---|---|---|
| 4,810,648 | A | 3/1989 | Stalker |
| 4,940,835 | A | 7/1990 | Fraley et al. |
| 5,789,538 | A | 8/1998 | Rebar et al. |
| 5,925,523 | A | 7/1999 | Dove et al. |
| 6,007,988 | A | 12/1999 | Choo et al. |
| 6,013,453 | A | 1/2000 | Choo et al. |
| 6,140,081 | A | 10/2000 | Barbas |
| 6,200,759 | B1 | 3/2001 | Dove et al. |
| 6,242,568 | B1 | 6/2001 | Barbas et al. |
| 6,453,242 | B1 | 9/2002 | Eisenberg et al. |
| 6,479,626 | B1 | 11/2002 | Kim et al. |
| 6,534,261 | B1 | 3/2003 | Cox et al. |
| 6,599,692 | B1 | 6/2003 | Case et al. |
| 6,689,558 | B2 | 2/2004 | Case |
| 6,794,136 | B1 | 9/2004 | Eisenberg et al. |
| 6,903,185 | B2 | 6/2005 | Kim et al. |
| 7,030,215 | B2 | 4/2006 | Liu et al. |
| 7,067,317 | B2 | 6/2006 | Rebar et al. |
| 7,070,934 | B2 | 7/2006 | Cox, III et al. |
| 7,153,949 | B2 | 12/2006 | Kim et al. |
| 7,253,273 | B2 | 8/2007 | Collingwood |
| 7,262,054 | B2 | 8/2007 | Jamieson et al. |
| 7,361,635 | B2 | 4/2008 | Miller et al. |
| 7,462,758 | B2 | 12/2008 | Biesgen |
| 8,420,782 | B2 | 4/2013 | Bonas et al. |
| 8,440,431 | B2 | 5/2013 | Voytas et al. |
| 2003/0232410 | A1 | 12/2003 | Liljedahl et al. |
| 2005/0026157 | A1 | 2/2005 | Baltimore et al. |
| 2005/0064474 | A1 | 3/2005 | Holmes et al. |
| 2005/0208489 | A1 | 9/2005 | Carroll et al. |
| 2005/0267061 | A1 | 12/2005 | Martin |
| 2006/0188987 | A1 | 8/2006 | Guschin et al. |
| 2007/0134796 | A1 | 6/2007 | Holmes et al. |
| 2007/0218528 | A1 | 9/2007 | Miller |
| 2008/0131962 | A1 | 6/2008 | Miller |
| 2008/0182332 | A1 | 7/2008 | Cai |
| 2009/0111119 | A1 | 4/2009 | Doyon et al. |
| 2009/0117617 | A1 | 5/2009 | Holmes et al. |
| 2009/0205083 | A1 | 8/2009 | Gupta et al. |
| 2009/0263900 | A1 | 10/2009 | DeKelver et al. |
| 2010/0047805 | A1 | 2/2010 | Wang |
| 2010/0199389 | A1 | 8/2010 | Butler et al. |
| 2011/0041195 | A1 | 2/2011 | Doyon |
| 2011/0145940 | A1 | 6/2011 | Voytas et al. |
| 2011/0167521 | A1 | 6/2011 | DeKelver et al. |
| 2011/0189775 | A1 | 8/2011 | Ainley et al. |
| 2011/0201055 | A1 | 8/2011 | Doyon et al. |
| 2011/0207221 | A1 | 8/2011 | Cost et al. |
| 2011/0229582 | A1 | 9/2011 | Fischer et al. |
| 2011/0239315 | A1 | 9/2011 | Bonas et al. |
| 2011/0281361 | A1 | 11/2011 | DeKelver et al. |
| 2011/0287545 | A1 | 11/2011 | Cost et al. |

(Continued)

FOREIGN PATENT DOCUMENTS

| EP | 0 242 246 | 11/1992 |
|---|---|---|
| GB | 2338237 | 8/1998 |

(Continued)

OTHER PUBLICATIONS

Valton et al., 5' Cytosine-Phosphoguanine (CpG) Methylation Impacts the Activity of Natural and Engineere Meganucleases, JBC (2012) vol. 287 (36) pp. 30139-30150.

Daboussi et al., Chromosomal Contxt and Epigenetic Mechanisms Control the efficacy of Genome Editing by Rare-Cutting Designer Endonucleases, Nuc Acids Research (2012) vol. 40(13) pp. 6367-6379.

Gao et al., Heritable Targeted Mutagenesis in Maize using a Designed Endonuclease, The Plant Journal, (2009), vol. 61 (1) pp. 176-187.

Ainley et al., "Trait Stacking via Targeted Genome Editing," *Plant Biotechnol. J.* 11(9):1126-1134 (2013).

Beerli et al., Toward Controlling Gene Expression at Will: Specific Regulation of the ERBB-2/HER-2 Promoter by Using Polydactyl Zinc Finger Proteins Constructed From Modular Building Blocks, *PNAS USA* 95(25):14628-14633 (1998).

(Continued)

*Primary Examiner* — Matthew R Keogh
(74) *Attorney, Agent, or Firm* — Sean M. Russell; Barnes & Thornburg LLP

(57) ABSTRACT

As disclosed herein, optimal native genomic loci of soybean plants have been identified that represent best sites for targeted insertion of exogenous sequences.

20 Claims, 16 Drawing Sheets

(56) References Cited

U.S. PATENT DOCUMENTS

| | | |
|---|---|---|
| 2011/0301073 A1 | 12/2011 | Gregory et al. |
| 2014/0283166 A1 | 9/2014 | Chomet et al. |

FOREIGN PATENT DOCUMENTS

| | | |
|---|---|---|
| WO | WO 93/19181 | 9/1993 |
| WO | WO 95/19431 | 7/1995 |
| WO | WO 96/06166 | 2/1996 |
| WO | WO 96/30517 | 10/1996 |
| WO | WO 98/53057 | 11/1998 |
| WO | WO 98/53058 | 11/1998 |
| WO | WO 98/53059 | 11/1998 |
| WO | WO 98/53060 | 11/1998 |
| WO | WO 98/54311 | 12/1998 |
| WO | WO 00/27878 | 5/2000 |
| WO | WO 01/60970 | 8/2001 |
| WO | WO 01/88197 | 11/2001 |
| WO | WO 02/016536 | 2/2002 |
| WO | WO 02/077227 | 10/2002 |
| WO | WO 02/099084 | 12/2002 |
| WO | WO 03/016496 | 2/2003 |
| WO | WO 05/012515 | 2/2005 |
| WO | WO 05/107437 | 11/2005 |
| WO | WO 07/014275 | 2/2007 |
| WO | WO 07/053482 | 5/2007 |
| WO | WO 13/144663 | 3/2013 |

OTHER PUBLICATIONS

Beerli et al., "Engineering Polydactyl Zinc-Finger Transcription Factors," *Nature Biotechnol.* 20:135-141(2002).

Bibikova et al., "Stimulation of Gomologous Recombination Through Targeted Cleavage by Chimeric Nucleases," *Mol. Cell. Biol.* 21(1):289-297 (2001).

Bibikova et al., "Enhancing Gene Targeting With Designed Zinc Finger Nucleases," *Science* 300(5620):764 (2003).

Bitinate et al., "Foki Dimerization Is Required for DNA Cleavage," *PNAS USA* 95:10570-10575 (1998).

Bonas et al., "Genetic and Structural Characterization of the Avirulence Gene AVRBS3 From *Xanthomonas campestris* PV. *vesicatori,*" *Mol. Gen. Genet.* 218:127-136 (1989).

Cai et al., Targeted Transgene Integration in Plant Cells Using Designed Zinc Finger Nucleases, *Plant Mol. Biol.* 69(6):699-709 (2009).

Choo et al., Advances in Zinc Finger Engineering, *Curr. Opin. Struct. Biol.* 10:411-416 (2000).

Curtin et al., "Targeted Mutagenesis of Duplicated Genes in Soybean with Zinc-Finger Nucleases," *Plant Physiology* 156:466-473 (2011).

D'Halluin et al., "Homologous Recombination: A Basis for Targeted Genome Optimization in Crop Species Such as Maize," *Plant Biotechnology Journal* 6(1):93-102 (2008).

DeGreef et al., "Evaluation of Herbicide Resistance in Transgenic Crops Under Field Conditions," *Nat Biotechnology* 7:61-64 (1989).

Doyon et al., "Heritable Targeted Gene Disruption in Zebrafish Using Designed Zinc-Finger Nucleases," *Nat. Biotechnol.* 26:702-708 (2008).

Fisher et al., Starch Branching Enzyme II From Maize Endosperm, *Plant Physiol.* 102:1045-1046 (1993).

Geiser et al., "The Hypervariable Region in the Genes Coding for Entomopathogenic Crystal Proteins of Bacillus Thuringiensis: Nucleotide Sequence of the KURHD1 Gene of Subsp. *kurstaki* HD1," *Gene* 48:109-118 (1986).

Guerts et al., Knockout Rats via Embryo Micronjection of Zinc-Finger Nucleases, *Science* 325(5939):433 (2009).

Haft et al., "A Guild of 45 CRISPR-Associated (CAS) Protein Families and Multiple CRISPR/CAS Subtypes Exist in Prokaryotic Genomes," *PLoS Comput. Biol.* 1:e60 (2005) <http://www.jcvi.org/cms/nc/publications/listing/browse/3/article//Haft/#sthash.bXXP6pOi.dpuf>.

Hayes et al., "Molecular Cloning and Heterologous Expression of a CDNA Encoding a Mouse Glutathione S-Transferase YC Subunit Possessing High Catalytic Activity for Aflatoxin B1-8,9-Expoxide," *Biochem. J.* 285:173-180 (1992).

Heuer et al., "Repeat Domain Diversity of AVRBS3-Like Genes in *Ralstonia solanacearum* Strains and Association With Host Preferences in the Field," *Appl. and Envir. Micro.* 73(13):4379-4384 (2007).

Isalan et al., "A Rapid, Generally Applicable Method to Engineer Zinc Fingers Illustrated by Targeting the HIV-1 Promoter," *Nature Biotechnol.* 19:656-660 (2001).

Jansen et al., "Identification of Genes That Are Associated With DNA Repeats in Prokaryotes," *Mol. Microbiol.* 43:1565-1575 (2002).

Jones et al., "Isolation of the Tomato CF-9 Gene for Resistance to Cladosporium Fulvum by Transposon Tagging," *Science* 266:789-793 (1994).

Kay et al., "A Bacterial Effector Acts as a Plant Transcription Factor and Induces a Cell Size Regulator,"*Science* 318:648-651 (2007).

Kim et al., "Chimeric Restriction Enzyme:GAL4 Fusion to FOKL Cleavage Domain," *J. Biol. Chem.* 379:489-495 (1998).

Kim et al., "Getting a Handhold on DNA: Design of Poly-Zinc Finger Proteins With Femtomolar Dissociation Constants," *PNAS USA* 95:2812-2817 (1998).

Kim et al., "Design of TATA Box-Binding Proteinyzinc Finger Fusions for Targeted Regulation of Gene Expression," *PNAS* 94:3616-3620 (1997).

Kim et al., "Site-Specific Cleavage of DNA-RNA Hybrids by Zinc Finger/FOKI Cleavage Domain Fusions," *Gene* 203:43-49 (1997).

Kim et al., "Construction of a Z-DNA-Specific Restriction Endonuclease," *PNAS* 94:12875-12879 (1997).

Kim et al., "Hybrid Restriction Enzymes: Zinc Finger Fusions to FOK I Cleavage Domain," *PNAS* 93:1156-1160 (1996).

Kim et al., "Chimeric Restriction Endonuclease," *PNAS* 91:883-887 (1994).

Knutson et al., "Modification of *Brassica* Seed Oil by Antisense Expression of a Stearoyl-Acyl Carrier Protein Desaturase Gene," *Proc. Natl. Acad. Sci. U.S.A.*, 89:2624-2628 (1992).

Kumar et al., "Controlling Transgene Integration in Plants," *Trends Plant Sci.* 6:155-159 (2001).

Le et al., "Simultaneous Generation and Germline Transmission of Multiple Gene Mutations in Rat Using CRISPR-CAS Systems," *Nature Biotechnology* 31:684-686 (2013).

Lee et al., "The Molecular Basis of Sulfonylurea Herbicide Resistance in Tobacco," *EMBO J.* 7(5):1241 (1988).

Liu et al., "Design of Polydactyl Zinc-Finger Proteins for Unique Addressing Within Complex Genomes," *PNAS USA* 94:5525-5530 (1997).

Makarova et al., "A Putative RNA-Interference-Based Immune System Inprokaryotes: Computational Analysis of the Predicted Enzymatic Machinery, Functional Analogies With Eukaryotic RNAI, and Hypothetical Mechanisms of Action," *Biol. Direct.* 1:7 (2006).

Makarova et al., "A DNA Repair System Specific for the Thermophilic Archaea and Bacteria Predicted by Genomic Context Analysis," *Nucleic Acids Res.* 30:482-496 (2002).

Mani et al., "Binding of Two Zinc Finger Nuclease Monomers to Two Specific Sites Is Required for Effective Double-Strand DNA Cleavage," *Biochem. Biophys. Res. Commun.* 334:1191-1197 (2005).

Martin et al., "Map-Based Cloning of a Protein Kinase Gene Conferring Disease Resistance to Tomato," *Science* 262:1432-1436 (1993).

Miki et al., "Transformation of *Brassica napus* Canola Cultivars with *Arabidopsis thaliana* Acetohydroxyacid Synthase Genes and Analysis of Herbicide Resistance," *Theor. Appl. Genet.* 80:449 (1990).

Mindrinos et al., "The *A. thaliana* Disease Resistance Gene RPS2 Encodes a Protein Containing a Nucleotide-Binding Site and Leucine-Rich Repeats," *Cell* 78:1089 (1994).

Moehle et al., "Targeted Gene Addition Into a Specified Location in the Human Genome Using Designed Zinc Finger Nucleases," *Proc. Natl. Acad. Sci. USA* 104(9):3055-3060 (2007).

(56) References Cited

OTHER PUBLICATIONS

Nekrasov et al., "Targeted Mutagenesis in the Model Plant *Nicotiana benthamiana* Using CAS9 RNA-Guided Endonuclease," *Nature Biotechnology* 31:691-693 (2013).
Pabo et al., "Design and Selection of Novel CYS2HIS2 Zincfinger Proteins," *Ann. Rev. Biochem* 70:313-340 (2001).
Paszkowski et al., "Gene Targeting in Plants," *EMBO J.* 7:4021-4026 (1988).
Pen et al., "Production of Active Bacillus Licheniformis Alpha-Amylase in Tobacco and Its Application in Starch Liquefaction," *BioTechnology* 10:292 (1992).
Przibilla et al., "Site-Specific Mutagenesis of the D1 Subunit of Photosystem II in Wild-Type Chlamydomona," Plant Cell 3:169-174 (1991).
Puchta et al., "Homologous Recombination in Plant Cells Is Enhanced by In Vivo Induction of Double Strand Breaks Into DNA by a Site-Specific Endonuclease," *Nucleic Acid Research* 21:5034-5040 (1993).
Raboy et al., "A Survey of Maize Kernel Mutants for Variation in Phytic Acid," *Maydica* 35:383-390 (1990).
Roberts et al., "Rebase: Restriction Enzymes and Methyltransferases," *Nucleic Acids Res.* 31:418-420 (2003).
Scheffler et al., "Desaturase Multigene Families of *Brassica napus* Arose Through Genome Duplication," *TAG* 94(5):583-591 (1997).
Schierholt et al., "Mapping a High Oleic Acid Mutation in Winter Oilseed Rape (*Brassica napus* L.)" *TAG* 101(5-6):897-901 (2000).
Schierholt et al., "Inheritance of High Oleic Acid Mutations in Winter Oilseed Rape (*Brassica napus* L.)" *Crop Sci.* 41:1444-1449 (2001).
Schornack et al., "Gene-For-Gene-Mediated Recognition of Nuclear-Targeted AVRBS3-Like Bacterial Effector Proteins," *J. Plant Physiol.* 163(3):256-272 (2006).
Segal, "Custom DNA-Binding Proteins Come of Age: Polydactyl Zinc-Finger Proteins," *Curr. Opin. Biotechnol.* 12:632-637 (2001).
Shan et al., "Targeted Genome Modification of Crop Plants Using a CRISPR-CAS System," *Nature Biotechnology* 31:686-680 (2013).
Shiroza et al., "Sequence Analysis of the *Streptococcus* Mutans Fructosyltransferase Gene and Flanking Regions," *J. Bacteriol.* 170(2):810-816 (1988).
Shukla et al., "Precise Genome Modification in the Crop Species *Zea mays* Using Zinc-Finger Nucleases," *Nature* 459:437-441 (2009).
Siebert et al., "Efficient Repair of Genomic Double-Strand Breaks by Homologous Recombination Between Directly Repeated Sequences in the Plant Genome," *Plant Cell* 14:1121-1131 (2002).
Smith et al., "A Detailed Study of the Substrate Specificity of a Chimeric Restriction Enzyme," *Nucleic Acids Res.* 27:674-681 (1999).
Smith et al., "Requirements for Double-Strand Cleavage by Chimeric Restriction Enzymes with Zinc Finger DNA-Recognition Domains," *Nucleic Acids Res.* 28:3361-3369 (2000).
Sogaard et al., "Site-Directed Mutagenesis of Histidine 93, Aspartic Acid 180, Glutamic Acid 205, Hisitidine 290, and Aspartic Acid 291 at the Active Site and Tryptophan 279 at the Raw Starch Binding Site in Barley A-Amylase 1," *J. Biol. Chem.* 268:22480 (1993).

Steinmetz et al., "The DNA Sequence of the Gene for the Secreted *Bacillus subtilis* Enzyme Levansucrase and Its Genetic Control Sites," *Mol. Gen. Genet.* 20:220 (1985).
Terada et al., "Efficient Gene Targeting by Homologous Recombination in Rice," *Nat. Biotechnol.* 20(10):1030 (2002).
Terada et al., "Gene Targeting by Homologous Recombination as a Biotechnological Tool for Rice Functional Genomics," *Plant Physiol.* 144(2):846 (2007).
Urnov et al., "Genome Editing With Engineered Zinc Finger Nucleases," *Nature Reviews* 11:636-546(2010).
Urnov et al., "Highly Efficient Endogenous Human Gene Correction Using Designed Zinc-Finger Nucleases," *Nature* 435:646-651 (2005).
Van Hartingsveldt et al., "Cloning, Characterization and Overexpression of the Phytase-Encoding Gene (PHYA) of Aspergillus and Niger," *Gene* 127:87-94 (1993).
Wah et al., "Structure of FOKI Has Implications for DNA Cleavage," *PNAS USA* 95:10564-10569 (1998).
Wu et al., "Custom-Designed Zinc Finger Nucleases: What Is Next?," *Cell. Mol. Life Sci.* 64:2933-2944 (2007).
Eqyuem et al., "Characterization of Three Loci for Homologous Gene Targeting and Transgene Expression," *Biotechnology and Bioengineering*, vol. 110, No. 8, Aug. 2013.
Akhtar, et al., "Chromatin Position Effects Assayed by Thousands of Reporters Integrated in Parallel," *Cell* 154, 914-927, Aug. 15, 2013.
Tillo et al., "G+C content dominates intrinsic nucleosome occupancy," *BMC Bioinformatics* 2009, 10:442, Dec. 22, 2009, available at http://www.biomedcentral.com/1471-2105/10/442.
Krebs et al., "Keys to Open Chromatin for Transcription Activation: FACT and Asf1," *Molecular Cell* 34, May 29, 2009.
Perez-Pinera et al., "Gene targeting to the ROSA26 locus directed by engineered zinc finger nucleases," *Nucleic Acids Research*, 2011, 1-12.
Sadelain et al., "Safe harbours for the integration of new DNA in the human genome," Nature Reviews | Cancer, vol. 12, Jan. 2012.
Silva et al., "Meganucleases and Other Tools for Targeted Genome Engineering: Perspectives and Challenges for Gene Therapy," *Current Gene Therapy*, 2011, 11, 11-27.
International Search Report, International Application No. PCT/US2014/063728, dated Apr. 29, 2015.
International Search Report, International Application No. PCT/US2014/063739, dated Apr. 8, 2015.
Dufourmantel et al., "Generation of fertile transplastomic soybean," *Plant Mol. Biol.*, 2004, 55(4):479-189.
Yadav et al., "Enhanced viral intergenic region-specific short interfering RNA accumulation and DNA methylation correlates with resistance against a geminivirus," *Mol Plant Microbe Interact.*, 2011, 24(10): 1189-1197.
Song et al., "Genome-wide analysis of DNA methylation in soybean," *Mol Plant*, Epub Aug. 21, 2013, 6(6): 1961-1974.
Sonah et al., "An improved genotyping by sequencing (GBS) approach offering increased versatility and efficiency of SNP discovery and genotyping," *PLoS One*, Epub Jan. 23, 2013, 8(1):e54603.
Schmitz et al., "Epigenome-wide inheritance of cytosine methylation variants in a recombinant inbred population," *Genome Res.*, Epub Jun. 5, 2013, 23(10):1663-74.
Schmutz et al., "Glycine Max Chromosome 4 GLYMAchr_04_Cont2713, Whole Genome Shotgun Sequence," Aug. 29, 2013.

OPTIMAL SOYBEAN LOCI

CROSS-REFERENCE TO RELATED APPLICATIONS

This application claims the benefit, under 35 U.S.C. § 119(e), to U.S. Provisional Patent Application No. 61/899,602, filed on Nov. 4, 2013, the contents of which are incorporated by reference in their entirety into the present application.

REFERENCE TO SEQUENCE LISTING SUBMITTED ELECTRONICALLY

The official copy of the sequence listing is submitted electronically via EFS-Web as an ASCII formatted sequence listing with a file named "75608232324seqlist.txt", created on Oct. 31, 2014, and having a size of 13.8 megabytes and is filed concurrently with the specification. The sequence listing contained in this ASCII formatted document is part of the specification and is herein incorporated by reference in its entirety.

REFERENCE TO TABLE LISTING SUBMITTED ELECTRONICALLY

The official copy of the table listing is submitted electronically via EFS-Web as a .PDF formatted table listing with a file named "Table 3", created on Nov. 4, 2013, and having a size of 12 megabytes and is filed concurrently with the specification. The table listing contained in this .PDF formatted document is part of the specification and is herein incorporated by reference in its entirety.

BACKGROUND

The genome of numerous types of dicot plants, for example soybean plants, was successfully transformed with transgenes in the early 1990's. Over the last twenty years, numerous methodologies have been developed for transforming the genome of dicot plants, like soybean, wherein a transgene is stably integrated into the genome of dicot plants. This evolution of dicot transformation methodologies has resulted in the capability to successfully introduce a transgene comprising an agronomic trait within the genome of dicot plants, such as soybean. The introduction of insect resistance and herbicide tolerant traits within dicot plants in the late—1990's provided producers with a new and convenient technological innovation for controlling insects and a wide spectrum of weeds, which was unparalleled in cultivation farming methods. Currently, transgenic dicot plants are commercially available throughout the world, and new transgenic products such as Enlist™ Soybean offer improved solutions for ever-increasing weed challenges. The utilization of transgenic dicot plants in modern agronomic practices would not be possible, but for the development and improvement of transformation methodologies.

However, current transformation methodologies rely upon the random insertion of transgenes within the genome of dicot plants, such as soybean. Reliance on random insertion of genes into a genome has several disadvantages. The transgenic events may randomly integrate within gene transcriptional sequences, thereby interrupting the expression of endogenous traits and altering the growth and development of the plant. In addition, the transgenic events may indiscriminately integrate into locations of the genome that are susceptible to gene silencing, culminating in the reduced or complete inhibition of transgene expression either in the first or subsequent generations of transgenic plants. Finally, the random integration of transgenes within the plant genome requires considerable effort and cost in identifying the location of the transgenic event and selecting transgenic events that perform as designed without agronomic impact to the plant. Novel assays must be continually developed to determine the precise location of the integrated transgene for each transgenic event, such as a soybean transgenic event. The random nature of plant transformation methodologies results in a "position-effect" of the integrated transgene, which hinders the effectiveness and efficiency of transformation methodologies.

Targeted genome modification of plants has been a longstanding and elusive goal of both applied and basic research. Targeting genes and gene stacks to specific locations in the genome of diot plants, such as soybean plants, will improve the quality of transgenic events, reduce costs associated with production of transgenic events and provide new methods for making transgenic plant products such as sequential gene stacking. Overall, targeting trangenes to specific genomic sites is likely to be commercially beneficial. Significant advances have been made in the last few years towards development of methods and compositions to target and cleave genomic DNA by site specific nucleases (e.g., Zinc Finger Nucleases (ZFNs), Meganucleases, Transcription Activator-Like Effector Nucelases (TALENS) and Clustered Regularly Interspaced Short Palindromic Repeats/CRISPR-associated nuclease (CRISPR/Cas) with an engineered crRNA/tracr RNA), to induce targeted mutagenesis, induce targeted deletions of cellular DNA sequences, and facilitate targeted recombination of an exogenous donor DNA polynucleotide within a predetermined genomic locus. See, for example, U.S. Patent Publication No. 20030232410; 20050208489; 20050026157; 20050064474; and 20060188987, and International Patent Publication No. WO 2007/014275, the disclosures of which are incorporated by reference in their entireties for all purposes. U.S. Patent Publication No. 20080182332 describes use of non-canonical zinc finger nucleases (ZFNs) for targeted modification of plant genomes and U.S. Patent Publication No. 20090205083 describes ZFN-mediated targeted modification of a plant EPSPs genomic locus. Current methods for targeted insertion of exogenous DNA typically involve co-transformation of plant tissue with a donor DNA polynucleotide containing at least one transgene and a site specific nuclease (e.g., ZFN) which is designed to bind and cleave a specific genomic locus of an actively transcribed coding sequence. This causes the donor DNA polynucleotide to stably insert within the cleaved genomic locus resulting in targeted gene addition at a specified genomic locus comprising an actively transcribed coding sequence.

An alternative approach is to target the transgene to preselected target nongenic loci within the genome of dicot plants like soybean. In recent years, several technologies have been developed and applied to plant cells for the targeted delivery of a transgene within the genome of dicot plants like soybean. However, much less is known about the attributes of genomic sites that are suitable for targeting. Historically, non-essential genes and pathogen (viral) integration sites in genomes have been used as loci for targeting. The number of such sites in genomes is rather limiting and there is therefore a need for identification and characterization of targetable optimal genomic loci that can be used for targeting of donor polynucleotide sequences. In addition to being amenable to targeting, optimal genomic loci are expected to be neutral sites that can support transgene expression and breeding applications. A need exists for compositions and methods that define criteria to identify optimal nongenic loci within the genome of dicot plants, for example soybean plants, for targeted transgene integration.

SUMMARY

In an embodiment, the subject disclosure relates to a recombinant sequence, comprising: a nucleic acid sequence of at least 1 Kb and having at least 90%, 95%, or 99% sequence identity with a nongenic sequence selected from the group consisting of soy_OGL_1423 (SEQ ID NO:639), soy_OGL_1434 (SEQ ID NO:137), soy_OGL_4625 (SEQ ID NO:76), soy_OGL_6362 (SEQ ID NO:440), soy_OGL_308 (SEQ ID NO:43), soy_OGL_307 (SEQ ID NO:566), soy_OGL_310 (SEQ ID NO:4236), soy_OGL_684 (SEQ ID NO:47), soy_OGL_682 (SEQ ID NO:2101), and soy_OGL_685 (SEQ ID NO:48). In one embodiment, the insertion of the DNA of interest modifies the original sequence of the nongenic loci by alterations of the nongenic loci sequence proximal to the insertion site including for example deletions, inversions, insertions, and duplications of the nongenic loci sequence. In a further aspect, an embodiment relates to a DNA of interest, wherein the DNA of interest is inserted into said nongenic sequence. In another aspect, an embodiment comprises the recombinant sequence, wherein a DNA of interest is inserted proximal to a zinc finger target site. In another aspect, an embodiment comprises the recombinant sequence, wherein a DNA of interest is inserted at a zinc finger target site. In another embodiment, the recombinant sequence comprises an inserted DNA of interest that further comprises an analytical domain. In another embodiment, the recombinant sequence comprises an inserted DNA of interest that does not encode a peptide. In a further embodiment, the recombinant sequence comprises a DNA of interest that encodes a peptide. In yet another embodiment, the recombinant sequence comprises an inserted DNA of interest that further comprises a gene expression cassette. In an embodiment, the gene expressions cassette contains a gene comprising an insecticidal resistance gene, herbicide tolerance gene, nitrogen use efficiency gene, water use efficiency gene, nutritional quality gene, DNA binding gene, and selectable marker gene. In a further embodiment, the recombinant sequence comprises two or more gene expression cassettes. In another embodiment, the recombinant sequence comprises two or more of said nongenic sequences that are located on a same chromosome. In an additional embodiment, the recombinant sequence comprises the DNA of interest and/or the nongenic sequence are modified during insertion of said DNA of interest into the nongenic sequence. In another embodiment, the subject disclosure relates to a soybean plant, soybean plant part, or soybean plant cell comprising a recombinant sequence.

In a further embodiment, the disclosure relates to a method of making a transgenic plant cell comprising a DNA of interest. In another aspect of the disclosure, the method comprises selecting a target nongenic soybean genomic locus having at least 90%, 95%, or 99% sequence identity with a target nongenic soybean genomic locus selected from the group consisting of soy_OGL_1423 (SEQ ID NO:639), soy_OGL_1434 (SEQ ID NO:137), soy_OGL_4625 (SEQ ID NO:76), soy_OGL_6362 (SEQ ID NO:440), soy_OGL_308 (SEQ ID NO:43), soy_OGL_307 (SEQ ID NO:566), soy_OGL_310 (SEQ ID NO:4236), soy_OGL_684 (SEQ ID NO:47), soy_OGL_682 (SEQ ID NO:2101), and soy_OGL_685 (SEQ ID NO:48); selecting a site specific nuclease that specifically binds and cleaves said target nongenic soybean genomic locus; introducing said site specific nuclease into a soybean plant cell; introducing the DNA of interest into the plant cell; inserting the DNA of interest into said target nongenic soybean genomic loci; and, selecting transgenic plant cells comprising the DNA of interest targeted to said nongenic locus. In a further aspect, an embodiment relates to a method of making a transgenic plant cell. In another embodiment, the DNA of interest comprises an analytical domain. In an embodiment, the DNA of interest does not encode a peptide. In yet another embodiment, the DNA of interest encodes a peptide. In a further embodiment, the DNA of interest comprises a gene expression cassette comprising a transgene. In another embodiment, the DNA of interest comprises two or more gene expression cassettes. In a subsequent embodiment, the site specific nuclease is selected from the group consisting of a zinc finger nuclease, a CRISPR nuclease, a TALEN, a homing endonuclease or a meganuclease. In an embodiment, the said DNA of interest is integrated within said nongenic locus via a homology directed repair integration method. In another embodiment, the said DNA of interest is integrated within said nongenic locus via a non-homologous end joining integration method. In a further embodiment, the method of making a transgenic plant cell provides for two or more of said DNA of interest that are inserted into two or more of said target nongenic soybean genomic loci. In another embodiment, the method of making a transgenic plant cell comprises two or more of said target nongenic soybean genomic loci that are located on a same chromosome. In an additional embodiment, the method of making a transgenic plant cell comprises the DNA of interest and/or the nongenic sequence that are modified during insertion of said DNA of interest into the nongenic sequence.

In accordance with one embodiment, a purified soybean polynucleotide loci is disclosed herein, wherein the purified sequence comprises a nongenic sequence of at least 1 Kb. In one embodiment the nongenic sequence is hypomethylated, exemplifies evidence of recombination and is located in proximal location to an expressing genic region in the soybean genome. In one embodiment, the nongenic sequence has a length ranging from about 1 Kb to about 8.4 Kb. In one embodiment, the DNA of interest comprises exogenous DNA sequences, including for example regulatory sequences, restriction cleavage sites, RNA encoding regions or protein encoding regions. In one embodiment, the DNA of interest comprises a gene expression cassette comprising one or more transgenes. In another embodiment, the purified sequence comprises a nongenic sequence having at least 90%, 95%, or 99% sequence identity with a nongenic sequence selected from the group consisting of soy_OGL_1423 (SEQ ID NO:639), soy_OGL_1434 (SEQ ID NO:137), soy_OGL_4625 (SEQ ID NO:76), soy_OGL_6362 (SEQ ID NO:440), soy_OGL_308 (SEQ ID NO:43), soy_OGL_307 (SEQ ID NO:566), soy_OGL_310 (SEQ ID NO:4236), soy_OGL_684 (SEQ ID NO:47), soy_OGL_682 (SEQ ID NO:2101), and soy_OGL_685 (SEQ ID NO:48). In a further embodiment, the purified nongenic soybean genomic loci comprise a DNA of interest, wherein said DNA of interest is inserted into said nongenic sequence. In another aspect, an embodiment comprises the purified nongenic soybean genomic loci, wherein said DNA of interest is inserted proximal to a zinc finger target site. In a different aspect, an embodiment comprises the purified nongenic soybean genomic loci, wherein said DNA of interest is inserted between a pair of zinc finger target sites. In yet another aspect, an embodiment comprises the purified nongenic soybean genomic loci, wherein said DNA of interest comprises an analytical domain. In another aspect, an embodiment comprises the purified nongenic soybean genomic loci, wherein said DNA of interest does not encode a peptide. In a subsequent aspect, an embodiment comprises the purified nongenic soybean genomic loci, wherein said DNA of interest encodes a peptide. In an embodiment, the gene expression cassette contains a gene comprising an insecticidal resistance gene, herbicide tolerance gene, nitrogen use efficiency gene, water use efficiency gene, nutritional quality gene, DNA binding gene, and selectable marker gene. In a subsequent embodiment, the site specific nuclease is selected from the group consisting of a zinc finger nuclease, a CRISPR nuclease, a TALEN, a homing endonuclease or a meganuclease. In an embodiment, the said DNA of interest is integrated within said nongenic sequence via a homology directed repair integration method. In another embodiment, the said DNA of interest is integrated within said nongenic sequence via a non-homologous end joining integration method. In a further embodiment, the DNA of interest comprises two or more gene expression cassettes. In a further embodiment, purified nongenic soybean genomic loci provides for two or more of said DNA of interest that are inserted into two or more of said target nongenic soybean genomic loci. In another embodiment, the purified nongenic soybean genomic loci provides for two or more of said target nongenic soybean genomic loci that are located on a same chromosome. In an additional embodiment, the purified nongenic soybean genomic comprises the DNA of interest and/or the nongenic sequence that are modified during insertion of said DNA of interest into the nongenic sequence. In another embodiment, the DNA of interest is inserted via a homology directed repair or a non-homologous end joining repair mechanism.

In another embodiment, the subject disclosure provides for a plant comprising a recombinant sequence, said recombinant sequence comprising: a nucleic acid sequence having at least 90%, 95%, or 99% sequence identity with a nongenic sequence; and, a DNA of interest, wherein the DNA of interest is inserted into said nongenic sequence. In another embodiment, the nongenic sequence is selected from the group consisting of soy_OGL_1423 (SEQ ID NO:639), soy_OGL_1434 (SEQ ID NO:137), soy_OGL_4625 (SEQ ID NO:76), soy_OGL_6362 (SEQ ID NO:440), soy_OGL_308 (SEQ ID NO:43), soy_OGL_307 (SEQ ID NO:566), soy_OGL_310 (SEQ ID NO:4236), soy_OGL_684 (SEQ ID NO:47), soy_OGL_682 (SEQ ID NO:2101), and soy_OGL_685 (SEQ ID NO:48). In an additional embodiment, the plant comprises two or more of said recombinant sequences. In a further aspect, an embodiment comprises the plant, wherein said recombinant sequences are located on the same chromosome. In another aspect, an embodiment comprises the plant, wherein said DNA of interest is inserted proximal to a zinc finger target site. In a subsequent aspect, an embodiment comprises the plant, wherein said DNA of interest is inserted between a pair of zinc finger target sites. In an embodiment, said DNA of interest comprises an analytical domain. In a further embodiment, said DNA of interest does not encode a peptide. In yet another embodiment, said DNA of interest encodes a peptide. In a subsequent embodiment, said DNA of interest comprises a gene expression cassette comprising an insecticidal resistance gene, herbicide tolerance gene, nitrogen use efficiency gene, water use efficiency gene, nutritional quality gene, DNA binding gene, and selectable marker gene. In another aspect, an embodiment comprises the plant, wherein, said DNA of interest and/or said nongenic sequence are modified during insertion of said DNA of interest into said nongenic sequence.

In another embodiment, the purified sequence comprises a nongenic sequence having at least 90%, 95%, or 99% sequence identity with a nongenic sequence selected from the group consisting of soy_OGL_1423 (SEQ ID NO:639), soy_OGL_1434 (SEQ ID NO:137), soy_OGL_308 (SEQ ID NO:43), soy_OGL_307 (SEQ ID NO:566), soy_OGL_310 (SEQ ID NO:4236), soy_OGL_684 (SEQ ID NO:47), soy_OGL_682 (SEQ ID NO:2101), and soy_OGL_685 (SEQ ID NO:48).

In another embodiment, the purified sequence comprises a nongenic sequence having at least 90%, 95%, or 99% sequence identity with a nongenic sequence selected from the group consisting of soy_OGL_1423 (SEQ ID NO:639), and soy_OGL_1434 (SEQ ID NO:137).

In another embodiment, the purified sequence comprises a nongenic sequence having at least 90%, 95%, or 99% sequence identity with a nongenic sequence selected from the group consisting of soy_OGL_308 (SEQ ID NO:43), soy_OGL_307 (SEQ ID NO:566), and soy_OGL_310 (SEQ ID NO:4236).

In another embodiment, the purified sequence comprises a nongenic sequence having at least 90%, 95%, or 99% sequence identity with a nongenic sequence selected from the group consisting of soy_OGL_684 (SEQ ID NO:47), soy_OGL_682 (SEQ ID NO:2101), and soy_OGL_685 (SEQ ID NO:48).

In another embodiment, the purified sequence comprises a nongenic sequence having at least 90%, 95%, or 99% sequence identity with a nongenic sequence selected from the group consisting of soy_OGL_1423 (SEQ ID NO:639), soy_OGL_1434 (SEQ ID NO:137), soy_OGL_308 (SEQ ID NO:43), soy_OGL_307 (SEQ ID NO:566), and soy_OGL_310 (SEQ ID NO:4236).

In another embodiment, the purified sequence comprises a nongenic sequence having at least 90%, 95%, or 99% sequence identity with a nongenic sequence selected from the group consisting of soy_OGL_308 (SEQ ID NO:43), soy_OGL_307 (SEQ ID NO:566), soy_OGL_310 (SEQ ID NO:4236), soy_OGL_684 (SEQ ID NO:47), soy_OGL_682 (SEQ ID NO:2101), and soy_OGL_685 (SEQ ID NO:48).

In another embodiment, the purified sequence comprises a nongenic sequence having at least 90%, 95%, or 99% sequence identity with a nongenic sequence selected from the group consisting of soy_OGL_4625 (SEQ ID NO:76), soy_OGL_6362 (SEQ ID NO:440), and soy_OGL_308 (SEQ ID NO:43).

BRIEF DESCRIPTION OF THE DRAWINGS

FIG. 15A illustrates a distribution of the polynucleotide sequence lengths of the optimal genomic loci (OGL). FIG. 15B illustrates the distribution of the optimal nongenic maize loci relative to their recombination frequency. FIG. 15C illustrates the distribution of expressed nucleic acid sequences relative to their proximity (log scale) to the optimal genomic loci (OGL).

DETAILED DESCRIPTION

Definitions

Figure 1:
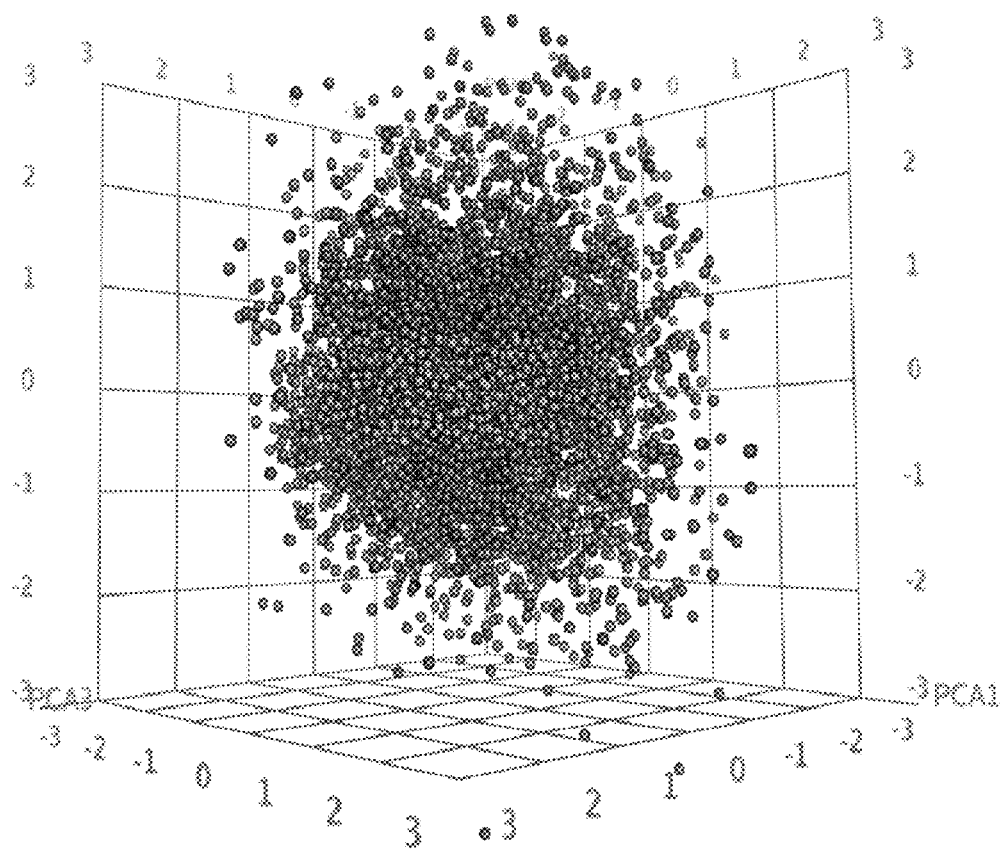
FIG. 1. Represents a three dimensional graph of the 7,018 select genomic loci clustered into 32 clusters. The clusters can be graphed three dimensionally and distinguished by color or other indicators. Each cluster was assigned a unique identifier for ease of visualization, wherein all select genomic loci with the same identifier belonging to the same cluster. After the clustering process, a representative select genomic loci was chosen from each cluster. This was performed by choosing a select genomic loci, within each cluster, that was closest to the centroid of that cluster.

In describing and claiming the invention, the following terminology will be used in accordance with the definitions set forth below.

The term "about" as used herein means greater or lesser than the value or range of values stated by 10 percent, but is not intended to designate any value or range of values to only this broader definition. Each value or range of values preceded by the term "about" is also intended to encompass the embodiment of the stated absolute value or range of values.

As used herein, the term "plant" includes a whole plant and any descendant, cell, tissue, or part of a plant. The term "plant parts" include any part(s) of a plant, including, for example and without limitation: seed (including mature seed and immature seed); a plant cutting; a plant cell; a plant cell culture; a plant organ (e.g., pollen, embryos, flowers, fruits, shoots, leaves, roots, stems, and explants). A plant tissue or plant organ may be a seed, callus, or any other group of plant cells that is organized into a structural or functional unit. A plant cell or tissue culture may be capable of regenerating a plant having the physiological and morphological characteristics of the plant from which the cell or tissue was obtained, and of regenerating a plant having substantially the same genotype as the plant. In contrast, some plant cells are not capable of being regenerated to produce plants. Regenerable cells in a plant cell or tissue culture may be embryos, protoplasts, meristematic cells, callus, pollen, leaves, anthers, roots, root tips, silk, flowers, kernels, ears, cobs, husks, or stalks.

Plant parts include harvestable parts and parts useful for propagation of progeny plants. Plant parts useful for propagation include, for example and without limitation: seed; fruit; a cutting; a seedling; a tuber; and a rootstock. A harvestable part of a plant may be any useful part of a plant, including, for example and without limitation: flower; pollen; seedling; tuber; leaf; stem; fruit; seed; and root.

A plant cell is the structural and physiological unit of the plant. Plant cells, as used herein, includes protoplasts and protoplasts with a cell wall. A plant cell may be in the form of an isolated single cell, or an aggregate of cells (e.g., a friable callus and a cultured cell), and may be part of a higher organized unit (e.g., a plant tissue, plant organ, and plant). Thus, a plant cell may be a protoplast, a gamete producing cell, or a cell or collection of cells that can regenerate into a whole plant. As such, a seed, which comprises multiple plant cells and is capable of regenerating into a whole plant, is considered a "plant part" in embodiments herein.

The term "protoplast", as used herein, refers to a plant cell that had its cell wall completely or partially removed, with the lipid bilayer membrane thereof naked. Typically, a protoplast is an isolated plant cell without cell walls which has the potency for regeneration into cell culture or a whole plant.

As used herein the terms "native" or "natural" define a condition found in nature. A "native DNA sequence" is a DNA sequence present in nature that was produced by natural means or traditional breeding techniques but not generated by genetic engineering (e.g., using molecular biology/transformation techniques).

As used herein, "endogenous sequence" defines the native form of a polynucleotide, gene or polypeptide in its natural location in the organism or in the genome of an organism.

The term "isolated" as used herein means having been removed from its natural environment.

The term "purified", as used herein relates to the isolation of a molecule or compound in a form that is substantially free of contaminants normally associated with the molecule or compound in a native or natural environment and means having been increased in purity as a result of being separated from other components of the original composition. The term "purified nucleic acid" is used herein to describe a nucleic acid sequence which has been separated from other compounds including, but not limited to polypeptides, lipids and carbohydrates.

The terms "polypeptide", "peptide" and "protein" are used interchangeably to refer to a polymer of amino acid residues. The term also applies to amino acid polymers in which one or more amino acids are chemical analogues or modified derivatives of a corresponding naturally-occurring amino acids.

As used herein an "optimal dicot genomic loci", "optimal nongenic dicot loci", "optimal nongenic loci", or "optimal genomic loci (OGL)" is a native DNA sequence found in the nuclear genome of a dicot plant that has the following properties: nongenic, hypomethylated, targetable, and in proximal location to a genic region, wherein the genomic region around the optimal dicot genomic loci exemplifies evidence of recombination.

As used herein an "optimal soybean genomic loci", "optimal nongenic soybean loci", "optimal nongenic loci", or "optimal genomic loci (OGL)" is a native DNA sequence found in the nuclear genome of a dicot plant that has the following properties: nongenic, hypomethylated, targetable, and in proximal location to a genic region, wherein the genomic region around the optimal dicot genomic loci exemplifies evidence of recombination.

As used herein, a "nongenic dicot sequence" or "nongenic dicot genomic sequence" is a native DNA sequence found in the nuclear genome of a dicot plant, having a length of at least 1 Kb, and devoid of any open reading frames, gene sequences, or gene regulatory sequences. Furthermore, the nongenic dicot sequence does not comprise any intron sequence (i.e., introns are excluded from the definition of nongenic). The nongenic sequence cannot be transcribed or translated into protein. Many plant genomes contain nongenic regions. As much as 95% of the genome can be nongenic, and these regions may be comprised of mainly repetitive DNA.

As used herein, a "nongenic soybean sequence" or "nongenic soybean genomic sequence" is a native DNA sequence found in the nuclear genome of a soybean plant, having a length of at least 1 Kb, and devoid of any open reading frames, gene sequences, or gene regulatory sequences. Furthermore, the nongenic soybean sequence does not comprise any intron sequence (i.e., introns are excluded from the definition of nongenic). The nongenic sequence cannot be transcribed or translated into protein. Many plant genomes contain nongenic regions. As much as 95% of the genome can be nongenic, and these regions may be comprised of mainly repetitive DNA.

As used herein, a "genic region" is defined as a polynucleotide sequence that comprises an open reading frame encoding an RNA and/or polypeptide. The genic region may also encompass any identifiable adjacent 5' and 3' non-coding nucleotide sequences involved in the regulation of expression of the open reading frame up to about 2 Kb upstream of the coding region and 1 Kb downstream of the coding region, but possibly further upstream or downstream. A genic region further includes any introns that may be present in the genic region. Further, the genic region may comprise a single gene sequence, or multiple gene sequences interspersed with short spans (less than 1 Kb) of nongenic sequences.

As used herein a "nucleic acid of interest", "DNA of interest", or "donor" is defined as a nucleic acid/DNA sequence that has been selected for site directed, targeted insertion into the dicot genome, like a soybean genome. A nucleic acid of interest can be of any length, for example between 2 and 50,000 nucleotides in length (or any integer value therebetween or thereabove), preferably between about 1,000 and 5,000 nucleotides in length (or any integer value therebetween). A nucleic acid of interest may comprise one or more gene expression cassettes that further comprise actively transcribed and/or translated gene sequences. Conversely, the nucleic acid of interest may comprise a polynucleotide sequence which does not comprise a functional gene expression cassette or an entire gene (e.g., may simply comprise regulatory sequences such as a promoter), or may not contain any identifiable gene expression elements or any actively transcribed gene sequence. The nucleic acid of interest may optionally contain an analytical domain. Upon insertion of the nucleic acid of interest into the dicot genome of soybean for example, the inserted sequences are referred to as the "inserted DNA of interest". Further, the nucleic acid of interest can be DNA or RNA, can be linear or circular, and can be single-stranded or double-stranded. It can be delivered to the cell as naked nucleic acid, as a complex with one or more delivery agents (e.g., liposomes, poloxamers, T-strand encapsulated with proteins, etc.,) or contained in a bacterial or viral delivery vehicle, such as, for example, *Agrobacterium tumefaciens* or an adenovirus or an adeno-associated Virus (AAV), respectively.

As used herein the term "analytical domain" defines a nucleic acid sequence that contains functional elements that assist in the targeted insertion of nucleic acid sequences. For example, an analytical domain may contain specifically designed restriction enzyme sites, zinc finger binding sites, engineered landing pads or engineered transgene integration platforms and may or may not comprise gene regulatory elements or an open reading frame. See, for example, U.S. Patent Publication No 20110191899, incorporated herein by reference in its entirety.

As used herein the term "selected dicot sequence" defines a native genomic DNA sequence of a dicot plant that has been chosen for analysis to determine if the sequence qualifies as an optimal nongenic dicot genomic loci.

As used herein the term "selected soybean sequence" defines a native genomic DNA sequence of a soybean plant that has been chosen for analysis to determine if the sequence qualifies as an optimal nongenic soybean genomic loci.

As used herein, the term "hypomethylation" or "hypomethylated", in reference to a DNA sequence, defines a reduced state of methylated DNA nucleotide residues in a given sequence of DNA. Typically, the decreased methylation relates to the number of methylated adenine or cytosine residues, relative to the average level of methylation found in nongenic sequences present in the genome of a dicot plant like a soybean plant.

As used herein a "targetable sequence" is a polynucleotide sequence that is sufficiently unique in a nuclear genome to allow site specific, targeted insertion of a nucleic acid of interest into one specific sequence.

As used herein the term "non-repeating" sequence is defined as a sequence of at least 1 Kb in length that shares less than 40% identity to any other sequence within the genome of a dicot plant, like soybean. Calculations of sequence identity can be determined using any standard technique known to those skilled in the art including, for example, scanning a selected genomic sequence against the dicot genome, e.g., soybean c.v. Williams 82 genome, using a BLAST™ based homology search using the NCBI BLAST™+ software (version 2.2.25) run using the default parameter settings (Stephen F. Altschul et al (1997), "Gapped BLAST and PSI-BLAST: a new generation of protein database search programs", Nucleic Acids Res. 25:3389-3402). For example, as the selected soybean sequences (from the *Glycine max* c.v. Williams82 genome) were analyzed, the first BLAST™ hit identified from such a search represents the dicot sequence, e.g., soybean c.v. Williams82 sequence, itself. The second BLAST™ hit for each selected soybean sequence was identified and the alignment coverage (represented as the percent of the selected soybean sequence covered by the BLAST™ hit) of the hit was used as a measure of uniqueness of the selected soybean sequence within the genome of a dicot plant, such as soybean. These alignment coverage values for the second BLAST™ hit ranged from a minimum of 0% to a maximum of 39.97% sequence identity. Any sequences that aligned at higher levels of sequence identity were not considered.

The term "in proximal location to a genic region" when used in reference to a nongenic sequence defines the relative location of the nongenic sequence to a genic region. Specifically, the number of genic regions within a 40 Kb neighborhood (i.e., within 40 Kb on either end of the selected optimal soybean genomic loci sequence) is analyzed. This analysis was completed by assaying gene annotation information and the locations of known genes in the genome of a known dicot, such as soybean, that were extracted from a moncot genome database, for example the Soybean Genome Database. For each of the optimal nongenic soybean genomic loci, e.g., 7,018 optimal nongenic soybean genomic loci, a 40 Kb window around the optimal genomic loci sequence was defined and the number of annotated genes with locations overlapping this window was counted. The number of genic regions ranged from a minimum of 1 gene to a maximum of 18 genes within the 40 Kb neighborhood.

The term "known soybean coding sequence" as used herein relates to any polynucleotide sequence identified from any dicot genomic database, including the Soybean Genomic Database (www.soybase.org, Shoemaker, R. C. et al. SoyBase, the USDA-ARS soybean genetics and genomics database. *Nucleic Acids Res.* 2010 January; 38(Database issue):D843-6.) that comprise an open reading frame, either before or after processing of intron sequences, and are transcribed into mRNA and optionally translated into a protein sequence when placed under the control of the appropriate genetic regulatory elements. The known soybean coding sequence can be a cDNA sequence or a genomic sequence. In some instances, the known soybean coding sequence can be annotated as a functional protein. In other instances, the known soybean coding sequence may not be annotated.

The term "predicted dicot coding sequence" as used herein relates to any Expressed Sequence Tag (EST) polynucleotide sequences described in a dicot genomic database, for example the Soybean Genomic Database. ESTs are identified from cDNA libraries constructed using oligo(dT) primers to direct first-strand synthesis by reverse transcriptase. The resulting ESTs are single-pass sequencing reads of less than 500 bp obtained from either the 5' or 3' end of the cDNA insert. Multiple ESTs may be aligned into a single contig. The identified EST sequences are uploaded into the dicot genomic database, e.g., Soybean Genomic Database and can be searched via bioinformatics methods to predict corresponding genomic polynucleotide sequences that comprise a coding sequence that is transcribed into mRNA and optionally translated into a protein sequence when placed under the control of the appropriate genetic regulatory elements.

The term "predicted soybean coding sequence" as used herein relates to any Expressed Sequence Tag (EST) polynucleotide sequences described in a soybean genomic database, for example the Soybean Genomic Database. ESTs are identified from cDNA libraries constructed using oligo(dT) primers to direct first-strand synthesis by reverse transcriptase. The resulting ESTs are single-pass sequencing reads of less than 500 bp obtained from either the 5' or 3' end of the cDNA insert. Multiple ESTs may be aligned into a single contig. The identified EST sequences are uploaded into the soybean genomic database, e.g., Soybean Genomic Database and can be searched via bioinformatics methods to predict corresponding genomic polynucleotide sequences that comprise a coding sequence that is transcribed into mRNA and optionally translated into a protein sequence when placed under the control of the appropriate genetic regulatory elements.

The term "evidence of recombination" as used herein relates to the meiotic recombination frequencies between any pair of dicot genomic markers, e.g., soybean genomic markers, across a chromosome region comprising the selected soybean sequence. The recombination frequencies were calculated based on the ratio of the genetic distance between markers (in centimorgan (cM)) to the physical distance between the markers (in megabases (Mb)). For a selected soybean sequence to have evidence of recombination, the selected soybean sequence must contain at least one recombination event between two markers flanking the selected soybean sequence as detected using a high resolution marker dataset generated from multiple mapping populations.

As used herein the term "relative location value" is a calculated value defining the distance of a genomic locus from its corresponding chromosomal centromere. For each selected soybean sequence, the genomic distance from the native location of the selected soybean sequence to the centromere of the chromosome that it is located on, is measured (in Bp). The relative location of selected soybean sequence within the chromosome is represented as the ratio of its genomic distance to the centromere relative to the length of the specific chromosomal arm (measured in Bp) that it lies on. These relative location values for the optimal nongenic soybean genomic loci can be generated for different dicot plants, the relative location values for the soybean dataset ranged from a minimum of 0 to a maximum of 0.99682 ratio of genomic distance.

The term "exogenous DNA sequence" as used herein is any nucleic acid sequence that has been removed from its native location and inserted into a new location altering the sequences that flank the nucleic acid sequence that has been moved. For example, an exogenous DNA sequence may comprise a sequence from another species.

"Binding" refers to a sequence-specific, interaction between macromolecules (e.g., between a protein and a nucleic acid). Not all components of a binding interaction need be sequence-specific (e.g., contacts with phosphate residues in a DNA backbone), as long as the interaction as a whole is sequence-specific. Such interactions are generally characterized by a dissociation constant (Kd). "Affinity" refers to the strength of binding: increased binding affinity being correlated with a lower binding constant (Kd).

A "binding protein" is a protein that is able to bind to another molecule. A binding protein can bind to, for example, a DNA molecule (a DNA-binding protein), an RNA molecule (an RNA-binding protein) and/or a protein molecule (a protein-binding protein). In the case of a protein-binding protein, it can bind to itself (to form homodimers, homotrimers, etc.) and/or it can bind to one or more molecules of a different protein or proteins. A binding protein can have more than one type of binding activity. For example, zinc finger proteins have DNA-binding, RNA-binding and protein-binding activity.

As used herein the term "zinc fingers," defines regions of amino acid sequence within a DNA binding protein binding domain whose structure is stabilized through coordination of a zinc ion.

A "zinc finger DNA binding protein" (or binding domain) is a protein, or a domain within a larger protein, that binds DNA in a sequence-specific manner through one or more zinc fingers, which are regions of amino acid sequence within the binding domain whose structure is stabilized through coordination of a zinc ion. The term zinc finger DNA binding protein is often abbreviated as zinc finger protein or ZFP. Zinc finger binding domains can be "engineered" to bind to a predetermined nucleotide sequence. Non-limiting examples of methods for engineering zinc finger proteins are design and selection. A designed zinc finger protein is a protein not occurring in nature whose design/composition results principally from rational criteria. Rational criteria for design include application of substitution rules and computerized algorithms for processing information in a database storing information of existing ZFP designs and binding data. See, for example, U.S. Pat. Nos. 6,140,081; 6,453,242; 6,534,261 and 6,794,136; see also WO 98/53058; WO 98/53059; WO 98/53060; WO 02/016536 and WO 03/016496.

A "TALE DNA binding domain" or "TALE" is a polypeptide comprising one or more TALE repeat domains/units. The repeat domains are involved in binding of the TALE to its cognate target DNA sequence. A single "repeat unit" (also referred to as a "repeat") is typically 33-35 amino acids in length and exhibits at least some sequence homology with other TALE repeat sequences within a naturally occurring TALE protein. See, e.g., U.S. Patent Publication No. 20110301073, incorporated by reference herein in its entirety.

The CRISPR (Clustered Regularly Interspaced Short Palindromic Repeats)/Cas (CRISPR Associated) nuclease system. Briefly, a "CRISPR DNA binding domain" is a short stranded RNA molecule that acting in concert with the CAS enzyme can selectively recognize, bind, and cleave genomic DNA. The CRISPR/Cas system can be engineered to create a double-stranded break (DSB) at a desired target in a genome, and repair of the DSB can be influenced by the use of repair inhibitors to cause an increase in error prone repair. See, e.g., Jinek et al (2012) Science 337, p. 816-821, Jinek et al, (2013), eLife 2:e00471, and David Segal, (2013) eLife 2:e00563).

Zinc finger, CRISPR and TALE binding domains can be "engineered" to bind to a predetermined nucleotide sequence, for example via engineering (altering one or more amino acids) of the recognition helix region of a naturally occurring zinc finger. Similarly, TALEs can be "engineered"

to bind to a predetermined nucleotide sequence, for example by engineering of the amino acids involved in DNA binding (the repeat variable diresidue or RVD region). Therefore, engineered DNA binding proteins (zinc fingers or TALEs) are proteins that are non-naturally occurring. Non-limiting examples of methods for engineering DNA-binding proteins are design and selection. A designed DNA binding protein is a protein not occurring in nature whose design/composition results principally from rational criteria. Rational criteria for design include application of substitution rules and computerized algorithms for processing information in a database storing information of existing ZFP and/or TALE designs and binding data. See, for example, U.S. Pat. Nos. 6,140, 081; 6,453,242; and 6,534,261; see also WO 98/53058; WO 98/53059; WO 98/53060; WO 02/016536 and WO 03/016496 and U.S. Publication Nos. 20110301073, 20110239315 and 20119145940.

A "selected" zinc finger protein, CRISPR or TALE is a protein not found in nature whose production results primarily from an empirical process such as phage display, interaction trap or hybrid selection. See e.g., U.S. Pat. No. 5,789,538; U.S. Pat. No. 5,925,523; U.S. Pat. No. 6,007,988; U.S. Pat. No. 6,013,453; U.S. Pat. No. 6,200,759; WO 95/19431; WO 96/06166; WO 98/53057; WO 98/54311; WO 00/27878; WO 01/60970 WO 01/88197 and WO 02/099084 and U.S. Publication Nos. 20110301073, 20110239315 and 20119145940.

"Recombination" refers to a process of exchange of genetic information between two polynucleotides, including but not limited to, donor capture by non-homologous end joining (NHEJ) and homologous recombination. For the purposes of this disclosure, "homologous recombination (HR)" refers to the specialized form of such exchange that takes place, for example, during repair of double-strand breaks in cells via homology-directed repair mechanisms. This process requires nucleotide sequence homology, uses a "donor" molecule to template repair of a "target" molecule (i.e., the nucleotide sequence that experienced the double-strand break), and is variously known as "non-crossover gene conversion" or "short tract gene conversion," because it leads to the transfer of genetic information from the donor to the target. Without wishing to be bound by any particular theory, such transfer can involve mismatch correction of heteroduplex DNA that forms between the broken target and the donor, and/or "synthesis-dependent strand annealing," in which the donor is used to resynthesize genetic information that will become part of the target, and/or related processes. Such specialized HR often results in an alteration of the sequence of the target molecule such that part or all of the sequence of the donor polynucleotide is incorporated into the target polynucleotide. For HR-directed integration, the donor molecule contains at least 2 regions of homology to the genome ("homology arms") of least 50-100 base pairs in length. See, e.g., U.S. Patent Publication No. 20110281361.

In the methods of the disclosure, one or more targeted nucleases as described herein create a double-stranded break in the target sequence (e.g., cellular chromatin) at a predetermined site, and a "donor" polynucleotide, having homology to the nucleotide sequence in the region of the break for HR mediated integration or having no homology to the nucleotide sequence in the region of the break for NHEJ mediated integration, can be introduced into the cell. The presence of the double-stranded break has been shown to facilitate integration of the donor sequence. The donor sequence may be physically integrated or, alternatively, the donor polynucleotide is used as a template for repair of the break via homologous recombination, resulting in the introduction of all or part of the nucleotide sequence as in the donor into the cellular chromatin. Thus, a first sequence in cellular chromatin can be altered and, in certain embodiments, can be converted into a sequence present in a donor polynucleotide. Thus, the use of the terms "replace" or "replacement" can be understood to represent replacement of one nucleotide sequence by another, (i.e., replacement of a sequence in the informational sense), and does not necessarily require physical or chemical replacement of one polynucleotide by another.

In any of the methods described herein, additional pairs of zinc-finger proteins, CRISPRS or TALEN can be used for additional double-stranded cleavage of additional target sites within the cell.

Any of the methods described herein can be used for insertion of a donor of any size and/or partial or complete inactivation of one or more target sequences in a cell by targeted integration of donor sequence that disrupts expression of the gene(s) of interest. Cell lines with partially or completely inactivated genes are also provided.

Furthermore, the methods of targeted integration as described herein can also be used to integrate one or more exogenous sequences. The exogenous nucleic acid sequence can comprise, for example, one or more genes or cDNA molecules, or any type of coding or noncoding sequence, as well as one or more control elements (e.g., promoters). In addition, the exogenous nucleic acid sequence (transgene) may produce one or more RNA molecules (e.g., small hairpin RNAs (shRNAs), inhibitory RNAs (RNAis), micro-RNAs (miRNAs), etc.) or protein.

"Cleavage" as used herein defines the breakage of the phosphate-sugar backbone of a DNA molecule. Cleavage can be initiated by a variety of methods including, but not limited to, enzymatic or chemical hydrolysis of a phosphodiester bond. Both single-stranded cleavage and double-stranded cleavage are possible, and double-stranded cleavage can occur as a result of two distinct single-stranded cleavage events. DNA cleavage can result in the production of either blunt ends or staggered ends. In certain embodiments, fusion polypeptides are used for targeted double-stranded DNA cleavage. A "cleavage domain" comprises one or more polypeptide sequences which possesses catalytic activity for DNA cleavage. A cleavage domain can be contained in a single polypeptide chain or cleavage activity can result from the association of two (or more) polypeptides.

A "cleavage half-domain" is a polypeptide sequence which, in conjunction with a second polypeptide (either identical or different) forms a complex having cleavage activity (preferably double-strand cleavage activity). The terms "first and second cleavage half-domains;" "+ and − cleavage half-domains" and "right and left cleavage half-domains" are used interchangeably to refer to pairs of cleavage half-domains that dimerize.

An "engineered cleavage half-domain" is a cleavage half-domain that has been modified so as to form obligate heterodimers with another cleavage half-domain (e.g., another engineered cleavage half-domain). See, also, U.S. Patent Publication Nos. 2005/0064474, 20070218528, 2008/0131962 and 2011/0201055, incorporated herein by reference in their entireties.

A "target site" or "target sequence" refers to a portion of a nucleic acid to which a binding molecule will bind, provided sufficient conditions for binding exist.

Nucleic acids include DNA and RNA, can be single- or double-stranded; can be linear, branched or circular; and can be of any length. Nucleic acids include those capable of forming duplexes, as well as triplex-forming nucleic acids. See, for example, U.S. Pat. Nos. 5,176,996 and 5,422,251. Proteins include, but are not limited to, DNA-binding proteins, transcription factors, chromatin remodeling factors, methylated DNA binding proteins, polymerases, methylases, demethylases, acetylases, deacetylases, kinases, phosphatases, integrases, recombinases, ligases, topoisomerases, gyrases and helicases.

A "product of an exogenous nucleic acid" includes both polynucleotide and polypeptide products, for example, transcription products (polynucleotides such as RNA) and translation products (polypeptides).

A "fusion" molecule is a molecule in which two or more subunit molecules are linked, for example, covalently. The subunit molecules can be the same chemical type of molecule, or can be different chemical types of molecules. Examples of the first type of fusion molecule include, but are not limited to, fusion proteins (for example, a fusion between a ZFP DNA-binding domain and a cleavage domain) and fusion nucleic acids (for example, a nucleic acid encoding the fusion protein described supra). Examples of the second type of fusion molecule include, but are not limited to, a fusion between a triplex-forming nucleic acid and a polypeptide, and a fusion between a minor groove binder and a nucleic acid. Expression of a fusion protein in a cell can result from delivery of the fusion protein to the cell or by delivery of a polynucleotide encoding the fusion protein to a cell, wherein the polynucleotide is transcribed, and the transcript is translated, to generate the fusion protein. Trans-splicing, polypeptide cleavage and polypeptide ligation can also be involved in expression of a protein in a cell. Methods for polynucleotide and polypeptide delivery to cells are presented elsewhere in this disclosure.

For the purposes of the present disclosure, a "gene", includes a DNA region encoding a gene product (see infra), as well as all DNA regions which regulate the production of the gene product, whether or not such regulatory sequences are adjacent or operably linked to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions.

"Gene expression" refers to the conversion of the information, contained in a gene, into a gene product. A gene product can be the direct transcriptional product of a gene (e.g., mRNA, tRNA, rRNA, antisense RNA, interfering RNA, ribozyme, structural RNA or any other type of RNA) or a protein produced by translation of a mRNA. Gene products also include RNAs which are modified, by processes such as capping, polyadenylation, methylation, and editing, and proteins modified by, for example, methylation, acetylation, phosphorylation, ubiquitination, ADP-ribosylation, myristilation, and glycosylation.

Sequence identity: The term "sequence identity" or "identity," as used herein in the context of two nucleic acid or polypeptide sequences, refers to the residues in the two sequences that are the same when aligned for maximum correspondence over a specified comparison window.

As used herein, the term "percentage of sequence identity" refers to the value determined by comparing two optimally aligned sequences (e.g., nucleic acid sequences, and amino acid sequences) over a comparison window, wherein the portion of the sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleotide or amino acid residue occurs in both sequences to yield the number of matched positions, dividing the number of matched positions by the total number of positions in the comparison window, and multiplying the result by 100 to yield the percentage of sequence identity.

Methods for aligning sequences for comparison are well-known in the art. Various programs and alignment algorithms are described in, for example: Smith and Waterman (1981) Adv. Appl. Math. 2:482; Needleman and Wunsch (1970) J. Mol. Biol. 48:443; Pearson and Lipman (1988) Proc. Natl. Acad. Sci. U.S.A. 85:2444; Higgins and Sharp (1988) Gene 73:237-44; Higgins and Sharp (1989) CABIOS 5:151-3; Corpet et al. (1988) Nucleic Acids Res. 16:10881-90; Huang et al. (1992) Comp. Appl. Biosci. 8:155-65; Pearson et al. (1994) Methods Mol. Biol. 24:307-31; Tatiana et al. (1999) FEMS Microbiol. Lett. 174:247-50. A detailed consideration of sequence alignment methods and homology calculations can be found in, e.g., Altschul et al. (1990) J. Mol. Biol. 215:403-10. The National Center for Biotechnology Information (NCBI) Basic Local Alignment Search Tool (BLAST™; Altschul et al. (1990)) is available from several sources, including the National Center for Biotechnology Information (Bethesda, Md.), and on the internet, for use in connection with several sequence analysis programs. A description of how to determine sequence identity using this program is available on the internet under the "help" section for BLAST™. For comparisons of nucleic acid sequences, the "Blast 2 sequences" function of the BLAST™ (Blastn) program may be employed using the default parameters. Nucleic acid sequences with even greater similarity to the reference sequences will show increasing percentage identity when assessed by this method.

Specifically hybridizable/Specifically complementary: As used herein, the terms "specifically hybridizable" and "specifically complementary" are terms that indicate a sufficient degree of complementarity, such that stable and specific binding occurs between the nucleic acid molecule and a target nucleic acid molecule. Hybridization between two nucleic acid molecules involves the formation of an anti-parallel alignment between the nucleic acid sequences of the two nucleic acid molecules. The two molecules are then able to form hydrogen bonds with corresponding bases on the opposite strand to form a duplex molecule that, if it is sufficiently stable, is detectable using methods well known in the art. A nucleic acid molecule need not be 100% complementary to its target sequence to be specifically hybridizable. However, the amount of sequence complementarity that must exist for hybridization to be specific is a function of the hybridization conditions used.

Hybridization conditions resulting in particular degrees of stringency will vary depending upon the nature of the hybridization method of choice and the composition and length of the hybridizing nucleic acid sequences. Generally, the temperature of hybridization and the ionic strength (especially the Na+ and/or Mg++ concentration) of the hybridization buffer will determine the stringency of hybridization, though wash times also influence stringency. Calculations regarding hybridization conditions required for attaining particular degrees of stringency are known to those of ordinary skill in the art, and are discussed, for example, in Sambrook et al. (ed.) Molecular Cloning: A Laboratory Manual, 2nd ed., vol. 1-3, Cold Spring Harbor Laboratory Press, Cold Spring Harbor, N.Y., 1989, chapters 9 and 11; and Hames and Higgins (eds.) Nucleic Acid Hybridization, IRL Press, Oxford, 1985. Further detailed instruction and guidance with regard to the hybridization of nucleic acids may be found, for example, in Tijssen, "Overview of principles of hybridization and the strategy of nucleic acid probe assays," in Laboratory Techniques in Biochemistry and Molecular Biology-Hybridization with Nucleic Acid Probes, Part I, Chapter 2, Elsevier, N.Y., 1993; and Ausubel et al., Eds., Current Protocols in Molecular Biology, Chapter 2, Greene Publishing and Wiley-Interscience, N.Y., 1995.

As used herein, "stringent conditions" encompass conditions under which hybridization will only occur if there is less than 20% mismatch between the hybridization molecule and a sequence within the target nucleic acid molecule. "Stringent conditions" include further particular levels of stringency. Thus, as used herein, "moderate stringency" conditions are those under which molecules with more than 20% sequence mismatch will not hybridize; conditions of "high stringency" are those under which sequences with more than 10% mismatch will not hybridize; and conditions of "very high stringency" are those under which sequences with more than 5% mismatch will not hybridize. The following are representative, non-limiting hybridization conditions.

High Stringency condition (detects sequences that share at least 90% sequence identity): Hybridization in 5×SSC buffer (wherein the SSC buffer contains a detergent such as SDS, and additional reagents like salmon sperm DNA, EDTA, etc.) at 65° C. for 16 hours; wash twice in 2×SSC buffer (wherein the SSC buffer contains a detergent such as SDS, and additional reagents like salmon sperm DNA, EDTA, etc.) at room temperature for 15 minutes each; and wash twice in 0.5×SSC buffer (wherein the SSC buffer contains a detergent such as SDS, and additional reagents like salmon sperm DNA, EDTA, etc.) at 65° C. for 20 minutes each.

Moderate Stringency condition (detects sequences that share at least 80% sequence identity): Hybridization in 5×-6×SSC buffer (wherein the SSC buffer contains a detergent such as SDS, and additional reagents like salmon sperm DNA, EDTA, etc.) at 65-70° C. for 16-20 hours; wash twice in 2×SSC buffer (wherein the SSC buffer contains a detergent such as SDS, and additional reagents like salmon sperm DNA, EDTA, etc.) at room temperature for 5-20 minutes each; and wash twice in 1×SSC buffer (wherein the SSC buffer contains a detergent such as SDS, and additional reagents like salmon sperm DNA, EDTA, etc.) at 55-70° C. for 30 minutes each.

Non-stringent control condition (sequences that share at least 50% sequence identity will hybridize): Hybridization in 6×SSC buffer (wherein the SSC buffer contains a detergent such as SDS, and additional reagents like salmon sperm DNA, EDTA, etc.) at room temperature to 55° C. for 16-20 hours; wash at least twice in 2×-3×SSC buffer (wherein the SSC buffer contains a detergent such as SDS, and additional reagents like salmon sperm DNA, EDTA, etc.) at room temperature to 55° C. for 20-30 minutes each.

As used herein, the term "substantially homologous" or "substantial homology," with regard to a contiguous nucleic acid sequence, refers to contiguous nucleotide sequences that hybridize under stringent conditions to the reference nucleic acid sequence. For example, nucleic acid sequences that are substantially homologous to a reference nucleic acid sequence are those nucleic acid sequences that hybridize under stringent conditions (e.g., the Moderate Stringency conditions set forth, supra) to the reference nucleic acid sequence. Substantially homologous sequences may have at least 80% sequence identity. For example, substantially homologous sequences may have from about 80% to 100% sequence identity, such as about 81%; about 82%; about 83%; about 84%; about 85%; about 86%; about 87%; about 88%; about 89%; about 90%; about 91%; about 92%; about 93%; about 94% about 95%; about 96%; about 97%; about 98%; about 98.5%; about 99%; about 99.5%; and about 100%. The property of substantial homology is closely related to specific hybridization. For example, a nucleic acid molecule is specifically hybridizable when there is a sufficient degree of complementarity to avoid non-specific binding of the nucleic acid to non-target sequences under conditions where specific binding is desired, for example, under stringent hybridization conditions.

In some instances "homologous" may be used to refer to the relationship of a first gene to a second gene by descent from a common ancestral DNA sequence. In such instances, the term, homolog, indicates a relationship between genes separated by the event of speciation (see ortholog) or to the relationship between genes separated by the event of genetic duplication (see paralog). In other instances "homologous" may be used to refer to the level of sequence identity between one or more polynucleotide sequences, in such instances the one or more polynucleotide sequences do not necessarily descend from a common ancestral DNA sequence. Those with skill in the art are aware of the interchangeably of the term "homologous" and appreciate the proper application of the term.

As used herein, the term "ortholog" (or "orthologous") refers to a gene in two or more species that has evolved from a common ancestral nucleotide sequence, and may retain the same function in the two or more species.

As used herein, the term "paralogous" refers to genes related by duplication within a genome. Orthologs retain the same function in the course of evolution, whereas paralogs evolve new functions, even if these new functions are unrelated to the original gene function.

As used herein, two nucleic acid sequence molecules are said to exhibit "complete complementarity" when every nucleotide of a sequence read in the 5' to 3' direction is complementary to every nucleotide of the other sequence when read in the 3' to 5' direction. A nucleotide sequence that is complementary to a reference nucleotide sequence will exhibit a sequence identical to the reverse complement sequence of the reference nucleotide sequence. These terms and descriptions are well defined in the art and are easily understood by those of ordinary skill in the art.

When determining the percentage of sequence identity between amino acid sequences, it is well-known by those of skill in the art that the identity of the amino acid in a given position provided by an alignment may differ without affecting desired properties of the polypeptides comprising the aligned sequences. In these instances, the percent sequence identity may be adjusted to account for similarity between conservatively substituted amino acids. These adjustments are well-known and commonly used by those of skill in the art. See, e.g., Myers and Miller (1988) Computer Applications in Biosciences 4:11-7. Statistical methods are known in the art and can be used in analysis of the identified 7,018 optimal genomic loci.

As an embodiment, the identified optimal genomic loci comprising 7,018 individual optimal genomic loci sequences can be analyzed via an F-distribution test. In probability theory and statistics, the F-distribution is a continuous probability distribution. The F-distribution test is a statistical significance test that has an F-distribution, and is used when comparing statistical models that have been fit to a data set, to identify the best-fitting model. An F-distribution is a continuous probability distribution, and is also known as Snedecor's F-distribution or the Fisher-Snedecor distribution. The F-distribution arises frequently as the null distribution of a test statistic, most notably in the analysis of variance. The F-distribution is a right-skewed distribution. The F-distribution is an asymmetric distribution that has a minimum value of 0, but no maximum value. The curve reaches a peak not far to the right of 0, and then gradually approaches the horizontal axis the larger the F value is. The F-distribution approaches, but never quite touches the horizontal axis. It will be appreciated that in other embodiments, variations on this equation, or indeed different equations, may be derived and used by the skilled person and are applicable to the analysis of 7,018 individual optimal genomic loci sequences.

Operably linked: A first nucleotide sequence is "operably linked" with a second nucleotide sequence when the first nucleotide sequence is in a functional relationship with the second nucleotide sequence. For instance, a promoter is operably linked to a coding sequence if the promoter affects the transcription or expression of the coding sequence. When recombinantly produced, operably linked nucleotide sequences are generally contiguous and, where necessary to join two protein-coding regions, in the same reading frame. However, nucleotide sequences need not be contiguous to be operably linked.

The term, "operably linked," when used in reference to a regulatory sequence and a coding sequence, means that the regulatory sequence affects the expression of the linked coding sequence. "Regulatory sequences," "regulatory elements", or "control elements," refer to nucleotide sequences that influence the timing and level/amount of transcription, RNA processing or stability, or translation of the associated coding sequence. Regulatory sequences may include promoters; translation leader sequences; introns; enhancers; stem-loop structures; repressor binding sequences; termination sequences; polyadenylation recognition sequences; etc. Particular regulatory sequences may be located upstream and/or downstream of a coding sequence operably linked thereto. Also, particular regulatory sequences operably linked to a coding sequence may be located on the associated complementary strand of a double-stranded nucleic acid molecule.

When used in reference to two or more amino acid sequences, the term "operably linked" means that the first amino acid sequence is in a functional relationship with at least one of the additional amino acid sequences.

The disclosed methods and compositions include fusion proteins comprising a cleavage domain operably linked to a DNA-binding domain (e.g., a ZFP) in which the DNA-binding domain by binding to a sequence in the soybean optimal genomic locus directs the activity of the cleavage domain to the vicinity of the sequence and, hence, induces a double stranded break in the optimal genomic locus. As set forth elsewhere in this disclosure, a zinc finger domain can be engineered to bind to virtually any desired sequence. Accordingly, one or more DNA-binding domains can be engineered to bind to one or more sequences in the optimal genomic locus. Expression of a fusion protein comprising a DNA-binding domain and a cleavage domain in a cell, effects cleavage at or near the target site.

EMBODIMENTS

Targeting transgenes and transgene stacks to specific locations in the genome of dicot plants, like a soybean plant, will improve the quality of transgenic events, reduce costs associated with production of transgenic events and provide new methods for making transgenic plant products such as sequential gene stacking. Overall, targeting trangenes to specific genomic sites is likely to be commercially beneficial. Significant advances have been made in the last few years towards development of site-specific nucleases such as ZFNs, CRISPRs, and TALENs that can facilitate addition of donor polynucleotides to pre-selected sites in plant and other genomes. However, much less is known about the attributes of genomic sites that are suitable for targeting. Historically, non-essential genes and pathogen (viral) integration sites in genomes have been used as loci for targeting. The number of such sites in genomes is rather limiting and there is therefore a need for identification and characterization of optimal genomic loci that can be used for targeting of donor polynucleotide sequences. In addition to being amenable to targeting, optimal genomic loci are expected to be neutral sites that can support transgene expression and breeding applications.

Applicants have recognized that additional criteria are desirable for insertion sites and have combined these criteria to identify and select optimal sites in the dicot genome, like the soybean genome, for the insertion of exogenous sequences. For targeting purposes, the site of selected insertion needs to be unique and in a non-repetitive region of the genome of a dicot plant, like a soybean plant. Likewise, the optimal genomic site for insertion should possess minimal undesirable phenotypic effects and be susceptible to recombination events to facilitate introgression into agronomically elite lines using traditional breeding techniques. In order to identify the genomic loci that meet the listed criteria, the genome of a soybean plant was scanned using a customized bioinformatics approach and genome scale datasets to identify novel genomic loci possessing characteristics that are beneficial for the integration of polynucleotide donor sequence and the subsequent expression of an inserted coding sequence.

I. Identification of Nongenic Soybean Genomic Loci

In accordance with one embodiment a method is provided for identifying optimal nongenic soybean genomic sequence for insertion of exogenous sequences. The method comprises the steps of first identifying soybean genomic sequences of at least 1 Kb in length that are hypomethylated. In one embodiment the hypomethylated genomic sequence is 1, 1.5, 2, 2.5, 3, 3.5, 4, 4.5, 5, 5.5, 6, 6.5, 7, 7.5, 8, 8.5, 9, 10, 11, 12, 13, 14, 15, 16 or 17 Kb in length. In one embodiment the hypomethylated genomic sequence is about 1 to about 5.7 Kb in length and in a further embodiment is about 2 Kb in length. A sequence is considered hypomethylated if it has less than 1% DNA methylation within the sequence. In one embodiment the methylation status is measured based on the presence of 5-methylcytosine at one or more CpG dinucleotides, CHG or CHH trinucleotides within a selected soybean sequence, relative to the amount of total cytosines found at corresponding CpG dinucleotides, CHG or CHH trinucleotides within a normal control DNA sample. More particularly, in one embodiment the selected soybean sequence has less than 1, 2 or 3 methylated nucleotides per 500 nucleotides of the selected soybean sequence. In one embodiment the selected soybean sequence has less than one, two, or three 5-methylcytosines at CpG dinucleotides per 500 nucleotides of the selected soybean sequence. In one embodiment the selected soybean sequence is 1 to 4 Kb in length and comprises a 1 Kb sequence devoid of 5-methylcytosines. In one embodiment the selected soybean sequence is 1, 1.5, 2, 2.5, 3, 3.5, 4, 4.5, 5, 5.5, or 6, Kb in length and contains 1 or 0 methylated nucleotides in its entire length. In one embodiment the selected soybean sequence is 1, 1.5, 2, 2.5, 3, 3.5, 4, 4.5, 5, 5.5, or 6, Kb in length and contains no 5-methylcytosines at CpG dinucleotides within in its entire length. In accordance with one embodiment the methylation of a selected soybean sequence may vary based on source tissue. In such embodiments the methylation levels used to determine if a sequence is hypomethylated represents the average amount of methylation in the sequences isolated from two or more tissues (e.g., from root and shoot).

In addition to the requirement that an optimal genomic site be hypomethylated, the selected soybean sequence must also be nongenic. Accordingly, all hypomethylated genomic sequences are further screened to eliminate hypomethylated sequences that contain a genic region. This includes any open reading frames regardless of whether the transcript encodes a protein. Hypomethylated genomic sequences that include genic regions, including any identifiable adjacent 5' and 3' non-coding nucleotide sequences involved in the regulation of expression of an open reading frame and any introns that may be present in the genic region, are excluded from the optimal nongenic soybean genomic locus of the present disclosure.

Optimal nongenic soybean genomic loci must also be sequences that have demonstrated evidence of recombination. In one embodiment the selected soybean sequence must contain at least one recombination event between two markers flanking the selected soybean sequence as detected using a high resolution marker dataset generated from multiple mapping populations. In one embodiment the pair of markers flanking a 0.5, 1, 1.5 Mb dicot genomic sequence, such as a soybean genomic sequence, comprising the selected soybean sequence are used to calculate the recombinant frequency for the selected soybean sequence. Recombination frequencies between each pairs of markers (measured in centimorgan (cM)) to the genomic physical distance between the markers (in Mb)) must be greater than 0.0157 cM/Mb. In one embodiment the recombination frequency for a 1 Mb soybean genomic sequence comprising the selected soybean sequence ranges from about 0.01574 cM/Mb to about 83.52 cM/Mb. In one embodiment an optimal genomic loci is one where recombination events have been detected within the selected soybean sequence.

An optimal nongenic soybean genomic loci will also be a targetable sequence, i.e., a sequence that is relatively unique in the soybean genome such that a gene targeted to the selected soybean sequence will only insert in one location of the soybean genome. In one embodiment the entire length of the optimal genomic sequence shares less than 30%, 35%, or 40%, sequence identity with another sequence of similar length contained in the soybean genome. Accordingly, in one embodiment the selected soybean sequence cannot comprise a 1 Kb sequence that share more than 25%, 30%, 35%, or 40% sequence identity with another 1 Kb sequence contained in the soybean genome. In a further embodiment the selected soybean sequence cannot comprise a 500 bp sequence that share more than 30%, 35%, or 40% sequence identity with another 500 bp sequence contained in the soybean genome. In one embodiment the selected soybean sequence cannot comprise a 1 Kb sequence that share more than 40% sequence identity with another 1 Kb sequence contained in the genome of a dicot plant, like a soybean plant.

An optimal nongenic soybean genomic loci will also be proximal to a genic region. More particularly, a selected soybean sequence must be located in the vicinity of a genic region (e.g., a genic region must be located within 40 Kb of genomic sequence flanking and contiguous with either end of the selected soybean as found in the native genome). In one embodiment a genic region is located within 10, 20, 30 or 40 Kb of contiguous genomic sequence located at either end of the selected soybean sequence as found in the native soybean genome. In one embodiment two or more genic regions are located within 10, 20, 30 or 40 Kb of contiguous genomic sequence flanking the two ends of the selected soybean sequence. In one embodiment 1-18 genic regions are located within 10, 20, 30 or 40 Kb of contiguous genomic sequence flanking the two ends of the selected soybean sequence. In one embodiment two or more genic regions are located within a 20, 30 or 40 Kb genomic sequence comprising the selected soybean sequence. In one embodiment 1-18 genic regions are located within a 40 Kb genomic sequence comprising the selected soybean sequence. In one embodiment the genic region located within a 10, 20, 30 or 40 Kb of contiguous genomic sequence flanking the selected soybean sequence comprises a known gene in the genome of a dicot plant, such as a soybean plant.

In accordance with one embodiment a modified nongenic soybean genomic loci is provided wherein the loci is at least 1 Kb in length, is nongenic, comprises no methylated cytosine residues, has a recombination frequency of greater than 0.01574 cM/Mb over a 1 Mb genomic region encompassing the soybean genomic loci and a 1 Kb sequence of the soybean genomic loci shares less than 40% sequence identity with any other 1 Kb sequence contained in the dicot genome, wherein the nongenic soybean genomic loci is modified by the insertion of a DNA of interest into the nongenic soybean genomic loci.

A method for identifying optimal nongenic soybean genomic loci is provided. In some embodiments, the method first comprises screening the dicot genome to create a first pool of selected soybean sequences that have a minimal length of 1 Kb and are hypomethylated, optionally wherein the genomic sequence has less than 1% methylation, optionally wherein the genomic sequence is devoid of any methylated cytosine residues. This first pool of selected soybean sequences can be further screened to eliminate loci that do not meet the requirements for optimal nongenic soybean genomic loci. Dicot genomic sequences, such as those obtained from soybean, that encode dicot transcripts, share greater than 40% or higher sequence identity with another sequence of similar length, do not exhibit evidence of recombination, and do not have a known open reading frame within 40 Kb of the selected soybean sequence, are eliminated from the first pool of sequences, leaving a second pool of sequences that qualify as optimal nongenic soybean loci. In one embodiment any selected soybean sequences that do not have a known dicot gene (i.e., a soybean gene), or a sequence comprising a 2 Kb upstream and/or 1 Kb downstream region of a known dicot gene, within 40 Kb of one end of said nongenic sequence are eliminated from the first pool of sequences. In one embodiment any selected soybean sequences that do not contain a known gene that expresses a protein within 40 Kb of the selected soybean sequence are eliminated. In one embodiment any selected soybean sequences that do not have a recombination frequency of greater than 0.01574 cM/Mb are eliminated.

Using these selection criteria applicants have identified select optimal genomic loci of dicot, such as soybean, that serve as optimal nongenic soybean genomic loci, the sequences of which are disclosed as SEQ ID NO: 1-SEQ ID NO: 7,018. The present disclosure also encompasses natural variants or modified derivatives of the identified optimal nongenic soybean genomic loci wherein the variant or derivative loci comprise a sequence that differs from any sequence of SEQ ID NO: 1-SEQ ID NO: 7,018 by 1, 2, 3, 4, 5, 6, 7, 8, 9 or 10 nucleotides. In one embodiment optimal nongenic soybean genomic loci for use in accordance with the present disclosure comprise sequences selected from SEQ ID NO: 1-SEQ ID NO: 7,018 or sequences that share 90%, 91%, 92%, 93%, 94%, 95%, 96%, 97%, 98% or 99% sequence identity with a sequence selected from SEQ ID NO: 1-SEQ ID NO: 7,018.

In another embodiment, dicot plants for use in accordance with the present disclosure comprise any plant selected from the group consisting of a soybean plant, a canola plant, a rape plant, a *Brassica* plant, a cotton plant, and a sunflower plant. Examples of dicot plants that can be used include, but are not limited to, canola, cotton, potato, *quinoa*, amaranth, buckwheat, safflower, soybean, sugarbeet, sunflower, canola, rape, tobacco, *Arabidopsis, Brassica*, and cotton.

In another embodiment, optimal nongenic soybean genomic loci for use in accordance with the present disclosure comprise sequences selected from soybean plants. In a further embodiment, optimal nongenic soybean genomic loci for use in accordance with the present disclosure comprise sequences selected from *Glycine max* inbreds. Accordingly, a *Glycine max* inbred includes agronomically elite varieties thereof. In a subsequent embodiment, optimal nongenic soybean genomic loci for use in accordance with the present disclosure comprise sequences selected from transformable soybean lines. In an embodiment, representative transformable soybean lines include; Maverick, Williams82, Merrill JackPeking, Suzuyutaka, Fayette, Enrei, Mikawashima, WaseMidori, Jack, Leculus, Morocco, Serena, Maple prest, Thorne, Bert, Jungery, A3237, Williams, Williams79, AC Colibri, Hefeng 25, Dongnong 42, Hienong 37, Jilin 39, Jiyu 58, A3237, Kentucky Wonder, Minidoka, and derivatives thereof. One of skill in the art will appreciate that as a result of phylogenetic divergence, various types of soybean lines do not contain identical genomic DNA sequences, and that polymorphisms or allelic variation may be present within genomic sequences. In an embodiment, the present disclosure encompasses such polymorphism or allelic variations of the identified optimal nongenic soybean genomic loci wherein the polymorphisms or allelic variation comprise a sequence that differs from any sequence with SEQ ID NO: 1-SEQ ID NO: 7,018 by 1, 2, 3, 4, 5, 6, 7, 8, 9 or 10 nucleotides. In a further embodiment, the present disclosure encompasses such polymorphisms or allelic variations of the identified optimal nongenic soybean genomic loci wherein the sequences comprising the polymorphisms or allelic variation share 90%, 91%, 92%, 93%, 94%, 95%, 96%, 97%, 98% or 99% sequence identity with any sequence of SEQ ID NO: 1-SEQ ID NO: 7,018.

The identified optimal genomic loci comprising 7,018 individual sequences can be categorized into various sub-groupings by further analysis using a multivariate analysis method. Application of any multivariate analysis statistical programs is used to uncover the latent structure (dimensions) of a set of variables. A number of different types of multivariate algorithms can be used, for example the data set can be analyzed using multiple regression analysis, logistic regression analysis, discriminate analysis, multivariate analysis of variance (MANOVA), factor analysis (including both common factor analysis, and principal component analysis), cluster analysis, multidimensional scaling, correspondence analysis, conjoint analysis, canonical analysis, canonical correlation, and structural equation modeling.

In accordance with one embodiment the optimal nongenic soybean genomic loci are further analyzed using multivariate data analysis such as Principal Component Analysis (PCA). Only a brief description will be given here, more information can be found in H. Martens, T. Naes, Multivariate Calibration, Wiley, N.Y., 1989. PCA evaluates the underlying dimensionality (latent variables) of the data, and gives an overview of the dominant patterns and major trends in the data. In one embodiment, the optimal nongenic soybean genomic loci can be sorted into clusters via a principal component analysis (PCA) statistical method. The PCA is a mathematical procedure that uses an orthogonal transformation to convert a set of observations of possibly correlated variables into a set of values of linearly uncorrelated variables called principal components. The number of principal components is less than or equal to the number of original variables. This transformation is defined in such a way that the first principal component has the largest possible variance (that is, accounts for as much of the variability in the data as possible), and each succeeding component in turn has the highest variance possible under the constraint that it be orthogonal to (i.e., uncorrelated with) the preceding components. Principal components are guaranteed to be independent if the data set is jointly normally distributed. PCA is sensitive to the relative scaling of the original variables. Examples of the use of PCA to cluster a set of entities based on features of the entities include; Ciampitti, I. et al., (2012) Crop Science, 52(6); 2728-2742, Chemometrics: A Practical Guide, Kenneth R. Beebe, Randy J. Pell, and Mary Beth Seasholtz, Wiley-Interscience, 1 edition, 1998, U.S. Pat. No. 8,385,662, and European Patent No. 2,340,975.

In accordance with one embodiment a principal component analysis (PCA) was conducted on the 7,018 optimal soybean genomic loci using the following 10 features for each identified optimal soybean genomic loci:

1. Length of the hypo-methylated region around the optimal soybean genomic loci (OGL)
   a. DNA methylation profiles of root and shoot tissues isolated from a dicot plant, e.g., *Glycine Max* cultivar Williams82, were constructed using a high throughput whole genome sequencing approach. Extracted DNA was subjected to bisulphite treatment that converts unmethylated cytosines to uracils, but does not affect methylated cytosines, and then sequenced using Illumina HiSeq technology (Krueger, F. et al. DNA methylome analysis using short bisulfite sequencing data. Nature Methods 9, 145-151 (2012)). The raw sequencing reads were mapped to the dicot reference sequence, e.g., *Glycine max* reference sequence, using the Bismark™ mapping software (as described in Krueger F, Andrews S R (2011) Bismark: a flexible aligner and methylation caller for Bisulfite-Seq applications. (Bioinformatics 27: 1571-1572)). The length of the hypo-methylated region around each of the OGLs was calculated using the described methylation profiles.

2. Rate of Recombination in a 1 MB region around the OGL
   a. For each OGL, a pair of markers on either side of the OGL, within a 1 Mb window, was identified. Recombination frequencies between each pairs of markers across the chromosome were calculated based on the ratio of the genetic distance between markers (in centimorgan (cM)) to the genomic physical distance between the markers (in Mb).

3. Level of OGL sequence uniqueness
   a. For each OGL, the nucleotide sequence of the OGL was scanned against the genome of a dicot plant, e.g., soybean c.v. Williams82 genome, using a BLAST based homology search. As these OGL sequences are identified from the genome of a dicot plant, e.g., soybean c.v. Williams82 genome, the first BLAST hit identified through this search represents the OGL sequence itself. The second BLAST hit for each OGL was identified and the alignment coverage of the hit was used as a measure of uniqueness of the OGL sequence within the dicot genome, e.g., soybean genome.

4. Distance from the OGL to the closest gene in its neighborhood
   a. Gene annotation information and the location of known genes in the dicot genome, e.g., soybean c.v. Williams82 genome, were extracted from a known dicot genome database, e.g., Soybean Genome Database (www.soybase.org). For each OGL, the closest annotated gene in its upstream or downstream neighborhood was identified and the distance between the OGL sequence and the gene was measured (in bp).

5. GC % in the OGL neighborhood
   a. For each OGL, the nucleotide sequence was analyzed to estimate the number of Guanine and Cytosine bases present. This count was represented as a percentage of the sequence length of each OGL and provides a measure for GC %.

6. Number of genes in a 40 Kb neighborhood around the OGL
   a. Gene annotation information and the location of known genes in the dicot genome, e.g., soybean c.v. Williams82 genome, were extracted from a known dicot genomic database, e.g., Soybean Genome Database (www.soybase.org). For each OGL, a 40 Kb window around the OGL was defined and the number of annotated genes with locations overlapping this window was counted.

7. Average gene expression in a 40 Kb neighborhood around the OGL.
   a. Transcript level expression of dicot genes, e.g., soybean genes, was measured by analyzing transcriptome profiling data generated from dicot plant tissues, e.g., soybean c.v. Williams82 root and shoot tissues, using RNAseq technology. For each OGL, annotated genes within the dicot genome, soybean c.v. Williams82 genome, that were present in a 40 Kb neighborhood around the OGL were identified. Expression levels for each of the genes in the window were extracted from the transcriptome profiles and an average gene expression level was calculated.

8. Level of Nucleosome occupancy around the OGL
   a. Discerning the level of nucleosome occupancy for a particular nucleotide sequence provides information about chromosomal functions and the genomic context of the sequence. The NuPoP™ statistical package provides a user-friendly software tool for predicting the nucleosome occupancy and the most probable nucleosome positioning map for genomic sequences of any size (Xi, L., Fondufe-Mittendor, Y., Xia, L., Flatow, J., Widom, J. and Wang, J.-P., Predicting nucleosome positioning using a duration Hidden Markov Model, BMC Bioinformatics, 2010, doi:10.1186/1471-2105-11-346). For each OGL, the nucleotide sequence was submitted to the NuPoP™ software and a nucleosome occupancy score was calculated.

9. Relative location within the chromosome (proximity to centromere)
   a. Information on position of the centromere in each of the dicot chromosomes, e.g., soybean chromosomes, and the lengths of the chromosome arms was extracted from a dicot genomic database, e.g., Soybean Genome Database (www.soybase.org). For each OGL, the genomic distance from the OGL sequence to the centromere of the chromosome that it is located on, is measured (in bp). The relative location of a OGL within the chromosome is represented as the ratio of its genomic distance to the centromere relative to the length of the specific chromosomal arm that it lies on.

10. Number of OGLs in a 1 Mb region around the OGL
    a. For each OGL, a 1 Mb genomic window around the OGL location is defined and the number of OGLs, in the dicot 1 Kb OGL dataset, whose genomic locations overlap with this window is tallied.

The results or values for the score of the features and attributes of each optimal nongenic soybean genomic loci are further described in Table 3 of Example 2. The resulting dataset was used in the PCA statistical method to cluster the 7,018 identified optimal nongenic soybean genomic loci into clusters. During the clustering process, after estimating the "p" principle components of the optimal genomic loci, the assignment of the optimal genomic loci to one of the 32 clusters proceeded in the "p" dimensional Euclidean space. Each of the "p" axes was divided into "k" intervals. Optimal genomic loci assigned to the same interval were grouped together to form clusters. Using this analysis, each PCA axis was divided into two intervals, which was chosen based on a priori information regarding the number of clusters required for experimental validation. All analysis and the visualization of the resulting clusters were carried out with the Molecular Operating Environment™ (MOE) software from Chemical Computing Group Inc. (Montreal, Quebec, Canada). The PCA approach was used to cluster the set of 7,018 optimal soybean genomic loci into 32 distinct clusters based on their feature values, described above.

Figure 2:
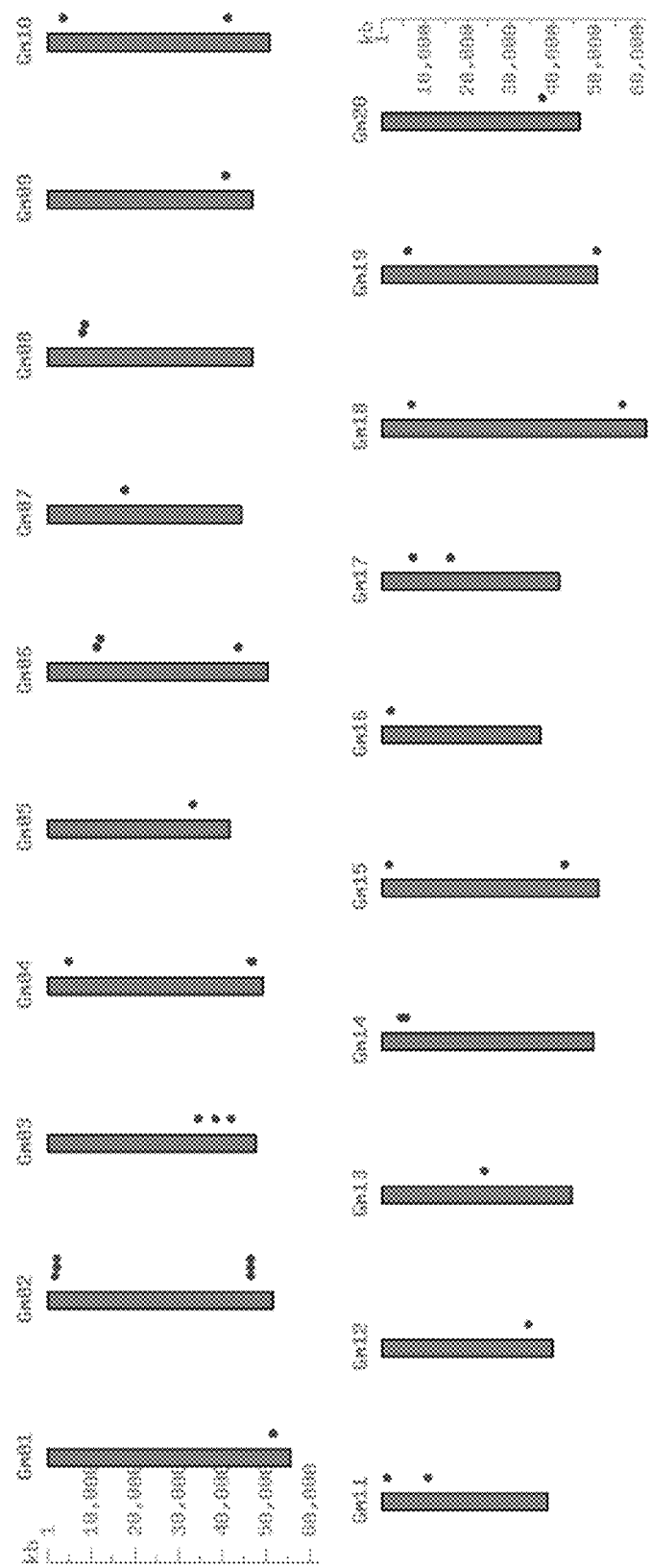
FIG. 2. Provides a schematic drawing indicating the chromosomal distribution of the optimal genomic loci, selected for being closest to the centroid of each of the 32 respective clusters.

During the PCA process, five principal components (PC) were generated, with the top three PCs containing about 90% of the total variation in the dataset (Table 4). These three PCs were used to graphically represent the 32 clusters in a three dimensional plot (see FIG. 1). After the clustering process, was completed, one representative optimal genomic loci was chosen from each cluster. This was performed by choosing a select optimal genomic locus, within each cluster, that was closest to the centroid of that cluster by computational methods (Table 4). The chromosomal locations of the 32 representative optimal genomic loci are uniformly distributed among the soybean chromosomes as shown in FIG. 2.

In accordance with one embodiment a modified optimal nongenic soybean genomic loci is provided wherein the optimal nongenic soybean genomic loci has been modified and comprise one or more nucleotide substitutions, deletions or insertions. In one embodiment the optimal nongenic soybean genomic loci is modified by the insertion of a DNA of interest.

In an embodiment the optimal nongenic soybean genomic loci to be modified is a genomic sequence selected from any sequence described in Table 7 and 8 of Example 7. In one embodiment the optimal nongenic soybean genomic loci to be modified is a genomic sequence selected from soy_OGL_1423 (SEQ ID NO:639), soy_OGL_1434 (SEQ ID NO:137), soy_OGL_4625 (SEQ ID NO:76), soy_OGL_6362 (SEQ ID NO:440), soy_OGL_308 (SEQ ID NO:43), soy_OGL_307 (SEQ ID NO:566), soy_OGL_310 (SEQ ID NO:4236), soy_OGL_684 (SEQ ID NO:47), soy_OGL_682 (SEQ ID NO:2101), and soy_OGL_685 (SEQ ID NO:48). In one embodiment the optimal nongenic soybean genomic loci to be modified is a genomic sequence selected from soy_OGL_1423 (SEQ ID NO:639). In one embodiment the optimal nongenic soybean genomic loci to be modified is a genomic sequence selected from soy_OGL_1434 (SEQ ID NO:137). In one embodiment the optimal nongenic soybean genomic loci to be modified is a genomic sequence selected from soy_OGL_4625 (SEQ ID NO:76). In one embodiment the optimal nongenic soybean genomic loci to be modified is a genomic sequence selected from soy_OGL_6362 (SEQ ID NO:440). In one embodiment the optimal nongenic soybean genomic loci to be modified is a genomic sequence selected from soy_OGL_308 (SEQ ID NO:43). In one embodiment the optimal nongenic soybean genomic loci to be modified is a genomic sequence selected from soy_OGL_307 (SEQ ID NO:566). In one embodiment the optimal nongenic soybean genomic loci to be modified is a genomic sequence selected from soy_OGL_310 (SEQ ID NO:4236). In one embodiment the optimal nongenic soybean genomic loci to be modified is a genomic sequence selected from soy_OGL_684 (SEQ ID NO:47). In one embodiment the optimal nongenic soybean genomic loci to be modified is a genomic sequence selected from soy_OGL_682 (SEQ ID NO:2101). In one embodiment the optimal nongenic soybean genomic loci to be modified is a genomic sequence selected from soy_OGL_685 (SEQ ID NO:48).

In a further embodiment the optimal nongenic soybean genomic loci to be modified is a genomic sequence selected from soy_OGL_1423 (SEQ ID NO:639), soy_OGL_1434 (SEQ ID NO:137), and soy_OGL_4625 (SEQ ID NO:76). In a further embodiment the optimal nongenic soybean genomic loci to be modified is a genomic sequence selected from loci_soy_OGL_6362 (SEQ ID NO:440), and soy_OGL_308 (SEQ ID NO:43. In a further embodiment the optimal nongenic soybean genomic loci to be modified is a genomic sequence selected from soy_OGL_307 (SEQ ID NO:566), soy_OGL_310 (SEQ ID NO:4236), soy_OGL_684 (SEQ ID NO:47), soy_OGL_682 (SEQ ID NO:2101), and soy_OGL_685 (SEQ ID NO:48). In a further embodiment the optimal nongenic soybean genomic loci to be modified is a genomic sequence selected from loci soy_OGL_307 (SEQ ID NO:566), soy_OGL_310 (SEQ ID NO:4236), soy_OGL_684 (SEQ ID NO:47), and soy_OGL_682 (SEQ ID NO:2101). In a further embodiment the optimal nongenic soybean genomic loci to be modified is a genomic sequence selected from loci soy_OGL_307 (SEQ ID NO:566), soy_OGL_310 (SEQ ID NO:4236), and soy_OGL_684 (SEQ ID NO:47). In a further embodiment the optimal nongenic soybean genomic loci to be modified is a genomic sequence selected from loci soy_OGL_307 (SEQ ID NO:566), and soy_OGL_310 (SEQ ID NO:4236). In a further embodiment the optimal nongenic soybean genomic loci to be modified is a genomic sequence selected from loci soy_OGL_310 (SEQ ID NO:4236), soy_OGL_684 (SEQ ID NO:47), soy_OGL_682 (SEQ ID NO:2101), and soy_OGL_685 (SEQ ID NO:48). In a further embodiment the optimal nongenic soybean genomic loci to be modified is a genomic sequence selected from loci soy_OGL_684 (SEQ ID NO:47), soy_OGL_682 (SEQ ID NO:2101), and soy_OGL_685 (SEQ ID NO:48). In a further embodiment the optimal nongenic soybean genomic loci to be modified is a genomic sequence selected from loci soy_OGL_682 (SEQ ID NO:2101), and soy_OGL_685 (SEQ ID NO:48).

In a further embodiment the optimal nongenic soybean genomic loci to be modified is a genomic sequence selected from loci soy_OGL_307 (SEQ ID NO:566), soy_OGL_310 (SEQ ID NO:4236), and soy_OGL_308 (SEQ ID NO:566). In a further embodiment the optimal nongenic soybean genomic loci to be modified is a genomic sequence selected from loci soy_OGL_6362 (SEQ ID NO:440), soy_OGL_4625 (SEQ ID NO:76), and soy_OGL_308 (SEQ ID NO:566). In a further embodiment the optimal nongenic soybean genomic loci to be modified is a genomic sequence selected from loci soy_OGL_1423 (SEQ ID NO:639) and soy_OGL_1434 (SEQ ID NO:137). In a further embodiment the optimal nongenic soybean genomic loci to be modified is a genomic sequence selected from loci soy_OGL_682 (SEQ ID NO:47), soy_OGL_684 (SEQ ID NO:2101), and soy_OGL_85 (SEQ ID NO:48).

In one embodiment the optimal nongenic soybean genomic loci is selected from the genomic sequences of soy_ogl_2474 (SEQ ID NO: 1), soy_ogl_768 (SEQ ID NO: 506), soy_ogl_2063 (SEQ ID NO: 2063), soy_ogl_1906 (SEQ ID NO: 1029), soy_ogl_1112 (SEQ ID NO: 1112), soy_ogl_3574 (SEQ ID NO: 1452), soy_ogl_2581 (SEQ ID NO: 1662), soy_ogl_3481 (SEQ ID NO: 1869), soy_ogl_1016 (SEQ ID NO: 2071), soy_ogl_937 (SEQ ID NO: 2481), soy_ogl_6684 (SEQ ID NO: 2614), soy_ogl_6801 (SEQ ID NO: 2874), soy_ogl_6636 (SEQ ID NO: 2970), soy_ogl_4665 (SEQ ID NO: 3508), soy_ogl_3399 (SEQ ID NO: 3676), soy_ogl_4222 (SEQ ID NO: 3993), soy_ogl_2543 (SEQ ID NO: 4050), soy_ogl_275 (SEQ ID NO: 4106), soy_ogl_598 (SEQ ID NO: 4496), soy_ogl_1894 (SEQ ID NO: 4622), soy_ogl_5454 (SEQ ID NO: 4875), soy_ogl_6838 (SEQ ID NO: 4888), soy_ogl_4779 (SEQ ID NO: 5063), soy_ogl_3333 (SEQ ID NO: 5122), soy_ogl_2546 (SEQ ID NO: 5520), soy_ogl_796 (SEQ ID NO: 5687), soy_ogl_873 (SEQ ID NO: 6087), soy_ogl_5475 (SEQ ID NO: 6321), soy_ogl_2115 (SEQ ID NO: 6520), soy_ogl_2518 (SEQ ID NO: 6574), soy_ogl_5551 (SEQ ID NO: 6775), and soy_ogl_4563 (SEQ ID NO: 6859).

In one embodiment the optimal nongenic soybean genomic loci is selected from the genomic sequences of soy_ogl_308 (SEQ ID NO: 43), soy_ogl_307 (SEQ ID NO: 566), soy_ogl_2063 (SEQ ID NO: 748), soy_ogl_1906 (SEQ ID NO: 1029), soy_ogl_262 (SEQ ID NO: 1376), soy_ogl_5227 (SEQ ID NO: 1461), soy_ogl_4074 (SEQ ID NO: 1867), soy_ogl_3481 (SEQ ID NO: 1869), soy_ogl_1016 (SEQ ID NO: 2071), soy_ogl_937 (SEQ ID NO: 2481), soy_ogl_5109 (SEQ ID NO: 2639), soy_ogl_6801 (SEQ ID NO: 2874), soy_ogl_6636 (SEQ ID NO: 2970), soy_ogl_4665 (SEQ ID NO: 3508), soy_ogl_6189 (SEQ ID NO: 3682), soy_ogl_4222 (SEQ ID NO: 3993), soy_ogl_2543 (SEQ ID NO: 4050), soy_ogl_310 (SEQ ID NO: 4326), soy_ogl_2353 (SEQ ID NO: 4593), soy_ogl_1894 (SEQ ID NO: 4622), soy_ogl_3669 (SEQ ID NO: 4879), soy_ogl_3218 (SEQ ID NO: 4932), soy_ogl_5689 (SEQ ID NO: 5102), soy_ogl_3333 (SEQ ID NO: 5122), soy_ogl_2546 (SEQ ID NO: 5520), soy_ogl_1208 (SEQ ID NO: 5698), soy_ogl_873 (SEQ ID NO: 6087), soy_ogl_5957 (SEQ ID NO: 6515), soy_ogl_4846 (SEQ ID NO: 6571), soy_ogl_3818 (SEQ ID NO: 6586), soy_ogl_5551 (SEQ ID NO: 6775), soy_ogl_7 (SEQ ID NO: 6935), soy_OGL_684 (SEQ ID NO: 47), soy_OGL_682 (SEQ ID NO: 2101), soy_OGL_685 (SEQ ID NO: 48), soy_OGL_1423 (SEQ ID NO: 639), soy_OGL_1434 (SEQ ID NO: 137), soy_OGL_4625 (SEQ ID NO: 76), and soy_OGL_6362 (SEQ ID NO: 440).

In one embodiment the optimal nongenic soybean genomic loci is targeted with a DNA of interest, wherein the DNA of interest integrates within or proximal to the zinc finger nuclease target sites. In accordance with an embodiment, exemplary zinc finger target sites of optimal maize select genomic loci are provided in Table 8. In accordance with an embodiment, integration of a DNA of interest occurs within or proximal to the exemplary target sites of: SEQ ID NO: 7363 and SEQ ID NO: 7364, SEQ ID NO: 7365 and SEQ ID NO: 7366, SEQ ID NO: 7367 and SEQ ID NO: 7368, SEQ ID NO: 7369 and SEQ ID NO: 7370, SEQ ID NO: 7371 and SEQ ID NO: 7372, SEQ ID NO: 7373 and SEQ ID NO: 7374, SEQ ID NO: 7375 and SEQ ID NO: 7376, SEQ ID NO: 7377 and SEQ ID NO: 7378, SEQ ID NO: 7379 and SEQ ID NO: 7380, SEQ ID NO: 7381 and SEQ ID NO: 7382, SEQ ID NO: 7383 and SEQ ID NO: 7384, SEQ ID NO: 7385 and SEQ ID NO: 7386, SEQ ID NO: 7387 and SEQ ID NO: 7388, SEQ ID NO: 7389 and SEQ ID NO: 7390, SEQ ID NO: 7391 and SEQ ID NO: 7392, SEQ ID NO: 7393 and SEQ ID NO: 7394, SEQ ID NO: 7395 and SEQ ID NO: 7396, SEQ ID NO: 7397 and SEQ ID NO: 7398, SEQ ID NO: 7399 and SEQ ID NO: 7400, SEQ ID NO: 7401 and SEQ ID NO: 7402, SEQ ID NO: 7403 and SEQ ID NO: 7404, SEQ ID NO: 7405 and SEQ ID NO: 7406, SEQ ID NO: 7407 and SEQ ID NO: 7408, SEQ ID NO: 7409 and SEQ ID NO: 7410, SEQ ID NO: 7411 and SEQ ID NO: 7412, SEQ ID NO: 7413 and SEQ ID NO: 7414, SEQ ID NO: 7415 and SEQ ID NO: 7416, SEQ ID NO: 7417 and SEQ ID NO: 7418, SEQ ID NO: 7419 and SEQ ID NO: 7420, SEQ ID NO: 7421 and SEQ ID NO: 7422, SEQ ID NO: 7423 and SEQ ID NO: 7424, SEQ ID NO: 7425 and SEQ ID NO: 7426.

In one embodiment the optimal nongenic soybean genomic loci is targeted with a DNA of interest, wherein the DNA of interest integrates within or proximal to the zinc finger nuclease target sites. In accordance with an embodiment, the zinc finger nuclease binds to the zinc finger target site and cleaves the unique soybean genomic polynucleotide target sites, whereupon the DNA of interest integrates within or proximal to the soybean genomic polynucleotide target sites. In an embodiment, integration of the DNA of interest occurs within the zinc finger target site may result with rearrangements. In accordance with one embodiment, the rearrangements may comprise deletions, insertions, inversions, and repeats. In an embodiment, integration of the DNA of interest proximal to the zinc finger target site. According to an aspect of the embodiment, the integration of the DNA is proximal to the zinc finger target site, and may integrate within 1.5 Kb, 1.25 Kb, 1.0 Kb, 0.75 Kb, 0.5 Kb, or 0.25 Kb to the zinc finger target site. Insertion within a genomic region proximal to the zinc finger target site is known in the art, see US Patent Pub No. 2010/0257638 A1 (herein incorporated by reference in its entirety).

In accordance with one embodiment the selected nongenic sequence comprise the following characteristics:

a) the nongenic sequence does not contain greater than 1% DNA methylation within the sequence;

b) the nongenic sequence has a relative location value from 0.211 to 0.976 ratio of genomic distance from a soybean chromosomal centromere;

c) the nongenic sequence has a guanine/cytosine percent content range of 25.62 to 43.76%; and, d) the nongenic sequence is from about 1 Kb to about 4.4 Kb in length.

II. Recombinant Derivatives of Identified Optimal Nongenic Soybean Loci

In accordance with one embodiment, after having identified a genomic loci of a dicot plant, such as a soybean plant, as a highly desirable location for inserting polynucleotide donor sequences, one or more nucleic acids of interest can be inserted into the identified genomic locus. In one embodiment the nucleic acid of interest comprises exogenous gene sequences or other desirable polynucleotide donor sequences. In another embodiment, after having identified a genomic loci of a dicot plant, such as a soybean plant, as a highly desirable location for inserting polynucleotide donor sequences, one or more nucleic acids of interest or the optimal nongenic soybean genomic loci can optionally be deleted, excised or removed with the subsequent integration of the DNA of interest into the identified genomic locus. In one embodiment the insertion of a nucleic acid of interest into the optimal nongenic soybean genomic loci comprises removal, deletion, or excision of the exogenous gene sequences or other desirable polynucleotide donor sequences.

The present disclosure further relates to methods and compositions for targeted integration into the select soybean genomic locus using ZFNs and a polynucleotide donor construct. The methods for inserting a nucleic acid sequence of interest into the optimal nongenic soybean genomic loci, unless otherwise indicated, use conventional techniques in molecular biology, biochemistry, chromatin structure and analysis, cell culture, recombinant DNA and related fields as are within the skill of the art. These techniques are fully explained in the literature. See, for example, Sambrook et al. MOLECULAR CLONING: A LABORATORY MANUAL, Second edition, Cold Spring Harbor Laboratory Press, 1989 and Third edition, 2001; Ausubel et al., CURRENT PROTOCOLS IN MOLECULAR BIOLOGY, John Wiley & Sons, New York, 1987 and periodic updates; the series METHODS IN ENZYMOLOGY, Academic Press, San Diego; Wolfe, CHROMATIN STRUCTURE AND FUNCTION, Third edition, Academic Press, San Diego, 1998; METHODS IN ENZYMOLOGY, Vol. 304, "Chromatin" (P. M. Wassarman and A. P. Wolffe, eds.), Academic Press, San Diego, 1999; and METHODS IN MOLECULAR BIOLOGY, Vol. 119, "Chromatin Protocols" (P. B. Becker, ed.) Humana Press, Totowa, 1999.

Methods for Nucleic Acid Insertion into the Soybean Genome

Any of the well known procedures for introducing polynucleotide donor sequences and nuclease sequences as a DNA construct into host cells may be used in accordance with the present disclosure. These include the use of calcium phosphate transfection, polybrene, protoplast fusion, PEG, electroporation, ultrasonic methods (e.g., sonoporation), liposomes, microinjection, naked DNA, plasmid vectors, viral vectors, both episomal and integrative, and any of the other well known methods for introducing cloned genomic DNA, cDNA, synthetic DNA or other foreign genetic material into a host cell (see, e.g., Sambrook et al., supra). It is only necessary that the particular nucleic acid insertion procedure used be capable, of successfully introducing at least one gene into the host cell capable of expressing the protein of choice.

As noted above, DNA constructs may be introduced into the genome of a desired plant species by a variety of conventional techniques. For reviews of such techniques see, for example, Weissbach & Weissbach Methods for Plant Molecular Biology (1988, Academic Press, N.Y.) Section VIII, pp. 421-463; and Grierson & Corey, Plant Molecular Biology (1988, 2d Ed.), Blackie, London, Ch. 7-9. A DNA construct may be introduced directly into the genomic DNA of the plant cell using techniques such as electroporation and microinjection of plant cell protoplasts, by agitation with silicon carbide fibers (See, e.g., U.S. Pat. Nos. 5,302,523 and 5,464,765), or the DNA constructs can be introduced directly to plant tissue using biolistic methods, such as DNA particle bombardment (see, e.g., Klein et al. (1987) Nature 327:70-73). Alternatively, the DNA construct can be introduced into the plant cell via nanoparticle transformation (see, e.g., US Patent Publication No. 20090104700, which is incorporated herein by reference in its entirety). Alternatively, the DNA constructs may be combined with suitable T-DNA border/flanking regions and introduced into a conventional *Agrobacterium tumefaciens* host vector. *Agrobacterium tumefaciens*-mediated transformation techniques, including disarming and use of binary vectors, are well described in the scientific literature. See, for example Horsch et al. (1984) Science 233:496-498, and Fraley et al. (1983) Proc. Nat'l. Acad. Sci. USA 80:4803.

In addition, gene transfer may be achieved using non-*Agrobacterium* bacteria or viruses such as *Rhizobium* sp. NGR234, *Sinorhizoboium meliloti, Mesorhizobium loti*, potato virus X, cauliflower mosaic virus and cassava vein mosaic virus and/or tobacco mosaic virus, See, e.g., Chung et al. (2006) Trends Plant Sci. 11(1):1-4. The virulence functions of the *Agrobacterium tumefaciens* host will direct the insertion of a T-strand containing the construct and adjacent marker into the plant cell DNA when the cell is infected by the bacteria using binary T DNA vector (Bevan (1984) Nuc. Acid Res. 12:8711-8721) or the co-cultivation procedure (Horsch et al. (1985) Science 227:1229-1231). Generally, the *Agrobacterium* transformation system is used to engineer dicotyledonous plants (Bevan et al. (1982) Ann. Rev. Genet. 16:357-384; Rogers et al. (1986) Methods Enzymol. 118:627-641). The *Agrobacterium* transformation system may also be used to transform, as well as transfer, DNA to monocotyledonous plants and plant cells. See U.S. Pat. No. 5,591,616; Hernalsteen et al. (1984) EMBO J. 3:3039-3041; Hooykass-Van Slogteren et al. (1984) Nature 311:763-764; Grimsley et al. (1987) Nature 325:1677-179; Boulton et al. (1989) Plant Mol. Biol. 12:31-40; and Gould et al. (1991) Plant Physiol. 95:426-434.

Alternative gene transfer and transformation methods include, but are not limited to, protoplast transformation through calcium-, polyethylene glycol (PEG)- or electroporation-mediated uptake of naked DNA (see Paszkowski et al. (1984) EMBO J. 3:2717-2722, Potrykus et al. (1985) Molec. Gen. Genet. 199:169-177; Fromm et al. (1985) Proc. Nat. Acad. Sci. USA 82:5824-5828; and Shimamoto (1989) Nature 338:274-276) and electroporation of plant tissues (D'Halluin et al. (1992) Plant Cell 4:1495-1505). Additional methods for plant cell transformation include microinjection, silicon carbide mediated DNA uptake (Kaeppler et al. (1990) Plant Cell Reporter 9:415-418), and microprojectile bombardment (see Klein et al. (1988) Proc. Nat. Acad. Sci. USA 85:4305-4309; and Gordon-Kamm et al. (1990) Plant Cell 2:603-618).

In one embodiment a nucleic acid of interest introduced into a host cell for targeted insertion into the genome comprises homologous flanking sequences on one or both ends of the targeted nucleic acid of interest. In such an embodiment, the homologous flanking sequences contain sufficient levels of sequence identity to a dicot genomic sequence, such as a genomic sequence from soybean, to support homologous recombination between it and the genomic sequence to which it bears homology. Approximately 25, 50, 100, 200, 500, 750, 1000, 1500, or 2000 nucleotides, or more of sequence identity, ranging from 70% to 100%, between a donor and a genomic sequence (or any integral value between 10 and 200 nucleotides, or more) will support homologous recombination therebetween.

In another embodiment the targeted nucleic acid of interest lacks homologous flanking sequences, and the targeted nucleic acid of interest shares low to very low levels of sequence identity with a genomic sequence.

In other embodiments of targeted recombination and/or replacement and/or alteration of a sequence in a region of interest in cellular chromatin, a chromosomal sequence is altered by homologous recombination with an exogenous "donor" nucleotide sequence. Such homologous recombination is stimulated by the presence of a double-stranded break in cellular chromatin, if sequences homologous to the region of the break are present. Double-strand breaks in cellular chromatin can also stimulate cellular mechanisms of non-homologous end joining. In any of the methods described herein, the first nucleotide sequence (the "donor sequence") can contain sequences that are homologous, but not identical, to genomic sequences in the region of interest, thereby stimulating homologous recombination to insert a non-identical sequence in the region of interest. Thus, in certain embodiments, portions of the donor sequence that are homologous to sequences in the region of interest exhibit between about 80, 85, 90, 95, 97.5, to 99% (or any integer therebetween) sequence identity to the genomic sequence that is replaced. In other embodiments, the homology between the donor and genomic sequence is higher than 99%, for example if only 1 nucleotide differs as between donor and genomic sequences of over 100 contiguous base pairs.

In certain cases, a non-homologous portion of the donor sequence can contain sequences not present in the region of interest, such that new sequences are introduced into the region of interest. In these instances, the non-homologous sequence is generally flanked by sequences of 50 to 2,000 base pairs (or any integral value therebetween) or any number of base pairs greater than 2,000, that are homologous or identical to sequences in the region of interest. In other embodiments, the donor sequence is non-homologous to the first sequence, and is inserted into the genome by non-homologous recombination mechanisms.

In accordance with one embodiment a zinc finger nuclease (ZFN) is used to introduce a double strand break in a targeted genomic locus to facilitate the insertion of a nucleic acid of interest. Selection of a target site within the selected genomic locus for binding by a zinc finger domain can be accomplished, for example, according to the methods disclosed in U.S. Pat. No. 6,453,242, the disclosure of which is incorporated herein, that also discloses methods for designing zinc finger proteins (ZFPs) to bind to a selected sequence. It will be clear to those skilled in the art that simple visual inspection of a nucleotide sequence can also be used for selection of a target site. Accordingly, any means for target site selection can be used in the methods described herein.

For ZFP DNA-binding domains, target sites are generally composed of a plurality of adjacent target subsites. A target subsite refers to the sequence, usually either a nucleotide triplet or a nucleotide quadruplet which may overlap by one nucleotide with an adjacent quadruplet that is bound by an individual zinc finger. See, for example, WO 02/077227, the disclosure of which is incorporated herein. A target site generally has a length of at least 9 nucleotides and, accordingly, is bound by a zinc finger binding domain comprising at least three zinc fingers. However binding of, for example, a 4-finger binding domain to a 12-nucleotide target site, a 5-finger binding domain to a 15-nucleotide target site or a 6-finger binding domain to an 18-nucleotide target site, is also possible. As will be apparent, binding of larger binding domains (e.g., 7-, 8-, 9-finger and more) to longer target sites is also consistent with the subject disclosure.

In accordance with one embodiment, it is not necessary for a target site to be a multiple of three nucleotides. In cases in which cross-strand interactions occur (see, e.g., U.S. Pat. No. 6,453,242 and WO 02/077227), one or more of the individual zinc fingers of a multi-finger binding domain can bind to overlapping quadruplet subsites. As a result, a three-finger protein can bind a 10-nucleotide sequence, wherein the tenth nucleotide is part of a quadruplet bound by a terminal finger, a four-finger protein can bind a 13-nucleotide sequence, wherein the thirteenth nucleotide is part of a quadruplet bound by a terminal finger, etc.

The length and nature of amino acid linker sequences between individual zinc fingers in a multi-finger binding domain also affects binding to a target sequence. For example, the presence of a so-called "non-canonical linker," "long linker" or "structured linker" between adjacent zinc fingers in a multi-finger binding domain can allow those fingers to bind subsites which are not immediately adjacent. Non-limiting examples of such linkers are described, for example, in U.S. Pat. No. 6,479,626 and WO 01/53480. Accordingly, one or more subsites, in a target site for a zinc finger binding domain, can be separated from each other by 1, 2, 3, 4, 5 or more nucleotides. One nonlimiting example would be a four-finger binding domain that binds to a 13-nucleotide target site comprising, in sequence, two contiguous 3-nucleotide subsites, an intervening nucleotide, and two contiguous triplet subsites.

While DNA-binding polypeptides identified from proteins that exist in nature typically bind to a discrete nucleotide sequence or motif (e.g., a consensus recognition sequence), methods exist and are known in the art for modifying many such DNA-binding polypeptides to recognize a different nucleotide sequence or motif. DNA-binding polypeptides include, for example and without limitation: zinc finger DNA-binding domains; leucine zippers; UPA DNA-binding domains; GAL4; TAL; LexA; a Tet repressor; LacR; and a steroid hormone receptor.

In some examples, a DNA-binding polypeptide is a zinc finger. Individual zinc finger motifs can be designed to target and bind specifically to any of a large range of DNA sites. Canonical $Cys_2His_2$ (as well as non-canonical $Cys_3His$) zinc finger polypeptides bind DNA by inserting an α-helix into the major groove of the target DNA double helix. Recognition of DNA by a zinc finger is modular; each finger contacts primarily three consecutive base pairs in the target, and a few key residues in the polypeptide mediate recognition. By including multiple zinc finger DNA-binding domains in a targeting endonuclease, the DNA-binding specificity of the targeting endonuclease may be further increased (and hence the specificity of any gene regulatory effects conferred thereby may also be increased). See, e.g., Urnov et al. (2005) Nature 435:646-51. Thus, one or more zinc finger DNA-binding polypeptides may be engineered and utilized such that a targeting endonuclease introduced into a host cell interacts with a DNA sequence that is unique within the genome of the host cell. Preferably, the zinc finger protein is non-naturally occurring in that it is engineered to bind to a target site of choice. See, for example, Beerli et al. (2002) Nature Biotechnol. 20:135-141; Pabo et al. (2001) Ann. Rev. Biochem. 70:313-340; Isalan et al. (2001) Nature Biotechnol. 19:656-660; Segal et al. (2001) Curr. Opin. Biotechnol. 12:632-637; Choo et al. (2000) Curr Opin. Struct. Biol. 10:411-416; U.S. Pat. Nos. 6,453,242; 6,534,261; 6,599,692; 6,503,717; 6,689,558; 7,030,215; 6,794,136; 7,067,317; 7,262,054; 7,070,934; 7,361,635; 7,253,273; and U.S. Patent Publication Nos. 2005/0064474; 2007/0218528; 2005/0267061, all incorporated herein by reference in their entireties.

An engineered zinc finger binding domain can have a novel binding specificity, compared to a naturally-occurring zinc finger protein. Engineering methods include, but are not limited to, rational design and various types of selection. Rational design includes, for example, using databases comprising triplet (or quadruplet) nucleotide sequences and individual zinc finger amino acid sequences, in which each triplet or quadruplet nucleotide sequence is associated with one or more amino acid sequences of zinc fingers which bind the particular triplet or quadruplet sequence. See, for example, co-owned U.S. Pat. Nos. 6,453,242 and 6,534,261, incorporated by reference herein in their entireties.

Alternatively, the DNA-binding domain may be derived from a nuclease. For example, the recognition sequences of homing endonucleases and meganucleases such as I-SceI, I-CeuI, PI-PspI, PI-Sce, I-SceIV, I-CsmI, I-PanI, I-SceII, I-PpoI, I-SceIII, I-CreI, I-TevI, I-TevII and I-TevIII are known. See also U.S. Pat. No. 5,420,032; U.S. Pat. No. 6,833,252; Belfort et al. (1997) Nucleic Acids Res. 25:3379-3388; Dujon et al. (1989) Gene 82:115-118; Perler et al. (1994) Nucleic Acids Res. 22, 1125-1127; Jasin (1996) Trends Genet. 12:224-228; Gimble et al. (1996) J. Mol. Biol. 263:163-180; Argast et al. (1998) J. Mol. Biol. 280:345-353 and the New England Biolabs catalogue. In addition, the DNA-binding specificity of homing endonucleases and meganucleases can be engineered to bind non-natural target sites. See, for example, Chevalier et al. (2002) Molec. Cell 10:895-905; Epinat et al. (2003) Nucleic Acids Res. 31:2952-2962; Ashworth et al. (2006) Nature 441:656-659; Paques et al. (2007) Current Gene Therapy 7:49-66; U.S. Patent Publication No. 20070117128.

As another alternative, the DNA-binding domain may be derived from a leucine zipper protein. Leucine zippers are a class of proteins that are involved in protein-protein interactions in many eukaryotic regulatory proteins that are important transcription factors associated with gene expression. The leucine zipper refers to a common structural motif shared in these transcriptional factors across several kingdoms including animals, plants, yeasts, etc. The leucine zipper is formed by two polypeptides (homodimer or heterodimer) that bind to specific DNA sequences in a manner where the leucine residues are evenly spaced through an α-helix, such that the leucine residues of the two polypeptides end up on the same face of the helix. The DNA binding specificity of leucine zippers can be utilized in the DNA-binding domains disclosed herein.

In some embodiments, the DNA-binding domain is an engineered domain from a TAL effector derived from the plant pathogen *Xanthomonas* (see, Miller et al. (2011) Nature Biotechnology 29(2):143-8; Boch et al, (2009) Science 29 Oct. 2009 (10.1126/science.117881) and Moscou and Bogdanove, (2009) Science 29 Oct. 2009 (10.1126/science.1178817; and U.S. Patent Publication Nos. 20110239315, 20110145940 and 20110301073).

The CRISPR (Clustered Regularly Interspaced Short Palindromic Repeats)/Cas (CRISPR Associated) nuclease system is a recently engineered nuclease system based on a bacterial system that can be used for genome engineering. It is based on part of the adaptive immune response of many bacteria and Archea. When a virus or plasmid invades a bacterium, segments of the invader's DNA are converted into CRISPR RNAs (crRNA) by the 'immune' response. This crRNA then associates, through a region of partial complementarity, with another type of RNA called tracr- RNA to guide the Cas9 nuclease to a region homologous to the crRNA in the target DNA called a "protospacer". Cas9 cleaves the DNA to generate blunt ends at the DSB at sites specified by a 20-nucleotide guide sequence contained within the crRNA transcript. Cas9 requires both the crRNA and the tracrRNA for site specific DNA recognition and cleavage. This system has now been engineered such that the crRNA and tracrRNA can be combined into one molecule (the "single guide RNA"), and the crRNA equivalent portion of the single guide RNA can be engineered to guide the Cas9 nuclease to target any desired sequence (see Jinek et al (2012) Science 337, p. 816-821, Jinek et al, (2013), eLife 2:e00471, and David Segal, (2013) eLife 2:e00563). Thus, the CRISPR/Cas system can be engineered to create a double-stranded break (DSB) at a desired target in a genome, and repair of the DSB can be influenced by the use of repair inhibitors to cause an increase in error prone repair.

In certain embodiments, Cas protein may be a "functional derivative" of a naturally occurring Cas protein. A "functional derivative" of a native sequence polypeptide is a compound having a qualitative biological property in common with a native sequence polypeptide. "Functional derivatives" include, but are not limited to, fragments of a native sequence and derivatives of a native sequence polypeptide and its fragments, provided that they have a biological activity in common with a corresponding native sequence polypeptide. A biological activity contemplated herein is the ability of the functional derivative to hydrolyze a DNA substrate into fragments. The term "derivative" encompasses both amino acid sequence variants of polypeptide, covalent modifications, and fusions thereof. Suitable derivatives of a Cas polypeptide or a fragment thereof include but are not limited to mutants, fusions, covalent modifications of Cas protein or a fragment thereof. Cas protein, which includes Cas protein or a fragment thereof, as well as derivatives of Cas protein or a fragment thereof, may be obtainable from a cell or synthesized chemically or by a combination of these two procedures. The cell may be a cell that naturally produces Cas protein, or a cell that naturally produces Cas protein and is genetically engineered to produce the endogenous Cas protein at a higher expression level or to produce a Cas protein from an exogenously introduced nucleic acid, which nucleic acid encodes a Cas that is same or different from the endogenous Cas. In some case, the cell does not naturally produce Cas protein and is genetically engineered to produce a Cas protein. The Cas protein is deployed in mammalian cells (and putatively within plant cells) by co-expressing the Cas nuclease with guide RNA. Two forms of guide RNAs can be used to facilitate Cas-mediated genome cleavage as disclosed in Le Cong, F., et al., (2013) Science 339(6121):819-823.

In other embodiments, the DNA-binding domain may be associated with a cleavage (nuclease) domain. For example, homing endonucleases may be modified in their DNA-binding specificity while retaining nuclease function. In addition, zinc finger proteins may also be fused to a cleavage domain to form a zinc finger nuclease (ZFN). The cleavage domain portion of the fusion proteins disclosed herein can be obtained from any endonuclease or exonuclease. Exemplary endonucleases from which a cleavage domain can be derived include, but are not limited to, restriction endonucleases and homing endonucleases. See, for example, 2002-2003 Catalogue, New England Biolabs, Beverly, Mass.; and Belfort et al. (1997) Nucleic Acids Res. 25:3379-3388. Additional enzymes which cleave DNA are known (e.g., S1 Nuclease; mung bean nuclease; pancreatic DNase I; micrococcal nuclease; yeast HO endonuclease; see also Linn et al. (eds.) Nucleases, Cold Spring Harbor Laboratory Press, 1993). Non limiting examples of homing endonucleases and meganucleases include I-SceI, I-CeuI, PI-PspI, PI-Sce, I-SceIV, I-CsmI, I-PanI, I-SceII, I-PpoI, I-SceIII, I-CreI, I-TevI, I-TevII and I-TevIII are known. See also U.S. Pat. No. 5,420,032; U.S. Pat. No. 6,833,252; Belfort et al. (1997) Nucleic Acids Res. 25:3379-3388; Dujon et al. (1989) Gene 82:115-118; Perler et al. (1994) Nucleic Acids Res. 22, 1125-1127; Jasin (1996) Trends Genet. 12:224-228; Gimble et al. (1996) J. Mol. Biol. 263:163-180; Argast et al. (1998) J. Mol. Biol. 280:345-353 and the New England Biolabs catalogue. One or more of these enzymes (or functional fragments thereof) can be used as a source of cleavage domains and cleavage half-domains.

Restriction endonucleases (restriction enzymes) are present in many species and are capable of sequence-specific binding to DNA (at a recognition site), and cleaving DNA at or near the site of binding. Certain restriction enzymes (e.g., Type IIS) cleave DNA at sites removed from the recognition site and have separable binding and cleavage domains. For example, the Type IIS enzyme FokI catalyzes double-stranded cleavage of DNA, at 9 nucleotides from its recognition site on one strand and 13 nucleotides from its recognition site on the other. See, for example, U.S. Pat. Nos. 5,356,802; 5,436,150 and 5,487,994; as well as Li et al. (1992) Proc. Natl. Acad. Sci. USA 89:4275-4279; Li et al. (1993) Proc. Natl. Acad. Sci. USA 90:2764-2768; Kim et al. (1994a) Proc. Natl. Acad. Sci. USA 91:883-887; Kim et al. (1994b) J. Biol. Chem. 269:31,978-31,982. Thus, in one embodiment, fusion proteins comprise the cleavage domain (or cleavage half-domain) from at least one Type IIS restriction enzyme and one or more zinc finger binding domains, which may or may not be engineered.

An exemplary Type IIS restriction enzyme, whose cleavage domain is separable from the binding domain, is FokI. This particular enzyme is active as a dimer. Bitinaite et al. (1998) Proc. Natl. Acad. Sci. USA 95: 10,570-10,575. Accordingly, for the purposes of the present disclosure, the portion of the FokI enzyme used in the disclosed fusion proteins is considered a cleavage half-domain. Thus, for targeted double-stranded cleavage and/or targeted replacement of cellular sequences using zinc finger-FokI fusions, two fusion proteins, each comprising a FokI cleavage half-domain, can be used to reconstitute a catalytically active cleavage domain. Alternatively, a single polypeptide molecule containing a zinc finger binding domain and two FokI cleavage half-domains can also be used. Parameters for targeted cleavage and targeted sequence alteration using zinc finger-FokI fusions are provided elsewhere in this disclosure.

A cleavage domain or cleavage half-domain can be any portion of a protein that retains cleavage activity, or that retains the ability to multimerize (e.g., dimerize) to form a functional cleavage domain. Exemplary Type IIS restriction enzymes are described in International Publication WO 2007/014275, incorporated by reference herein in its entirety.

To enhance cleavage specificity, cleavage domains may also be modified. In certain embodiments, variants of the cleavage half-domain are employed these variants minimize or prevent homodimerization of the cleavage half-domains. Non-limiting examples of such modified cleavage half-domains are described in detail in WO 2007/014275, incorporated by reference in its entirety herein. In certain embodiments, the cleavage domain comprises an engineered cleavage half-domain (also referred to as dimerization domain mutants) that minimize or prevent homodimerization. Such embodiments are known to those of skill the art and described for example in U.S. Patent Publication Nos. 20050064474; 20060188987; 20070305346 and 20080131962, the disclosures of all of which are incorporated by reference in their entireties herein. Amino acid residues at positions 446, 447, 479, 483, 484, 486, 487, 490, 491, 496, 498, 499, 500, 531, 534, 537, and 538 of FokI are all targets for influencing dimerization of the FokI cleavage half-domains.

Additional engineered cleavage half-domains of FokI that form obligate heterodimers can also be used in the ZFNs described herein. Exemplary engineered cleavage half-domains of Fok I that form obligate heterodimers include a pair in which a first cleavage half-domain includes mutations at amino acid residues at positions 490 and 538 of Fok I and a second cleavage half-domain includes mutations at amino acid residues 486 and 499. In one embodiment, a mutation at 490 replaces Glu (E) with Lys (K); the mutation at 538 replaces Iso (I) with Lys (K); the mutation at 486 replaced Gln (Q) with Glu (E); and the mutation at position 499 replaces Iso (I) with Lys (K). Specifically, the engineered cleavage half-domains described herein were prepared by mutating positions 490 (E→K) and 538 (I→K) in one cleavage half-domain to produce an engineered cleavage half-domain designated "E490K:I538K" and by mutating positions 486 (Q→E) and 499 (I→L) in another cleavage half-domain to produce an engineered cleavage half-domain designated "Q486E:I499L". The engineered cleavage half-domains described herein are obligate heterodimer mutants in which aberrant cleavage is minimized or abolished. See, e.g., U.S. Patent Publication No. 2008/0131962, the disclosure of which is incorporated by reference in its entirety for all purposes. In certain embodiments, the engineered cleavage half-domain comprises mutations at positions 486, 499 and 496 (numbered relative to wild-type FokI), for instance mutations that replace the wild type Gln (Q) residue at position 486 with a Glu (E) residue, the wild type Iso (I) residue at position 499 with a Leu (L) residue and the wild-type Asn (N) residue at position 496 with an Asp (D) or Glu (E) residue (also referred to as a "ELD" and "ELE" domains, respectively). In other embodiments, the engineered cleavage half-domain comprises mutations at positions 490, 538 and 537 (numbered relative to wild-type FokI), for instance mutations that replace the wild type Glu (E) residue at position 490 with a Lys (K) residue, the wild type Iso (I) residue at position 538 with a Lys (K) residue, and the wild-type His (H) residue at position 537 with a Lys (K) residue or a Arg (R) residue (also referred to as "KKK" and "KKR" domains, respectively). In other embodiments, the engineered cleavage half-domain comprises mutations at positions 490 and 537 (numbered relative to wild-type FokI), for instance mutations that replace the wild type Glu (E) residue at position 490 with a Lys (K) residue and the wild-type His (H) residue at position 537 with a Lys (K) residue or a Arg (R) residue (also referred to as "KIK" and "KR" domains, respectively). (See US Patent Publication No. 20110201055). In other embodiments, the engineered cleavage half domain comprises the "Sharkey" and/or "Sharkey'" mutations (see Guo et al, (2010) J. Mol. Biol. 400(1):96-107).

Engineered cleavage half-domains described herein can be prepared using any suitable method, for example, by site-directed mutagenesis of wild-type cleavage half-domains (Fok I) as described in U.S. Patent Publication Nos. 20050064474; 20080131962; and 20110201055. Alternatively, nucleases may be assembled in vivo at the nucleic acid target site using so-called "split-enzyme" technology (see e.g. U.S. Patent Publication No. 20090068164). Components of such split enzymes may be expressed either on separate expression constructs, or can be linked in one open reading frame where the individual components are separated, for example, by a self-cleaving 2A peptide or IRES sequence. Components may be individual zinc finger binding domains or domains of a meganuclease nucleic acid binding domain.

Nucleases can be screened for activity prior to use, for example in a yeast-based chromosomal system as described in WO 2009/042163 and 20090068164. Nuclease expression constructs can be readily designed using methods known in the art. See, e.g., United States Patent Publications 20030232410; 20050208489; 20050026157; 20050064474; 20060188987; 20060063231; and International Publication WO 07/014275. Expression of the nuclease may be under the control of a constitutive promoter or an inducible promoter, for example the galactokinase promoter which is activated (de-repressed) in the presence of raffinose and/or galactose and repressed in presence of glucose.

Distance between target sites refers to the number of nucleotides or nucleotide pairs intervening between two target sites as measured from the edges of the sequences nearest each other. In certain embodiments in which cleavage depends on the binding of two zinc finger domain/cleavage half-domain fusion molecules to separate target sites, the two target sites can be on opposite DNA strands. In other embodiments, both target sites are on the same DNA strand. For targeted integration into the optimal genomic locus, one or more ZFPs are engineered to bind a target site at or near the predetermined cleavage site, and a fusion protein comprising the engineered DNA-binding domain and a cleavage domain is expressed in the cell. Upon binding of the zinc finger portion of the fusion protein to the target site, the DNA is cleaved, preferably via a double-stranded break, near the target site by the cleavage domain.

The presence of a double-stranded break in the optimal genomic locus facilitates integration of exogenous sequences via homologous recombination. Thus, in one embodiment the polynucleotide comprising the nucleic acid sequence of interest to be inserted into the targeted genomic locus will include one or more regions of homology with the targeted genomic locus to facilitate homologous recombination.

In addition to the fusion molecules described herein, targeted replacement of a selected genomic sequence also involves the introduction of a donor sequence. The polynucleotide donor sequence can be introduced into the cell prior to, concurrently with, or subsequent to, expression of the fusion protein(s). The donor polynucleotide contains sufficient homology to the optimal genomic locus to support homologous recombination between it and the optimal genomic locus genomic sequence to which it bears homology. Approximately 25, 50, 100, 200, 500, 750, 1,000, 1,500, 2,000 nucleotides or more of sequence homology between a donor and a genomic sequence, or any integral value between 10 and 2,000 nucleotides or more, will support homologous recombination. In certain embodiments, the homology arms are less than 1,000 basepairs in length. In other embodiments, the homology arms are less than 750 base pairs in length. Additionally, donor polynucleotide sequences can comprise a vector molecule containing sequences that are not homologous to the region of interest in cellular chromatin. A donor polynucleotide molecule can contain several, discontinuous regions of homology to cellular chromatin. For example, for targeted insertion of sequences not normally present in a region of interest, said sequences can be present in a donor nucleic acid molecule and flanked by regions of homology to sequence in the region of interest. The donor polynucleotide can be DNA or RNA, single-stranded or double-stranded and can be introduced into a cell in linear or circular form. See, e.g., U.S. Patent Publication Nos. 20100047805, 20110281361, 20110207221 and U.S. application Ser. No. 13/889,162. If introduced in linear form, the ends of the donor sequence can be protected (e.g., from exonucleolytic degradation) by methods known to those of skill in the art. For example, one or more dideoxynucleotide residues are added to the 3' terminus of a linear molecule and/or self-complementary oligonucleotides are ligated to one or both ends. See, for example, Chang et al. (1987) *Proc. Natl. Acad. Sci. USA* 84:4959-4963; Nehls et al. (1996) *Science* 272:886-889. Additional methods for protecting exogenous polynucleotides from degradation include, but are not limited to, addition of terminal amino group(s) and the use of modified internucleotide linkages such as, for example, phosphorothioates, phosphoramidates, and O-methyl ribose or deoxyribose residues.

In accordance with one embodiment a method of preparing a transgenic dicot plant, such as a soybean plant, is provided wherein a DNA of interest has been inserted into an optimal nongenic soybean genomic locus. The method comprises the steps of:
 a. selecting an optimal nongenic soybean locus as a target for insertion of the nucleic acid of interest;
 b. introducing a site specific nuclease into a dicot plant cell, such as a soybean plant cell, wherein the site specific nuclease cleaves the nongenic sequence;
 c. introducing the DNA of interest into the plant cell; and
 d. selecting transgenic plant cells comprising the DNA of interest targeted to said nongenic sequence.

In accordance with one embodiment a method of preparing a transgenic dicot protoplast cell, like a soybean protoplast cell, is provided wherein a DNA of interest has been inserted into an optimal nongenic soybean genomic locus. The method comprises the steps of:
 a. selecting an optimal nongenic soybean locus as a target for insertion of the nucleic acid of interest;
 b. introducing a site specific nuclease into a dicot protoplast cell, like a soybean protoplast cell, wherein the site specific nuclease cleaves the nongenic sequence;
 c. introducing the DNA of interest into the dicot protoplast cell, like a soybean protoplast cell; and
 d. selecting the transgenic dicot protoplast cell, like a soybean protoplast cell, comprising the DNA of interest targeted to said nongenic sequence.

In one embodiment the site specific nuclease is selected from the group consisting of a Zinc Finger nuclease, a CRISPR nuclease, a TALEN nuclease, or a meganuclease, and more particularly in one embodiment the site specific nuclease is a Zinc Finger nuclease. In accordance with one embodiment the DNA of interest is integrated within said nongenic sequence via a homology directed repair integration method. Alternatively, in some embodiments the DNA of interest is integrated within said nongenic sequence via a non-homologous end joining integration method. In additional embodiments, the DNA of interest is integrated within said nongenic sequence via a previously undescribed integration method. In one embodiment the method comprises selecting a optimal nongenic soybean genomic locus for targeted insertion of a DNA of interest that has the following characteristics:

a. the nongenic sequence is at least 1 Kb in length and does not contain greater than 1% DNA methylation within the sequence
 b. the nongenic sequence exhibits a 0.01574 to 83.52 cM/Mb rate of recombination within the dicot genome, like a soybean genome;
 c. the nongenic sequence exhibits a 0 to 0.494 level of nucleosome occupancy of the dicot genome, like a soybean genome;
 d. the nongenic sequence shares less than 40% sequence identity with any other sequence contained in the dicot genome, like a soybean genome;
 e. the nongenic sequence has a relative location value from 0 to 0.99682 ratio of genomic distance from a dicot chromosomal centromere, like soybean;
 f. the nongenic sequence has a guanine/cytosine percent content range of 14.4 to 45.9%;
 g. the nongenic sequence is located proximally to a genic sequence; and,
 h. a 1 Mb region of dicot genomic sequence, like a soybean genomic sequence, comprising said nongenic sequence comprises one or more additional nongenic sequences. In one embodiment the optimal nongenic soybean locus is selected from a loci of cluster 1, 2, 3, 4, 5, 6, 7, 8, 9, 10, 11, 2, 3, 4, 5, 6, 7, 8, 9, 20, 21, 22, 23, 24, 25, 26, 27, 28, 29, 30, 31 or 32.

Delivery

The donor molecules disclosed herein are integrated into a genome of a cell via targeted, homology-independent and/or homology-dependent methods. For such targeted integration, the genome is cleaved at a desired location (or locations) using a nuclease, for example, a fusion between a DNA-binding domain (e.g., zinc finger binding domain, CRISPR or TAL effector domain is engineered to bind a target site at or near the predetermined cleavage site) and nuclease domain (e.g., cleavage domain or cleavage half-domain). In certain embodiments, two fusion proteins, each comprising a DNA-binding domain and a cleavage half-domain, are expressed in a cell, and bind to target sites which are juxtaposed in such a way that a functional cleavage domain is reconstituted and DNA is cleaved in the vicinity of the target sites. In one embodiment, cleavage occurs between the target sites of the two DNA-binding domains. One or both of the DNA-binding domains can be engineered. See, also, U.S. Pat. No. 7,888,121; U.S. Patent Publication 20050064474 and International Patent Publications WO05/084190, WO05/014791 and WO 03/080809.

The nucleases as described herein can be introduced as polypeptides and/or polynucleotides. For example, two polynucleotides, each comprising sequences encoding one of the aforementioned polypeptides, can be introduced into a cell, and when the polypeptides are expressed and each binds to its target sequence, cleavage occurs at or near the target sequence. Alternatively, a single polynucleotide comprising sequences encoding both fusion polypeptides is introduced into a cell. Polynucleotides can be DNA, RNA or any modified forms or analogues or DNA and/or RNA.

Following the introduction of a double-stranded break in the region of interest, the transgene is integrated into the region of interest in a targeted manner via non-homology dependent methods (e.g., non-homologous end joining (NHEJ)) following linearization of a double-stranded donor molecule as described herein. The double-stranded donor is preferably linearized in vivo with a nuclease, for example one or more of the same or different nucleases that are used to introduce the double-stranded break in the genome. Synchronized cleavage of the chromosome and the donor in the cell may limit donor DNA degradation (as compared to linearization of the donor molecule prior to introduction into the cell). The nuclease target sites used for linearization of the donor preferably do not disrupt the transgene(s) sequence(s).

The transgene may be integrated into the genome in the direction expected by simple ligation of the nuclease overhangs (designated "forward" or "AB" orientation) or in the alternate direction (designated "reverse" or "BA" orientation). In certain embodiments, the transgene is integrated following accurate ligation of the donor and chromosome overhangs. In other embodiments, integration of the transgene in either the BA or AB orientation results in deletion of several nucleotides.

Through the application of techniques such as these, the cells of virtually any species may be stably transformed. In some embodiments, transforming DNA is integrated into the genome of the host cell. In the case of multicellular species, transgenic cells may be regenerated into a transgenic organism. Any of these techniques may be used to produce a transgenic plant, for example, comprising one or more donor polynucleotide acid sequences in the genome of the transgenic plant.

The delivery of nucleic acids may be introduced into a plant cell in embodiments of the invention by any method known to those of skill in the art, including, for example and without limitation: by transformation of protoplasts (See, e.g., U.S. Pat. No. 5,508,184); by desiccation/inhibition-mediated DNA uptake (See, e.g., Potrykus et al. (1985) Mol. Gen. Genet. 199:183-8); by electroporation (See, e.g., U.S. Pat. No. 5,384,253); by agitation with silicon carbide fibers (See, e.g., U.S. Pat. Nos. 5,302,523 and 5,464,765); by Agrobacterium-mediated transformation (See, e.g., U.S. Pat. Nos. 5,563,055, 5,591,616, 5,693,512, 5,824,877, 5,981, 840, and 6,384,301); by acceleration of DNA-coated particles (See, e.g., U.S. Pat. Nos. 5,015,580, 5,550,318, 5,538, 880, 6,160,208, 6,399,861, and 6,403,865) and by Nanoparticles, nanocarriers and cell penetrating peptides (WO201126644A2; WO2009046384A1; WO2008148223A1) in the methods to deliver DNA, RNA, Peptides and/or proteins or combinations of nucleic acids and peptides into plant cells.

The most widely-utilized method for introducing an expression vector into plants is based on the natural transformation system of Agrobacterium. A. tumefaciens and A. rhizogenes are plant pathogenic soil bacteria that genetically transform plant cells. The $T_i$ and $R_i$ plasmids of A. tumefaciens and A. rhizogenes, respectively, carry genes responsible for genetic transformation of the plant. The $T_i$ (tumor-inducing)-plasmids contain a large segment, known as T-DNA, which is transferred to transformed plants. Another segment of the $T_i$ plasmid, the vir region, is responsible for T-DNA transfer. The T-DNA region is bordered by left-hand and right-hand borders that are each composed of terminal repeated nucleotide sequences. In some modified binary vectors, the tumor-inducing genes have been deleted, and the functions of the vir region are utilized to transfer foreign DNA bordered by the T-DNA border sequences. The T-region may also contain, for example, a selectable marker for efficient recovery of transgenic plants and cells, and a multiple cloning site for inserting sequences for transfer such as a nucleic acid encoding a fusion protein of the invention.

Thus, in some embodiments, a plant transformation vector is derived from a $T_i$ plasmid of A. tumefaciens (See, e.g., U.S. Pat. Nos. 4,536,475, 4,693,977, 4,886,937, and 5,501, 967; and European Patent EP 0 122 791) or a $R_i$ plasmid of A. rhizogenes. Additional plant transformation vectors include, for example and without limitation, those described by Herrera-Estrella et al. (1983) Nature 303:209-13; Bevan et al. (1983), supra; Klee et al. (1985) Bio/Technol. 3:637-42; and in European Patent EP 0 120 516, and those derived from any of the foregoing. Other bacteria, such as Sinorhizobium, Rhizobium, and Mesorhizobium, that naturally interact with plants can be modified to mediate gene transfer to a number of diverse plants. These plant-associated symbiotic bacteria can be made competent for gene transfer by acquisition of both a disarmed $T_i$ plasmid and a suitable binary vector.

The Nucleic Acid of Interest

The polynucleotide donor sequences for targeted insertion into a genomic locus of a dicot plant, like a soybean plant, typically range in length from about 10 to about 5,000 nucleotides. However, nucleotides substantially longer, up to 20,000 nucleotides can be used, including sequences of about 5, 6, 7, 8, 9, 10, 11 and 12 Kb in length. Additionally, donor sequences can comprise a vector molecule containing sequences that are not homologous to the replaced region. In one embodiment the nucleic acid of interest will include one or more regions that share homology with the targeted genomic loci. Generally, the homologous region(s) of the nucleic acid sequence of interest will have at least 50% sequence identity to a genomic sequence with which recombination is desired. In certain embodiments, the homologous region(s) of the nucleic acid of interest shares 60%, 70%, 80%, 90%, 95%, 98%, 99%, or 99.9% sequence identity with sequences located in the targeted genomic locus. However, any value between 1% and 100% sequence identity can be present, depending upon the length of the nucleic acid of interest.

A nucleic acid of interest can contain several, discontinuous regions of sequence sharing relatively high sequence identity to cellular chromatin. For example, for targeted insertion of sequences not normally present in a targeted genomic locus, the unique sequences can be present in a donor nucleic acid molecule and flanked by regions of sequences that share a relatively high sequence identity to a sequence present in the targeted genomic locus.

A nucleic acid of interest can also be inserted into a targeted genomic locus to serve as a reservoir for later use. For example, a first nucleic acid sequence comprising sequences homologous to a nongenic region of the genome of a dicot plant, like a soybean plant, but containing a nucleic acid of interest (optionally encoding a ZFN under the control of an inducible promoter), may be inserted in a targeted genomic locus. Next, a second nucleic acid sequence is introduced into the cell to induce the insertion of a DNA of interest into an optimal nongenic genomic locus of a dicot plant, like a soybean plant. Either the first nucleic acid sequence comprises a ZFN specific to the optimal nongenic soybean genomic locus and the second nucleic acid sequence comprises the DNA sequence of interest, or vice versa. In one embodiment the ZFN will cleave both the optimal nongenic soybean genomic locus and the nucleic acid of interest. The resulting double stranded break in the genome can then become the integration site for the nucleic acid of interest released from the optimal genomic locus. Alternatively, expression of a ZFN already located in the genome can be induced after introduction of the DNA of interest to induce a double stranded break in the genome that can then become the integration site for the introduced nucleic acid of interest. In this way, the efficiency of targeted integration of a DNA of interest at any region of interest may be improved since the method does not rely on simultaneous uptake of both the nucleic acids encoding the ZFNs and the DNA of interest.

A nucleic acid of interest can also be inserted into an optimal nongenic soybean genomic locus to serve as a target site for subsequent insertions. For example, a nucleic acid of interest comprised of DNA sequences that contain recognition sites for additional ZFN designs may be inserted into the locus. Subsequently, additional ZFN designs may be generated and expressed in cells such that the original nucleic acid of interest is cleaved and modified by repair or homologous recombination. In this way, reiterative integrations of nucleic acid of interests may occur at the optimal nongenic genomic locus of a dicot plant, like a soybean plant.

Exemplary exogenous sequences that can be inserted into an optimal nongenic soybean genomic locus include, but are not limited to, any polypeptide coding sequence (e.g., cDNAs), promoter, enhancer and other regulatory sequences (e.g., interfering RNA sequences, shRNA expression cassettes, epitope tags, marker genes, cleavage enzyme recognition sites and various types of expression constructs. Such sequences can be readily obtained using standard molecular biological techniques (cloning, synthesis, etc.) and/or are commercially available.

To express ZFNs, sequences encoding the fusion proteins are typically subcloned into an expression vector that contains a promoter to direct transcription. Suitable prokaryotic and eukaryotic promoters are well known in the art and described, e.g., in Sambrook et al., Molecular Cloning, A Laboratory Manual (2nd ed. 1989; 3.sup.rd ed., 2001); Kriegler, Gene Transfer and Expression: A Laboratory Manual (1990); and Current Protocols in Molecular Biology (Ausubel et al., supra. Bacterial expression systems for expressing the ZFNs are available in, e.g., *E. coli, Bacillus* sp., and *Salmonella* (Palva et al., Gene 22:229-235 (1983)). Kits for such expression systems are commercially available. Eukaryotic expression systems for mammalian cells, yeast, and insect cells are well known by those of skill in the art and are also commercially available.

The particular expression vector used to transport the genetic material into the cell is selected with regard to the intended use of the fusion proteins, e.g., expression in plants, animals, bacteria, fungus, protozoa, etc. (see expression vectors described below). Standard bacterial and animal expression vectors are known in the art and are described in detail, for example, U.S. Patent Publication 20050064474A1 and International Patent Publications WO05/084190, WO05/014791 and WO03/080809.

Standard transfection methods can be used to produce bacterial, mammalian, yeast or insect cell lines that express large quantities of protein, which can then be purified using standard techniques (see, e.g., Colley et al., J. Biol. Chem. 264:17619-17622 (1989); Guide to Protein Purification, in Methods in Enzymology, vol. 182 (Deutscher, ed., 1990)). Transformation of eukaryotic and prokaryotic cells are performed according to standard techniques (see, e.g., Morrison, J. Bact. 132:349-351 (1977); Clark-Curtiss & Curtiss, Methods in Enzymology 101:347-362 (Wu et al., eds., 1983).

The disclosed methods and compositions can be used to insert polynucleotide donor sequences into a predetermined location such as one of the optimal nongenic soybean genomic loci. This is useful inasmuch as expression of an introduced transgene into the soybean genome depends critically on its integration site. Accordingly, genes encoding herbicide tolerance, insect resistance, nutrients, antibiotics or therapeutic molecules can be inserted, by targeted recombination.

In one embodiment the nucleic acid of interest is combined or "stacked" with gene encoding sequences that provide additional resistance or tolerance to glyphosate or another herbicide, and/or provides resistance to select insects or diseases and/or nutritional enhancements, and/or improved agronomic characteristics, and/or proteins or other products useful in feed, food, industrial, pharmaceutical or other uses. The "stacking" of two or more nucleic acid sequences of interest within a plant genome can be accomplished, for example, via conventional plant breeding using two or more events, transformation of a plant with a construct which contains the sequences of interest, re-transformation of a transgenic plant, or addition of new traits through targeted integration via homologous recombination.

Such polynucleotide donor nucleotide sequences of interest include, but are not limited to, those examples provided below:

1. Genes or Coding Sequence (e.g. iRNA) That Confer Resistance to Pests or Disease (A) Plant Disease Resistance Genes. Plant defenses are often activated by specific interaction between the product of a disease resistance gene (R) in the plant and the product of a corresponding avirulence (Avr) gene in the pathogen. A plant variety can be transformed with cloned resistance gene to engineer plants that are resistant to specific pathogen strains. Examples of such genes include, the tomato Cf-9 gene for resistance to *Cladosporium fulvum* (Jones et al., 1994 Science 266:789), tomato Pto gene, which encodes a protein kinase, for resistance to *Pseudomonas syringae* pv. tomato (Martin et al., 1993 Science 262:1432), and *Arabidopsis* RSSP2 gene for resistance to *Pseudomonas syringae* (Mindrinos et al., 1994 Cell 78:1089).

(B) A *Bacillus thuringiensis* protein, a derivative thereof or a synthetic polypeptide modeled thereon, such as, a nucleotide sequence of a Bt δ-endotoxin gene (Geiser et al., 1986 Gene 48:109), and a vegetative insecticidal (VIP) gene (see, e.g., Estruch et al. (1996) Proc. Natl. Acad. Sci. 93:5389-94). Moreover, DNA molecules encoding δ-endotoxin genes can be purchased from American Type Culture Collection (Rockville, Md.), under ATCC accession numbers 40098, 67136, 31995 and 31998.

(C) A lectin, such as, nucleotide sequences of several *Clivia miniata* mannose-binding lectin genes (Van Damme et al., 1994 Plant Molec. Biol. 24:825).

(D) A vitamin binding protein, such as avidin and avidin homologs which are useful as larvicides against insect pests. See U.S. Pat. No. 5,659,026.

(E) An enzyme inhibitor, e.g., a protease inhibitor or an amylase inhibitor. Examples of such genes include a rice cysteine proteinase inhibitor (Abe et al., 1987 J. Biol. Chem. 262:16793), a tobacco proteinase inhibitor I (Huub et al., 1993 Plant Molec. Biol. 21:985), and an α-amylase inhibitor (Sumitani et al., 1993 Biosci. Biotech. Biochem. 57:1243).

(F) An insect-specific hormone or pheromone such as an ecdysteroid and juvenile hormone a variant thereof, a mimetic based thereon, or an antagonist or agonist thereof, such as baculovirus expression of cloned juvenile hormone esterase, an inactivator of juvenile hormone (Hammock et al., 1990 Nature 344:458).

(G) An insect-specific peptide or neuropeptide which, upon expression, disrupts the physiology of the affected pest (J. Biol. Chem. 269:9). Examples of such genes include an insect diuretic hormone receptor (Regan, 1994), an allostatin identified in *Diploptera punctata* (Pratt, 1989), and insect-specific, paralytic neurotoxins (U.S. Pat. No. 5,266,361).

(H) An insect-specific venom produced in nature by a snake, a wasp, etc., such as a scorpion insectotoxic peptide (Pang, 1992 Gene 116:165).

(I) An enzyme responsible for a hyperaccumulation of monoterpene, a sesquiterpene, a steroid, hydroxamic acid, a phenylpropanoid derivative or another non-protein molecule with insecticidal activity.

(J) An enzyme involved in the modification, including the post-translational modification, of a biologically active molecule; for example, glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic. Examples of such genes include, a callas gene (PCT published application WO93/02197), chitinase-encoding sequences (which can be obtained, for example, from the ATCC under accession numbers 3999637 and 67152), tobacco hookworm chitinase (Kramer et al., 1993 Insect Molec. Biol. 23:691), and parsley ubi4-2 polyubiquitin gene (Kawalleck et al., 1993 Plant Molec. Biol. 21:673).

(K) A molecule that stimulates signal transduction. Examples of such molecules include nucleotide sequences for mung bean calmodulin cDNA clones (Botella et al., 1994 Plant Molec. Biol. 24:757) and a nucleotide sequence of a soybean calmodulin cDNA clone (Griess et al., 1994 Plant Physiol. 104:1467).

(L) A hydrophobic moment peptide. See U.S. Pat. Nos. 5,659,026 and 5,607,914; the latter teaches synthetic antimicrobial peptides that confer disease resistance.

(M) A membrane permease, a channel former or a channel blocker, such as a cecropin-β lytic peptide analog (Jaynes et al., 1993 Plant Sci. 89:43) which renders transgenic tobacco plants resistant to *Pseudomonas solanacearum*.

(N) A viral-invasive protein or a complex toxin derived therefrom. For example, the accumulation of viral coat proteins in transformed plant cells imparts resistance to viral infection and/or disease development effected by the virus from which the coat protein gene is derived, as well as by related viruses. Coat protein-mediated resistance has been conferred upon transformed plants against alfalfa mosaic virus, cucumber mosaic virus, tobacco streak virus, potato virus X, potato virus Y, tobacco etch virus, tobacco rattle virus and tobacco mosaic virus. See, for example, Beachy et al. (1990) Ann. Rev. Phytopathol. 28:451.

(O) An insect-specific antibody or an immunotoxin derived therefrom. Thus, an antibody targeted to a critical metabolic function in the insect gut would inactivate an affected enzyme, killing the insect. For example, Taylor et al. (1994) Abstract #497, Seventh Int'l. Symposium on Molecular Plant-Microbe Interactions shows enzymatic inactivation in transgenic tobacco via production of single-chain antibody fragments.

(P) A virus-specific antibody. See, for example, Tavladoraki et al. (1993) Nature 266:469, which shows that transgenic plants expressing recombinant antibody genes are protected from virus attack.

(Q) A developmental-arrestive protein produced in nature by a pathogen or a parasite. Thus, fungal endo α-1,4-D polygalacturonases facilitate fungal colonization and plant nutrient release by solubilizing plant cell wall homo-α-1,4-D-galacturonase (Lamb et al., 1992) Bio/Technology 10:1436. The cloning and characterization of a gene which encodes a bean endopolygalacturonase-inhibiting protein is described by Toubart et al. (1992 Plant J. 2:367).

(R) A developmental-arrestive protein produced in nature by a plant, such as the barley ribosome-inactivating gene that provides an increased resistance to fungal disease (Longemann et al., 1992). Bio/Technology 10:3305.

(S) RNA interference, in which an RNA molecule is used to inhibit expression of a target gene. An RNA molecule in one example is partially or fully double stranded, which triggers a silencing response, resulting in cleavage of dsRNA into small interfering RNAs, which are then incorporated into a targeting complex that destroys homologous mRNAs. See, e.g., Fire et al., U.S. Pat. No. 6,506,559; Graham et al. U.S. Pat. No. 6,573,099.

2. Genes That Confer Resistance to a Herbicide (A) Genes encoding resistance or tolerance to a herbicide that inhibits the growing point or meristem, such as an imidazalinone, sulfonanilide or sulfonylurea herbicide. Exemplary genes in this category code for mutant acetolactate synthase (ALS) (Lee et al., 1988 EMBO J. 7:1241) also known as acetohydroxyacid synthase (AHAS) enzyme (Miki et al., 1990 Theor. Appl. Genet. 80:449).

(B) One or more additional genes encoding resistance or tolerance to glyphosate imparted by mutant EPSP synthase and aroA genes, or through metabolic inactivation by genes such as DGT-28, 2mEPSPS, GAT (glyphosate acetyltransferase) or GOX (glyphosate oxidase) and other phosphono compounds such as glufosinate (pat, bar, and dsm-2 genes), and aryloxyphenoxypropionic acids and cyclohexanediones (ACCase inhibitor encoding genes). See, for example, U.S. Pat. No. 4,940,835, which discloses the nucleotide sequence of a form of EPSP which can confer glyphosate resistance. A DNA molecule encoding a mutant aroA gene can be obtained under ATCC Accession Number 39256, and the nucleotide sequence of the mutant gene is disclosed in U.S. Pat. No. 4,769,061. European patent application No. 0 333 033 and U.S. Pat. No. 4,975,374 disclose nucleotide sequences of glutamine synthetase genes which confer resistance to herbicides such as L-phosphinothricin. The nucleotide sequence of a phosphinothricinacetyl-transferase gene is provided in European application No. 0 242 246. De Greef et al. (1989) Bio/Technology 7:61 describes the production of transgenic plants that express chimeric bar genes coding for phosphinothricin acetyl transferase activity. Exemplary of genes conferring resistance to aryloxyphenoxypropionic acids and cyclohexanediones, such as sethoxydim and haloxyfop, are the Accl-S1, Accl-S2 and Accl-S3 genes described by Marshall et al. (1992) Theor. Appl. Genet. 83:435.

(C) Genes encoding resistance or tolerance to a herbicide that inhibits photosynthesis, such as a triazine (psbA and gs+ genes) and a benzonitrile (nitrilase gene). Przibilla et al. (1991) Plant Cell 3:169 describe the use of plasmids encoding mutant psbA genes to transform *Chlamydomonas*. Nucleotide sequences for nitrilase genes are disclosed in U.S. Pat. No. 4,810,648, and DNA molecules containing these genes are available under ATCC accession numbers 53435, 67441 and 67442. Cloning and expression of DNA coding for a glutathione S-transferase is described by Hayes et al. (1992) Biochem. J. 285:173.

(D) Genes encoding resistance or tolerance to a herbicide that bind to hydroxyphenylpyruvate dioxygenases (HPPD), enzymes which catalyze the reaction in which para-hydroxyphenylpyruvate (HPP) is transformed into homogentisate. This includes herbicides such as isoxazoles (EP418175, EP470856, EP487352, EP527036, EP560482, EP682659, U.S. Pat. No. 5,424,276), in particular isoxaflutole, which is a selective herbicide for soybean, diketonitriles (EP496630, EP496631), in particular 2-cyano-3-cyclopropyl-1-(2-

SO2CH3-4-CF3 phenyl)propane-1,3-dione and 2-cyano-3-cyclopropyl-1-(2-SO2CH3-4-2,3Cl2phenyl)propane-1,3-dione, triketones (EP625505, EP625508, U.S. Pat. No. 5,506,195), in particular sulcotrione, and pyrazolinates. A gene that produces an overabundance of HPPD in plants can provide tolerance or resistance to such herbicides, including, for example, genes described in U.S. Pat. Nos. 6,268,549 and 6,245,968 and U.S. patent application, Publication No. 20030066102.

(E) Genes encoding resistance or tolerance to phenoxy auxin herbicides, such as 2,4-dichlorophenoxyacetic acid (2,4-D) and which may also confer resistance or tolerance to aryloxyphenoxypropionate (AOPP) herbicides. Examples of such genes include the α-ketoglutarate-dependent dioxygenase enzyme (aad-1) gene, described in U.S. Pat. No. 7,838,733.

(F) Genes encoding resistance or tolerance to phenoxy auxin herbicides, such as 2,4-dichlorophenoxyacetic acid (2,4-D) and which may also confer resistance or tolerance to pyridyloxy auxin herbicides, such as fluroxypyr or triclopyr. Examples of such genes include the α-ketoglutarate-dependent dioxygenase enzyme gene (aad-12), described in WO 2007/053482 A2.

(G) Genes encoding resistance or tolerance to dicamba (see, e.g., U.S. Patent Publication No. 20030135879).

(H) Genes providing resistance or tolerance to herbicides that inhibit protoporphyrinogen oxidase (PPO) (see U.S. Pat. No. 5,767,373).

(I) Genes providing resistance or tolerance to triazine herbicides (such as atrazine) and urea derivatives (such as diuron) herbicides which bind to core proteins of photosystem II reaction centers (PS II) (See Brussian et al., (1989) EMBO J. 1989, 8(4): 1237-1245.

3. Genes That Confer or Contribute to a Value-Added Trait (A) Modified fatty acid metabolism, for example, by transforming soybean or *Brassica* with an antisense gene or stearoyl-ACP desaturase to increase stearic acid content of the plant (Knultzon et al., 1992) Proc. Nat. Acad. Sci. USA 89:2624.

(B) Decreased Phytate Content (1) Introduction of a phytase-encoding gene, such as the *Aspergillus niger* phytase gene (Van Hartingsveldt et al., 1993 Gene 127:87), enhances breakdown of phytate, adding more free phosphate to the transformed plant.

(2) A gene could be introduced that reduces phytate content. In dicots, this, for example, could be accomplished by cloning and then reintroducing DNA associated with the single allele which is responsible for soybean mutants characterized by low levels of phytic acid (Raboy et al., 1990 Maydica 35:383).

(C) Modified carbohydrate composition effected, for example, by transforming plants with a gene coding for an enzyme that alters the branching pattern of starch. Examples of such enzymes include, *Streptococcus* mucus fructosyltransferase gene (Shiroza et al., 1988) J. Bacteriol. 170:810, *Bacillus subtilis* levansucrase gene (Steinmetz et al., 1985 Mol. Gen. Genel. 200:220), *Bacillus licheniformis* α-amylase (Pen et al., 1992 Bio/Technology 10:292), tomato invertase genes (Elliot et al., 1993), barley amylase gene (Sogaard et al., 1993 J. Biol. Chem. 268:22480), and soybean endosperm starch branching enzyme II (Fisher et al., 1993 Plant Physiol. 102:10450).

III. Recombinant Constructs

As disclosed herein the present disclosure provides recombinant genomic sequences comprising an optimal nongenic soybean genomic sequence of at least 1 Kb and a DNA of interest, wherein the inserted DNA of interest is inserted into said nongenic sequence. In one embodiment the DNA of interest is an analytical domain, a gene or coding sequence (e.g. iRNA) that confers resistance to pests or disease, genes that confer resistance to a herbicide or genes that confer or contribute to a value-added trait, and the optimal nongenic soybean genomic sequence comprises the following characteristics:

a. the nongenic sequence is about 1 Kb to about 5.7 Kb in length and does not contain a methylated polynucleotide;

b. the nongenic sequence exhibits a 0.01574 to 83.52 cM/Mb rate of recombination within the genome of a dicot plant, like a soybean plant;

c. the nongenic sequence exhibits a 0 to 0.494 level of nucleosome occupancy of the dicot genome, like a soybean genome;

d. the nongenic sequence shares less than 40% sequence identity with any other sequence contained in the dicot genome, like a soybean genome;

e. the nongenic sequence has a relative location value from 0 to 0.99682 ratio of genomic distance from a dicot chromosomal centromere, like a soybean chromosomal center;

f. the nongenic sequence has a guanine/cytosine percent content range of 14.4 to 45.9%;

g. the nongenic sequence is located proximally to an genic sequence, comprising a known or predicted dicot coding sequence, such as a soybean coding sequence, within 40 Kb of contiguous genomic DNA comprising the native nongenic sequence; and, h. the nongenic sequence is located in a 1 Mb region of dicot genomic sequence, such as a genomic sequence, that comprises at least a second nongenic sequence.

In one embodiment the optimal nongenic soybean genomic sequence is further characterized as having a genic region comprisings 1 to 18 known or predicted soybean coding sequence within 40 Kb of contiguous genomic DNA comprising the native nongenic sequence. In one embodiment the optimal nongenic soybean locus is selected from a loci of cluster 1, 2, 3, 4, 5, 6, 7, 8, 9, 10, 11, 2, 3, 4, 5, 6, 7, 8, 9, 20, 21, 22, 23, 24, 25, 26, 27, 28, 29, 30, 31 or 32.

IV. Transgenic Plants

Transgenic plants comprising the recombinant optimal nongenic soybean loci are also provided in accordance with one embodiment of the present disclosure. Such transgenic plants can be prepared using techniques known to those skilled in the art.

A transformed dicot cell, callus, tissue or plant (i.e., a soybean cell, callus, tissue or plant) may be identified and isolated by selecting or screening the engineered plant material for traits encoded by the marker genes present on the transforming DNA. For instance, selection can be performed by growing the engineered plant material on media containing an inhibitory amount of the antibiotic or herbicide to which the transforming gene construct confers resistance. Further, transformed cells can also be identified by screening for the activities of any visible marker genes (e.g., the yellow fluorescence protein, green fluorescence protein, red fluorescence protein, beta-glucuronidase, luciferase, B or Cl genes) that may be present on the recombinant nucleic acid constructs. Such selection and screening methodologies are well known to those skilled in the art.

Physical and biochemical methods also may be used to identify plant or plant cell transformants containing inserted gene constructs. These methods include but are not limited to: 1) Southern analysis or PCR amplification for detecting and determining the structure of the recombinant DNA insert; 2) Northern blot, 51 RNase protection, primer-extension or reverse transcriptase-PCR amplification for detecting and examining RNA transcripts of the gene constructs; 3) enzymatic assays for detecting enzyme or ribozyme activity, where such gene products are encoded by the gene construct; 4) protein gel electrophoresis, Western blot techniques, immunoprecipitation, or enzyme-linked immunoassays (ELISA), where the gene construct products are proteins. Additional techniques, such as in situ hybridization, enzyme staining, and immunostaining, also may be used to detect the presence or expression of the recombinant construct in specific plant organs and tissues. The methods for doing all these assays are well known to those skilled in the art.

Effects of gene manipulation using the methods disclosed herein can be observed by, for example, Northern blots of the RNA (e.g., mRNA) isolated from the tissues of interest. Typically, if the mRNA is present or the amount of mRNA has increased, it can be assumed that the corresponding transgene is being expressed. Other methods of measuring gene and/or encoded polypeptide activity can be used. Different types of enzymatic assays can be used, depending on the substrate used and the method of detecting the increase or decrease of a reaction product or by-product. In addition, the levels of polypeptide expressed can be measured immunochemically, i.e., ELISA, RIA, EIA and other antibody based assays well known to those of skill in the art, such as by electrophoretic detection assays (either with staining or western blotting). As one non-limiting example, the detection of the AAD-12 (aryloxyalkanoate dioxygenase; see WO 2011/066360) and PAT (phosphinothricin-N-acetyl-transferase (PAT)) proteins using an ELISA assay is described in U.S. Patent Publication No. 20090093366 which is herein incorporated by reference in its entirety. The transgene may be selectively expressed in some tissues of the plant or at some developmental stages, or the transgene may be expressed in substantially all plant tissues, substantially along its entire life cycle. However, any combinatorial expression mode is also applicable.

One of skill in the art will recognize that after the exogenous polynucleotide donor sequence is stably incorporated in transgenic plants and confirmed to be operable, it can be introduced into other plants by sexual crossing. Any of a number of standard breeding techniques can be used, depending upon the species to be crossed.

The present disclosure also encompasses seeds of the transgenic plants described above wherein the seed has the transgene or gene construct. The present disclosure further encompasses the progeny, clones, cell lines or cells of the transgenic plants described above wherein the progeny, clone, cell line or cell has the transgene or gene construct.

Transformed plant cells which are produced by any of the above transformation techniques can be cultured to regenerate a whole plant which possesses the transformed genotype and thus the desired phenotype. Such regeneration techniques rely on manipulation of certain phytohormones in a tissue culture growth medium, typically relying on a biocide and/or herbicide marker which has been introduced together with the desired nucleotide sequences. Plant regeneration from cultured protoplasts is described in Evans, et al., "Protoplasts Isolation and Culture" in Handbook of Plant Cell Culture, pp. 124-176, Macmillan Publishing Company, New York, 1983; and Binding, Regeneration of Plants, Plant Protoplasts, pp. 21-73, CRC Press, Boca Raton, 1985. Regeneration can also be obtained from plant callus, explants, organs, pollens, embryos or parts thereof. Such regeneration techniques are described generally in Klee et al. (1987) Ann. Rev. of Plant Phys. 38:467-486.

A transgenic plant or plant material comprising a nucleotide sequence encoding a polypeptide may in some embodiments exhibit one or more of the following characteristics: expression of the polypeptide in a cell of the plant; expression of a portion of the polypeptide in a plastid of a cell of the plant; import of the polypeptide from the cytosol of a cell of the plant into a plastid of the cell; plastid-specific expression of the polypeptide in a cell of the plant; and/or localization of the polypeptide in a cell of the plant. Such a plant may additionally have one or more desirable traits other than expression of the encoded polypeptide. Such traits may include, for example: resistance to insects, other pests, and disease-causing agents; tolerances to herbicides; enhanced stability, yield, or shelf-life; environmental tolerances; pharmaceutical production; industrial product production; and nutritional enhancements.

In accordance with one embodiment a transgenic dicot protoplast (i.e., a soybean protoplast) is provided comprising a recombinant optimal nongenic soybean locus. More particularly, a dicot protoplast, such as a soybean protoplast, is provided comprising a DNA of interest inserted into an optimal nongenic soybean genomic loci of the dicot protoplast (i.e., a soybean protoplast), wherein said nongenic soybean genomic loci is about 1 Kb to about 5.7 Kb in length and lacks any methylated nucleotides. In one embodiment the transgenic dicot protoplast (i.e., a transgenic soybean protoplat), comprises a DNA of interest inserted into the optimal nongenic soybean genomic locus wherein the DNA of interest comprises an analytical domain, and/or an open reading frame. In one embodiment the inserted DNA of interest encodes a peptide and in a further embodiment the DNA of interest comprises at least one gene expression cassette comprising a transgene.

In accordance with one embodiment a transgenic dicot plant, dicot plant part, or dicot plant cell (i.e., a transgenic soybean plant, soybean plant part, or soybean plant cell) is provided comprising a recombinant optimal nongenic soybean locus. More particularly, a dicot plant, dicot plant part, or dicot plant cell (i.e., a soybean plant, soybean plant part, or soybean plant cell) is provided comprising a DNA of interest inserted into an optimal nongenic soybean genomic loci of the dicot plant, dicot plant part, or dicot plant cell (i.e., a soybean plant, soybean plant part, or soybean plant cell), wherein said nongenic soybean genomic loci is about 1 Kb to about 5.7 Kb in length and lacks any methylated nucleotides. In one embodiment the transgenic dicot plant, dicot plant part, or dicot plant cell (i.e., a transgenic soybean plant, soybean plant part, or soybean plant cell) comprises a DNA of interest inserted into the optimal nongenic soybean genomic locus wherein the DNA of interest comprises an analytical domain, and/or an open reading frame. In one embodiment the inserted DNA of interest encodes a peptide and in a further embodiment the DNA of interest comprises at least one gene expression cassette comprising a transgene.

EXAMPLES

Example 1: Identification of Targetable Genomic Loci in Soybean

The soybean genome was screened with a bioinformatics approach using specific criteria to select optimal genomic loci for targeting of a polynucleotide donor. The specific criteria used for selecting the genomic loci were developed using considerations for optimal expression of a transgene within the plant genome, considerations for optimal binding of genomic DNA by a site specific DNA-binding protein, and transgenic plant product development requirements. In order to identify and select the genomic loci, genomic and epigenomic datasets of the soybean genome were scanned using a bioinformatics approach. Screening genomic and epigenomic datasets resulted in select loci which met the following criteria: 1) hypomethylated and greater than 1 Kb in length; 2) targetable via site specific nuclease-mediated integration of a polynucleotide donor; 3) agronomically neutral or non-genic; 4) regions from which an integrated transgene can be expressed; and 5) regions with recombination within/around the locus. Accordingly, a total of 7,018 genomic loci (SEQ ID NO:1-SEQ ID NO:7,018) were identified using these specific criteria. The specific criteria are further described in detail below.

Hypomethylation

The soybean genome was scanned to select optimal genomic loci larger than 1 Kb that were DNA hypomethylated. DNA methylation profiles of root and shoot tissues isolated from *Glycine Max* cultivar Williams82 were constructed using a high throughput whole genome sequencing approach. Extracted DNA was subjected to bisulphite treatment that converts unmethylated cytosines to uracils, but does not affect methylated cytosines, and then sequenced using Illumina HiSeq technology (Krueger, F. et al. DNA methylome analysis using short bisulfite sequencing data. Nature Methods 9, 145-151 (2012)). The raw sequencing reads were collected and mapped to the soybean c.v. Williams82 reference genome using the Bismark™ mapping software as described in Krueger F, Andrews S R (2011) Bismark: a flexible aligner and methylation caller for Bisulfite-Seq applications. Bioinformatics 27: 1571-1572).

Since, during the bisulphite conversion process, cytosines in the DNA sequence that are methylated do not get converted to uracils, occurrence of cytosine bases in the sequencing data indicate the presence of DNA methylation. The reads that are mapped to the reference sequence were analyzed to identify genomic positions of cytosine residues with support for DNA methylation. The methylation level for each cytosine base in the genome was calculated as a percentage of the number of methylated reads mapping a particular cytosine base location to the total number of reads mapping to that location. The following hypothetical explains how methylation levels were calculated for each base within the soybean genome. For example, consider that there is a cytosine base at position 100 in chromosome 1 of the soybean c.v. Williams82 reference sequence. If there are a total of 20 reads mapped to cytosine base at position 100, and 10 of these reads are methylated, then the methylation level for the cytosine base at position 100 in chromosome 1 is estimated to be 50%. Accordingly, a profile of the methylation level for all of the genomic DNA base pairs obtained from the root and shoot tissue of soybean was calculated. The reads that could not be correctly mapped to unique locations in the soybean genome matched repetitive sequences that are widespread in the soybean genome, and are known in the art to be predominantly methylated.

Using the above described protocol, the methylation levels for the soybean c.v. Williams82 genome were measured. As such, regions of the soybean genome containing methylated reads indicated that these regions of the soybean genome were methylated. Conversely, the regions of the soybean genome that were absent of methylated reads indicated these regions of the soybean genome were non-methylated. The regions of the soybean genome from the shoot and root tissues that were non-methylated and did not contain any methylated reads are considered as "hypomethylated" regions. To make the root and shoot methylation profiles available for visualization, wiggle plots (http://useast.ensembl.org/info/website/upload/wig.html) were generated for each of the soybean c.v. Williams82 chromosomes.

After obtaining the DNA methylation level at the resolution of a single base pair in root and shoot tissues, as described above, the soybean genome was screened using 100 by windows to identify genomic regions that are methylated. For each window screened in the genome, a DNA methylation level was obtained by calculating the average level of methylation at every cytosine base in that window. Genomic windows with a DNA methylation level greater than 1% were termed as genomic regions that were methylated. The methylated windows identified in root and shoot profiles were combined to create a consensus methylation profile. Conversely, regions in the genome that did not meet these criteria and were not identified as methylated regions in the consensus profile were termed as hypo-methylated regions. Table 1 summarizes the identified hypo-methylated regions.

TABLE 1

| Hypomethylation profile of soybean c.v. Williams82 genome. | |
|---|---|
| Total soybean c.v. Williams82 genome size | ~970 Mb |
| Total combined length of hypomethylated region | ~354 Mb (36.5% of the soybean c.v. Williams82 genome) |
| Number of hypomethylated regions above 100 Bp | 763,709 |
| Number of hypomethylated regions above 1 Kb | 94,745 |
| Number of hypomethylated regions above 2 Kb | 19,369 |
| Number of hypomethylated regions above 10 Kb | 354 |
| Minimum length of hypomethylated region | 100 Bp |
| Maximum length of hypomethylated region | 84,100 Bp |

These hypomethylated regions of the soybean c.v. WILLIAMS82 genome were further characterized to identify and select specific genomic loci as the methylation free context of these regions indicated the presence of open chromatin. As such, all subsequent analyses were conducted on the identified hypomethylated regions.

Targetability

The hypomethylated sites identified in the soybean c.v. WILLIAMS82 were further analyzed to determine which sites were targetable via site specific nuclease-mediated integration of a polynucleotide donor. *Glycine max* is known to be a paleopolyploid crop which has undergone genome duplications in its genomic history (Jackson et al Genome sequence of the palaeopolyploid soybean, *Nature* 463, 178-183 (2010)). The soybean genome is known in the art to contain long stretches of highly repetitive DNA that are methylated and have high levels of sequence duplication. Annotation information of known repetitive regions in the soybean genome was collected from the Soybean Genome Database (www.soybase./org. Shoemaker R. C. et al. SoyBase, the USDA-ARS soybean genetics and genomics database. Nucleic Acids Res. 2010 January: 38 Database issue D843-6.).

Accordingly, the hypomethylated sites identified above were screened to remove any sites that aligned with known repetitive regions annotated on the soybean genome. The remaining hypomethylated sites that passed this first screen were subsequently scanned using a BLAST™ based homology search of a soybean genomic database via the NCBI BLAST™+ software (version 2.2.25) run using default parameter settings (Stephen F. Altschul et al (1997) Gapped BLAST and PSI-BLAST: a new generation of protein database search programs. Nucleic Acids Res. 25:3389-3402). As a result of the BLAST™ screen, any hypomethylated sites that had significant matches elsewhere in the genome, with sequence alignment coverage of over 40%, were removed from further analyses.

Agronomically Neutral or Nongenic

The hypomethylated sites identified in the soybean c.v. William82 were further analyzed to determine which sites were agronomically neutral or nongenic. As such, the hypomethylated sites described above were screened to remove any sites that overlapped or contained any known or predicted endogenous soybean c.v. William82 coding sequences. For this purpose, annotation data of known genes and mapping information of expressed sequence tag (EST) data were collected from Soybean Genomic Database (www.soybase.org—version 1.1 gene models were used, Jackson et al Genome sequence of the palaeopolyploid soybean Nature 463, 178-183 (2010)). Any genomic region immediately 2 Kb upstream and 1 Kb downstream to an open reading frame were also considered. These upstream and downstream regions may contain known or unknown conserved regulatory elements that are essential for gene function. The hypomethylated sites previously described above were analyzed for the presence of the known genes (including the 2 Kb upstream and 1 Kb downstream regions) and ESTs. Any hypomethylated sites that aligned with or overlapped with known genes (including the 2 Kb upstream and 1 Kb downstream regions) or ESTs were removed from downstream analysis.

Expression

The hypomethylated sites identified in the soybean c.v. Williams82 were further analyzed to determine which sites were within proximity to an expressed soybean gene. The transcript level expression of soybean genes was measured by analyzing transcriptome profiling data generated from soybean c.v. Williams82 root and shoot tissues using RNAseq™ technology as described in Mortazavi et al., Mapping and quantifying mammalian transcriptomes by RNA-Seq. *Nat Methods.* 2008; 5(7):621-628, and Shoemaker R C et al., RNA-Seq Atlas of *Glycine max*: a guide to the soybean Transcriptome. *BMC Plant Biol.* 2010 Aug. 5; 10:160. For each hypomethylated site, an analysis was completed to identify any annotated genes present within a 40 Kb region in proximity of the hypomethylated site, and an average expression level of the annotated gene(s) located in proximity to the hypomethylated site. Hypomethylated sites located greater than 40 Kb from an annotated gene with a non-zero average expression level were determined to not be proximal to an expressed soybean gene and were removed from further analyses.

Recombination

The hypomethylated sites identified in the soybean c.v. Williams82 were further analyzed to determine which sites had evidence of recombination and could facilitate introgression of the optimal genomic loci into other lines of soybean via conventional breeding. Diverse soybean genotypes are routinely crossed during conventional breeding to develop new and improved soybean lines containing traits of agronomic interest. As such, agronomic traits that are introgressed into optimal genomic loci within a soybean line via plant-mediated transformation of a transgene should be capable of further being introgressed into other soybean lines, especially elite lines, via meiotic recombination during conventional plant breeding. The hypomethylated sites described above were screened to identify and select sites that possessed some level of meiotic recombination. Any hypomethylated sites that were present within chromosomal regions characterized as recombination "cold-spots" were identified and removed. In soybean, these cold spots were defined using a marker dataset generated from recombinant inbred mapping population (Williams 82×PI479752). This dataset consisted of ~16,600 SNP markers that could be physically mapped to the *Glycine max* reference genome sequence.

The meiotic recombination frequencies between any pair of soybean genomic markers across a chromosome were calculated based on the ratio of the genetic distance between markers (in centimorgan (cM)) to the physical distance between the markers (in megabases (Mb)). For example, if the genetic distance between a pair of markers was 1 cM, and the physical distance between the same pair of markers was 2 Mb, then the calculated recombination frequency was determined to be 0.5 cM/Mb. For each hypomethylated site identified above, a pair of markers at least 1 Mb apart was chosen and the recombination frequency was calculated. Deployment of this method was used to calculate the recombination frequency of the hypomethylated sites. Any hypomethylated sites with a recombination frequency of 0 cM/Mb were identified and removed from further analysis. The remaining hypomethylated regions comprising a recombination frequency greater than 0 cM/Mb were selected for further analysis.

Identification of Optimal Genomic Loci

Application of the selection criteria described above resulted in the identification of a total of 90,325 optimal genomic loci from the soybean genome. Table 2 summarizes the lengths of the identified optimal genomic loci. These optimal genomic loci possess the following characteristics: 1) hypomethylated genomic loci greater than 1 Kb in length; 2) genomic loci that are targetable via site specific nuclease-mediated integration of a polynucleotide donor; 3) genomic loci that are agronomically neutral or nongenic; 4) genomic loci from which a transgene can be expressed; and 5) evidence of recombination within the genomic loci. Of all of the optimal genomic loci described in Table 2, only the optimal genomic loci that were greater than 1 Kb were further analyzed and utilized for targeting of a donor polynucleotide sequence. The sequences of these optimal genomic loci are disclosed as SEQ ID NO:1-SEQ ID NO:7, 018. Collectively, these optimal genomic loci are locations within the soybean genome that can be targeted with a donor polynucleotide sequence, as further demonstrated herein below.

TABLE 2

Lists the size range of optimal genomic loci identified in the soybean genome that are hypomethylated, show evidence of recombination, targetable, agronomically neutral or nongenic, and are in proximity to an expressed endogenous gene.

| | |
|---|---|
| Number of optimal genomic loci larger than 100 Bp | 90,325 |
| Number of optimal genomic loci larger than 1 Kb | 7,018 |
| Number of optimal genomic loci larger than 2 Kb | 604 |
| Number of optimal genomic loci larger than 4 Kb | 9 |

Example 2: F-Distribution and Principal Component Analysis to Cluster Optimal Genomic Loci from Soybean The 7,018 identified optimal genomic loci (SEQ ID NO: 1-SEQ ID NO: 7,018) were further analyzed using the F-distribution and Principal Component Analysis statistical methods to define a representative population and clusters for grouping of the optimal genomic loci.

F-Distribution Analysis

The identified 7,018 optimal genomic loci were statistically analyzed using a continuous probability distribution statistical analysis. As an embodiment of the continuous probability distribution statistical analysis, an F-distribution test was completed to determine a representative number of optimal genomic loci. The F-distribution test analysis was completed using equations and methods known by those with skill in the art. For more guidance, the F-distribution test analysis as described in K. M. Remund, D. Dixon, D L. Wright and L R. Holden. Statistical considerations in seed purity testing for transgenic traits. *Seed Science Research* (2001) 11, 101-119, herein incorporated by reference, is a non-limiting example of an F-distribution test. The F-distribution test assumes random sampling of the optimal genomic loci, so that any non-valid loci are evenly distributed across the 7,018 optimal genomic loci, and that the number of optimal genomic loci sampled is 10% or less of the total population of 7,018 optimal genomic loci.

The F-distribution analysis indicated that 32 of the 7,018 optimal genomic loci provided a representative number of the 7,018 optimal genomic loci, at a 95% confidence level. Accordingly, the F-distribution analysis showed that if 32 optimal genomic loci were tested and all were targetable with a donor polynucleotide sequence, then these results would indicate that 91 or more of the 7,018 optimal genomic loci are positive at the 95% confidence level. The best estimate of validating the total percentage of the 7,018 optimal genomic loci would be if 100% of the 32 tested optimal genomic loci were targetable. Accordingly, 91% is actually the lower bound of the true percent validated at the 95% confidence level. This lower bound is based on the 0.95 quantile of the F-distribution, for the 95% confidence level (Remund K, Dixon D, Wright D, and Holden L. Statistical considerations in seed purity testing for transgenic traits. *Seed Science Research* (2001) 11, 101-119).

Principal Component Analysis

Next, a Principal Component Analysis (PCA) statistical method was completed to further assess and visualize similarities and differences of the data set comprising the 7,018 identified optimal genomic loci to enable sampling of diverse loci for targeting validation. The PCA involves a mathematical algorithm that transforms a larger number of correlated variables into a smaller number of uncorrelated variables called principal components.

The PCA was completed on the 7,018 identified optimal genomic loci by generating a set of calculable features or attributes that could be used to describe the 7,018 identified optimal genomic loci. Each feature is numerically calculable and is defined specifically to capture the genomic and epigenomic context of the 7,018 identified optimal genomic loci. A set of 10 features for each soybean optimal genomic loci was identified and are described in greater detail below.

1. Length of the optimal genomic loci
   a. The length of the optimal genomic loci in this data set ranged from a minimum of 1,000 Bp to a maximum of 5,713 Bp.
2. Recombination frequency in a 1 MB region around the optimal genomic loci
   a. In soybean, recombination frequency for a chromosomal location was defined using an internal high resolution marker dataset generated from multiple mapping populations.
   b. Recombination frequencies between any pairs of markers across the chromosome were calculated based on the ratio of the genetic distance between markers (in centimorgan (cM)) to the physical distance between the markers (in Mb). For example, if the genetic distance between a pair of markers is 1 cM and the physical distance between the same pairs of markers is 2 Mb, the calculated recombination frequency is 0.5 cM/Mb. For each optimal genomic loci, a pair of markers at least 1 Mb apart was chosen and the recombination frequency was calculated in this manner. These recombination values ranged from a minimum of 0.01574 cM/Mb to a maximum of 83.52 cM/Mb.
3. Level of optimal genomic loci sequence uniqueness
   a. For each optimal genomic loci, the nucleotide sequence of the optimal genomic loci was scanned against the soybean c.v. Williams82 genome using a BLAST™ based homology search using the NCBI BLAST™+ software (version 2.2.25) run using the default parameter settings (Stephen F. Altschul et al (1997), "Gapped BLAST and PSI-BLAST: a new generation of protein database search programs", Nucleic Acids Res. 25:3389-3402). As these optimal genomic loci sequences are identified from the soybean c.v. Williams82 genome, the first BLAST™ hit identified through this search represents the soybean c.v. Williams82 sequence itself. The second BLAST™ hit for each optimal genomic loci sequence was identified and the alignment coverage (represented as the percent of the optimal genomic loci covered by the BLAST™ hit) of the hit was used as a measure of uniqueness of the optimal genomic loci sequence within the soybean genome. These alignment coverage values for the second BLAST™ hit ranged from a minimum of 0% to a maximum of 39.97% sequence identity. Any sequences that aligned at higher levels of sequence identity were not considered.
4. Distance from the optimal genomic loci to the closest gene in its neighborhood
   a. Gene annotation information and the location of known genes in the Soybean genome were extracted from Soybean Genome Database (available at, www.soybase.org—version 1.1 gene models were used, Jackson et al Genome sequence of the palaeopolyploid soybean, *Nature* 463, 178-183 (2010)). For each optimal genomic loci, the closest annotated gene, considering both upstream and downstream locations, was identified and the distance between the optimal genomic loci sequence and the gene was measured (in Bp). For example, if a optimal genomic locus is located in chromosome Gm01 from position 2,500 to position 3,500, and the closest gene to this optimal genomic locus is located in chromosome Gm01 from position 5,000 to position 6,000, the distance from the optimal genomic loci to this closest gene is calculated to be 1500 Bp. These values for all 7,018 of the optimal genomic loci dataset ranged from a minimum of 1,001 Bp to a maximum of 39,482 Bp.
5. GC % in the optimal genomic loci sequence
   a. For each optimal genomic locus, the nucleotide sequence was analyzed to estimate the number of Guanine and Cytosine bases present. This count was represented as a percentage of the sequence length of each optimal genomic locus and provides a measure for GC %. These GC % values for the soybean optimal genomic loci dataset range from 14.4% to 45.9%.
6. Number of genes in a 40 Kb neighborhood around the optimal genomic loci sequence a. Gene annotation information and the location of known genes in the soybean c.v. Williams82 genome were extracted from Soybean Genome Database. For each of the 7,018 optimal genomic loci sequence, a 40 Kb window around the optimal genomic loci sequence was defined and the number of annotated genes with locations overlapping this window was counted. These values ranged from a minimum of 1 gene to a maximum of 18 genes within the 40 Kb neighborhood.

7. Average gene expression in a 40 Kb neighborhood around the optimal genomic loci a. Transcript level expression of soybean genes was measured by analyzing available transcriptome profiling data generated from soybean c.v. Williams82 root and shoot tissues using RNAseg™ technology. Gene annotation information and the location of known genes in the soybean c.v. Williams82 genome were extracted from Soybean Genome Database For each optimal genomic locus, annotated genes within the soybean c.v. Williams82 genome that were present in a 40 Kb neighborhood around the optimal genomic loci were identified. Expression levels for each of the genes were extracted from the transcriptome profiles described in the above referenced citations and an average gene expression level was calculated. Expression values of all genes within the genome of soybean vary greatly. The average expression values for all of the 7,018 optimal genomic loci dataset ranged from a minimum of 0.000415 to a maximum of 872.7198.

8. Level of nucleosome occupancy around the optimal genomic loci a. Understanding the level of nucleosome occupancy for a particular nucleotide sequence provides information about chromosomal functions and the genomic context of the sequence. The NuPoP™ statistical package was used to predict the nucleosome occupancy and the most probable nucleosome positioning map for any size of genomic sequences (Xi, L., Fondufe-Mittendor, Y., Xia, L., Flatow, J., Widom, J. and Wang, J.-P., Predicting nucleosome positioning using a duration Hidden Markov Model, *BMC Bioinformatics*, 2010, doi: 10.1186/1471-2105-11-346.). For each of the 7,018 optimal genomic loci, the nucleotide sequence was submitted for analysis with the NuPoP™ software and a nucleosome occupancy score was calculated. These nucleosome occupancy scores for the soybean optimal genomic loci dataset ranged from a minimum of 0 to a maximum of 0.494.

9. Relative location within the chromosome (proximity to centromere)

a. A centromere is a region on a chromosome that joins two sister chromatids. The portions of a chromosome on either side of the centromere are known as chromosomal arms. Genomic locations of centromeres on all 20 Soybean chromosomes were identified in the published soybean c.v. Williams82 reference sequence (Jackson et al Genome sequence of the palaeopolyploid soybean Nature 463, 178-183 (2010)). Information on the position of the centromere in each of the Soybean chromosomes and the lengths of the chromosome arms was extracted from Soybean Genome Database. For each optimal genomic locus, the genomic distance from the optimal genomic locus sequence to the centromere of the chromosome that it is located on, is measured (in Bp). The relative location of optimal genomic loci within the chromosome is represented as the ratio of its genomic distance to the centromere relative to the length of the specific chromosomal arm that it lies on. These relative location values for the soybean optimal genomic loci dataset ranged from a minimum of 0 to a maximum of 0.99682 ratio of genomic distance.

10. Number of optimal genomic loci in a 1 Mb region a. For each optimal genomic loci, a 1 Mb genomic window around the optimal genomic loci location was defined and the number of other, additional optimal genomic loci present within or overlapping this region were calculated, including the optimal genomic loci under consideration. The number of optimal genomic loci in a 1 Mb ranged from a minimum of 1 to a maximum of 49.

All of the 7,018 optimal genomic loci were analyzed using the features and attributes described above. The results or values for the score of the features and attributes of each optimal genomic locus are further described in Table 3 (herein incorporated by reference as a separate electronic filing). The resulting dataset was used in the PCA statistical method to cluster the 7,018 identified optimal genomic loci into clusters. During the clustering process, after estimating the "p" principle components of the optimal genomic loci, the assignment of the optimal genomic loci to one of the 32 clusters proceeded in the "p" dimensional Euclidean space. Each of the "p" axes was divided into "k" intervals. Optimal genomic loci assigned to the same interval were grouped together to form clusters. Using this analysis, each PCA axis was divided into two intervals, which was chosen based on a priori information regarding the number of clusters required for experimental validation. All analysis and the visualization of the resulting clusters were carried out with the Molecular Operating Environment™ (MOE) software from Chemical Computing Group Inc. (Montreal, Quebec, Canada).

The PCA approach was used to cluster the set of 7,018 identified optimal genomic loci into 32 distinct clusters based on their feature values, described above. During the PCA process, five principal components (PC) were generated, with the top three PCs containing about 90% of the total variation in the dataset (Table 4). These three PCAs were used to graphically represent the 32 clusters in a three dimensional plot (FIG. 1). After the clustering process, was completed, one representative optimal genomic locus was chosen from each cluster. This was performed by choosing a select optimal genomic locus, within each cluster, that was closest to the centroid of that cluster (Table 4). The chromosomal locations of the 32 representative optimal genomic loci are uniformly distributed among the 20 soybean chromosomes and are not biased toward any particular genomic location, as shown in FIG. 2.

TABLE 4

Description of the 32 soybean representative optimal genomic loci identified from the PCA

| Optimal Genomic Loci Name | Genomic Location | Length (Bp) | Cluster Number | SEQ ID NO: |
|---|---|---|---|---|
| soy_ogl_2474 | Gm08: 2764201 . . . 2766752 | 2552 | 1 | 1 |
| soy_ogl_768 | Gm03: 339101 . . . 341100 | 2000 | 2 | 506 |
| soy_ogl_2063 | Gm06: 43091928 . . . 43094600 | 2673 | 3 | 748 |
| soy_ogl_1906 | Gm06: 11576991 . . . 11578665 | 1675 | 4 | 1029 |
| soy_ogl_1112 | Gm03: 46211408 . . . 46213400 | 1993 | 5 | 1166 |
| soy_ogl_3574 | Gm10: 46279901 . . . 46281026 | 1126 | 6 | 1452 |

TABLE 4-continued

Description of the 32 soybean representative optimal genomic loci identified from the PCA

| Optimal Genomic Loci Name | Genomic Location | Length (Bp) | Cluster Number | SEQ ID NO: |
|---|---|---|---|---|
| soy_ogl_2581 | Gm08: 9631801 . . . 9632800 | 1000 | 7 | 1662 |
| soy_ogl_3481 | Gm10: 40763663 . . . 40764800 | 1138 | 8 | 1869 |
| soy_ogl_1016 | Gm03: 41506001 . . . 41507735 | 1735 | 9 | 2071 |
| soy_ogl_937 | Gm03: 37707001 . . . 37708600 | 1600 | 10 | 2481 |
| soy_ogl_6684 | Gm20: 1754801 . . . 1755800 | 1000 | 11 | 2614 |
| soy_ogl_6801 | Gm20: 36923690 . . . 36924900 | 1211 | 12 | 2874 |
| soy_ogl_6636 | Gm19: 49977101 . . . 49978357 | 1257 | 13 | 2970 |
| soy_ogl_4665 | Gm14: 5050547 . . . 5051556 | 1010 | 14 | 3508 |
| soy_ogl_3399 | Gm10: 6612501 . . . 6613500 | 1000 | 15 | 3676 |
| soy_ogl_4222 | Gm13: 23474923 . . . 23476100 | 1178 | 16 | 3993 |
| soy_ogl_2543 | Gm08: 7532001 . . . 7534800 | 2800 | 17 | 4050 |
| soy_ogl_275 | Gm01: 51869201 . . . 51870400 | 1200 | 18 | 4106 |
| soy_ogl_598 | Gm02: 41665601 . . . 41667900 | 2300 | 19 | 4496 |
| soy_ogl_1894 | Gm06: 10540801 . . . 10542300 | 1500 | 20 | 4622 |
| soy_ogl_5454 | Gm17: 1944101 . . . 1945800 | 1700 | 21 | 4875 |
| soy_ogl_6838 | Gm20: 38263922 . . . 38265300 | 1379 | 22 | 4888 |
| soy_ogl_4779 | Gm14: 45446301 . . . 45447700 | 1400 | 23 | 5063 |
| soy_ogl_3333 | Gm10: 2950701 . . . 2951800 | 1100 | 24 | 5122 |
| soy_ogl_2546 | Gm08: 7765875 . . . 7767500 | 1626 | 25 | 5520 |
| soy_ogl_796 | Gm03: 1725501 . . . 1726600 | 1100 | 26 | 5687 |
| soy_ogl_873 | Gm03: 33650665 . . . 33653000 | 2336 | 27 | 6087 |
| soy_ogl_5475 | Gm17: 3403108 . . . 3404200 | 1093 | 28 | 6321 |
| soy_ogl_2115 | Gm07: 1389701 . . . 1390900 | 1200 | 29 | 6520 |
| soy_ogl_2518 | Gm08: 5229501 . . . 5230667 | 1167 | 30 | 6574 |
| soy_ogl_5551 | Gm17: 6541901 . . . 6543200 | 1300 | 31 | 6775 |
| soy_ogl_4563 | Gm13: 38977701 . . . 38978772 | 1072 | 32 | 6859 |

Figure 3:
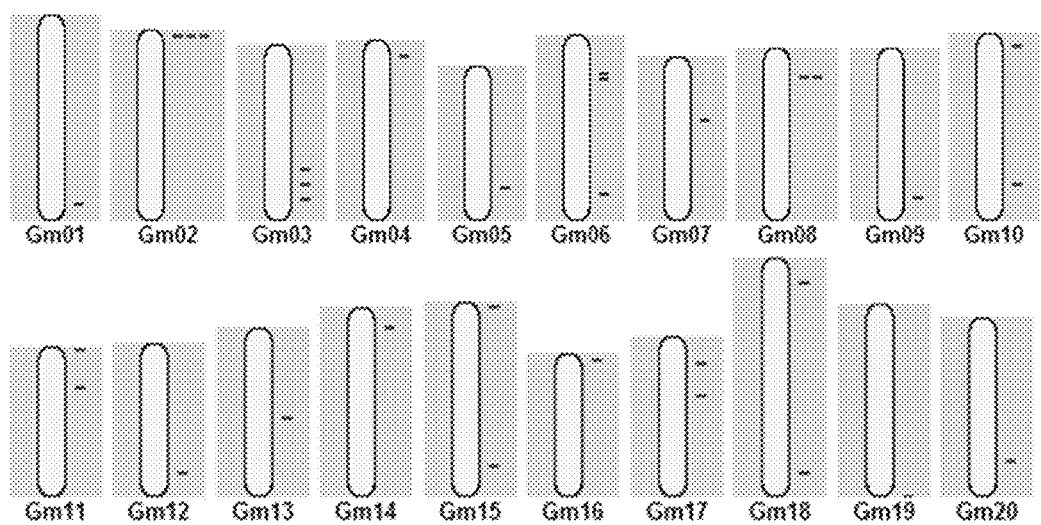
FIG. 3. Provides a schematic drawing indicating the soybean chromosomal location of the optimal genomic loci selected for targeting validation.

Final Selection of Genomic Loci for Targeting of a Polynucleotide Donor Polynucleotide Sequence A total of 32 genomic loci were identified and selected for targeting with a donor polynucleotide sequence from the 7,018 genomic loci that were clustered within 32 distinct clusters. For each of the 32 clusters, a representative genomic locus (closest to the centroid of the cluster as described above in Table 4) or an additional locus with homology to targeting line were chosen. The additional optimal genomic loci were selected by first screening all of the 7,018 selected optimal genomic sequences against a whole genome database consisting of genomic DNA sequence data for both *Glycine max* c.v. Maverick (transformation and targeting screening line) and *Glycine max* c.v. Williams82 (reference line) to determine the coverage (how many optimal genomic loci were present in both genomes) and percentage of sequence identity in the genome from both lines. The optimal genomic loci with 100% coverage (the entire sequence length of the optimal loci aligned between both genomes) and 100% identity in the Williams82 genomic databases were selected for targeting validation. Other criteria such as genomic loci size, extent of uniqueness, GC % content and chromosomal distribution of the optimal genomic loci were also taken into consideration in selecting the additional optimal genomic loci. The chromosomal location of the 32 selected optimal genomic loci and the specific genomic configuration of each soybean optimal genomic loci are shown in FIG. 3 and Table 5, respectively.

TABLE 5

Description of the 32 soybean selected optimal genomic loci chosen for targeting validation. From these optimal genomic loci listed in this table, exemplification of cleavage and targeting of 32 soybean optimal genomic loci are representative of the identified total of 7,018 soybean selected optimal genomic loci.

| Optimal Genomic Loci Name | Genomic Location | Length (Bp) | Cluster Number | SEQ ID NO: |
|---|---|---|---|---|
| soy_ogl_308 | Gm02: 1204801 . . . 1209237 | 4437 | 1 | 43 |
| soy_ogl_307 | Gm02: 1164701 . . . 1168400 | 3700 | 2 | 566 |
| soy_ogl_2063 | Gm06: 43091928 . . . 43094600 | 2673 | 3 | 748 |
| soy_ogl_1906 | Gm06: 11576991 . . . 11578665 | 1675 | 4 | 1029 |
| soy_ogl_262 | Gm01: 51061272 . . . 51062909 | 1638 | 5 | 1376 |
| soy_ogl_5227 | Gm16: 1298889 . . . 1300700 | 1812 | 6 | 1461 |
| soy_ogl_4074 | Gm12: 33610401 . . . 33611483 | 1083 | 7 | 1867 |
| soy_ogl_3481 | Gm10: 40763663 . . . 40764800 | 1138 | 8 | 1869 |
| soy_ogl_1016 | Gm03: 41506001 . . . 41507735 | 1735 | 9 | 2071 |
| soy_ogl_937 | Gm03: 37707001 . . . 37708600 | 1600 | 10 | 2481 |
| soy_ogl_5109 | Gm15: 42391349 . . . 42393400 | 2052 | 11 | 2639 |
| soy_ogl_6801 | Gm20: 36923690 . . . 36924900 | 1211 | 12 | 2874 |
| soy_ogl_6636 | Gm19: 49977101 . . . 49978357 | 1257 | 13 | 2970 |
| soy_ogl_4665 | Gm14: 5050547 . . . 5051556 | 1010 | 14 | 3508 |
| soy_ogl_6189 | Gm18: 55694401 . . . 55695900 | 1500 | 15 | 3682 |
| soy_ogl_4222 | Gm13: 23474923 . . . 23476100 | 1178 | 16 | 3993 |
| soy_ogl_2543 | Gm08: 7532001 . . . 7534800 | 2800 | 17 | 4050 |
| soy_ogl_310 | Gm02: 1220301 . . . 1222300 | 2000 | 18 | 4326 |
| soy_ogl_2353 | Gm07: 17194522 . . . 17196553 | 2032 | 19 | 4593 |
| soy_ogl_1894 | Gm06: 10540801 . . . 10542300 | 1500 | 20 | 4622 |
| soy_ogl_3669 | Gm11: 624301 . . . 626200 | 1900 | 21 | 4879 |
| soy_ogl_3218 | Gm09: 40167479 . . . 40168800 | 1322 | 22 | 4932 |
| soy_ogl_5689 | Gm17: 15291601 . . . 15293400 | 1800 | 23 | 5102 |
| soy_ogl_3333 | Gm10: 2950701 . . . 2951800 | 1100 | 24 | 5122 |
| soy_ogl_2546 | Gm08: 7765875 . . . 7767500 | 1626 | 25 | 5520 |
| soy_ogl_1208 | Gm04: 4023654 . . . 4025650 | 1997 | 26 | 5698 |
| soy_ogl_873 | Gm03: 33650665 . . . _33653000 | 2336 | 27 | 6087 |
| soy_ogl_5957 | Gm18: 6057701 . . . 6059100 | 1400 | 28 | 6515 |
| soy_ogl_4846 | Gm15: 924901 . . . 926200 | 1300 | 29 | 6571 |
| soy_ogl_3818 | Gm11: 10146701 . . . 10148200 | 1500 | 30 | 6586 |
| soy_ogl_5551 | Gm17: 6541901 . . . 6543200 | 1300 | 31 | 6775 |
| soy_ogl_7 | Gm05: 32631801 . . . 32633200 | 1400 | 32 | 6935 |
| soy_OGL_684 | Gm02: 45903201 . . . 45907300 | 4100 | 1 | 47 |
| soy_OGL_682 | Gm02: 45816543 . . . 45818777 | 2235 | 9 | 2101 |
| soy_OGL_685 | Gm02: 45910501 . . . 45913200 | 2700 | 1 | 48 |
| soy_OGL_1423 | Gm04: 45820631 . . . 45822916 | 2286 | 2 | 639 |
| soy_OGL_1434 | Gm04: 46095801 . . . 46097968 | 2168 | 1 | 137 |
| soy_OGL_4625 | Gm14: 3816738 . . . 3820070 | 3333 | 1 | 76 |
| soy_OGL_6362 | Gm19: 5311001 . . . 5315000 | 4000 | 1 | 440 |

A large suite of 7,018 genomic locations have been identified in the soybean genome as optimal genomic loci for targeting with a donor polynucleotide sequence using precision genome engineering technologies. A statistical analysis approach was deployed to group the 7,018 selected genomic loci into 32 clusters with similar genomic contexts, and to identify a subset of 32 selected genomic loci representative of the set of 7,018 selected genomic loci. The 32 representative loci were validated as optimal genomic loci via targeting with a donor polynucleotide sequence. By performing the PCA statistical analysis for the numerical values generated for the ten sets of features or attributes that are described above, the ten features or attributes were computed into PCA components of fewer dimensions. As such, PCA components were reduced into five dimensions that are representative of the ten features or attributes described above (Table 6). Each PCA component is equivalent to a combination of the ten features or attributes described above. From these PCA components comprising five dimensions, as computed using the PCA statistical analysis, the 32 clusters were determined.

TABLE 6

The five PCA components (PCA1, PCA2, PCA3, PCA4, and PCA5) that define each of the 32 clusters and the sequences (SEQ ID NO: 1-SEQ ID NO: 7,018) which make up each cluster. These five dimensions are representative of the ten features or attributes described above that were used to identify the optimal genomic loci. The minimum (Min), mean, median and maximum (Max) values for each PCA component are provided.

| | | Cluster1 (SEQ ID NO: 1-SEQ ID NO: 505) | Cluster2 (SEQ ID NO: 506-SEQ ID NO: 747) | Cluster3 (SEQ ID NO: 748-SEQ ID NO: 1028) | Cluster4 (SEQ ID NO: 1029-SEQ ID NO: 1165) | Cluster5 (SEQ ID NO: 1166-SEQ ID NO: 1451) | Cluster6 (SEQ ID NO: 1452-SEQ ID NO: 1661) | Cluster7 (SEQ ID NO: 1662-SEQ ID NO: 1868) | Cluster8 (SEQ ID NO: 1869-SEQ ID NO: 2070) | Cluster9 (SEQ ID NO: 2071-SEQ ID NO: 2480) | Cluster10 (SEQ ID NO: 2481-SEQ ID NO: 2613) | Cluster11 (SEQ ID NO: 2614-SEQ ID NO: 2873) |
|---|---|---|---|---|---|---|---|---|---|---|---|---|
| PCA1 | Min | −1.70227 | 0.022046 | −4.54911 | −1.72266 | −0.36976 | 0.287697 | −3.34863 | −1.0806 | −1.5084417 | −0.06921 | −4.85854 |
| | Mean | 0.349775 | 0.812634 | −1.47305 | −0.00185 | 0.540899 | 0.967917 | −0.58528 | 0.313491 | 0.178145825 | 0.746656 | −1.77485 |
| | Median | 0.363103 | 0.796321 | −1.18164 | 0.049082 | 0.52498 | 0.918269 | −0.34364 | 0.291582 | 0.204892845 | 0.729936 | −1.59613 |
| | Max | 1.507894 | 1.834871 | 0.032399 | 2.027233 | 1.499719 | 2.461219 | 0.417058 | 1.718384 | 1.4452823 | 2.258209 | −0.10335 |
| PCA2 | Min | −0.65485 | −0.6907 | −1.37642 | −1.15246 | −2.2623 | −2.69847 | −2.33499 | −2.05394 | −0.85615188 | −1.07918 | −1.48917 |
| | Mean | 0.803591 | 0.805611 | 0.42863 | 0.549053 | −0.97646 | −0.63594 | −1.07926 | −0.67684 | 0.0131018 | 0.201017 | −0.12584 |
| | Median | 0.640172 | 0.690953 | 0.30208 | 0.435896 | −0.92946 | −0.51848 | −1.03176 | −0.62625 | −0.061526693 | 0.165577 | −0.16842 |
| | Max | 6.750318 | 4.21356 | 3.492035 | 2.037537 | 0.224862 | 0.316075 | 0.014994 | 0.262266 | 2.8737593 | 1.883538 | 2.389063 |
| PCA3 | Min | −4.63386 | −6.20928 | −3.64977 | −7.46971 | −2.4347 | −3.28026 | −2.79672 | −2.36222 | −1.7842444 | −3.17428 | −2.64864 |
| | Mean | −1.0374 | −0.87017 | −1.09511 | −1.21149 | −0.49711 | −0.30392 | −0.4893 | −0.36718 | −0.137149779 | −0.20772 | −0.28997 |
| | Median | −0.94654 | −0.7282 | −0.92816 | −0.96309 | −0.45901 | −0.19996 | −0.43677 | −0.27515 | −0.068803158 | −0.04455 | −0.18716 |
| | Max | 0.240454 | 0.010148 | −0.11534 | −0.13414 | 0.476554 | 0.457804 | 0.452481 | 0.453505 | 0.9092167 | 0.928412 | 0.782125 |
| PCA4 | Min | −2.22011 | −1.02405 | −1.33923 | 0.069312 | −1.70627 | −0.80904 | −1.29231 | 0.360563 | −2.9615474 | −2.44418 | −2.7613 |
| | Mean | −0.71495 | 0.283541 | 0.212841 | 1.084988 | −0.35855 | 0.479481 | 0.459736 | 1.348666 | −1.407512305 | −0.75615 | −0.85361 |
| | Median | −0.70787 | 0.306108 | 0.209055 | 1.116651 | −0.35772 | 0.435449 | 0.436138 | 1.307628 | −1.38790425 | −0.78738 | −0.81593 |
| | Max | 0.786678 | 1.575184 | 2.221794 | 2.571196 | 0.755949 | 2.664817 | 2.193427 | 3.122114 | −0.40942505 | 0.783523 | 0.985444 |
| PCA5 | Min | −0.17971 | −3.06393 | −0.55749 | −4.5557 | 0.159064 | −2.0539 | −0.70289 | −1.90857 | −1.897981 | −4.47156 | −2.35152 |
| | Mean | 0.943093 | 0.368965 | 0.713771 | −0.21905 | 0.876745 | 0.463248 | 0.768677 | 0.285719 | −0.029561107 | −0.90424 | −0.18625 |
| | Median | 0.854279 | 0.3771 | 0.670629 | −0.10817 | 0.846543 | 0.459296 | 0.763885 | 0.338391 | 0.034177913 | −0.68409 | −0.12264 |
| | Max | 3.583402 | 2.613815 | 2.279238 | 2.341478 | 1.913726 | 1.633977 | 2.164417 | 1.422805 | 0.84937429 | 0.242494 | 0.940019 |

| | | Cluster12 (SEQ ID NO: 2874-SEQ ID NO: 2969) | Cluster13 (SEQ ID NO: 2970-SEQ ID NO: 3507) | Cluster14 (SEQ ID NO: 3508-SEQ ID NO: 3675) | Cluster15 (SEQ ID NO: 3676-SEQ ID NO: 3992) | Cluster16 (SEQ ID NO: 3993-SEQ ID NO: 4049) | Cluster17 (SEQ ID NO: 4050-SEQ ID NO: 4105) | Cluster18 (SEQ ID NO: 4106-SEQ ID NO: 4495) | Cluster19 (SEQ ID NO: 4496-SEQ ID NO: 4621) | Cluster20 (SEQ ID NO: 4622-SEQ ID NO: 4874) | Cluster21 (SEQ ID NO: 4875-SEQ ID NO: 4887) | Cluster22 (SEQ ID NO: 4888-SEQ ID NO: 5062) |
|---|---|---|---|---|---|---|---|---|---|---|---|---|
| PCA1 | Min | −2.10567 | −0.78413 | −0.1362 | −3.50478 | −1.06581 | −0.48995 | −0.12394 | −3.44417 | −2.5926 | 0.041919 | 0.192262 |
| | Mean | 0.215254 | 0.402511 | 0.841125 | −0.99405 | 0.054644 | 0.218477 | 0.705185 | −1.60324 | −0.21989 | 0.498017 | 0.919859 |
| | Median | 0.167943 | 0.421486 | 0.793343 | −0.86435 | 0.043314 | 0.186449 | 0.69823 | −1.62442 | −0.07645 | 0.530588 | 0.860249 |
| | Max | 2.638122 | 1.521265 | 2.011089 | 0.254192 | 1.078006 | 1.212386 | 1.894809 | −0.14778 | 1.10593 | 0.937608 | 1.90419 |
| PCA2 | Min | −3.24885 | −2.49287 | −2.07915 | −2.50642 | −2.60289 | 0.060129 | 0.131404 | −0.33368 | −0.05632 | −1.56352 | −1.38005 |
| | Mean | −0.53611 | −1.09247 | −0.94959 | −1.29395 | −1.20352 | 1.419729 | 1.150768 | 1.001573 | 0.843814 | −0.4111 | −0.07498 |
| | Median | −0.33651 | −1.08189 | −0.91699 | −1.24996 | −1.17679 | 1.280417 | 1.065186 | 0.789798 | 0.776486 | −0.28559 | −0.02529 |
| | Max | 2.608386 | −0.24001 | 0.020389 | −0.4655 | −0.31958 | 3.913198 | 3.040107 | 6.340514 | 2.929741 | 0.123387 | 0.788801 |
| PCA3 | Min | −14.6314 | −1.01198 | −1.91077 | −1.7135 | −2.73956 | −0.27788 | −1.13076 | −1.78506 | −0.92532 | 0.00053 | −0.17801 |
| | Mean | −3.0284 | 0.137956 | 0.208329 | 0.071922 | −0.21452 | −0.27811 | 0.161876 | −0.14195 | 0.233953 | 0.437291 | 0.567525 |
| | Median | −1.93463 | 0.177648 | 0.306399 | 0.132791 | −0.00072 | −0.15148 | 0.163129 | −0.06546 | 0.23185 | 0.450869 | 0.560588 |
| | Max | 0.72284 | 1.034171 | 1.086972 | 0.996862 | 0.765974 | 0.427866 | 1.323874 | 0.948736 | 1.409277 | 0.918483 | 1.635718 |
| PCA4 | Min | −1.00771 | −2.10637 | −1.17239 | −1.48955 | −0.78727 | −1.60097 | −0.69878 | −1.09012 | 0.172103 | −0.51316 | −0.24073 |
| | Mean | 0.594551 | −0.85746 | −0.33529 | −0.37717 | 0.438916 | −0.23831 | 0.47476 | 0.670052 | 1.210219 | 0.100213 | 0.936613 |

TABLE 6-continued

The five PCA components (PCA1, PCA2, PCA3, PCA4, and PCA5) that define each of the 32 clusters and the sequences (SEQ ID NO: 1-SEQ ID NO: 7,018) which make up each cluster. These five dimensions are representative of the ten features or attributes described above that were used to identify the optimal genomic loci. The minimum (Min), mean, median and maximum (Max) values for each PCA component are provided.

| | | Cluster23 (SEQ ID NO: 5063-SEQ ID NO: 5121) | Cluster24 (SEQ ID NO: 5122-SEQ ID NO: 5519) | Cluster25 (SEQ ID NO: 5520-SEQ ID NO: 5686) | Cluster26 (SEQ ID NO: 5687-SEQ ID NO: 6086) | Cluster27 (SEQ ID NO: 6087-SEQ ID NO: 6320) | Cluster28 (SEQ ID NO: 6321-SEQ ID NO: 6519) | Cluster29 (SEQ ID NO: 6520-SEQ ID NO: 6573) | Cluster30 (SEQ ID NO: 6574-SEQ ID NO: 6774) | Cluster31 (SEQ ID NO: 6775-SEQ ID NO: 6588) | Cluster32 (SEQ ID NO: 6589-SEQ ID NO: 7018) |
|---|---|---|---|---|---|---|---|---|---|---|---|
| PCA5 | Median | 0.392421 | −0.86062 | −0.4333 | −0.47105 | 0.356632 | −0.21174 | 0.451745 | 0.638494 | 1.196036 | 0.075167 | 0.954165 |
| | Max | 4.86024 | 0.27396 | 0.580863 | 0.978394 | 2.500934 | 0.871996 | 1.775638 | 2.468554 | 2.614263 | 0.536589 | 2.449815 |
| | Min | −18.7726 | −0.77506 | −3.53913 | −1.20206 | −3.51125 | 0.008136 | −0.77069 | −0.62934 | −1.42543 | 0.258308 | −0.57322 |
| | Mean | −4.21943 | 0.229577 | −0.3992 | 0.08327 | −0.93398 | 0.233117 | 0.233117 | 0.369827 | −0.02377 | 0.648857 | 0.282176 |
| | Median | −2.90093 | 0.240883 | −0.33338 | 0.087451 | −0.70513 | 0.701934 | 0.225125 | 0.29277 | −0.01138 | 0.603284 | 0.263371 |
| | Max | −0.33401 | 1.115681 | 0.396515 | 1.044241 | 0.040091 | 2.01268 | 1.665714 | 1.937356 | 1.791794 | 1.079582 | 1.412132 |
| PCA1 | Min | −3.01097 | −2.17545 | −1.47203 | −0.82652 | −4.22215 | −2.8128 | −0.55955 | −0.14823 | −3.68328 | −2.1948 |
| | Mean | −1.10273 | 0.189203 | 0.026625 | 0.609339 | −1.7704 | −0.5307 | 0.365085 | 0.695365 | −1.17291 | −0.20762 |
| | Median | −1.05343 | 0.274006 | 0.000548 | 0.622131 | −1.68559 | −0.44093 | 0.372341 | 0.679272 | −1.05591 | −0.07481 |
| | Max | 0.215051 | 1.539568 | 1.204076 | 2.040596 | −0.20599 | 1.026142 | 1.082778 | 1.542552 | −0.04543 | 1.044939 |
| PCA2 | Min | −1.37504 | −1.29996 | −0.49733 | −0.35268 | −0.8685 | −0.39322 | −1.70938 | −1.71589 | −1.7904 | −1.39851 |
| | Mean | −0.52564 | −0.24039 | 0.701345 | 0.996746 | 0.520887 | 0.744232 | −0.66621 | −0.41853 | −0.82975 | −0.40126 |
| | Median | −0.48207 | −0.18651 | 0.497651 | 0.817435 | 0.384759 | 0.686377 | −0.69103 | −0.33802 | −0.8047 | −0.39539 |
| | Max | 0.176255 | 0.87503 | 3.880586 | 4.311936 | 3.021218 | 3.474901 | 0.015191 | 0.704506 | −0.11251 | 0.595757 |
| PCA3 | Min | −0.26777 | −0.37688 | −0.16467 | −0.23246 | −0.47501 | −0.00111 | 0.538379 | 0.435168 | 0.337445 | 0.222405 |
| | Mean | 0.293 | 0.505379 | 0.71742 | 1.077263 | 0.78187 | 1.005429 | 1.055894 | 1.156804 | 1.045676 | 1.227425 |
| | Median | 0.264634 | 0.473588 | 0.674781 | 1.053549 | 0.727749 | 1.007761 | 1.085427 | 1.14325 | 1.036725 | 1.200613 |
| | Max | 0.932042 | 1.841691 | 2.234525 | 2.790854 | 2.556613 | 2.483974 | 1.565017 | 3.16182 | 1.973707 | 2.509435 |
| PCA4 | Min | 0.213129 | 0.305131 | −3.03078 | −3.22656 | −2.78298 | −0.8606 | −1.61996 | −1.16215 | −1.17888 | −0.50044 |
| | Mean | 1.158602 | 1.628149 | −1.25321 | −0.49661 | −0.42577 | 0.564935 | −0.67182 | −0.02267 | 0.109856 | 0.973061 |
| | Median | 1.088302 | 1.633074 | −1.21889 | −0.46274 | −0.40653 | 0.537203 | −0.72684 | −0.03125 | 0.201603 | 0.930979 |
| | Max | 2.046121 | 2.833294 | −0.00705 | 1.301237 | 1.30015 | 2.491648 | 0.122389 | 1.218455 | 1.682597 | 2.614142 |
| PCA5 | Min | −0.00876 | −1.17026 | −2.49874 | −3.23886 | −2.76649 | −4.07782 | −0.9589 | −1.70771 | −1.41474 | −2.02076 |
| | Mean | 0.59606 | 0.172591 | −0.46655 | −0.94402 | −0.73067 | −1.02591 | −0.15265 | −0.47755 | −0.34837 | −0.70651 |
| | Median | 0.577423 | 0.151654 | −0.39547 | −0.84381 | −0.69992 | −0.89159 | −0.17176 | −0.40794 | −0.32927 | −0.61785 |
| | Max | 1.322481 | 1.497953 | 0.404344 | 0.182532 | 0.480085 | −0.10675 | 0.562286 | 0.446026 | 0.347785 | −0.0103 |

Example 3: Design of Zinc Fingers to Bind Genomic Loci in Soybean

Zinc finger proteins directed against the identified DNA sequences of the representative genomic loci were designed as previously described. See, e.g., Urnov et al., (2005) Nature 435:646-551. Exemplary target sequence and recognition helices are shown in Table 7 (recognition helix regions designs) and Table 8 (target sites). In Table 8, nucleotides in the target site that are contacted by the ZFP recognition helices are indicated in uppercase letters and non-contacted nucleotides are indicated in lowercase. Zinc Finger Nuclease (ZFN) target sites were designed for all of the previously described 32 selected optimal genomic loci. Numerous ZFP designs were developed and tested to identify the fingers which bound with the highest level of efficiency with 32 different representative genomic loci target sites which were identified and selected in soybean as described above. The specific ZFP recognition helices (Table 7) which bound with the highest level of efficiency to the zinc finger recognition sequences were used for targeting and integration of a donor sequence within the soybean genome.

TABLE 7 zinc finger designs for the soybean selected genomic loci (N/A indicates "not applicable").

| pDAB Number | ZFP Number | F1 | F2 | F3 | F4 | F5 | F6 |
|---|---|---|---|---|---|---|---|
| 124201 | 391 | SEQ ID NO: 7019 QSANRTK | SEQ ID NO: 7020 HRSSLRR | SEQ ID NO: 7021 QSANRTK | SEQ ID NO: 7022 DSSDRKK | SEQ ID NO: 7023 DRSNRTT | SEQ ID NO: 7024 DNSNRIK |
| | | SEQ ID NO: 7025 RSDNLSV | SEQ ID NO: 7026 QKATRIN | SEQ ID NO: 7027 RSDHLSE | SEQ ID NO: 7028 RNDNRKN | SEQ ID NO: 7029 DRSNRTT | SEQ ID NO: 7030 RKYYLAK |
| 124221 | 411 | SEQ ID NO: 7031 DRSNRTT | SEQ ID NO: 7032 QSAHRIT | SEQ ID NO: 7033 HAQGLRH | SEQ ID NO: 7034 QSGHLSR | SEQ ID NO: 7035 QSGHLSR | N/A |
| | | SEQ ID NO: 7036 QSGSLTR | SEQ ID NO: 7037 RLDWLPM | SEQ ID NO: 7038 RPYTLRL | SEQ ID NO: 7039 DNSNRIK | N/A | N/A |
| 125332 | 651 | SEQ ID NO: 7040 TSGNLTR | SEQ ID NO: 7041 TSGNLTR | SEQ ID NO: 7042 QSGDLTR | SEQ ID NO: 7043 HKWVLRQ | N/A | N/A |
| | | SEQ ID NO: 7044 QSGHLAR | SEQ ID NO: 7045 TSSNRKT | SEQ ID NO: 7046 DSSDRKK | SEQ ID NO: 7047 QSGNLAR | SEQ ID NO: 7048 HNSSLKD | N/A |
| 125309 | 655 | SEQ ID NO: 7049 TSGSLSR | SEQ ID NO: 7050 QLNNLKT | SEQ ID NO: 7051 QSADRTK | SEQ ID NO: 7052 DNSNRIK | SEQ ID NO: 7053 TSGSLSR | SEQ ID NO: 7054 QSGDLTR |
| | | SEQ ID NO: 7055 QSANRTK | SEQ ID NO: 7056 DRSNRTT | SEQ ID NO: 7057 QSGDLTR | SEQ ID NO: 7058 HRSSLLN | N/A | N/A |
| 124884 | 195 | SEQ ID NO: 7059 IDHGRYR | SEQ ID NO: 7060 DRSNLTR | SEQ ID NO: 7061 QSGDLTR | SEQ ID NO: 7062 QSGDLTR | SEQ ID NO: 7063 QRNARTL | N/A |
| | | SEQ ID NO: 7064 TSGNLTR | SEQ ID NO: 7065 DRTGLRS | SEQ ID NO: 7066 SQYTLRRD | SEQ ID NO: 7067 TSGHLSR | SEQ ID NO: 7068 RSDHLSE | SEQ ID NO: 7069 QSASRKN |
| 124234 | 424 | SEQ ID NO: 7070 TNQNRIT | SEQ ID NO: 7071 HSNARKT | SEQ ID NO: 7072 QSADRTK | SEQ ID NO: 7073 DNSNRIK | SEQ ID NO: 7074 RSDALTQ | N/A |
| | | SEQ ID NO: 7075 TSGNLTR | SEQ ID NO: 7076 QSNQLRQ | SEQ ID NO: 7077 QSGNLAR | SEQ ID NO: 7078 RQEHRVA | SEQ ID NO: 7079 QSGALAR | SEQ ID NO: 7080 QSGHLSR |
| 124257 | 447 | SEQ ID NO: 7081 QSGSLTR | SEQ ID NO: 7082 WRSCRSA | SEQ ID NO: 7083 WSGNLAR | SEQ ID NO: 7084 WRISLAA | SEQ ID NO: 7085 QKHHLGD | SEQ ID NO: 7086 RSADLSR |

TABLE 7 -continued zinc finger designs for the soybean selected genomic loci
(N/A indicates "not applicable").

| pDAB Number | ZFP Number | F1 | F2 | F3 | F4 | F5 | F6 |
|---|---|---|---|---|---|---|---|
| | | SEQ ID NO: 7087 DRSNRTT | SEQ ID NO: 7088 QSANRIK | SEQ ID NO: 7089 QSANRIK | SEQ ID NO: 7090 DRSNRTT | SEQ ID NO: 7091 QSGNLAR | N/A |
| 125316 | 662 | SEQ ID NO: 7092 QSGNLAR | SEQ ID NO: 7093 TSGNLTR | SEQ ID NO: 7094 DRSNRTT | SEQ ID NO: 7095 QNATRIN | SEQ ID NO: 7096 TSSNRKT | SEQ ID NO: 7097 QSGHLSR |
| | | SEQ ID NO: 7098 DSSTRKT | SEQ ID NO: 7099 QSGNLAR | SEQ ID NO: 7100 RSDVLST | SEQ ID NO: 7101 QSGPLTQ | N/A | N/A |
| 124265 | 455 | SEQ ID NO: 7102 QSGNLAR | SEQ ID NO: 7103 DKSCLPT | SEQ ID NO: 7104 WELNRRT | SEQ ID NO: 7105 TSGNLTR | SEQ ID NO: 7106 DRSNLTR | N/A |
| | | SEQ ID NO: 7107 DRSDLSR | SEQ ID NO: 7108 RREHLRA | SEQ ID NO: 7109 RSDNLAR | SEQ ID NO: 7110 QWNYRGS | SEQ ID NO: 7111 RSHSLLR | SEQ ID NO: 7112 RRDTLLD |
| 124273 | 463 | SEQ ID NO: 7113 QSGDLTR | SEQ ID NO: 7114 QSGNLAR | SEQ ID NO: 7115 HQCCLTS | SEQ ID NO: 7116 RSANLTR | SEQ ID NO: 7117 RSANLAR | SEQ ID NO: 7118 TNQNRIT |
| | | SEQ ID NO: 7119 ATKDLAA | SEQ ID NO: 7120 TSGHLSR | SEQ ID NO: 7121 RSDNLSE | SEQ ID NO: 7122 TSSNRKT | SEQ ID NO: 7123 DRSALAR | SEQ ID NO: 7124 RSDYLAK |
| 124888 | 213 | SEQ ID NO: 7125 rsdnlar | SEQ ID NO: 7126 qsnalnr | SEQ ID NO: 7127 qkgtlge | SEQ ID NO: 7128 qsgsltr | SEQ ID NO: 7129 rsdsllr | SEQ ID NO: 7130 wscclrd |
| | | SEQ ID NO: 7131 qsgsltr | SEQ ID NO: 7132 drsyrnt | SEQ ID NO: 7133 dqsnlra | SEQ ID NO: 7134 rhshlts | SEQ ID NO: 7135 qsgnlar | N/A |
| 124885 | 215 | SEQ ID NO: 7136 tsgnltr | SEQ ID NO: 7137 lsqdlnr | SEQ ID NO: 7138 rsdslsr | SEQ ID NO: 7139 dssartk | SEQ ID NO: 7140 rsdhlsa | SEQ ID NO: 7141 crrnlrn |
| | | SEQ ID NO: 7142 seadrsk | SEQ ID NO: 7143 drsnltr | SEQ ID NO: 7144 drsalsr | SEQ ID NO: 7145 tssnrkt | SEQ ID NO: 7146 ergtlar | SEQ ID NO: 7147 drsalar |
| 124610 | 480 | SEQ ID NO: 7148 STDYRYP | SEQ ID NO: 7149 QSGNLAR | SEQ ID NO: 7150 RSDNLSV | SEQ ID NO: 7151 TRWWLPE | SEQ ID NO: 7152 RSDHLSQ | SEQ ID NO: 7153 TRSPLTT |
| | | SEQ ID NO: 7154 TNQSLHW | SEQ ID NO: 7155 QSGNLAR | SEQ ID NO: 7156 RPYTLRL | SEQ ID NO: 7157 QSGSLTR | SEQ ID NO: 7158 RSDVLSE | SEQ ID NO: 7159 TSSNRKT |
| 124614 | 484 | SEQ ID NO: 7160 RSDVLST | SEQ ID NO: 7161 RNSYLIS | SEQ ID NO: 7162 RSANLAR | SEQ ID NO: 7163 TNQNRIT | SEQ ID NO: 7164 RSDNLSV | N/A |
| | | SEQ ID NO: 7165 RSDHLSA | SEQ ID NO: 7166 RSANLTR | SEQ ID NO: 7167 LRHHLTR | SEQ ID NO: 7168 DRSTLRQ | SEQ ID NO: 7169 HNHDLRN | SEQ ID NO: 7170 TSGNLTR |
| 124636 | 506 | SEQ ID NO: 7171 QSANRTT | SEQ ID NO: 7172 QNAHRKT | SEQ ID NO: 7173 QSGNLAR | SEQ ID NO: 7174 QRNHRTT | SEQ ID NO: 7175 QSANRTK | N/A |

TABLE 7 -continued zinc finger designs for the soybean selected genomic loci
(N/A indicates "not applicable").

| pDAB Number | ZFP Number | F1 | F2 | F3 | F4 | F5 | F6 |
|---|---|---|---|---|---|---|---|
| | | SEQ ID NO: 7176 RSDHLSE | SEQ ID NO: 7177 TSGSLTR | SEQ ID NO: 7178 QSGALAR | SEQ ID NO: 7179 QSGHLSR | N/A | N/A |
| 124648 | 518 | SEQ ID NO: 7180 YRWLRNS | SEQ ID NO: 7181 TNSNRKR | SEQ ID NO: 7182 QSANRTT | SEQ ID NO: 7183 HRSSLRR | SEQ ID NO: 7184 RSDVLSA | SEQ ID NO: 7185 QNATRIN |
| | | SEQ ID NO: 7186 RSDSLLR | SEQ ID NO: 7187 QSCARNV | SEQ ID NO: 7188 RPYTLRL | SEQ ID NO: 7189 HRSSLRR | SEQ ID NO: 7190 RSDSLLR | SEQ ID NO: 7191 QSCARNV |
| 121225 | 233 | SEQ ID NO: 7192 QSSDLSR | SEQ ID NO: 7193 YHWYLKK | SEQ ID NO: 7194 QSANRTK | SEQ ID NO: 7195 DNSNRIK | SEQ ID NO: 7196 QSGNLAR | SEQ ID NO: 7197 DRTNLNA |
| | | SEQ ID NO: 7198 RSDNLSE | SEQ ID NO: 7199 TSANLSR | SEQ ID NO: 7200 QSANRTK | SEQ ID NO: 7201 DNSYLPR | SEQ ID NO: 7202 LKQNLDA | SEQ ID NO: 7203 RSHHLKA |
| 121227 | 235 | SEQ ID NO: 7204 RSDHLSQ | SEQ ID NO: 7205 TARLLKL | SEQ ID NO: 7206 RSDNLTR | SEQ ID NO: 7207 QSSDLSR | SEQ ID NO: 7208 YHWYLKK | N/A |
| | | SEQ ID NO: 7209 DRSNLSR | SEQ ID NO: 7210 TSGNLTR | SEQ ID NO: 7211 DRSNRTT | SEQ ID NO: 7212 TNSNRKR | SEQ ID NO: 7213 RSDSLSV | SEQ ID NO: 7214 QNANRKT |
| 121233 | 241 | SEQ ID NO: 7215 TSGNLTR | SEQ ID NO: 7216 QRSHLSD | SEQ ID NO: 7217 RSDNLSE | SEQ ID NO: 7218 VRRALSS | SEQ ID NO: 7219 RSDNLSV | N/A |
| | | SEQ ID NO: 7220 QSSNLAR | SEQ ID NO: 7221 TSGSLTR | SEQ ID NO: 7222 QSGNLAR | SEQ ID NO: 7223 QKVNRAG | SEQ ID NO: 7224 TSGSLSR | SEQ ID NO: 7225 DSSALAK |
| 121235 | 243 | SEQ ID NO: 7226 QSGDLTR | SEQ ID NO: 7227 RKDPLKE | SEQ ID NO: 7228 QSGNLAR | SEQ ID NO: 7229 ATCCLAH | SEQ ID NO: 7230 QSSDLSR | SEQ ID NO: 7231 RRDNLHS |
| | | SEQ ID NO: 7232 QSGNLAR | SEQ ID NO: 7233 HNSSLKD | SEQ ID NO: 7234 QSGALAR | SEQ ID NO: 7235 QSANRTK | SEQ ID NO: 7236 RSDHLST | SEQ ID NO: 7237 RSDHLSR |
| 121238 | 250 | SEQ ID NO: 7238 TSGNLTR | SEQ ID NO: 7239 DSTNLRA | SEQ ID NO: 7240 DRSHLAR | SEQ ID NO: 7241 RSDDLTR | SEQ ID NO: 7242 TSSNRKT | N/A |
| | | SEQ ID NO: 7243 TSGNLTR | SEQ ID NO: 7244 QSGALVI | SEQ ID NO: 7245 QNAHRKT | SEQ ID NO: 7246 LKHHLTD | SEQ ID NO: 7247 RSDNLST | SEQ ID NO: 7248 DRSNRKT |
| 121246 | 259 | SEQ ID NO: 7249 DRSALSR | SEQ ID NO: 7250 RSDALTQ | SEQ ID NO: 7251 DRSTRTK | SEQ ID NO: 7252 QSGNLHV | SEQ ID NO: 7253 RSDNLTR | N/A |
| | | SEQ ID NO: 7254 DRSNLSR | SEQ ID NO: 7255 QSGNLAR | SEQ ID NO: 7256 RSDSLLR | SEQ ID NO: 7257 WLSSLSA | N/A | N/A |
| 121249 | 262 | SEQ ID NO: 7258 RSDNLST | SEQ ID NO: 7259 DSSSRIK | SEQ ID NO: 7260 QSGALAR | SEQ ID NO: 7261 QSGNLHV | SEQ ID NO: 7262 RSDVLST | SEQ ID NO: 7263 RYAYLTS |

TABLE 7 -continued zinc finger designs for the soybean selected genomic loci
(N/A indicates "not applicable").

| pDAB Number | ZFP Number | F1 | F2 | F3 | F4 | F5 | F6 |
|---|---|---|---|---|---|---|---|
| | | SEQ ID NO: 7264 RSDNLSE | SEQ ID NO: 7265 TRSPLRN | SEQ ID NO: 7266 QNAHRKT | SEQ ID NO: 7267 RSDHLSE | SEQ ID NO: 7268 RNDNRKN | |
| 125324 | 670 | SEQ ID NO: 7269 QRTNLVE | SEQ ID NO: 7270 ASKTRTN | SEQ ID NO: 7271 RSANLAR | SEQ ID NO: 7272 RSDHLTQ | SEQ ID NO: 7273 RSAHLSR | N/A |
| | | SEQ ID NO: 7274 RSDNLSV | SEQ ID NO: 7275 QNANRIT | SEQ ID NO: 7276 DQSNLRA | SEQ ID NO: 7277 QNAHRKT | SEQ ID NO: 7278 RSAHLSR | N/A |
| 121265 | 282 | SEQ ID NO: 7279 DRSALAR | SEQ ID NO: 7280 RSDYLAK | SEQ ID NO: 7281 RSDDLSR | SEQ ID NO: 7282 RNDNRTK | SEQ ID NO: 7283 RSDHLST | SEQ ID NO: 7284 HSNTRKN |
| | | SEQ ID NO: 7285 RSDVLSE | SEQ ID NO: 7286 QRSNLKV | SEQ ID NO: 7287 QSSNLAR | SEQ ID NO: 7288 QSGHLSR | N/A | N/A |
| 121271 | 288 | SEQ ID NO: 7289 DRSDLSR | SEQ ID NO: 7290 LRFNLRN | SEQ ID NO: 7291 RSDSLSV | SEQ ID NO: 7292 QNANRKT | N/A | N/A |
| | | SEQ ID NO: 7293 QSGDLTR | SEQ ID NO: 7294 TSGSLTR | SEQ ID NO: 7295 RSDDLTR | SEQ ID NO: 7296 YRWLLRS | SEQ ID NO: 7297 QSGDLTR | N/A |
| 124666 | 538 | SEQ ID NO: 7298 RSDNLST | SEQ ID NO: 7299 AACNRNA | SEQ ID NO: 7300 RPYTLRL | SEQ ID NO: 7301 QSGSLTR | SEQ ID NO: 7302 SQYTLRD | SEQ ID NO: 7303 TSGHLSR |
| | | SEQ ID NO: 7304 QSANRTK | SEQ ID NO: 7305 DRSNRTT | SEQ ID NO: 7306 RSDVLST | SEQ ID NO: 7307 CRRNLRN | N/A | N/A |
| 124814 | 598 | SEQ ID NO: 7308 QSGDLTR | SEQ ID NO: 7309 HRSSLLN | SEQ ID NO: 7310 TNQSLHW | SEQ ID NO: 7311 QSGNLAR | SEQ ID NO: 7312 QSGNLAR | N/A |
| | | SEQ ID NO: 7313 RSCCLHL | SEQ ID NO: 7314 RNASRTR | SEQ ID NO: 7315 QSGNLAR | SEQ ID NO: 7316 RQEHRVA | SEQ ID NO: 7317 RSDNLSE | SEQ ID NO: 7318 TSSNRKT |
| 124690 | 560 | SEQ ID NO: 7319 RSDVLSE | SEQ ID NO: 7320 QRSNLKV | SEQ ID NO: 7321 QSGALAR | SEQ ID NO: 7322 YRWLRNS | SEQ ID NO: 7323 QSANRTT | SEQ ID NO: 7324 DRSNRTT |
| | | SEQ ID NO: 7325 QNAHRKT | SEQ ID NO: 7326 LAHHLVQ | SEQ ID NO: 7327 HAQGLRH | SEQ ID NO: 7328 QSGHLSR | SEQ ID NO: 7329 RSDDLTR | SEQ ID NO: 7330 RRFTLSK |
| 124815 | 599 | SEQ ID NO: 7331 RSDNLSE | SEQ ID NO: 7332 KSWSRYK | SEQ ID NO: 7333 RSAHLSR | SEQ ID NO: 7334 RSDDLTR | SEQ ID NO: 7335 YSWTLRD | SEQ ID NO: 7336 TSGNLTR |
| | | SEQ ID NO: 7337 RSDVLST | SEQ ID NO: 7338 DNSSRTR | SEQ ID NO: 7339 RSDALAR | SEQ ID NO: 7340 RSDSLSA | SEQ ID NO: 7341 DRSDLSR | N/A |
| 124816 | 600 | SEQ ID NO: 7342 GTQGLGI | SEQ ID NO: 7343 DRSNLTR | SEQ ID NO: 7344 RNDDRKK | SEQ ID NO: 7345 RSDVLSE | SEQ ID NO: 7346 RSSDRTK | N/A |

TABLE 7 -continued zinc finger designs for the soybean selected genomic loci (N/A indicates "not applicable").

| pDAB Number | ZFP Number | F1 | F2 | F3 | F4 | F5 | F6 |
|---|---|---|---|---|---|---|---|
| | | SEQ ID NO: 7347 QSANRTK | SEQ ID NO: 7348 DSSHRTR | SEQ ID NO: 7349 QSANRTK | SEQ ID NO: 7350 SVGNLNQ | SEQ ID NO: 7351 TSGNLTR | N/A |
| 124842 | 631 | SEQ ID NO: 7352 TNQNRIT | SEQ ID NO: 7353 HSNARKT | SEQ ID NO: 7354 QSSHLTR | SEQ ID NO: 7355 RLDNRTA | SEQ ID NO: 7356 QSGNLAR | SEQ ID NO: 7357 QGANLIK |
| | | SEQ ID NO: 7358 RSDNLST | SEQ ID NO: 7359 QKSPLNT | SEQ ID NO: 7360 QSSDLSR | SEQ ID NO: 7361 QSSDLSR | SEQ ID NO: 7362 YHWYLKK | N/A |
| 125338 | 37 | SEQ ID NO: 7574 TSSNRKT | SEQ ID NO: 7575 RSDELRG | SEQ ID NO: 7576 RSDTLSA | SEQ ID NO: 7577 DKSTRTK | N/A | N/A |
| | | SEQ ID NO: 7578 DRSTRTK | SEQ ID NO: 7579 QSGNLHV | SEQ ID NO: 7580 QNAHRKT | SEQ ID NO: 7581 QSANRTK | SEQ ID NO: 7582 TSGSLSR | SEQ ID NO: 7583 FYMQLSR |

TABLE 8

Zinc finger target site of soybean selected genomic loci

| Locus ID | Name | pDAB Number | ZFP Number and Binding Sites (5'→3') |
|---|---|---|---|
| OGL 01 | soy_ogl_308 | 124201 391 | SEQ ID NO: 7363 TACTATTCCTAAG TTAAA / SEQ ID NO: 7364 TGGTACTAGGGGA TAAAG |
| OGL 02 | soy_ogl_307 | 124221 411 | SEQ ID NO: 7365 GGAGGAATTTA GATAC / SEQ ID NO: 7366 TACTTGCTGGTA |
| OGL 03 | soy_ogl_2063 | 125305 651 | SEQ ID NO: 7367 ATCATCTGCAAA / SEQ ID NO: 7368 CTTGAATTCCT ATGGA |
| OGL 04 | soy_ogl_1906 | 125309 655 | SEQ ID NO: 7369 AACTTGTGAGTAA ACTGC / SEQ ID NO: 7370 ATTGCATAATAA |
| OGL 05 | soy_ogl_262 | 124884 195 | SEQ ID NO: 7371 GTTGTCTTGCT GCTAT / SEQ ID NO: 7372 ACACAGGGTATCT TCGAT |
| OGL 06 | soy_ogl_5227 | 124234 424 | SEQ ID NO: 7373 ATGTACTCATA TTCAT / SEQ ID NO: 7374 GGAGTAAGGGAAA AAGAT |
| OGL 07 | soy_ogl_4074 | 124257 447 | SEQ ID NO: 7375 GCTCGTCATTGAA TTGTGTA / SEQ ID NO: 7376 GAAAAATAATT AATAC |
| OGL 08 | soy_ogl_3481 | 125316 662 | SEQ ID NO: 7377 GGATATATAAACG ATGAA / SEQ ID NO: 7378 ATAATGGAACCC |
| OGL 09 | soy_ogl_1016 | 124265 455 | SEQ ID NO: 7379 GACGATCACC TCGAA / SEQ ID NO: 7380 CCGGTGTCAGAGA GGGCC |
| OGL 10 | soy_ogl_937 | 124273 463 | SEQ ID NO: 7381 AATGAGAGAGG AGAAGCA / SEQ ID NO: 7382 CAGATCAATCAGG GTCCC |
| OGL 11 | soy_ogl_5109 | 124888 213 | SEQ ID NO: 7383 CTCTACATGGTA CCACTCG / SEQ ID NO: 7384 GAAAGGCACC TCGTA |
| OGL 12 | soy_ogl_6801 | 124885 215 | SEQ ID NO: 7385 ATCAGCCACGAT CCTGCA / SEQ ID NO: 7386 GTCGCCCATGTCTG ACTCA |
| OGL 13 | soy_ogl_6636 | 124610 480 | SEQ ID NO: 7387 CTATAGTTTTAAG TGAATTA / SEQ ID NO: 7388 TATATGGTATTGG AAATT |
| OGL 14 | soy_ogl_4665 | 124614 484 | SEQ ID NO: 7389 CATCGTCTCA TGCTT / SEQ ID NO: 7390 GATCCTACAAGTG AGAGG |
| OGL 15 | soy_ogl_6189 | 124636 506 | SEQ ID NO: 7391 TTTTCTTTCT CTTTA / SEQ ID NO: 7392 GGAGTAGTTAGG |
| OGL 16 | soy_ogl_4222 | 124648 518 | SEQ ID NO: 7393 AACATCTTTAACT CATTGT / SEQ ID NO: 7394 ATAGTGGTTTGC ATAGTG |
| OGL 17 | soy_ogl_2543 | 121225 233 | SEQ ID NO: 7395 CACGAAAAACTA AATTTGCT / SEQ ID NO: 7396 AGGTATTTCTAAG ATAGG |
| OGL 18 | soy_ogl_310 | 121227 235 | SEQ ID NO: 7397 TTTGCTGAGT GAAGG / SEQ ID NO: 7398 CAAATGTGATAAC TGATGAC |
| OGL 19 | soy_ogl_2353 | 121233 241 | SEQ ID NO: 7399 AAGATGAAGC GAGAT / SEQ ID NO: 7400 ATCGTTCAAGAAG TTGAA |

TABLE 8-continued

Zinc finger target site of soybean selected genomic loci

| Locus ID Name | pDAB Number | ZFP Number and Binding Sites (5'→3') | |
|---|---|---|---|
| OGL soy_20 ogl_1894 | 121235 | 243 SEQ ID NO: 7401 CAGGCTGGCAAA ATGGAA | SEQ ID NO: 7402 GGGTGGTAAGTAC TTGAA |
| OGL soy_22 ogl_3218 | 121238 | 250 SEQ ID NO: 7403 AATGCGTGGC CACGAT | SEQ ID NO: 7404 AACTAGCGTAGA GTAGAT |
| OGL soy_24 ogl_3333 | 121246 | 259 SEQ ID NO: 7405 GAGAAAGCCA TGGTC | SEQ ID NO: 7406 TGTGTGGAAGAC |
| OGL soy_25 ogl_2546 | 121249 | 262 SEQ ID NO: 7407 TGGATGTCAAGT ATTCAAG | SEQ ID NO: 7408 TAGGGGAGAA TACAG |
| OGL soy_28 ogl_5957 | 125324 | 670 SEQ ID NO: 7409 GGGAGGGAGA CCCAA | SEQ ID NO: 7410 GGGAGAAACA AAAAG |
| OGL soy_30 ogl_3818 | 121265 | 282 SEQ ID NO: 7411 GTTTGGTTAGGCG CAGATC | SEQ ID NO: 7412 GGAGAAACAACTG |
| OGL soy_31 ogl_5551 | 121271 | 288 SEQ ID NO: 7413 AAAGTGTC ATGCC | SEQ ID NO: 7414 GCAATTGCGG TTGCA |
| OGLoptimal_loci_33 1098 | 124666 | 538 SEQ ID NO: 7415 GGTATCGTATTGC ATTAG | SEQ ID NO: 7416 CGCACGTAATAA |
| OGLoptimal_loci_34 97772 | 124814 | 598 SEQ ID NO: 7417 GAAGAAATTA TTGCA | SEQ ID NO: 7418 AATCAGAGGGAAG TGAGA |
| OGLoptimal_loci_35 236662 | 124690 | 560 SEQ ID NO: 7419 AACTAACTTGTA ACAACTG | SEQ ID NO: 7420 TTGGCGGGAATTA GTAGA |
| OGLoptimal_loci_36 139485 | 124815 | 599 SEQ ID NO: 7421 GATCTTGCGGGG TAGCAG | SEQ ID NO: 7422 GACCTGGTGG TCATG |
| OGLoptimal_loci_37 301175 | 125338 | 627 SEQ ID NO: 7584 ATACGTCAGGGTt antgGTTGTTTAAT GAAAAGCC | OGL37 |
| OGLoptimal_loci_38 152337 | 124816 | 600 SEQ ID NO: 7423 TCTATGTCGG ACTTT | SEQ ID NO: 7424 GATCATTTAAG GATAA |
| OGLoptimal_loci_39 202616 | 124842 | 631 SEQ ID NO: 7425 ATGAATTCCCTTT TCTTA | SEQ ID NO: 7426 TTTGCTGCTTT ATAG |

The soybean representative genomic loci zinc finger designs were incorporated into zinc finger expression vectors encoding a protein having at least one finger with a CCHC structure. See, U.S. Patent Publication No. 2008/0182332. In particular, the last finger in each protein had a CCHC backbone for the recognition helix. The non-canonical zinc finger-encoding sequences were fused to the nuclease domain of the type IIS restriction enzyme FokI (amino acids 384-579 of the sequence of Wah et al., (1998) Proc. Natl. Acad. Sci. USA 95:10564-10569) via a four amino acid ZC linker and an opaque-2 nuclear localization signal optimized for soybean to form zinc-finger nucleases (ZFNs). See, U.S. Pat. No. 7,888,121. Zinc fingers for the various functional domains were selected for in vivo use. Of the numerous ZFNs that were designed, produced and tested to bind to the putative genomic target site, the ZFNs described in Table 8 above were identified as having in vivo activity and were characterized as being capable of efficiently binding and cleaving the unique soybean genomic polynucleotide target sites in planta.

ZFN Construct Assembly

Plasmid vectors containing ZFN gene expression constructs were designed and completed using skills and techniques commonly known in the art (see, for example, Ausubel or Maniatis). Each ZFN-encoding sequence was fused to a sequence encoding an opaque-2 nuclear localization signal (Maddaloni et al., (1989) Nuc. Acids Res. 17:7532), that was positioned upstream of the zinc finger nuclease. The non-canonical zinc finger-encoding sequences were fused to the nuclease domain of the type IIS restriction enzyme FokI (amino acids 384-579 of the sequence of Wah et al. (1998) Proc. Natl. Acad. Sci. USA 95:10564-10569). Expression of the fusion proteins was driven by a strong constitutive promoter from the Cassava vein mosaic virus. The expression cassette also includes a 3' UTR from the *Agrobacterium tumefaciens* ORF23. The self-hydrolyzing 2A encoding the nucleotide sequence from *Thosea asigna* virus (Szymczak et al., (2004) Nat Biotechnol. 22:760-760) was added between the two Zinc Finger Nuclease fusion proteins that were cloned into the construct.

The plasmid vectors were assembled using the IN-FUSION™ Advantage Technology (Clontech, Mountain View, Calif.). Restriction endonucleases were obtained from New England BioLabs (Ipswich, Mass.) and T4 DNA Ligase (Invitrogen, Carlsbad, Calif.) was used for DNA ligation. Plasmid preparations were performed using NUCLEO-SPIN® Plasmid Kit (Macherey-Nagel Inc., Bethlehem, Pa.) or the Plasmid Midi Kit (Qiagen) following the instructions of the suppliers. DNA fragments were isolated using QIA-QUICK GEL EXTRACTION KIT™ (Qiagen) after agarose tris-acetate gel electrophoresis. Colonies of all ligation reactions were initially screened by restriction digestion of miniprep DNA. Plasmid DNA of selected clones was sequenced by a commercial sequencing vendor (Eurofins MWG Operon, Huntsville, Ala.). Sequence data were assembled and analyzed using the SEQUENCHER™ software (Gene Codes Corp., Ann Arbor, Mich.). Plasmids were constructed and confirmed via restriction enzyme digestion and via DNA sequencing.

Zinc Finger Cloning Via Automated Workflow

A subset of Zinc Finger Nuclease vectors were cloned via an automated DNA construction pipeline. Overall, the automted pipeline resulted in vector constructions with identical ZFN architecture as described previously. Each Zinc Finger monomer, which confers the DNA binding specificity of the ZFN, were divided into 2-3 unique sequences at a KPF amino acid motif. Both the 5' and 3' ends of the ZFN fragments were modified with inclusion of a BsaI recognition site (GGTCTCN) and derived overhangs. Overhangs were distributed such that a 6-8 part assembly would only result in the desired full length expression clone. Modified DNA fragments were synthesized de novo (Synthetic Genomics Incorporated, La Jolla, Calif.). A single dicot backbone, pDAB118796 was used in all of the soybean ZFN builds. It contained the Cassava Mosaic Virus promoter and the Opaque2 NLS as well as the FokI domain and the Orf23 3'UTR from *Agrobacterium tumefaciens*. Cloned in between the Opaque 2 NLS and the FokI domain was a BsaI flanked SacB gene from *Bacillus subtilis*. When putative ligation events were plated on Sucrose containing media, the SacB cassette acts as a negative selection agent reducing or eliminating vector backbone contamination. A second part repeatedly utilized in all builds was pDAB117443. This vector contains the first monomer Fok1 domain, the T2A stutter sequence, and the 2$^{nd}$ monomer Opaque2 NLS all flanked by BsaI sites.

Using these materials as as the ZFN DNA parts library, a Freedom Evo 150® (TECAN, Mannedorf, Switzerland) manipulated the addition of 75-100 ng of each DNA plasmid or synthesized fragment from 2D bar coded tubes into a PCR plate (ThermoFisher, Waltham, Mass.). BsaI (NEB, Ipswich, Mass.) and T4 DNA ligase (NEB, Ipswich, Mass.) supplemented with Bovine Serum Albumin protein (NEB, Ipswich, Mass.) and T4 DNA Ligase Buffer (NEB, Ipswich, Mass.) were added to the reaction. Reactions were cycled (25×) with incubations for 3 minutes at 37° C. and 4 minutes at 16° C. C1000 Touch Thermo Cycler® (BioRad, Hercules Calif.). Ligated material was transformed and screened in Top10 Cells® (Life Technologies Carlsbad, Calif.) by hand or using a Qpix460 colony picker and LabChip GX® (Perkin Elmer, Waltham, Mass.). Correctly digesting colonies were sequence confirmed provided to plant transformation.

Universal Donor Construct Assembly

To support rapid testing of a large number of target loci, a novel, flexible universal donor system sequence was designed and constructed. The universal donor polynucleotide sequence was compatible with high throughput vector construction methodologies and analysis. The universal donor system was composed of at least three modular domains: a variable ZFN binding domain, a non-variable analytical and user defined features domain, and a simple plasmid backbone for vector scale up. The non-variable universal donor polynucleotide sequence was common to all donors and permits design of a finite set of assays that can be used across all of the soybean target sites thus providing uniformity in targeting assessment and reducing analytical cycle times. The modular nature of these domains allowed for high throughput donor assembly. Additionally, the universal donor polynucleotide sequence has other unique features aimed at simplifying downstream analysis and enhancing the interpretation of results. It contained an asymmetric restriction site sequence that allows the digestion of PCR products into diagnostically predicted sizes. Sequences comprising secondary structures that were expected to be problematic in PCR amplification were removed. The universal donor polynucleotide sequence was small in size (less than 3.0 Kb). Finally, the universal donor polynucleotide sequence was built upon the high copy pUC19 backbone that allows a large amount of test DNA to be bulked in a timely fashion.

Figure 7:
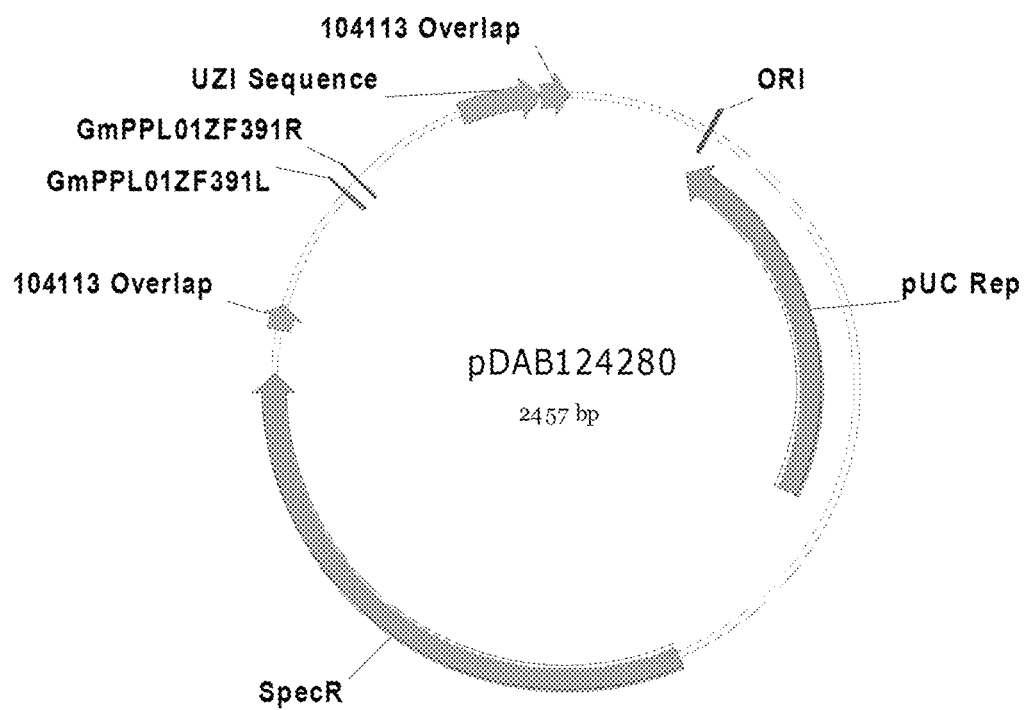
FIG. 7. Plasmid map of pDAB124280 (SEQ ID NO:7561). The numbered elements (i.e., GmPPL01ZF391R and GMPPL01ZF391L) correspond with zinc finger nuclease binding sequences of about 20 to 35 base pairs in length that are recognized and cleaved by corresponding zinc finger nuclease proteins. These zinc finger binding sequences and the annotated "UZI Sequence" (which is a 100-150 bp template region containing restriction sites and DNA sequences for primer design or coding sequences) comprise the universal donor cassette. Further included in this plasmid design is the "104113 Overlap" which are sequences that share homology to the plasmid vector for high throughput assembly of the universal donor cassettes within a plasmid vector (i.e., via Gibson assembly).
Figure 8:
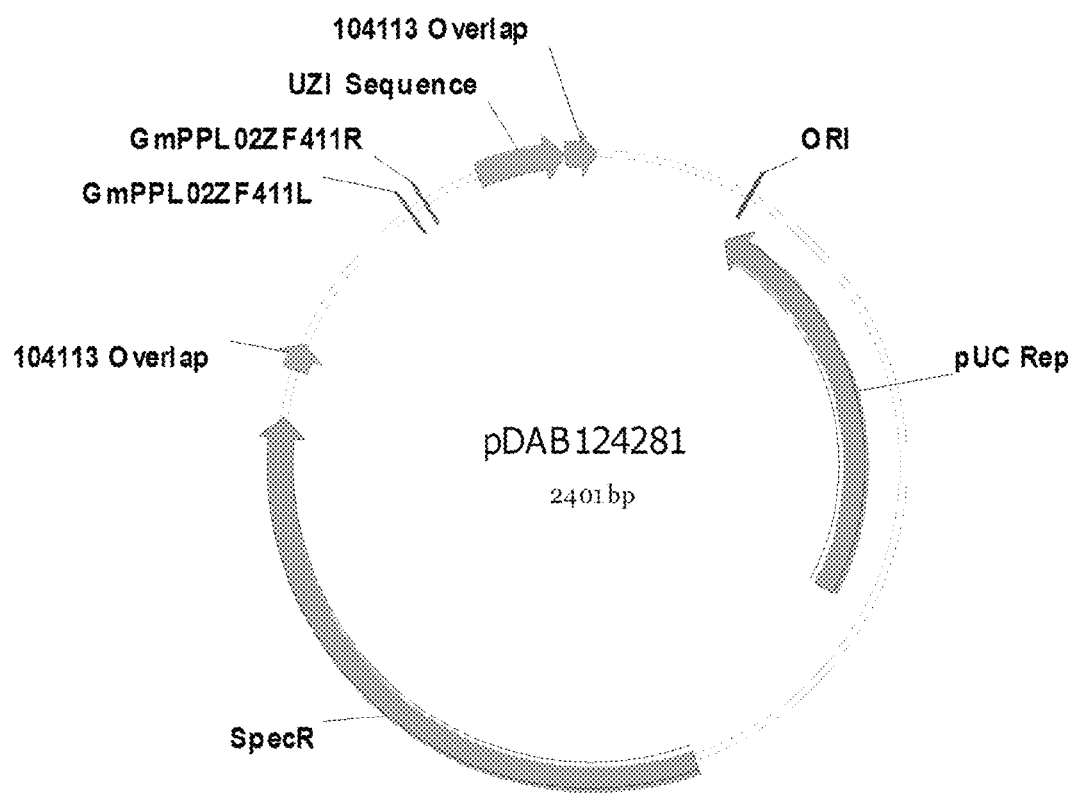
FIG. 8. Plasmid map of pDAB124281 (SEQ ID NO:7562). The numbered elements (i.e., GmPPL02ZF411R and GMPPL02ZF411L) correspond with zinc finger nuclease binding sequences of about 20 to 35 base pairs in length that are recognized and cleaved by corresponding zinc finger nuclease proteins. These zinc finger binding sequences and the annotated "UZI Sequence" (which is a 100-150 bp template region containing restriction sites and DNA sequences for primer design or coding sequences) comprise the universal donor cassette. Further included in this plasmid design is the "104113 Overlap" which are sequences that share homology to the plasmid vector for high throughput assembly of the universal donor cassettes within a plasmid vector (i.e., via Gibson assembly).
Figure 9:
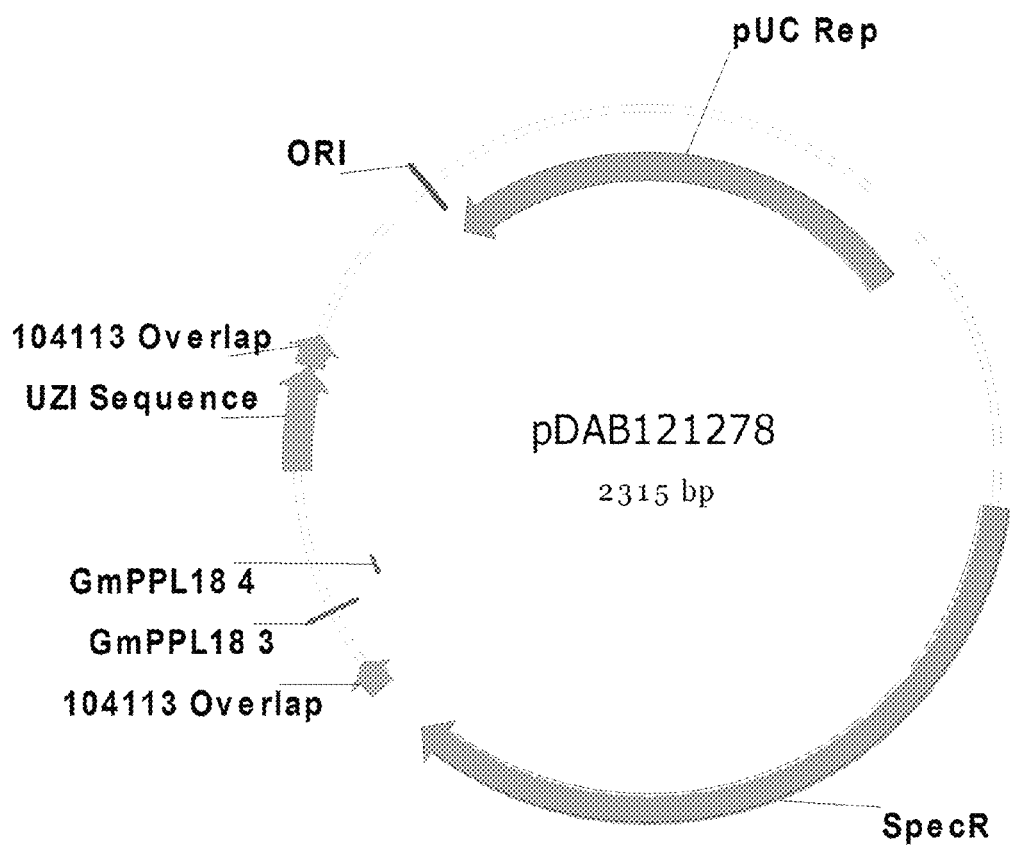
FIG. 9. Plasmid map of pDAB121278 (SEQ ID NO:7563). The numbered elements (i.e., GmPPL18_4 and GMPPL18_3) correspond with zinc finger nuclease binding sequences of about 20 to 35 base pairs in length that are recognized and cleaved by corresponding zinc finger nuclease proteins. These zinc finger binding sequences and the annotated "UZI Sequence" (which is a 100-150 bp template region containing restriction sites and DNA sequences for primer design or coding sequences) comprise the universal donor cassette. Further included in this plasmid design is the "104113 Overlap" which are sequences that share homology to the plasmid vector for high throughput assembly of the universal donor cassettes within a plasmid vector (i.e., via Gibson assembly).
Figure 10:
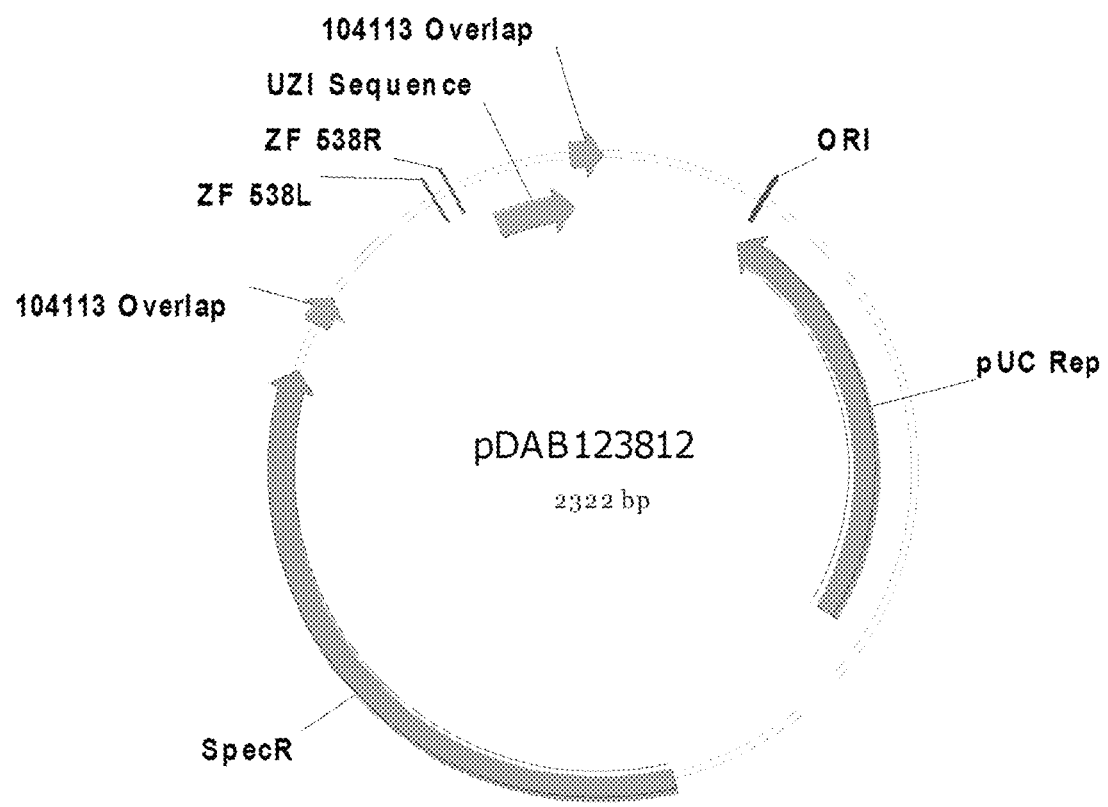
FIG. 10. Plasmid map of pDAB123812 (SEQ ID NO:7564). The numbered elements (i.e., ZF538R and ZF538L) correspond with zinc finger nuclease binding sequences of about 20 to 35 base pairs in length that are recognized and cleaved by corresponding zinc finger nuclease proteins. These zinc finger binding sequences and the annotated "UZI Sequence" (which is a 100-150 bp template region containing restriction sites and DNA sequences for primer design or coding sequences) comprise the universal donor cassette. Further included in this plasmid design is the "104113 Overlap" which are sequences that share homology to the plasmid vector for high throughput assembly of the universal donor cassettes within a plasmid vector (i.e., via Gibson assembly).
Figure 11:
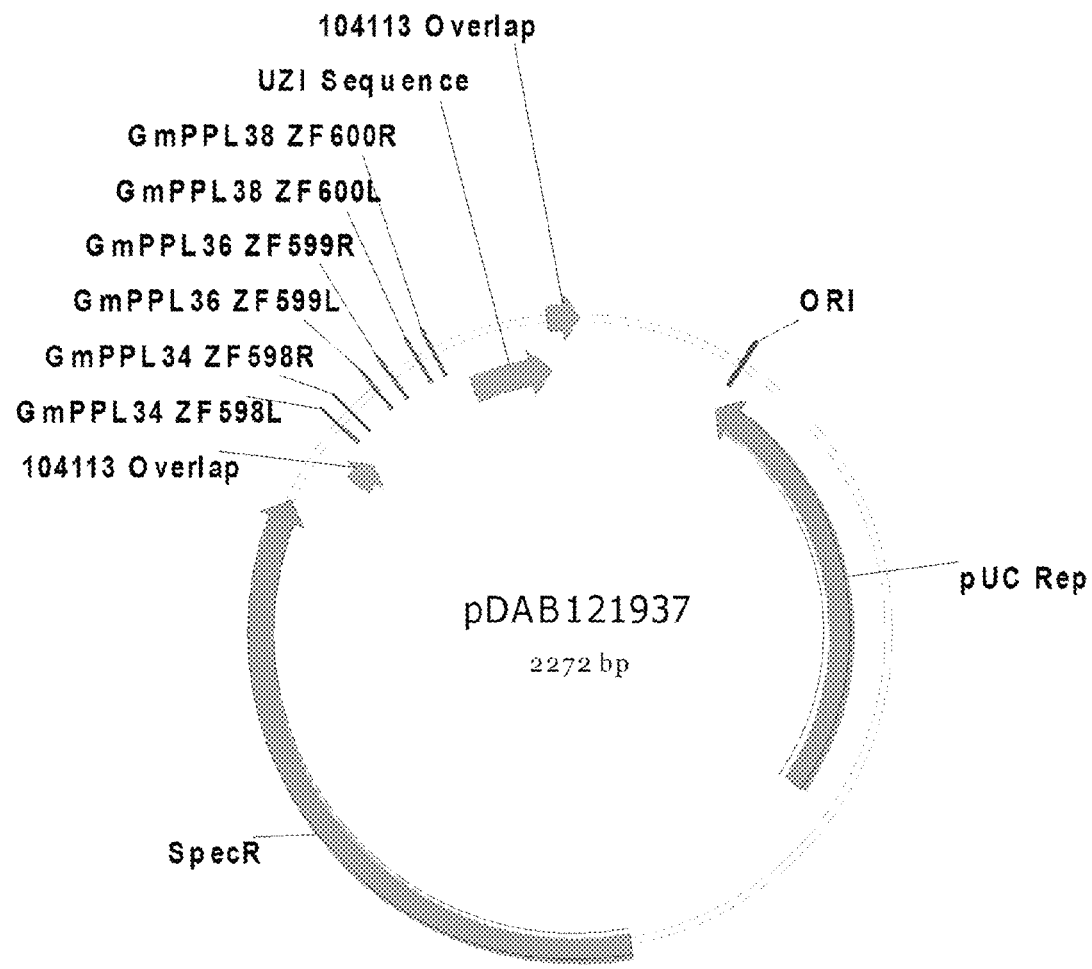
FIG. 11. Plasmid map of pDAB121937 (SEQ ID NO:7565). The numbered elements (i.e., GmPPL34ZF598L, GmPPL34ZF598R, GmPPL36ZF599L, GmPPL36ZF599R, GmPPL36ZF600L, and GmPPL36ZF600R) correspond with zinc finger nuclease binding sequences of about 20 to 35 base pairs in length that are recognized and cleaved by corresponding zinc finger nuclease proteins. These zinc finger binding sequences and the annotated "UZI Sequence" (which is a 100-150 bp template region containing restriction sites and DNA sequences for primer design or coding sequences) comprise the universal donor cassette. Further included in this plasmid design is the "104113 Overlap" which are sequences that share homology to the plasmid vector for high throughput assembly of the universal donor cassettes within a plasmid vector (i.e., via Gibson assembly).
Figure 12:
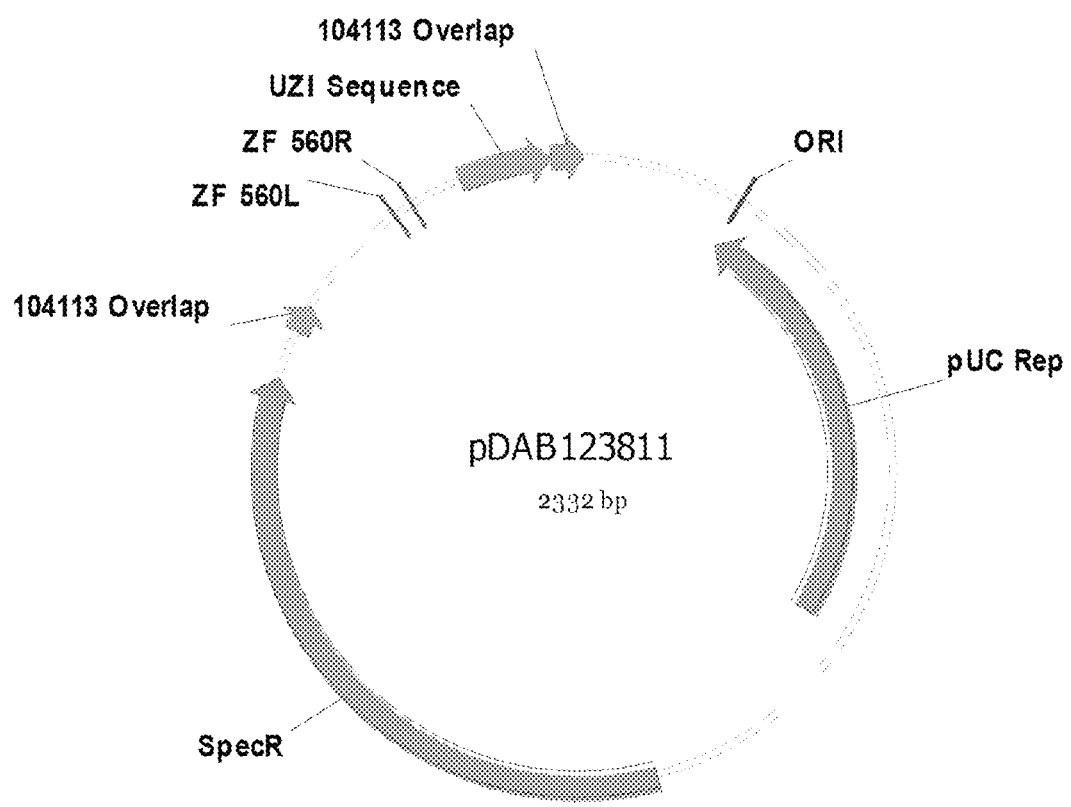
FIG. 12. Plasmid map of pDAB123811 (SEQ ID NO:7566). The numbered elements (i.e., ZF 560L and ZF 560R) correspond with zinc finger nuclease binding sequences of about 20 to 35 base pairs in length that are recognized and cleaved by corresponding zinc finger nuclease proteins. These zinc finger binding sequences and the annotated "UZI Sequence" (which is a 100-150 bp template region containing restriction sites and DNA sequences for primer design or coding sequences) comprise the universal donor cassette. Further included in this plasmid design is the "104113 Overlap" which are sequences that share homology to the plasmid vector for high throughput assembly of the universal donor cassettes within a plasmid vector (i.e., via Gibson assembly).
Figure 13:
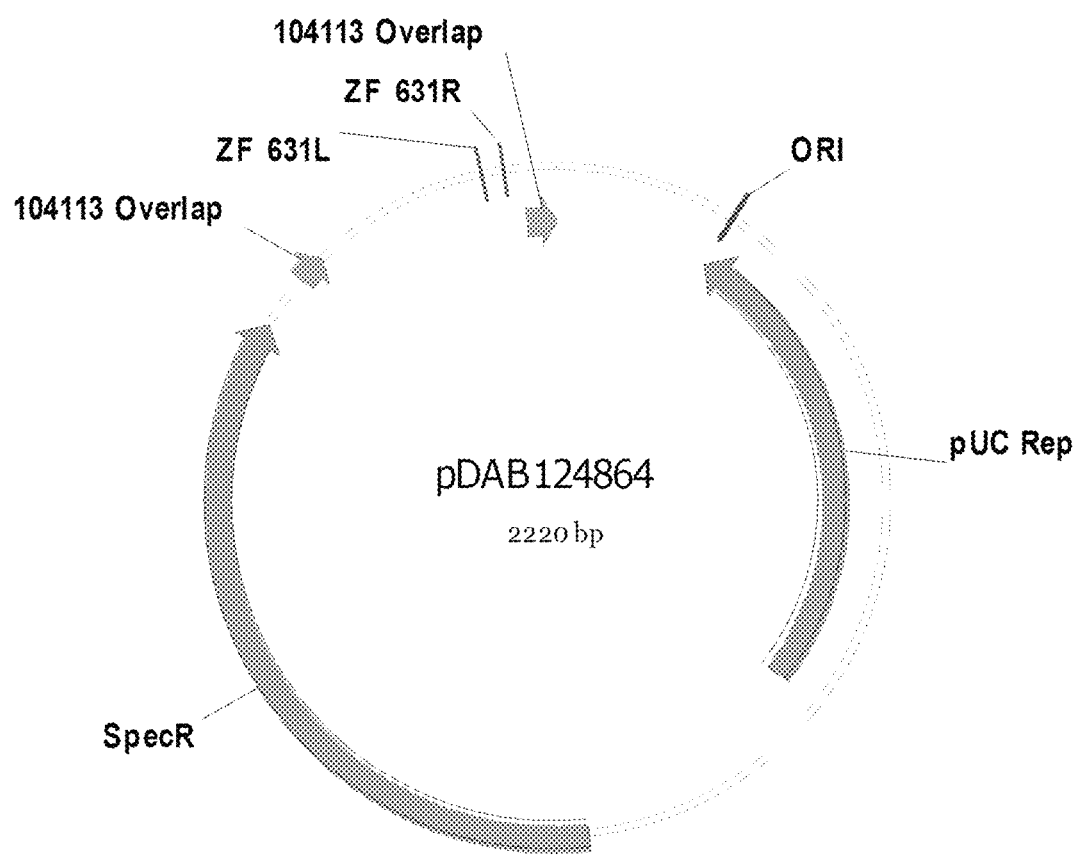
FIG. 13. Plasmid map of pDAB124864 (SEQ ID NO:7567). The numbered elements (i.e., ZF631L and ZF631R) correspond with zinc finger nuclease binding sequences of about 20 to 35 base pairs in length that are recognized and cleaved by corresponding zinc finger nuclease proteins. These zinc finger binding sequences and the annotated "UZI Sequence" (which is a 100-150 bp template region containing restriction sites and DNA sequences for primer design or coding sequences) comprise the universal donor cassette. Further included in this plasmid design is the "104113 Overlap" which are sequences that share homology to the plasmid vector for high throughput assembly of the universal donor cassettes within a plasmid vector (i.e., via Gibson assembly).

As an embodiment, an example plasmid comprising a universal donor polynucleotide sequence is provided as pDAB124280 (SEQ ID NO:7561 and FIG. 7). In an additional embodiment, a universal donor polynucleotide sequence is provided as: pDAB124281, SEQ ID NO:7562, FIG. 8; pDAB121278, SEQ ID NO:7563, FIG. 9; pDAB123812, SEQ ID NO:7564 FIG. 10; pDAB121937, SEQ ID NO:7565, FIG. 11; pDAB123811, SEQ ID NO:7566, FIG. 12; and, pDAB124864 SEQ ID NO:7567, FIG. 13. In another embodiment, additional sequences comprising the universal donor polynucleotide sequence with functionally expressing coding sequence or nonfunctional (promoterless) expressing coding sequences can be constructed (Table 11).

TABLE 11

The various universal domain sequences that were transformed into the plant cell protoplasts for donor mediated integration within the genome of soybean are provided. The various elements of the universal domain plasmid system are described and identified by base pair position in the accompanying SEQ ID NO:.

| Vector Name | ZFN binding domain | Analytical domain | Plasmid backbone | SEQ ID NO: |
|---|---|---|---|---|
| pDAB124280 | 1955-2312bp | 2313-2422bp | 2423-1954bp | A1 |
| pDAB124281 | 1955-2256bp | 2257-2366bp | 2367-1954bp | A2 |
| pDAB121278 | 1509-1724bp | 1725-1834bp | 1835-1508bp | A3 |
| pDAB123812 | 1955-2177bp | 2178-2287bp | 2288-1954bp | A4 |
| pDAB121937 | 1955-2127bp | 2128-2237bp | 2238-1954bp | A5 |
| pDAB123811 | 1955-2187bp | 2288-2297bp | 2298-1954bp | A6 |
| pDAB124864 | 1952-2185 | N/A | 2186-1951bp | A7 |

"N/A" means not applicable.

Figure 4:
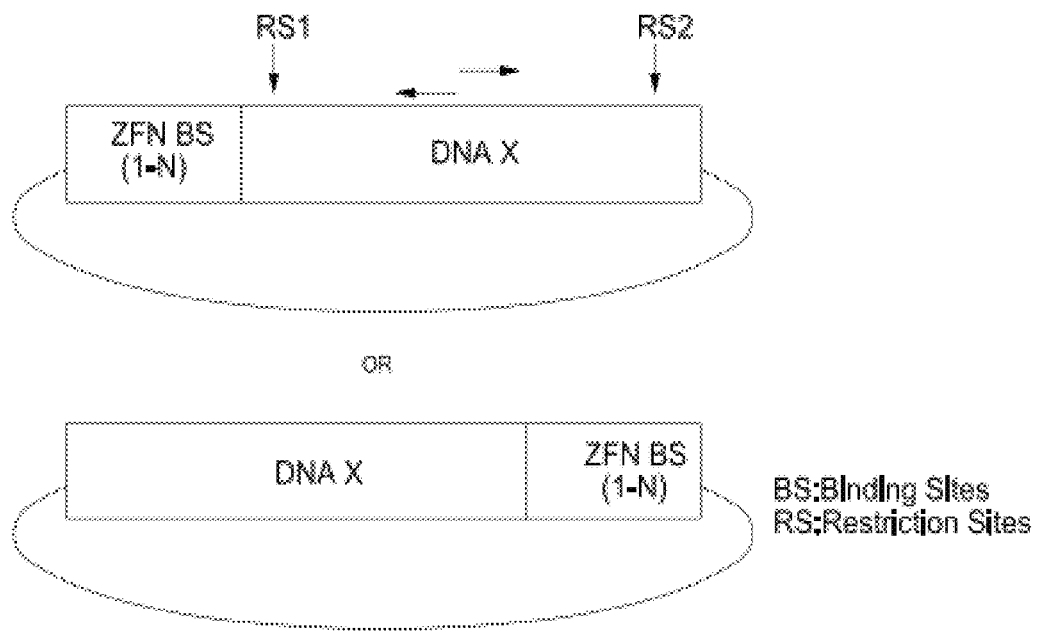
FIG. 4. Representation of the universal donor polynucleotide sequence for integration via non-homologous end joining (NHEJ). Two proposed vectors are provide wherein a DNA of interest (DNA X) comprises one or more (i.e., "1-N") zinc finger binding sites (ZFN BS) at either end of the DNA of interest. Vertical arrows show unique restriction sites and horizontal arrows represent potential PCR primer sites.
Figure 5:
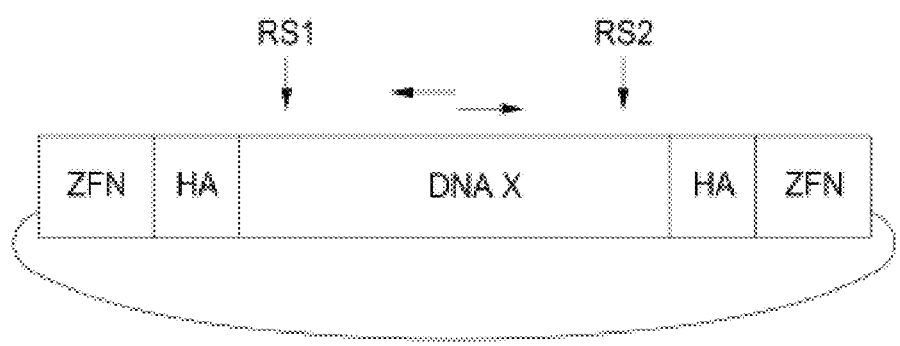
FIG. 5. Representation of the universal donor polynucleotide sequence for integration via homologous-directed repair (HDR). A DNA of interest (DNA X) comprising two regions of homologous sequences (HA) flanking the DNA of interest with zinc finger nuclease binding sites (ZFN) bracketing the DNAX and HA sequences. Vertical arrows show unique restriction sites and horizontal arrows represent potential PCR primer sites.

The universal donor polynucleotide sequence was a small 2-3 Kb modular donor system delivered as a plasmid. This was a minimal donor, comprising 1, 2, 3, 4, 5, 6, 7, 8, 9, or more ZFN binding sites, a short 100-150 by template region referred to as "DNA X" or "UZI Sequence" (SEQ ID NO:7568) that carries restriction sites and DNA sequences for primer design or coding sequences, and a simple plasmid backbone (FIG. 4). The entire plasmid was inserted through NHEJ following DNA double strand breaks at the appropriate ZFN binding site; the ZFN binding sites can be incorporated tandemly. This embodiment of a universal donor polynucleotide sequence was most suitable for rapid screening of target sites and ZFNs, and sequences that were difficult to amplify were minimized in the donor. Universal donors without the "UZI" sequence but carrying one or more ZFN sites have also been generated In a further embodiment the universal donor polynucleotide sequence was made up of at least 4 modules and carries ZFN binding sites, homology arms, DNA X with either just the approximately 100 by analytical piece or coding sequences. This embodiment of the universal donor polynucleotide sequence was suitable for interrogating HDR mediated gene insertion at a variety of target sites, with several ZFNs (FIG. 5).

The universal donor polynucleotide sequence can be used with all targeting molecules with defined DNA binding domains, with two modes of targeted donor insertion (NHEJ/HDR). As such, when the universal donor polynucleotide sequence was co-delivered with the appropriate ZFN expression construct, the donor vector and the soybean genome was cut in one specific location dictated by the binding of the particular ZFN. Once linearized, the donor can be incorporated into the genome by NHEJ or HDR. The different analytical considerations in the vector design can then be exploited to determine the Zinc Finger which maximizes the efficient delivery of targeted integration.

Example 4: Soybean Transformation Procedures

Before delivery to *Glycine max* c.v. Maverick protoplasts, plasmid DNA for each ZFN construct was prepared from cultures of *E. coli* using the PURE YIELD PLASMID MAXIPREP SYSTEM® (Promega Corporation, Madison, Wis.) or PLASMID MAXI KIT® (Qiagen, Valencia, Calif.) following the instructions of the suppliers.

Protoplast Isolation

Protoplasts were isolated from a Maverick suspension culture derived from callus produced from leaf explants. Suspensions were subcultured every 7 days in fresh LS medium (Linsmaier and Skoog 1965) containing 3% (w/v)

sucrose, 0.5 mg/L 2,4-D, and 7 g of bactoagar, pH 5.7 For isolation, thirty milliliters of a Maverick suspension culture 7 days post subculturing was transferred to a 50 ml conical tube and centrifuged at 200 g for 3 minutes, yielding about 10 ml of settled cell volume (SCV) per tube. The supernatant was removed and twenty milliliters of the enzyme solution (0.3% pectolyase (320952; MP Biomedicals), 3% cellulase ("Onozuka" R10™; Yakult Pharmaceuticals, Japan) in MMG solution (4 mM MES, 0.6 M mannitol, 15 mM $MgCl_2$, pH 6.0) was added for every 4 SCV of suspension cells and the tubes were wrapped with Parafilm™. The tubes were placed on a platform rocker overnight (about 16-18 hr) and an aliquot of the digested cells was viewed microscopically to ensure the digestion of the cell wall was sufficient.

Protoplast Purification

Thirty milliliters of a soybean c.v. Maverick suspension culture 7 days post subculturing was transferred to a 50 ml conical centrifuge tube and centrifuged at 200 g for 3 minutes, yielding about 10 ml of settled cell volume (SCV) per tube. The supernatant was removed without disturbing the cell pellet. Twenty milliliters of the enzyme solution (0.3% pectolyase (320952; MP Biomedicals), 3% cellulase ("Onozuka" R10™; Yakult Pharmaceuticals, Japan) in MMG solution (4 mM MES, 0.6 M mannitol, 15 mM $MgCl_2$, pH 6.0) was added for every 4 SCV of suspension cells and the tubes were wrapped with Parafilm™. The tubes were placed on a platform rocker overnight (about 16-18 hr). The next morning, an aliquot of the digested cells was viewed microscopically to ensure the digestion of the cell walls was sufficient.

Protoplast Purification

The cells/enzyme solutions were filtered slowly through a 100 μM cell strainer. The cell strainer was rinsed with 10 ml of W5+ media (1.82 mM MES, 192 mM NaCl, 154 mM $CaCl_2$, 4.7 mM KCl, pH 6.0). The filtering step was repeated using a 70 μM screen. The final volume was brought to 40 ml by adding 10 ml of W5+ media. The cells were mixed by inverting the tube. The protoplasts were slowly layered onto 8 ml of a sucrose cushion solution (500 mM sucrose, 1 mM $CaCl_2$, 5 mM MES-KOH, pH 6.0) by adding the cushion solution to the bottom of a 50 ml conical centrifuge tube containing the cells. The tubes were centrifuged at 350×g for 15 minutes in a swinging bucket rotor. A 5 ml pipette tip was used to slowly remove the protoplast band (about 7-8 ml). The protoplasts were then transferred to a 50 ml conical tube and 25 ml of W5+wash was added. The tubes were inverted slowly and the centrifuged for 10 minutes at 200 g. The supernatant was removed, 10 ml of MMG solution was added and the tube was inverted slowly to resuspend the protoplasts. The protoplast density was determined using a haemocytometer or a flow cytometer. Typically, 4 PCV of cells suspension yields about 2 million protoplasts.

Transformation of Protoplasts Using PEG

The protoplast concentration was adjusted to 1.6 million/ml with MMG. Protoplast aliquots of 300 μl (about 500,000 protoplasts) were transferred into 2 ml sterile tubes. The protoplast suspension was mixed regularly during the transfer of protoplasts into the tubes. Plasmid DNA was added to the protoplast aliquots according to the experimental design. The rack containing the tubes of protoplasts was slowly inverted 3 times for 1 minute each to mix the DNA and protoplasts. The protoplasts were incubated for 5 minutes at room temperature. Three hundred microliters of a polyethylene glycol (PEG 4000) solution (40% ethylene glycol (81240-Sigma Aldrich), 0.3 M mannitol, 0.4 M $CaCl_2$) was added to the protoplasts and the rack of tubes was mixed for 1 min and incubated for 5 min, with gentle inversion twice during the incubation. One milliliter of W5+ was slowly added to the tubes and the rack of tubes inverted 15-20 times. The tubes were then centrifuged at 350 g for 5 min and the supernatant removed without disturbing the pellet. One milliliter of WI media (4 mM MES 0.6 M mannitol, 20 mM KCl, pH 6.0) was added to each tube and the rack was gently inverted to resuspend the pellets. The rack was covered with aluminum foil and laid on its side to incubate overnight at 23° C.

Measuring Transformation Frequency and Harvesting the Protoplasts

Quantification of protoplasts and transformation efficiencies were measured using a Quanta Flow Cytometer™ (Beckman-Coulter Inc). Approximately 16-18 hours post transformation, 100 μl from each replicate was sampled, placed in a 96 well plate and diluted 1:1 with WI solution. The replicates were resuspended 3 times and 100 μl was quantified using flow cytometry. Prior to submitting the samples for analysis, the samples were centrifuged at 200 g for 5 min, supernatants were removed and the samples were flash frozen in liquid nitrogen. The samples were then placed in a −80° C. freezer until processing for molecular analysis.

Transformation of ZFN and Donor

Figure 14:
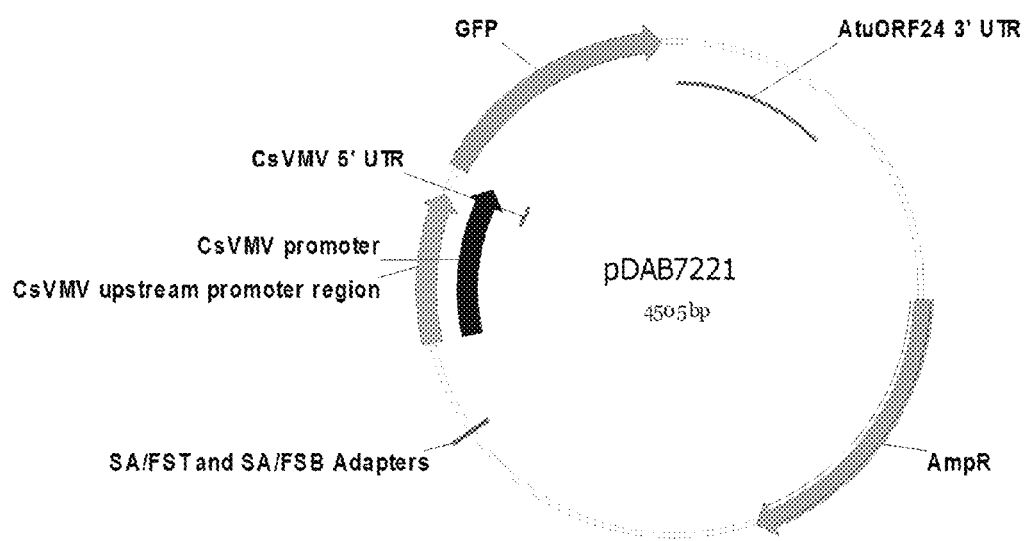
FIG. 14. Plasmid map of pDAB7221 (SEQ ID NO:7569). This plasmid contains the Cassava Vein Mosaic Virus Promoter (CsVMV) driving the GFP protein and flanked by the *Agrobacterium tumefaciens* (AtuORF 24 3'UTR).
Figure 15A:
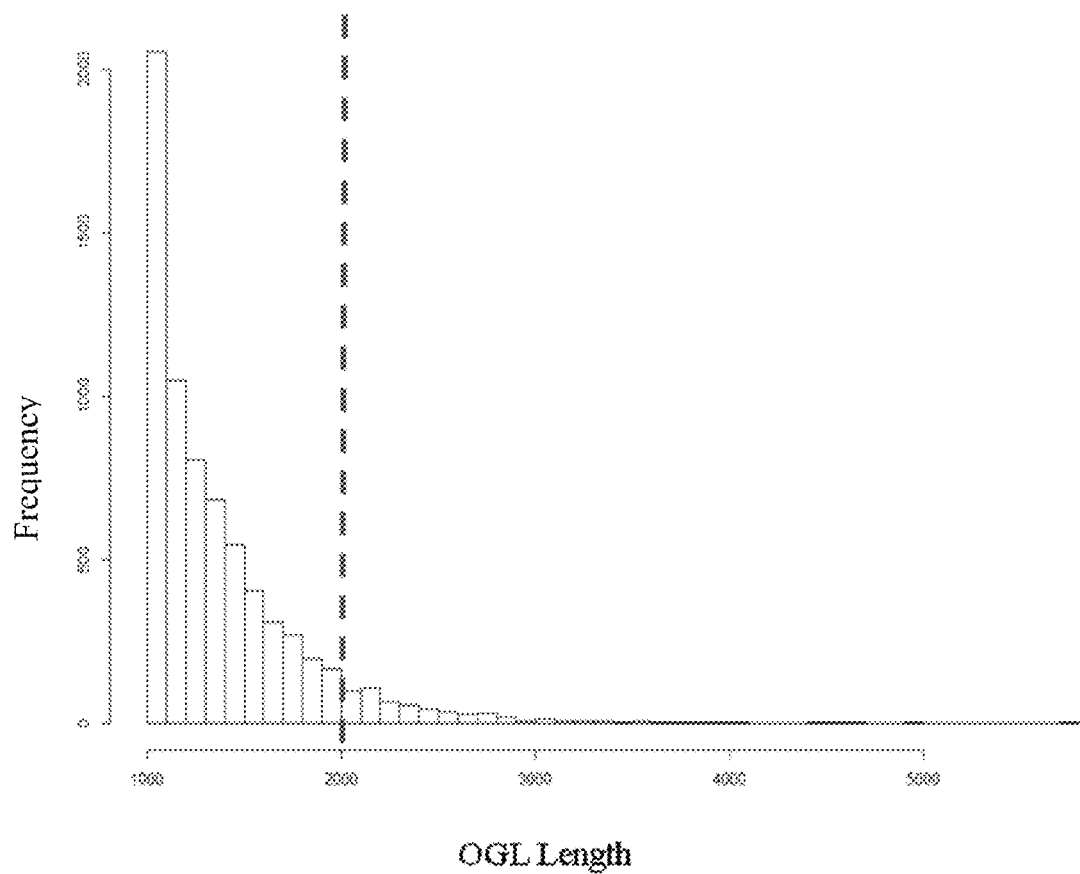
FIGS. 15A-15C. Histogram of characteristics (length, expression of coding region within 40 Kb of loci, and recombination frequency) for the identified optimal nongenic soybean loci.
Figure 15B:
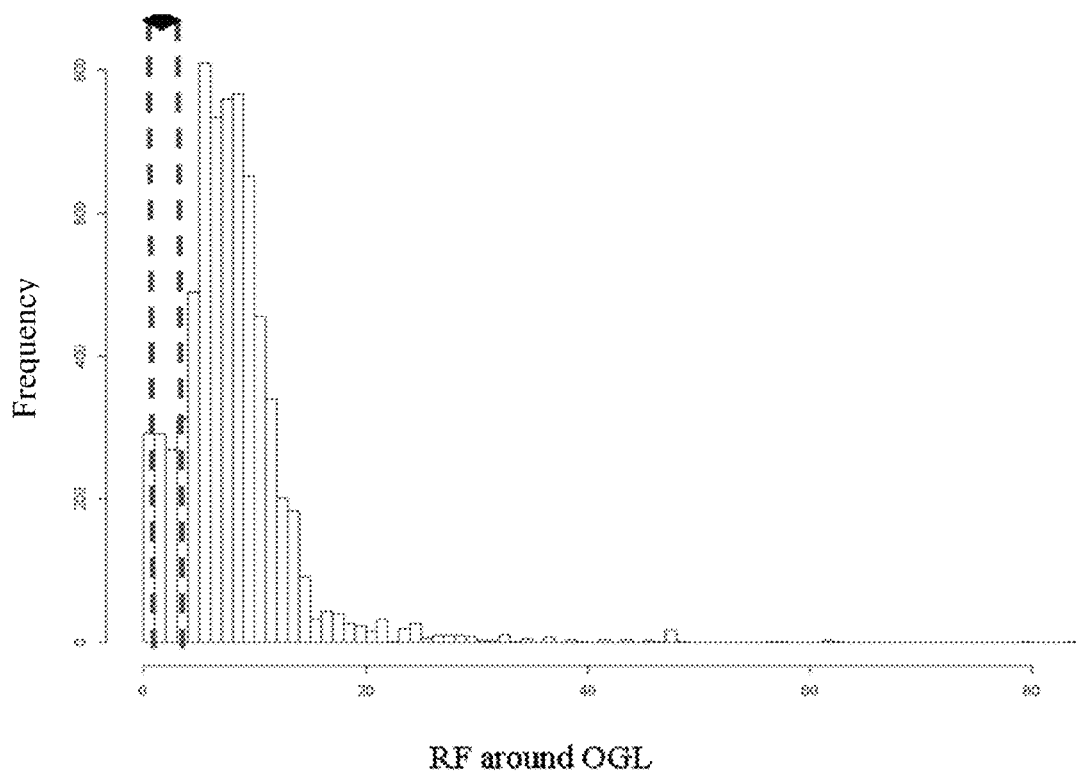
Figure 15C:
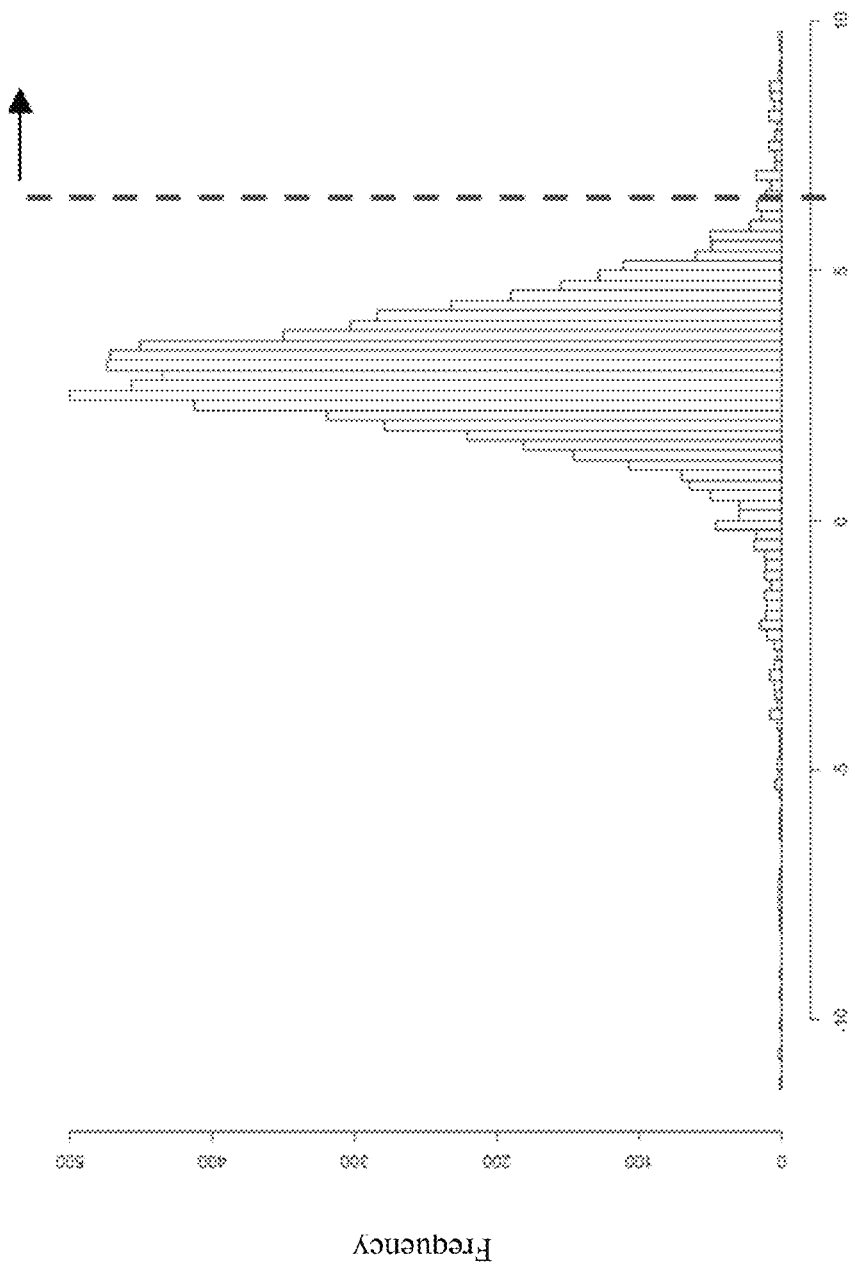

For each of the selected genomic loci of Table 5, the soybean protoplasts were transfected with constructs comprising a green fluorescent protein (gfp) gene expressing control, ZFN alone, donor alone and a mixture of ZFN and donor DNA at a ratio of 1:10 (by weight). The total amount of DNA for transfection of 0.5 million protoplasts was 80 μg. All treatments were conducted in replicates of three. The gfp gene expressing control used was pDAB7221 (FIG. 14, SEQ ID NO:7569) containing the Cassava Vein Mosaic Virs promoter—green fluorescent protein coding sequence—*Agrobacterium tumefaciens* ORF24 3'UTR gene expression cassettes. To provide a consistent amount of total DNA per transfection, either salmon sperm or a plasmid containing a gfp gene was used as filler where necessary. In a typical targeting experiment, 4 μg of ZFN alone or with 36 μg of donor plasmids were transfected and an appropriate amount of salmon sperm or pUC19 plasmid DNA was added to bring the overall amount of DNA to the final amount of 80 μg. Inclusion of gfp gene expressing plasmid as filler allows assessment of transfection quality across multiple loci and replicate treatments.

Example 5: Cleavage of Genomic Loci in Soybean Via Zinc Finger Nuclease

Targeting at select genomic loci was demonstrated by ZFN induced DNA cleavage and donor insertion using the protoplast based Rapid Targeting System (RTA). For each soybean select locus, up to six ZFN designs were generated and transformed into protoplasts either alone or with a universal donor polynucleotide and ZFN mediated clevage and insertion was measured using Next Generation Sequencing (NGS) or junctional (in-out) PCR respectively.

ZFN transfected soybean protoplasts were harvested 24 hours post-transfection, by centrifugation at 1600 rpm in 2 ml EPPENDORF™ tubes and the supernatant was completely removed. Genomic DNA was extracted from protoplast pellets using the QIAGEN PLANT DNA EXTRACTION KIT™ (Qiagen, Valencia, Calif.). The isolated DNA was resuspended in 50 μL of water and concentration was determined by NANODROP® (Invitrogen, Grand Island, N.Y.). The integrity of the DNA was estimated by running samples on 0.8% agarose gel electrophoresis. All samples were normalized (20-25 ng/μL) for PCR amplification to generate amplicons for sequencing (Illumina, Inc., SanDiego, Calif.). Bar-coded PCR primers for amplifying regions encompassing each test ZFN recognition sequence from treated and control samples were designed and purchased from IDT (Coralville, Iowa, HPLC purified). Optimum amplification conditions were identified by gradient PCR using 0.2 µM appropriate bar-coded primers, ACCUPRIME PFX SUPERMIX™ (Invitrogen, Carlsbad, Calif.) and 100 ng of template genomic DNA in a 23.5 µL reaction. Cycling parameters were initial denaturation at 95° C. (5 min) followed by 35 cycles of denaturation (95° C., 15 sec), annealing (55-72° C., 30 sec), extension (68° C., 1 min) and a final extension (68° C., 7 min). Amplification products were analyzed on 3.5% TAE agarose gels and appropriate annealing temperature for each primer combination was determined and used to amplify amplicons from control and ZFN treated samples as described above. All amplicons were purified on 3.5% agarose gels, eluted in water and concentrations were determined by NANODROP™. For Next Generation Sequencing, 100 ng of PCR amplicon from the ZFN treated and corresponding untreated soybean protoplast controls were pooled together and sequenced using Ilumina Next Generation Sequencing (NGS).

The cleavage activity of appropriate ZFNs at each soybean optimal genomic loci were assayed. Short amplicons encompassing the ZFN cleavage sites were amplified from the genomic DNA and subjected to Illumina NGS from ZFN treated and control protoplasts. The ZFN induced cleavage or DNA double strand break was resolved by the cellular NHEJ repair pathway by insertion or deletion of nucleotides (indels) at the cleavage site and presence of indels at the cleavage site was thus a measure of ZFN activity and was determined by NGS. Cleavage activity of the target specific ZFNs was estimated as the number of sequences with indels per 1 million high quality sequences using NGS analysis software (Patent publication 2012-0173,153, data Analysis of DNA sequences). Activities were observed for sobyean selected genomic loci targets and were further confirmed by sequence alignments that show a diverse footprint of indels at each ZFN cleavage site. This data suggests that the soybean selected genomic loci were amenable to cleavage by ZFNs. Differential activity at each target was reflective of its chromatin state and amenability to cleavage as well as the efficiency of expression of each ZFN.

Figure 6:
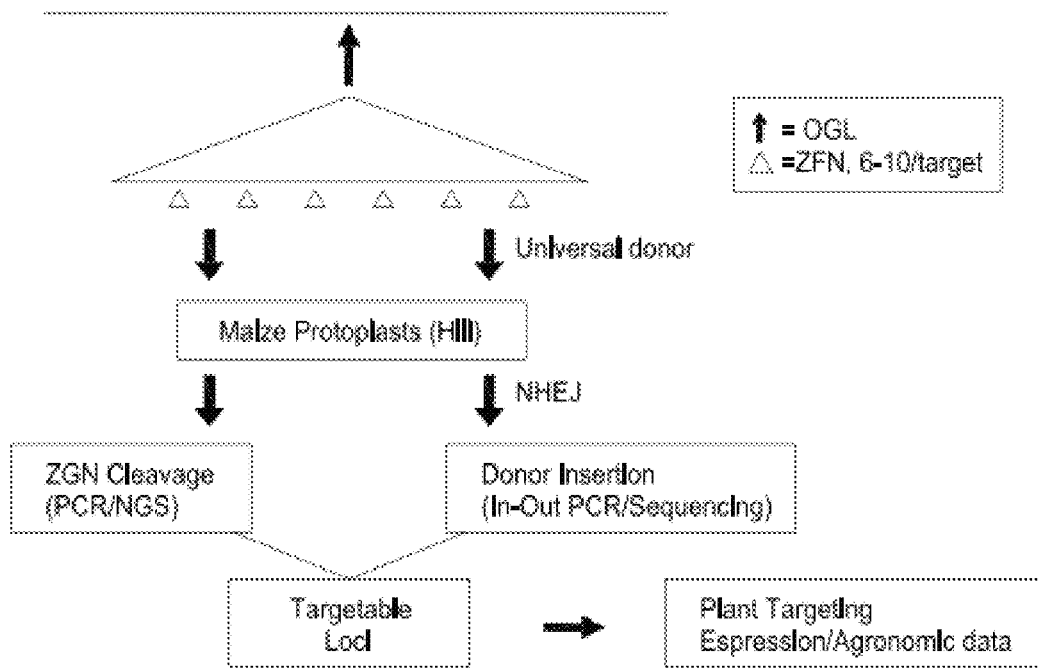
FIG. 6. Validation of soybean selected genomic loci targets using NHEJ based Rapid Targeting Analysis (RTA) method.

Example 6: Rapid Targeting Analysis of the Integration of a Polynucleotide Donor Validation of the targeting of the universal donor polynucleotide sequence within the soybean selected genomic loci targets via non-homologous end joining (NHEJ) meditated donor insertion, was performed using a semi-throughput protoplast based Rapid Testing Analysis method. For each soybean selected genomic loci target, around 3-6 ZFN designs were tested and targeting was assessed by measuring ZFN mediated cleavage by Next Generation Sequencing methods and donor insertion by junctional in-out PCR (FIG. 6). Soybean selected genomic loci that were positive in both assays were identified as a targetable locus.

ZFN Donor Insertion Rapid Testing Analysis

To determine if a soybean selected genomic loci target can be targeted for donor insertion, a ZFN construct and universal donor polynucleotide construct were co-delivered to soybean protoplasts which were incubated for 24 hours before the genomic DNA was extracted for analysis. If the expressed ZFN was able to cut the target binding site both at the soybean selected genomic loci target and in the donor, the linearized donor would then be inserted into the cleaved target site in the soybean genome via the non-homologous end joining (NHEJ) pathway. Confirmation of targeted integration at the soybean selected genomic loci target was completed based on an "In-Out" PCR strategy, where an "In" primer recognizes sequence at the native optimal genomic loci and an "Out" primer binds to sequence within the donor DNA. The primers were designed in a way that only when the donor DNA was inserted at the soybean selected genomic loci target, would the PCR assay produce an amplification product with the expected size. The In-Out PCR assay was performed at both the 5'- and 3'-ends of the insertion junction. The primers used for the analysis of integrated polynucleotide donor sequences are provided in Table 9.

ZFN Donor Insertion at Target Loci Using Nested "in-Out" PCR

All PCR amplifications were conducted using a TAKARA EX TAQ HS™ kit (Clonetech, Mountain View, Calif.). The first In-Out PCR was carried out in 25 µL final reaction volume that contains 1× TAKARA EX TAQ HS™ buffer, 0.2 mM dNTPs, 0.2 µM "Out" primer, 0.05 µM "In" primer (designed from the universal donor cassette described above), 0.75 unit of TAKARA EX TAQ HS™ polymerase, and 6 ng extracted soybean protoplast DNA. The reaction was then completed using a PCR program that consists of 94° C. for 3 min, 14 cycles of 98° C. for 12 sec, 60 30 sec and 72° C. for 1 min, followed by 72° C. for 10 min and held at 4° C. Final PCR products were run on an agarose gel along with 1 KB PLUS DNA LADDER™ (Life Technologies, Grand Island, N.Y.) for visualization.

The nested In-Out PCR was conducted in 25 µL final reaction volume that contained 1× TAKARA EX TAQ HS™ buffer, 0.2 mM dNTPs, 0.2 µM "Out" primer (Table 9), 0.1 µM "In" primer (designed from the universal donor cassette described above, Table 10), 0.75 units of TAKARA EX TAQ HS™ polymerase, and 1 µL of the first PCR product. The reaction was then completed using a PCR program that consisted of 94° C. for 3 min, 30 cycles of 98° C. for 12 sec, 60° C. for 30 sec and 72° C. for 45 sec, followed by 72° C. for 10 min and held at 4° C. Final PCR products were run on an agarose gel along with 1 KB PLUS DNA LADDER™ (Life Technologies, Grand Island, N.Y.) for visualization.

TABLE 9

List of all "Out" primers for nested In-Out PCR analysis of optimal genomic loci.

| | | | | |
|---|---|---|---|---|
| OGL01 First PCR | 5'-end | MAS1057 | SEQ ID NO: 7427 | CAAACAAGGAGAGAGCGAG |
| | | GM Spec | SEQ ID NO: 7428 | GATCGACATTGATCTGGCTA |
| | 3'-end | MAS1059 | SEQ ID NO: 7429 | GGCAAGGACACAAACGG |
| | | GM Uzi | SEQ ID NO: 7430 | ATATGTGTCCTACCGTATCAGG |

TABLE 9-continued

List of all "Out" primers for nested In-Out PCR
analysis of optimal genomic loci.

| | | | | |
|---|---|---|---|---|
| Nest | 5'-end | MAS1058 | SEQ ID NO: 7431 | TACCCAAGAAGAAACATTAGACC |
| PCR | | GM Spec Nst | SEQ ID NO: 7432 | GTTGCCTTGGTAGGTCC |
| | 3'-end | MAS1060 | SEQ ID NO: 7433 | ATGTAGTTGTTTCTCTGCTGTG |
| | | GM Uzi Nst | SEQ ID NO: 7434 | GAGCCATCAGTCCAACAC |
| OGL02 First | 5'-end | MAS1061 | SEQ ID NO: 7435 | CACGAGGTTTACGCCAT |
| PCR | 3'-end | MAS1063 | SEQ ID NO: 7436 | TCTGATAACTTGCTAGTGTGTG |
| Nest | 5'-end | MAS1062 | SEQ ID NO: 7437 | GCTGCTCAGTGGATGTC |
| PCR | 3'-end | MAS1064 | SEQ ID NO: 7438 | TCGTTTATCGGGATTGTCTC |
| OGL03 First | 5'-end | MAS1133 | SEQ ID NO: 7439 | TTGTTGCTTCTATGCTCCTC |
| PCR | 3'-end | MAS1135 | SEQ ID NO: 7440 | CGTCGTTGTGGATGAGG |
| Nest | 5'-end | MAS1134 | SEQ ID NO: 7441 | CCATTGCTGTTCTGCTTG |
| PCR | 3'-end | MAS1136 | SEQ ID NO: 7442 | TGTAGGTGACGGGTGTG |
| OGL04 First | 5'-end | MAS1155 | SEQ ID NO: 7443 | GTGTGTTATTGTCTGTGTTCTC |
| PCR | 3'-end | MAS1139 | SEQ ID NO: 7444 | GACTCCTATGTGCCTGATTC |
| Nest | 5'-end | MAS1156 | SEQ ID NO: 7445 | GAGAACGATGGATAGAAAAGCA |
| PCR | 3'-end | MAS1140 | SEQ ID NO: 7446 | TTTGTTTCAGTCTTGCTCCT |
| OGL05 First | 5'-end | MAS1121 | SEQ ID NO: 7447 | CTACCTATAAACTGGACGGAC |
| PCR | 3'-end | MAS1123 | SEQ ID NO: 7448 | CGTCAAATGCCCATTATTCAT |
| Nest | 5'-end | MAS1122 | SEQ ID NO: 7449 | GATTTGGGCTTGGGCATA |
| PCR | 3'-end | MAS1124 | SEQ ID NO: 7450 | TGAATCCCACTAGCACCAT |
| OGL06 First | 5'-end | MAS1065 | SEQ ID NO: 7451 | GGAGATAGAGTTAGAAGGTTTTGA |
| PCR | 3'-end | MAS1067 | SEQ ID NO: 7452 | GAGGTTGTTTTGACGCCA |
| Nest | 5'-end | MAS1066 | SEQ ID NO: 7453 | AAGGAAGAAATGTGAAAAGAAGAC |
| PCR | 3'-end | MAS1068 | SEQ ID NO: 7454 | AGAGAAGCGAAACCCAAAG |
| OGL07 First | 5'-end | MAS1069 | SEQ ID NO: 7455 | GACCCATTTATCTATCCCGTAT |
| PCR | 3'-end | MAS1071 | SEQ ID NO: 7456 | GGCTCGTATCAGTTCCATTTAG |
| Nest | 5'-end | MAS1070 | SEQ ID NO: 7457 | AAGTACGAACAAGATTGGTGAG |
| PCR | 3'-end | MAS1072 | SEQ ID NO: 7458 | TCTATTACATTCCATCCAAAGGC |
| OGL08 First | 5'-end | MAS1141 | SEQ ID NO: 7459 | GAAACGAGAGAGATGACCAATA |
| PCR | 3'-end | MAS1143 | SEQ ID NO: 7460 | GGTTCACGGGTTCAGC |
| Nest | 5'-end | MAS1142 | SEQ ID NO: 7461 | CCTGACGCAAAAGAAGAAATG |
| PCR | 3'-end | MAS1144 | SEQ ID NO: 7462 | GTTATACTTACTGTCACCACGAG |
| OGL09 First | 5'-end | MAS1073 | SEQ ID NO: 7463 | TTATTCCTGCGTCTCTCAC |
| PCR | 3'-end | MAS1075 | SEQ ID NO: 7464 | TTGTGCGTGATAAATAGGGC |
| Nest | 5'-end | MAS1074 | SEQ ID NO: 7465 | GATAGTTGATTGTTGTTAGCATA |
| PCR | 3'-end | MAS1076 | SEQ ID NO: 7466 | CTCACCTGTTGCCCGTA |
| OGL10 First | 5'-end | MAS1077 | SEQ ID NO: 7467 | GTTTGAGTTGGCAGGTGT |
| PCR | 3'-end | MAS1079 | SEQ ID NO: 7468 | CCGTGACTTGTGCTAGAG |
| Nest | 5'-end | MAS1078 | SEQ ID NO: 7469 | CTGAAGTTGACGCCGC |
| PCR | 3'-end | MAS1080 | SEQ ID NO: 7470 | AAGCACAGGACGGTTAGA |
| OGL11 First | 5'-end | MAS1125 | SEQ ID NO: 7471 | CACGGGTCACAAATCTAGTT |
| PCR | 3'-end | MAS1127 | SEQ ID NO: 7472 | CCATTAAGTCTGTCTCAACTTTC |
| Nest | 5'-end | MAS1126 | SEQ ID NO: 7473 | CTGCTTGAGTAGGAAGAAGTG |
| PCR | 3'-end | MAS1128 | SEQ ID NO: 7474 | ATCACCAAAGCCGAGAAC |
| OGL12 First | 5'-end | MAS1129 | SEQ ID NO: 7475 | GTAGGCGTGAAGGCTG |
| PCR | 3'-end | MAS1131 | SEQ ID NO: 7476 | TGAAACCGCACAATCTCG |
| Nest | 5'-end | MAS1130 | SEQ ID NO: 7477 | CCCTCCGAAACAATCCG |
| PCR | 3'-end | MAS1132 | SEQ ID NO: 7478 | ACCCGTTGAATGCGAG |
| OGL13 First | 5'-end | MAS1081 | SEQ ID NO: 7479 | AAGGTGGATGGGAGGAA |
| PCR | 3'-end | MAS1083 | SEQ ID NO: 7480 | TGGCACTAATACATTACATAAGACT |
| Nest | 5'-end | MAS1082 | SEQ ID NO: 7481 | ATGTTACTTCAATCCCTCGTC |
| PCR | 3'-end | MAS1084 | SEQ ID NO: 7482 | TGAATAGGGCAAAAACACAC |
| OGL14 First | 5'-end | MAS1085 | SEQ ID NO: 7483 | CAAGTGAGCAGGGCG |
| PCR | 3'-end | MAS1087 | SEQ ID NO: 7484 | CTATCATTCGTAAAGTTTGAGGAC |
| Nest | 5'-end | MAS1086 | SEQ ID NO: 7485 | AGCCTCACTCACAACAAAG |
| PCR | 3'-end | MAS1088 | SEQ ID NO: 7486 | TGAAACTGTCTTGTGACTTACC |
| OGL15 First | 5'-end | MAS1089 | SEQ ID NO: 7487 | GCACTGACATACCAACAATC |
| PCR | 3'-end | MAS1091 | SEQ ID NO: 7488 | GTTGTCGGGATTTCACTTCAT |
| Nest | 5'-end | MAS1090 | SEQ ID NO: 7489 | GATAGGAGAAAGAGCAAGGAC |
| PCR | 3'-end | MAS1092 | SEQ ID NO: 7490 | TTCTCAACATCAACTCATACACTC |
| OGL16 First | 5'-end | MAS1093 | SEQ ID NO: 7491 | CTCAAAGCAACATCAACCAT |
| PCR | 3'-end | MAS1095 | SEQ ID NO: 7492 | AATCCCAAAGCAGCCAAC |

TABLE 9-continued

List of all "Out" primers for nested In-Out PCR
analysis of optimal genomic loci.

```
          Nest 5'-end   MAS1094    SEQ ID NO: 7493  AAACACAAATCACATCATAGTAAAC
          PCR  3'-end   MAS1096    SEQ ID NO: 7494  GCTAGTATGCTTCTGTCAGTTTA OGL17 First 5'-end      MAS916     SEQ ID NO: 7495  ACTAGTTCTTTCCCGAACATT
      PCR   3'-end      MAS918     SEQ ID NO: 7496  CATTTGGTGATTTAACTCATCAGC
      Nest  5'-end      MAS917     SEQ ID NO: 7497  AAATTTACCACGGTTGGTCC
      PCR   3'-end      MAS919     SEQ ID NO: 7498  TCTGCATTAACTATATCAGGAGG OGL18 First 5'-end      MAS920     SEQ ID NO: 7499  ATTCAACATTTACCCTTCACAA
      PCR   3'-end      MAS922     SEQ ID NO: 7500  AATTCTTTCTCATACTTGGTTGT
      Nest  5'-end      MAS921     SEQ ID NO: 7501  CCTTGTTTTCCGTACTATCAATT
      PCR   3'-end      MAS923     SEQ ID NO: 7502  TATTGGAGTAATGTGGACAAGC OGL19 First 5'-end      MAS924     SEQ ID NO: 7503  AACAACTTTCCAACCCACAA
      PCR   3'-end      MAS1009    SEQ ID NO: 7504  CGTTTTACCTTGACTTGACCT
      Nest  5'-end      MAS925     SEQ ID NO: 7505  CCAGAGAGGAACCAGAAGT
      PCR   3'-end      MAS1010    SEQ ID NO: 7506  CCTTAGACAAAACTCGCACTT OGL20 First 5'-end      MAS1011    SEQ ID NO: 7507  CAAAGAGAAGACGCCACC
      PCR   3'-end      MAS930     SEQ ID NO: 7508  TCATTAGAGGGTCAAAAGTGC
      Nest  5'-end      MAS1012    SEQ ID NO: 7509  CCTGAAGAAAAGTGGGAGAA
      PCR   3'-end      MAS931     SEQ ID NO: 7510  TTCAATCATAATTAAACTAATAAGACTGT OGL22 First 5'-end      MAS960     SEQ ID NO: 7511  ACTGAATGTATTGTCCGACG
      PCR   3'-end      MAS962     SEQ ID NO: 7512  GCCCTACATTTTCATTTCATTGG
      Nest  5'-end      MAS961     SEQ ID NO: 7513  GTGAGACCGCCCCTT
      PCR   3'-end      MAS963     SEQ ID NO: 7514  CCACTACTTTTTACTCACAGAAGA OGF24 First 5'-end      MAS968     SEQ ID NO: 7515  GTCAATTCTCATCAGTTCCATCT
      PCR   3'-end      MAS970     SEQ ID NO: 7516  CGATGAATAGTATGAGTGCGTAG
      Nest  5'-end      MAS969     SEQ ID NO: 7517  TGCGTCTCTTGCTTCCTA
      PCR   3'-end      MAS971     SEQ ID NO: 7518  GCCACGAGAGGATAGAATAAT OGL25 First 5'-end      MAS972     SEQ ID NO: 7519  TAGTGTACCCTCCTCATCATA
      PCR   3'-end      MAS974     SEQ ID NO: 7520  GATAATCAAATGAGTGGACGAATA
      Nest  5'-end      MAS973     SEQ ID NO: 7521  TGTATTTGGATAAGTGTGGGAC
      PCR   3'-end      MAS975     SEQ ID NO: 7522  GATTTTAGCGTGATTGATGGAAG OGL28 First 5'-end      MAS1149    SEQ ID NO: 7523  CTGAAGCAAGTGGTGATGTT
      PCR   3'-end      MAS1151    SEQ ID NO: 7524  CTTACCACCACCTGCG
      Nest  5'-end      MAS1150    SEQ ID NO: 7525  GCATAAAGGTCAGCAGAGG
      PCR   3'-end      MAS1152    SEQ ID NO: 7526  TACTCTTTAGCCATAGCCAAT OGL30 First 5'-end      MAS988     SEQ ID NO: 7527  GTTTATTGCCAGAGACGGT
      PCR   3'-end      MAS990     SEQ ID NO: 752S  CGTCGTTGCTTGCTTGT
      Nest  5'-end      MAS989     SEQ ID NO: 7529  GGAAAGACATAAAAGTAAATGGAAG
      pcr   3'-end      MAS991     SEQ ID NO: 7530  TAACTACCTGATAACCTCCTTTT OGL31 First 5'-end      MAS992     SEQ ID NO: 7531  GCAAACTTTAAGTAAACTAGAGGC
      PCR   3'-end      MAS994     SEQ ID NO: 7532  AGTGTACTCTAGTCAGATTTTGC
      Nest  5'-end      MAS993     SEQ ID NO: 7533  CAACCCAACAAGCAAACAC
      PCR   3'-end      MAS995     SEQ ID NO: 7534  CTCGGTTTTGTAGTCATCTATGTA OGL33 First 5'-end      MAS1101    SEQ ID NO: 7535  GATGAATAACAGTGCGAGGA
      PCR   3'-end      MAS942     SEQ ID NO: 7536  CTGTAATCCTCATTTTGCACG
      Nest  5'-end      MAS941     SEQ ID NO: 7537  GGGGTAGTTACACTTCTGC
      PCR   3'-end      MAS943     SEQ ID NO: 7538  GGTGTGGTCGGCATATAGA OGL34 First 5'-end      MAS944     SEQ ID NO: 7539  TTCGCACAAGCCATCC
      PCR   3'-end      MAS946     SEQ ID NO: 7540  AACGACTTTTTGAATAGATGCT
      Nest  5'-end      MAS945     SEQ ID NO: 7541  GCATTCCTTCTTGTCTCGT
      PCR   3'-end      MAS947     SEQ ID NO: 7542  AACTTAGAGAAACTCATAACTCATC OGL35 First 5'-end      MAS948     SEQ ID NO: 7543  TCATAGCTTCAAGGGATTCAC
      PCR   3'-end      MAS950     SEQ ID NO: 7544  GTTCATCAAAACACGCAAGA
      Nest  5'-end      MAS949     SEQ ID NO: 7545  CTCATGCCAACAAAAGCC
      PCR   3'-end      MAS951     SEQ ID NO: 7546  GTAGTAACAAAAATGGATAACGCA OGL36 First 5'-end      MAS936     SEQ ID NO: 7547  TATCTGGCTTGAAGCTGAAT
      PCR   3'-end      MAS938     SEQ ID NO: 7548  TTATTTCCTTCGTGGCTTCG
      Nest  5'-end      MAS937     SEQ ID NO: 7549  CTCCACAATTTAGCATCCAAG
      PCR   3'-end      MAS939     SEQ ID NO: 7550  CGTCCATGTTTACTTGGCTA OGL37 First 5'-end      MAS952     SEQ ID NO: 7570  GTCATCATAATTGCTGTCCCA
      PCR   3'-end      MAS954     SEQ ID NO: 7571  GGATGTGTGCCTGAGC
      Nest  5'-end      MAS953     SEQ ID NO: 7572  CCTTCCTCGTGCCCTTA
      PCR   3'-end      MAS955     SEQ ID NO: 7573  CCCCTAATCTCATCGCAAG
```

TABLE 9-continued

List of all "Out" primers for nested In-Out PCR analysis of optimal genomic loci.

| OGL38 | First PCR | 5'-end | MAS932 | SEQ ID NO: 7551 TCTGTTGATTCCTAATCGTAGC |
| --- | --- | --- | --- | --- |
| | | 3'-end | MAS934 | SEQ ID NO: 7552 GTGATTGACATTTGTCTATAAGCA |
| | Nest PCR | 5'-end | MAS933 | SEQ ID NO: 7553 CCTCTTCACTGTGACTGAAC |
| | | 3'-end | MAS935 | SEQ ID NO: 7554 TTTCGGCTTGACATTTCTTTC |
| OGL39 | First PCR | 5'-end | MAS956 | SEQ ID NO: 7555 TGGCAAATCACACGGTC |
| | | 3'-end | MAS958 | SEQ ID NO: 7556 ACTACCTTGCCCCTAAGATC |
| | Nest PCR | 5'-end | MAS957 | SEQ ID NO: 7557 TGCCACGACAAGAATTTCAT |
| | | 3'-end | MAS959 | SEQ ID NO: 7558 TGGTGTGATTCCAACGC |

TABLE 10

List of all "In" primers for nested In-Out PCR analysis of optimal genomic loci.

| First PCR | 3'-end | GM_UnDo_3'F | SEQ ID NO: 7559 CAAATTCCCACTAAGCGCT |
| --- | --- | --- | --- |
| Nest PCR | 3'-end | GM_UnDo_3'_NST | SEQ ID NO: 7560 TAAAGGTGAGCAGAGGCA |

Deployment of the In-Out PCR assay in a protoplast targeting system was particularly challenging as large amounts of the plasmid DNA was used for transfection, and the large amount of DNA remains in the protoplast targeting system and was subsequently extracted along with cellular genomic DNA. The residual plasmid DNA may dilute the relative concentration of the genomic DNA and reduce the overall sensitivity of detection and can also be a significant cause of non-specific, aberrant PCR reactions. ZFN induced NHEJ-based donor insertion typically occurs in either a forward or a reverse orientation. In-Out PCR analysis of DNA for the forward orientation insertion often exhibited false positive bands, possibly due to shared regions of homology around the ZFN binding site in the target and donor that could result in priming and extension of unintegrated donor DNA during the amplification process. False positives were not seen in analyses that probed for reverse orientation insertion products and therefore all targeted donor integration analysis was carried out to interrogate reverse donor insertion in the RTA. In order to further increase specificity and reduce background, a nested PCR strategy was also employed. The nested PCR strategy used a second PCR amplification reaction that amplified a shorter region within the first amplification product of the first PCR reaction. Use of asymmetric amounts of "in" and "out" primers optimized the junctional PCR further for rapid targeting analysis at selected genomic loci.

The In-Out PCR analysis results were visualized on an agarose gel. For all soybean selected genomic loci of Table 12, "ZFN+donor treatments" produced a near expected sized band at the 5' and 3' ends. Control ZFN or donor alone treatments were negative in the PCR suggesting that the method was specifically scoring for donor integration at the target site of at least 32 of the optimal nongenic soybean genomic loci. All treatments were conducted in replicates of 3-6 and presence of the anticipated PCR product in multiple replicates (>1 at both ends) was used to confirm targeting. Donor insertion through NHEJ often produces lower intensity side products that were generated due to processing of linearized ends at the target and/or donor ZFN sites. In addition, it was observed that different ZFNs resulted in different levels of efficiency for targeted integration, with some of the ZFNs producing consistently high levels of donor integration, some ZFNs producing less consistent levels of donor integration, and other ZFNs resulting in no integration. Overall, for each of the soybean selected genomic loci targets that were tested, targeted integration was demonstrated within the soybean representative genomic loci targets by one or more ZFNs, which confirms that each of these loci were targetable. Furthermore, each of the soybean selected genomic loci targets was suitable for precision gene transformation. The validation of these soybean selected genomic loci targets were repeated multiple times with similar results, thus confirming the reproducibility of the validation process which includes plasmid design and construct, protoplast transformation, sample processing, sample analysis.

CONCLUSION

The donor plasmid and one ZFN designed to specifically cleave soybean selected genomic loci targets were transfected into soybean protoplasts and cells were harvested 24 hours later. Analysis of the genomic DNA isolated from control, ZFN treated and ZFN with donor treated protoplasts by in-out junctional PCR showed targeted insertion of the universal donor polynucleotide as a result of genomic DNA cleavage by the ZFNs (Table 12). These studies show that the universal donor polynucleotide system can be used to assess targeting at endogenous sites and for screening candidate ZFNs. Finally, the protoplast based Rapid Targeting Analysis and the novel universal donor polynucleotide sequence systems provide a rapid avenue for screening genomic targets and ZFNs for precision genome engineering efforts in plants. The methods can be extended to assess site specific cleavage and donor insertion at genomic targets in any system of interest using any nuclease that introduces DNA double or single strand breaks.

Over 7,018 selected genomic loci were identified by various criteria detailed above. The selected genomic loci were clustered using Principal Component Analysis based on the ten parameters used for defining the selected genomic loci. A representative of the clusters in addition to some other loci of interest were demonstrated to be targetable.

TABLE 12

Illustrates the results of the integration of a universal donor polynucleotide sequence within the soybean selected genomic loci targets.

| Name | ID | Location | Cluster Assignment | ZFN (pDAB#) | Donor (pDAB#) | Targetable Locus (Y/N) |
|---|---|---|---|---|---|---|
| OGL01 | soy_ogl_308 | Gm02: 1204801 . . . 1209237 | 1 | 124201 | 124280 | Y |
| OGL02 | soy_ogl_307 | Gm02: 1164701 . . . 1168400 | 2 | 124221 | 124281 | Y |
| OGL03 | soy_ogl_2063 | Gm06: 43091928 . . . 43094600 | 3 | 125305 | 125332 | Y |
| OGL04 | soy_ogl_1906 | Gm06: 11576991 . . . 11578665 | 4 | 125309 | 125330 | Y |
| OGL05 | soy_ogl_262 | Gm01: 51061272 . . . 51062909 | 5 | 124884 | 124290 | Y |
| OGL06 | soy_ogl_5227 | Gm16: 1298889 . . . 1300700 | 6 | 124234 | 123838 | Y |
| OGL07 | soy_ogl_4074 | Gm12: 33610401 . . . 33611483 | 7 | 124257 | 123839 | Y |
| OGL08 | soy_ogl_3481 | Gm10: 40763663 . . . 40764800 | 8 | 125316 | 125332 | Y |
| OGL09 | soy_ogl_1016 | Gm03: 41506001 . . . 41507735 | 9 | 124265 | 123836 | Y |
| OGL10 | soy_ogl_937 | Gm03: 37707001 . . . 37708600 | 10 | 124273 | 123837 | Y |
| OGL11 | soy_ogl_5109 | Gm15: 42391349 . . . 42393400 | 11 | 124888 | 124290 | Y |
| OGL12 | soy_ogl_6801 | Gm20: 36923690 . . . 36924900 | 12 | 124885 | 124291 | Y |
| OGL13 | soy_ogl_6636 | Gm19: 49977101 . . . 49978357 | 13 | 124610 | 124294 | Y |
| OGL14 | soy_ogl_4665 | Gm14: 5050547 . . . 5051556 | 14 | 124614 | 124845 | Y |
| OGL15 | soy_ogl_6189 | Gm18: 55694401 . . . 55695900 | 15 | 124636 | 124293 | Y |
| OGL16 | soy_ogl_4222 | Gm13: 23474923 . . . 23476100 | 16 | 124648 | 124292 | Y |
| OGL17 | soy_ogl_2543 | Gm08: 7532001 . . . 7534800 | 17 | 121225 | 121277 | Y |
| OGL18 | soy_ogl_310 | Gm02: 1220301 . . . 1222300 | 18 | 121227 | 121278 | Y |
| OGL19 | soy_ogl_2353 | Gm07: 17194522 . . . 17196553 | 19 | 121233 | 121279 | Y |
| OGL20 | soy_ogl_1894 | Gm06: 10540801 . . . 10542300 | 20 | 121235 | 121280 | Y |
| OGL22 | soy_ogl_3218 | Gm09: 40167479 . . . 40168800 | 22 | 121238 | 121281 | Y |
| OGL24 | soy_ogl_3333 | Gm10: 2950701 . . . 2951800 | 24 | 121234 | 121280 | Y |
| OGL25 | soy_ogl_2546 | Gm08: 7765875 . . . 7767500 | 25 | 121249 | 121284 | Y |
| OGL28 | soy_ogl_5957 | Gm18: 6057701 . . . 6059100 | 28 | 125324 | 125334 | Y |
| OGL30 | soy_ogl_3818 | Gm11: 10146701 . . . 10148200 | 30 | 121265 | 121288 | Y |
| OGL31 | soy_ogl_5551 | Gm17: 6541901 . . . 6543200 | 31 | 121271 | 121289 | Y |
| OGL33 | soy_OGL_684* | Gm02: 459032011 . . . 45907300 | 1 | 124666 | 123812 | Y |
| OGL34 | soy_OGL_682 | Gm02: 458165493 . . . 45818777 | 9 | 124814 | 121937 | Y |
| OGL35 | soy_OGL_685 | Gm02: 459105011 . . . 45913200 | 1 | 124690 | 123811 | Y |
| OGL36 | soy_OGL_1423 | Gm04: 45820631 . . . 45822916 | 2 | 124815 | 121937 | Y |
| OGL37* | soy_OGL_1434 | Gm04: 46095801 . . . 46097968 | 1 | 125338 | 124871 | Y |
| OGL38 | soy_OGL_4625 | Gm14: 3816738 . . . 3820070 | 1 | 124816 | 121937 | Y |
| OGL39 | soy_OGL_6362 | Gm19: 5311001 . . . 5315000 | 1 | 124842 | 124864 | Y |

Example 7: Optimal Nongenic Soybean Genomic Loci for Transgene Integration

A suite of optimal nongenic soybean genomic loci were identified from the 7,018 optimal nongenic soybean genomic loci to select multiple loci for site specific targeting and integration of gene expression cassettes and to generate stacks of gene expression cassettes within a single chromosome. The resulting set of three optimal nongenic soybean genomic loci are referred to herein as a "Mega Locus". The following criteria were used to filter the pool of optimal nongenic soybean genomic loci and select a suite of optimal nongenic soybean genomic loci:

1) Location of at least 3 optimal nongenic soybean genomic loci on the same chromosome in proximity to each other (within 500 Kb of the center optimal nongenic soybean genomic loci);
2) Optimal nongenic soybean genomic loci greater than 2 Kb in length, and within 50 Kb of each other; and,
3) The central/middle optimal nongenic soybean genomic loci is greater than 4 Kb in length.

Each of the above described criteria were applied to select a suite of optimal nongenic soybean genomic loci. The identified optimal nongenic soybean genomic loci are shown in Table 13.

TABLE 13

Optimal nongenic soybean genomic loci identified and selected for targeting with a gene expression cassette.

| OGL_ID | Location | Length | SEQ ID NO: | Grouping of Three Loci |
|---|---|---|---|---|
| soy_OGL_308* | Gm02: 1204801 . . . 1209237 | 4437 | 43 | Targetable Mega |
| soy_OGL_307* | Gm02: 1164701 . . . 1168400 | 3700 | 566 | Mega |
| soy_OGL_310 | Gm02: 1220301 . . . 1222300 | 2000 | 4236 | Locus #1 |
| soy_OGL_684* | Gm02: 45903201 . . . 45907300 | 4100 | 47 | Targetable Mega |
| soy_OGL_682 | Gm02: 45816543 . . . 45818777 | 2235 | 2101 | Locus #2 |
| soy_OGL_685 | Gm02: 45910501 . . . 45913200 | 2700 | 48 | |

*indicates that the OGL is long enough to be targeted by two separate gene expression cassettes.

Two additional optimal nongenic soybean genomic loci that were greater than 2 Kb and within 500 Kb to a known transgenic genomic event that was produced via random integration of a T-strand insert (e.g., AAD-12 Event 416: located at soybean chromosomal position, Gm04:46002956 . . . 46005750 as described in International Patent App. No. WO2011066384A1) were also selected for targeted gene stacking. The selected optimal nongenic soybean genomic loci are shown in Table 14.

TABLE 14

Optimal nongenic soybean genomic loci identified and selected for targeting with a gene expression cassette.

| OGL_ID | Location | Length | SEQ ID NO: | Grouping of Three Loci |
|---|---|---|---|---|
| soy_OGL_1423 | Gm04: 45820631 . . . 45822916 | 2286 | 639 | Targetable |
| soy_OGL_1434 | Gm04: 46095801 . . . 46097968 | 2168 | 137 | Megalocus 3 |

A third suite of optimal nongenic soybean genomic loci were identified from the 7,018 optimal nongenic soybean genomic loci to select a suite of loci for site specific targeting and integration of gene expression cassettes and to generate stacks of gene expression cassettes. The following criteria were used to filter the pool of optimal nongenic soybean genomic loci and select a suite of optimal nongenic soybean genomic loci:

1) Identify optimal nongenic soybean genomic loci greater than 3 Kb in length;
2) Average expression of neighboring genes within a 40 Kb region in root and shoot tissues is greater than 7.46, which is the 47.7% percentile of all optimal nongenic soybean genomic loci;
3) A recombination frequency of 0.5-4, which is below the mean/median for all of the optimal nongenic soybean genomic loci;
4) A GC content greater than 25%.

Each of the above described criteria were applied to select a suite of optimal nongenic soybean genomic loci. The identified optimal nongenic soybean genomic loci are shown in Table 15. All selected optimal nongenic soybean loci were screened for proximity to known soybean QTLs. Loci that are greater than 3 Kb can be targeted sequentially at the endogenous sequence.

TABLE 15

Optimal nongenic soybean genomic loci identified and selected for targeting with a gene expression cassette.

| OGL_ID | Location | Length | SEQ ID NO: |
|---|---|---|---|
| soy_OGL_4625 | Gm14: 3816738 . . . 3820070 | 3333 | 76 |
| soy_OGL_6362 | Gm19: 5311001 . . . 5315000 | 4000 | 440 |
| soy_OGL_308 | Gm02: 1204801 . . . 1209237 | 4437 | 43 |

The optimal nongenic soybean genomic loci that are selected using the above described criteria are validated by integrating a gene expression construct that contains selectable/reportable markers. This gene expression cassette is stably integrated into soybean plants via genomic targeting using a site specific nuclease. The targeted optimal nongenic soybean genomic loci that are produced and contain an expressable transgene are analyzed to identify single copy events that contain a full length integrated gene expression cassette. The expression profiles of the optimal nongenic soybean genomic loci are analyzed via qRT-PCR, Western blot, ELISA, LC-MS MS, and other known RNA or protein detection methods over multiple plant generations (e.g., $T_1$ and $T_2$ generations). In addition, the effect of the transgene expression cassette integration within the optimal nongenic soybean genomic loci on neighboring gene expression is assayed. Finally, the effect of the transgene expression cassette integration within the optimal nongenic soybean genomic loci on agronomic properties of soybean plants is assayed.

Lengthy table referenced here

US09909131-20180306-T00001

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US09909131B2). An electronic copy of the table will also be available from the USPTO upon request and payment of the fee set forth in 37 CFR 1.19(b)(3).

SEQUENCE LISTING (7584 sequences)

SEQ ID NO: 1 - DNA, 2552 bp, Glycine max
  Soy_ogl_2474 Gm08:2764201..2766752 Cluster 1
acatcaaggatcacaatgaaattatagctataatataaaaccttggtgacaaagtagtgtgtagtttttagttttttaattttatttttctgtaggatctagctgtctaggtatgaactaatgtattcatataagtatatgattgaggtcattgttataagaaatggttagatataatggacaaaatgaaatggcaataacaaagaagaagactggaatttcaatttcatttgaagcccattaagaagaattggaagggacccaataggtccagtttctctctcgtcgacatgtacattccgcagcacagccgcacaaattgaacgagtaatgggggggggggggggaccatatgatgataaaaaaaaaaaaatgaaagtgacatttttcttgggccttagaaaagtgacgtttgtttttggtacgaaaggtgcccgaaaatacgaaacccaaaacaaaagcaaaaaaataaaaaagaaaggtggaagtgggaccacaggtgtgtatagtagcagacagatagagagagaggagggtgtgtgtgcatgaagattgaagaagcgagaaagaacacatgctgtgacggaaacagtgccgacagccactattcattggtgacagactgtgactcacagttcttgaccaaccagtcaaccaccgccaccccttcacctcactttgactccttttctcacctcctgccacatgctgttcttcattcatgttttgtttttcaaaaaatatggtaattttgttatcctttgattaagagaaaataaaaataaataaaatatgagttttaaattaaaatttaaaactttcaatctatttcccttttctttttccctcgttcgaatctctaaacatttaattgatgcttcacattttctttattttcctcttctgatacattgcatcactaattataatcatactaaccacttatctttctcttaatttcttctctaaaagatgcgcccatgcatcttttccggaaataaaagaaaaagaaaactaatctcaaaggaacaaagtagaatagtagtcatgatcaaccaacaattgattctaaatgcctggacaagatccaaactctagaccgtagtatctaaattacttttgagtttttgactagctgtattattgataattataaataaaattattttacatgttttggtttttaaaataatttatcataatattaggattaatgctagacaagtctgttagaagtggtagtaactagttgtattaattatttaagtttataatattattgtattattaaacttaaatgttataatatatttgatttgatctcatatttaattttaatttattattacaggtagttctcccttcttacttactcgtctaatttttccatattatataatataattataacttataaaatctatatataagtgaatttttagcaagaaaatatttataagtgaattttagtttttaatattatgacgctatgaatattttgttgtttttttagttaatattacgtaatatagtatataaaaattaaaataatagtattatttaattattaaatagaattaaataattaaattttaaaccaatatcgatctttaccaattcaataattgatttgattttaagtatcgtaattcccatatttataagtacaaatatatagaaaatgtttgattaatatgctaagagagtgaaaaaagaggaaaaataattagatataataaaatttataatatgacacgaaaaaagaaagaaaaaaatgagagatgttgatgggatgtataaaatgaaaagtgatttatatatcactattcatattaaaattctttaatgaaaaatggaaactacactcctgtcttgtcttctggggcaccattaaaaaaaaaaaaaaggtgttgtccacatgatcaatctaacttatcttctttttttttgtctgaccaaggtttattactagctagtcttaaaaaaattaattccaagtaaacttttttgtcctcattataatatacttgtttaattgcactaaagttttcggtggagtccctatacttgcatattgcattgtgttaaaagagatcatgcatggatccaactctggtcggagtcatgaccatatattcaccccccatggtcacaagggggtgcagttgcaaactaatattacaaggacaaacacaagtcattgatctaagaataagaatctaggacatggcaattgtgagaaaaagaattaaagtacgataatgcttttaagcgacaaactagctttagagaaagagatcatcagtcttcaattttaattttggctctatgattatattcgctgttgagatgagcaattgcgaggaagaacccaagccttagaaagttgcagctaagtggagattgaggtcatttatgtggaagagtaacacttccttcagctttaattgaagtgggtagttaggatattccaagattagccttggcattaaatgattatattaagtgattatcgatctaatattagtttctctagtaattgattgttaagg

SEQ ID NO: 2 - DNA, 2700 bp, Glycine max
  Soy_ogl_2548 Gm08:7784801..7787500 Cluster 1
ttcaaaatcaatttcacaaaatcaatttaatttaaaattaagtttgtcagcaatcatttaagtatgtactggttgaggatatccttggtgcaaataaaaagcatctatatgtttatctttaaattatattttcttatgattatctttaaattatataatcttactaataaagttaagagtaaataacatattataaaacaataaattaacaaaaaaatcttttaagagtatatataaaactttttggagagaccttaaatgattcggtgggttaaattttcattccttattattatttttttaatttgcctttaactaaccacgcccaagaagacaatgaattgaaaattggttataataatttttaaacaatgcaaaataattttgtaactttcaaagggagcaagatggttcttacagttttattttaagaaataaataaaattaataagaacagaattataaataaaagttttttaaaaaaaatatataaataaaagttgccgtctgttaatgtttccccaaatattccaagagcatccaacgaatgagtagtagccggtaatgtaaaaaagtttcattaaaaacaaaaaacggtaacgtcaaaattaactcagtattttagtcgccttaatttatattaacacatgcaaagtgcaaacttctctcattttgatttttgactcaactgaagtcgcaactcgcaaggcaaaagtaagagtaatcgacaatcatttgaagtgaattgtaactaaaaaaataaatgaacaacatgcaagtgagctcattgataattaaaaagtgtaaaattcaacagaacaacagaaaaaacaaataaattaaagagggggcctactttaattttacctaatgaccacatgggtcatatgggtaaaaaatattagaaaggtcaaaatattagtctaaagacatgctcttatagatcaaacaagattaatatgttttcactataataaataaataaataaaaagtttgatttttttatacattgaaaacaaggggcaattagctagggtggtcaaggaatgaaatttgagtttaatggacaatttttttcagtaaaaaaatcaaatcaaattaattttaaattgttttaactgatttgattttatatctaaatagtcaaatttaaaaattaattcaaaattgaacttattttaaaaaattgattctaaactaaactaatttttaattcattttaaaatagttttaagaatcaaatcagttttcaatttatttttaaattatttttttcaaataaaaatacatttaaataaaaatcaattccattaatgaaactgattttataaaaataatttgattaactgaattgattttataaaataataaacttattttttcttaaattaattaaaaaaatcaatttgatttaagttatgttataatccgattcaatcccattgagttattttaacacgcgtgaaaggctattgaaacagctaaatagttttataatagggagttgtttgtttattagtttgtctctatgtgattttaaattaaaatttatctaggtatatgtgtttgtatagttgtcctttatgatattatctccttcatctgttcatcaacccttcttctcttcctgcgtcactgttctgtgtcgtgcaccgatgcacggtgacactacaattctttacatccccttctcctccacccaaattctgcctgccatctccaccttctttgacggtctctcagccaccactgcatcgctagtatgaagtcaacaacttcacaaaattgaagtctcatgattttcttcttcgcctaggcccaaggcaatgtaaaaaaaaagaagaaaggacacccaaacaataacaaatgaaagggaaaatcataaggaagatgtaattattacataggagacccaaagcacatgcttctactatccacggctttcaaccaccacacacaaccaatcaacaccaaaactctccctttcaaatccattatccgtcgatcttgggtgtctaattcacaatgatttctgtcccttttaaagttgttaaaacaacgttatttttagagttgtattaatattcaattataaaaatattaatataactttcaaaataacattattttaaaaggacagtgaaaaaacaatttgaaaagaaataataaataaattagattcgaacaaaacaatcataaaaaaaaatgaagaacaatactatctttttaattgattaatggcaaaacagtccttctctattaaaatattaaaatattcagcatattaaataattattaataccagaaaaaacttaaggtaaatttttttttatgcattgtacacaaggaataaaacttctccaccacagtctatacttgaaaacaaatatatatctattttgttgataattaaactttgtcaagtcattaagttaacggatttttaaaaaaaaatcattacctaaaccaaaagtgatttgggtttgatttaaacactatgaaaacctagttgcacccaatcgaagttaagggctaacggacatagcagttccatgtgtggccttgaccctcctttaatcttgtcttaaaaaatttgttacatgaatgaactcattgcgtttaagttattgtccattttgtctcttgtatgccttcacaattatcctttgaaagacatctttgtaggctaagggaaaaat

SEQ ID NO: 3 - DNA, 2946 bp, Glycine max
  Soy_ogl_2585 Gm08:9975655..9978600 Cluster 1
agatgatgctcaagtagcacttttgtgctctcaaatttaggctcaagtagcacaaggatccattaaacagaaaacagatcttccaaaaatgtagagtttagatatcaaatacagttaagtatacctttactgactatatagtccaacaatgttagatatcaccttaaaaaatatattagatataaaagtctaagcaaatgtatgatagtttttattttgctctccaaatgtgtagtttagataaagataaatgggtgctttctaattatgaacgtgaaagaaataaatcagcagagtatcataacatttgaaggaaaaacaatttcaaatttggatattatatgagataataaggaaaatgttaagttaccaggcacctgccttattgacgtagctgtctttaagatttatttatatacagaaaattaattttaacttaaattattggatgataacttttaatatattatttaaattaattcattagtaacattatgcaatctaaaaataaattattgttatagagtatttaataagcattatcacttatttaaaataatgtagggaaactttattttatatttattttaaacaaaattgaatacaagagttcagcatttccgcataaattgaagttttctaacagatcgcaacacaggcactccctcccactactccaaaagtgatgatgtttggtgacaatttcacttaaataatgagatactcacaaaaaaaaaagagtaaattaaatgagatattgtatgattttaataattagtacttctatcaatcttaatatagtaattgatttgtattattcaaaattacaaacctattatatattcagtgaaataattacaacttttttaatttaaccaagtaagtggtttcaaaaattatttattaaattattttaacttttgtcattaagggtgattataatcgatttagaacaattactttttatatgagacgtagttataactaaggtagaaaaataactttttttattgattaagattataactgatatacaaaattatttttttacatcaattataattataattataatgtgaaaagtcaaaatcaccatccatggttgaaattttttgaagccacgccttagtatattgttttacgaaatcaataattttgaactaaaaaaagtcaaaaacattcgcctaaacaagtcaaatacgcgaactaagttacttacaaaataattttagcatgaattaggcaaaagcaccaaacacaaaataaatagtaaataaaaattagcagaagcacctaacttgttttgaacttaaatcactgactcgtgtcgttcgtgcattcattttgcatatcataatagagttttattttgaccgttctgatgtgtgttgggaataaggaggaaaagatactttttttaagggtattactataattatgccacgagtcttgtgttgttgtgcatttagtattgtccagaaaagagataaatagaacacaacaacaaaaatattatttataaaaataaatccgttcagagtaattttatatggaaagagaaaagcttttttttttaatatctgtgaaggaaaaactgaatacgtgattttactagtgcttcttcccttctatttgacagcaagcaacacacactatatataggaaaagtttaggaggagtgctgctcacagaacaaccccaacgtgtagcaacaaattactaacaaacttaataaaatcttcaacgtgcaaaaccgatagaaaatctaaagaatcgctcaaacacaatttttaaaagatatgggatatctgattgagaaaaaaaaaatttactttaaaatttaaagtataagaaaatattttccaacagccttctataaggttaagtgagagaactaagctcagctttttaaaggcgtttccctgcctttttacatcgtttttttttaacataccccaaaatgctagctaactcaggttggcactagaacccgaaatccaaggaaaggtaaacaaacgaacgaatggcatttgaagttaagtagaaccctgattttagccatgctttacaatcattttttacaataataataaaaggtaaatgagagaaaaaaagtcactaagcttgacaaaatatactagaaaaaaatacaaaatatttgatctccataaatgagaagaaaattattacataaattactaacgagataaatgctataacgtgtgcataagattcatatgtaataattcttatgtgtcaaaataataattattaagtaattaaatagggatcttattcaaggattgaaccgataaatctaacaatttaaatcaaaccaactaaacccaatttcaatatgtttaattattagatttatctttttttcaaccggaatcaacgatgtccggtcaattgttttttaacttactaatatattttatactttggtacttaatttttttctttctatttttgtcttttttttcttcttcattcaatttaatattcttataatcttatctagtgttacaaagtgtcttaatttggtcatatttattatgtaatgtttattatattttaagtaaaaaatttaatgaaatatttattacgcaacatacacatataatttaattttatattttttgtattttaataatattaaaaatcgaatgattacaaagtcaacactatctttttttttctttttgaaactatttatatatgaatttttgaaaagttcatgaaattttcatataaaataattctgagtcttgctagccagcattgttaaggtattggttacaaattaataaataaagacatttcattaaaaaaaaaaacatattagagatacattacaaatcacacctaaaaatatattaatatcctttttaaatagagctttttttaatcttttaattagtgcttaaagacattagttatttt

SEQ ID NO: 4 - DNA, 2218 bp, Glycine max
  Soy_ogl_3627 Gm10:48643201..48645418 Cluster 1
catggtagataagacgtccgcatcacccatttgcaagacgggatcagtccaagttaatcgggcgattaaaggtctcacaacctttccatatgggaccagagttgcatatgcattaatgtcaactttcggagtatatgacaaaatcaaaataatatcagtcataggtatttatgcataatcaatttctttttatatcatacagctatgttcccctctttgaatcaattctaaatatgaataagtatagtttgtttttgaggtcatgtttgtgaacaaaaatatacacttatatccagtaataagtttaatttttatgctaaatagtgtaatgatttttacattcacagtcagctataaattattttccacaaatgcttgtattttttttactctcatcaagattactataactttctctcatactaaaatcattattatttgtatcattcgtattagtttaatcttaaattggaattgagacaaaaaaatcttcaacaaaagttatgtacgtctttttggtggagtaagtataaatgatttggtaaatattttcaaagaatcgacttagtgaccagaaaaattaaaggatctactgattagattttattataaccacttgaaatgtgtaacaattaaaaatttatcttccaaaaaaatattattcatttagattgataagagtccaaccatattacattgtcaatactcatattagtatatttgggaaaggttaacctccttgtcacaacccatttgcatatactgttgctgaccataaaaaaaaggttatgtatactgacctattatttttgcgtatttcacgtataggttgactcgtccatttttttttctttttatttatattaacctaatcccaatcttaatccaattctaaattttattattaaccaatcctttttcctattcatatttacctctggtctcatttaaataaatatacgtacagatattatatttgtatttattatttagatgagtttccttactcacttatttttaaaagtaaaaaacaaatattaatttgatggtgattttttttttacttagaacaagttttatttaaataaatgaaagaggtatgaaagtaaattgagatgaaaagatctaaaataatttaaattaaagtataaaagtgtgaaattcacaccaatttttaaaattttcatctcaaatacattcaaatgtaaatcaaccaaacattacctcaatgtttgatcaagattgctctagtattttttttttaattttaaaggttttcgttgtctttttttaattagtcaatgaaattatagcttacgtgtctctccattgttcaattataatactaatacaatattcatatttcaaatacttaaacttgaatgtaatgctatgtagtatttattagaatatcgcgtcacaaattatactgcaaaaaaaaaaaaaaaactatgcaaataagactttgtgactgaaatacaactttaaaaaaatattaagatcacttaatgatctgatgtgacaataaagcatacacgacataatgttattgattaactcaagtaaaagagacatcaaaactctacaaaactaagcataaccagaaaaatcaacatatttgatagcaaacaaaaattcagaatcaatacaagtaaagaagaaaagagagcaggaatctaaagaataggcaatagcagcgggtcaaataatctggatcatgaattcgtcatagcagagggtttcaaatttcaatgaagcttttgtacaagcgtaaggagtagggagctttgaaatagcaacgcgattacacgcttctgaaacaccctagaagaaaaatgttacacacaaattattccatgactgctactaatatgaacggtttcaccaaataccaaaatcagcagcaattgggccatttcaatggaaacaaaaatgtgcaggaaacgcttctacgtcacaaaaataaaagtcaccaaatggagccttaatggtgtgccttcttctctgccggtcacttgttctagattggcctctgccaagattttttcggatttaaggcaacttaattgttggatctgtctatatctggtggcatttttctctataattgcttacagtaatttattttcacttcgtcattcaattatcaacttgtaagcaattaatatgtaataaaaaaattaagagaatgtaacttaattgactgaataaaatgctt

SEQ ID NO: 5 - DNA, 2300 bp, Glycine max
  Soy_ogl_3814 Gm11:10048901..10051200 Cluster 1
atacaaattattttataaatgttgttttctgtatttctactattgtttcttgttgtgtcccattgtatttcataaagttcaaattgcattttggattgaactctggaagaaaaaaaaatctctttgattagtgggttgcatatgggtctagtggaataatcatacctttgaatttttatgtttctggtctagtgggttgcatatgggtcttcttcaacagatttttaactggttattgggtatcattcagtctagactagttatgtttcgttaatacatggaccctaacattttgattattttttccctgtaacttattgagaaaaaataataggttttgaagctcccttacaaaacatggtacatattcacacacaaaaaaatggtacatgggcatggctatcaacttacgagagccagatctatgacgaccatcccactaacgcattagatatcttagccatgatggctgaaggattaatggttttactgcaaggagaagaagaattgttaatctgatcaattgcgacttattagctatcttcttaattcctatagacgagagaaaggaacttttcctaattactttttcaactttttttttttttaagtttcgactcattgttgattactttggggattataaggttaatttggtgatgaaggaaaaaggaaagagaaaaaagatgtgagtttgaatccctctattgatgaaaatttaataattaatcactaatatttttcaattaaaaaacaaaacatttcctatcactttcatatcaaatattaaaagcagtatgtagataaatcgagttcatataaatacttgaagtttaactttaatttttttacttaacttaattcattaaatttaaaaattaagcttaatttatttaaaaatataaacttaaactctcccttttcattttattatttcctaatatttaggaaatattttatgttataaaataaactaaaaataagaaagaaaaagagaacaattttttaacaaaaattaattaattataatctttaaataaaattaaagtttaaaaaattattgtccatgtcttttttcttctcacatgcacacgcgtggaaacatactttgacaactttttcataactttttatgccaaaatatatagaaattgctttaactcgttattgtaaataagtttaaattaaattaaatattttttttttgagtgatgtaaatgaagttgatcaaatattgaatgaattactatgtttgaataatcataacaaaattcaaattatttatctccatttaatataatctttcttcagttcttgcaaaatcttgaactagatttttcctagttttaatcatatctataactctaaaaaaaaaatcatatctataactttcggcagattagcaatttgattatgcatttctccttgctacaatacaagctaggagttgtatttatatgtacagtttcctagtctacgaatcacgacaagatgagaggtaaagagacaaattatgagtcatgtcagagacaaacacaatgcatgagaatattttatttcactttttgggtacaaatattttatttattttagtgataggagatgcaaacaaaacagatattcacctagctagcttttgttgtttggtgagggaaatccaatccaaagccataaggggccaaaaatctcttataagtcatggcccttacttacaaattgttacttgtgctatccaaatgcagacccagtgttgggaaggaccataacctatagtcaataaatatgaaagtgctatttgcaagacctatgaataatgatactttcttcctctcaaaataactgatatttttagatttttttcagattaaaaaaataaatattctaagagaattaatacttattagaaaataatttaactaaaataacttttttactttcaataaatatattattaaatcttttagaataacgatatttatcataggaaaaaattaaaataaattataaatatttaaatatctcattcaaaaataaaaatattagtaatttagaatttttttttaaaaggttaaaactttaatcattttagtacctggagtatgagcacgtgccagatagccatacaatgcaaaaaggacacgtttgattgcaatagccgtgggtcctcatatcattcgtcttctacaatcaacttcacaaagacacaaacaatcaattccgacaatacacgttcatgtgttactgctagtcagggaacccattcttgctttgagtcacacacaatctgtaaggatcagatt

SEQ ID NO: 6 - DNA, 2668 bp, Glycine max
  Soy_ogl_734 Gm02:48333101..48335768 Cluster 1
accatttttgcttagttgtttacttgtttccttttcctttttctgaaattctctatggccactggtctaattgacaaatgaactgatttttcttttttggtatgtaatttctttataggttggactaaaactactaaggaatgcctgcaattgctatgtaaagagtgtaaacaccgacacaattaaaatagacatggtgtgtgctcatctttcactcttgacctaagcattgtgacatttatctggacccaagtaagattcactttgctgtgaaaatgtgaaggaaagttttgttcggattcattgaccaagaccaatgcaactaccatcttttgcaggatcatgggtttaaggatgtctctctagcctacgttggagttgaaaatttttactcttcttgcttatgtagttgggtgtcccataaatttacaccgtgtatgatattgatttttagcatatagttgacatgtgtaatcgaaatttagatatgtagggcataacttttacacatgtcatattgagttgaatggtttaaaagaataaaatattaatattttcattttatattaatttttacgctcatacctttcaagataaaaaaggaaaaaaaatactatagaaaagtagtttaaagtgtatagaaaaaagtgcaaaaatatttctataaaaaaattaacgtcataaggattctatatcttaaaattgacgatggaaaagtttggaaatcaagggatagtattattttcattatatattagttacccaataaaaaaagcatttttgctcatagtagacaaaaataatatgtataggtgcaaaattttctttttaataattacttacttaaaattagaactcaataccaatagtgaaattggaagaacctttaaacaaacttttgataaatatagatgacttaaaaggtttatcagatccactagctttgaacctttatttcttttattttgagtttgcgattcaatttaaaaatgatgcataaaaaatgatttaatttattaataaaataaaaatagcaaaattctagacgtttccaatagcttctaaaatttagggacattcttggccctcatccaaaaattctcttttaataaacatatactttcacatgctttcacccaatattattatggttccttccaagtaattattatgtgatttgggattatactactatggttcaagaccatgtaagctcgactaacgtgcatgtggcttttttcttttttcttttgaaagttaaagaatgtaattatatttcatgtggagactaatcaagagttaagaccacatataactatcaaaattcaaaagcattcacttacacacacatcttcatctttctcattcacgtagcacaaacactcttcatcatctcatgccactctcttttcttggtaagatcttcacatattctctcacactgggtctgaccttttcttttaagctctctgttgctaggcatttgctatatcccctcctttttttttttctaagtacacttccttttcctttttttaaaagtcaaattacttaaatgagctttttctttcaaaaaacctctcgtttccctcatattgtcgcacactccccgcacaagaatccactcctctcacagtagagacactccctcctctctttcacttttaatttttttttttttatctcatttgtcttccccaaattgtttgctctctcaagacactatggaagagacactcccccctctctttaaagttgttttgtgtcgtgctgaaagtcgtcttaaaccctagcacattggatttcaatttgatttgcttagggctcgaagatttctacaatattcgccgtttgtacctccaaattctggttcctatttcactttttgtttccatagtagtaaaaataaaaacaaaattcgcacattgaacgttcaatcttacagtgtaggacattttgaacatttttgtgtgactaaaatggatcgcattataatgtaattagcaatgcagatatgcgattgtaacttatgaggtttcttacgtttttttgtttggtttttcatgttttgggagaccaattgcaagtgctcttgatgcttagttttgttttattattttattttttctttgggcgggggctggattgttttctgaaatcggcatttgtatctgaaattagcatttgctataaagattgttttctaaacttattttttttatgggcgtccagtgatggcaatgagaactcaattttgcaaaaagtagtttctaaacgatccagaaactactttccggaatggtatcattatgatgtggaaagtggttttcagaatattttttagatattttgtatttcagaaagtattttctggaattcatctaaactagcattccgaaacgactttccatagtaacgattaaatagcctttgccgttccaaaacaaaaaaaaaattgaaaaggaaagaaacaaagtttcatgcacgtacctgatttctcacggtttcaattgtttgtattttttttttttacaatcaaagtcaatataatagaaggatgcttaggtaaaattttaatacctttgatatgcaaaagagggaaggaggaaaaattgatgagaaccaatgagaagggtttagagagcaatgagatagaatacatagaata

SEQ ID NO: 7 - DNA, 2135 bp, Glycine max
  Soy_ogl_3296 Gm10:990802..992936 Cluster 1
tgactgaatgctgtttcaccttgcttaaaattttcaatggttcattaattctacctactcttctacctaagtatctattatactttttatttttatttacttagttgtcctcgtttcatatttgtcccctcagaattctgtaacaagccgccagagaactgacaatatttaaagtgatattaactcaggtcgccatttttaaatttaaaacttttataatgtgaatgaaatacttaaattaaacagagagaaaaacatagtactttatccagacttaaatataagaaaaaacaatgtccaaatttaatagactgtaagcaaaatttcaactaatttaattttatttaatgttagtattccaaaaatatcattaagttaatttaaatgtgaacaccttttttaataaatatgattaaaggtagttttaaaaatgtaatttttatgaaaataagaaaattgtatgattttgactaacatccctaattattagtgtgaattaggtatttttgcctttcattgatcattttaactttgatctaacttacatttaataattaaaaaaacctacttagattgcatgtaaccttgtttgctagcgatatttggttttaaataatcgaaaaaaatgagaggacaaattgactatcgatcatttgggttatgccgccgtttatttggactgagaatgggtagtaagttgaaaaaacaagagttggtatatatgtcttaattgcatttggactctggatgagaatacatttatgattttcaactttgtgagagtgagaaaatataattacgtagtcgaaaagcgtcggcactaagatgtctttgcctatgactccgtaagaaagattcaacattttgattgctagtttactcttcatcttattgtactccatcaccatcacactaaacctcgcgtattcttttctttttctgtgtttattatatacccttgctattatatatgtaaagttgatagaatagaacccgttaacgtcgtcccgtgcgtgaaccgtgagacatttactagctgcacaaccctacgtagggagatatataacttgatattactattttcagtattttgatatttctgacacaaacatctacgggatagctaggtgataatgatagtattatctttgctatgcatgcatttcttgaatttgacttacgtgtaggtcgaaatctaaaagttagcatataatgtgataattgtgaagggatttataagttctattttatttatatttatacacaccttttatgtctcgggttaggtatttagagtataaagattgtataaatgatttttgttttgttatttttatatcgcactagtaaagtcatgggagtaggtaaattgtaccggaaaaatcatcaaattagatagatgcttggtgattattcaatattaaatttatgaatatttaatattttttaatttgaattgggtttaattcaatctccaaaatccaacttatgaaatgatattatccaaatttttataagtttcactttaattgcatctaatggcatctataactgatgtgaaattatacaaacctgacaaagacaatcttagatgcaacaatacaagatttattcaataatgtacttttataaaataaaggaattattccaaaaaataattattaaaataatatttgcataattaattttaacactcttcttactttgattttatttttaggaattgaattcaaatactagggagtttcctttttttatttattaacaaagactactattacaaaatatttaattacggaaaacggaaggtggtctgactgtagccctgatttgcttgggctatttattgagcacgtgactaatatcttttgggcgttgccccaattcaagatctctacattgttggaggaaaaaaaaacactctttcattgcacaaagtgaacttcttgtgacttgtgagtattttttttttgttatgaaagttaggagaaaattaaattaatgggggtaggtaatgagtcttttaattaggttaaaatgaagatttttaaataataaaaacatatttttaaaaaactaaaaatggatatgaagtggatccttttaggcatgtggataggtattaaatattaaat

SEQ ID NO: 8 - DNA, 2387 bp, Glycine max
  Soy_ogl_3720 Gm11:4101001..4103387 Cluster 1
aaaactaaaccccgtgtcagattgagtctacaaaatgacacgtgtaacaattgcagcatacatttaggatgtattgattgcacggctgtttcaagtgtttatagtacacaaaatttacacacttaaactaataattttaaatgttttaataatgcatttaaacatgcttaattgattcctgtaggctgtaactcaataacgaataaagtctacattgacaaggccataagcagtcactcacgtgaaatgacttgtaagagaggtagaggaacaacaagacaagggcacctagcaaaccaacaaaggcaccacctctagtccaacgaacctgatggttgccatagaaaattgaagcattccctatggtggaagcaagagactttaaatttgcaagatacatagtggcattttaaatttgctcaaaattttggaccgtttcaaagtcttgatctctccacaatcaccaacagtgtaacaccatttgggaattgagacttcacaatccattttgagatgaagagtgaaaagagaaaaggcccaacaccagccaggattgggtatgcaatttgtccagccaggtttatgatttggttctaggtgaactgcaatccattacatctattatctattttatgcacatataactaattcattattcttctaaaataaaaaactaattcattattttttatcctatatttattatcgttaaaacaccacttaaaacatgtttaacaaatttattttctcgtaaatcaaacagacatattaagatatggatcgacatttgatagctttttacttttttattaccttgttattctagtaagcatactgctgataggtgcagtcattttttgacggaaaagaatgaaaaaaaaagaggatgggggaaaatatgaaagatatatcatatatgggtgttaaagtagtccaaaaatgttaatatatatatcatatatattaaataaatattaatatatgtgatgttttaaaatatttaaatatattatcatctatattgcactgaatgaaaactcattgttaaaatatattaatattttttcgatacttgggaaaaatatatattaatatttgcatcacgcatatatgatatatctttcatattttcacaaatatcttagtggtattattcaattatatcttgcatattttttgatatgtttaaaacgaaagtaacaataaaaaaaaaaaaaacattgatattctataagctttcaacatccccattcccatatcgtaaggcaattgggtcctcaatcctcacccttggttgggcacaacacaacactcgcatctctcctatcgtgaaagtcagagtaaaaaagttgcattaccccacaaaatattagataggaccacagcaggagctggagtacctcccccttggccttcatttcgttcgtaccatcggatccttcttctgtcttctaagttctaaatcataataacgcactctttgtacaattgtaccatctattggaatggaatacacaattgagtccagcatttggtttataagttctcgttcaattttaactaacaatcatcatcgccgtcgatcacccaaatcatactttacgcaatatttatggatacatatcacgagggattcattattcacatcgcaaaagcaaaatagacctctctaatctagtctactcctcacgagagagatcaacaagcgtttggaattaacaaaaataacattatatactcccgtagatggtattatttcagaaataataatttaatttagatacttataatataatatttttatattaccttttggttttagatttttcaattactattttatacataggtgtaaaatatttatcacttttattaataactaatttctattgatgaaaaataaaattactttttttcgttttaattttatttttaaccattgaatatgtattgaaacacgtattataataattttatttgcaaatctaacctacactaagttaatcacttttgggagatttctctaaatatttatatttttatatctataagacttaaatatgaaatttaagtttgttaaataaatcaatccatataaaatttctattgtttatcgtacctctttataaaacgaaatataaaaatataaagcttgggaaaaaactacttctataccttcacttttttgtaatgtagccacacaaaattaaaaatacataattttcctctgtgatgtacttatttctcttgctgttgagtgtttttggatagcaaatagaggatgagagagagaagaagtgtttgattagtgatggtaggtgttacttgccgtgtatgatcgttgatccctttgttctgtgtgtgacgttagatgacattgacgcaga

SEQ ID NO: 9 - DNA, 1600 bp, Glycine max
  Soy_ogl_3726 Gm11:4421501..4423100 Cluster 1
cattaatgtaacaattaaaataaaattaatggtacaagcatctttatttataattatttattactatgtttttttttttatcattcttacctgtaaaagtcaataatcaattagagggtaataatacggaatttcaacaccaaaatgaatttttcaagtaaatattaatagtgtattcttcaaatccaatatgacgttctaatggtacaaattaaattagtttttgagattacttatttctgagtttaaattccatcaaagtcacttgattcccttcaagcccaccttcccattctttatcctagttagacctccttataaaaattagttttagacctgcttgtataaaatatttttggtgggcatccttatataaaatattattctttacgttttgcatattttattatatatgatataaaatgtttaatcaatggatgttgactcttagatgatgaaaagcttgctctttattttgctgtcctgaatttaaatttgttagtaatattccctgggaccagtgcaaacttttttatgctagaaatctaagcctaatatataaataggaacaacttaccttttaataacatttcaagtagttgaaactcgacgtaaaataagaaacatagtatttctatcatcgatatgaatgatcaacgtcaattcattggttatgttattacactaattaatacccttaattaatttgtattcttttgtttacgtgataaaataaccataacatttgattgtatgtgtttgtttataaataaaaattgtacactgtataaaaaaaaatatttataacactcacacatcttatttaattgacttagattttcttaatatttaatgatatgtgtttgaacaagcatgggtaaacctgatgttaaataaataatttttgattttacaaaattaattaaaacgacttgtgattaaaaacttttaccttaatataaaattaaaatgatttgatgaaagtaagtatgtaataaaatttaatatgaaattattaacacaacataaacataaaggataaatttttagccaaatatacttttgaaatataagattgtcatgtgaatttaactttttctttaaatatttaatactttttttgaaataatattttatgaaattgtatattaagacttgaattcaaattaccaagggattaaacttaagtgagctgttgtaatttttagtatttaagtttaatttatacaaataataaaaaatacagaaattgatccatgtcccaatcatatttaatttaatttactgtttttccaataacaaattattttgagctactttaacctattaatcaacaaattaaggaagtttgttttttggaaggatatggaattgggctatatgccactagaatattttccaaaaaatgaaaagcagcatgatacgtgtgtcacgtgcaagattctttagacgttataaatatttgatgtttatcaagatgatgattgatgggctatttctcttctctctgccatcaccacacctataatgaacgacctaaacctaaagtggtccttgttgtggttagtgtatcttccaaataagaatctcgcagataaca

SEQ ID NO: 10 - DNA, 2200 bp, Glycine max
  Soy_ogl_3828 Gm11:10563601..10565800 Cluster 1
ttcaaatttgacaaacaatttccacaattcatttcagttattttataatctatttaattggtctataaacatgttcaaagtaaggttttaatttataactttttatgtttttctattttttttttttacattcaaaatactctaatgaaattgatcatttattgtctttatgtaatacataatcataaaaatatatttccaattcttccattgggtcacatcatagcatttgtgcttgaaagcaaagaggcacatgggtggggttgattgttaatgctatccaacagccacgtacgtcgagacgaaacaagtaagttatgttgccctacaacttgtgccatcctacctctttactttgttcaaatgatggatggatattgcagaccaaacaactttcgatgcctacttacttactctcaaaaagttggccttggatacccattgctgcattccaaagctggactagtgccactgcttcatgaaattcttttccatggaaaatcatcactcacaaacacaaaagctcatgtccatcaatttccttttatacttgttctaaaggtaaagcagattttgttgtatatgttactattaaattcaggtatcagagatataacagaatttataacaactcaaacattattcaaccaactaattactaaactaaacaagataaaccagattaagatcttcttttaaacttcaacatatattttttttcactcattaacaatatttgaaaaaaaaaagctaaaaattacttgatagattatattaatttaatagtagttaatacatatgttttttttcactcattaacaataacttaaattaattgttttaaaaatattctattttaaaactcaacttattgttttggacgaatttttgaaaattcactttagacatatatataaatattgaccagccttattagtagctttaatatatttattttaagataaaataaaaaatcttatttttaaatatttttttaaaatataaaataaaaaatgataccatttttataattattaaaaatatacgaacaaaaataattaaaaacattttcataagagagaacctgcaaatgtcgttatcattacttaaaagcgtgcctaagaaacaattggaacatgcaaaacaaattatgaaggccctgtgatcgtaggtttattattattgcactcttaataaattggctatcactatttacaatcatgcactgcgttacaagacaattttacgcgctttaatctatttcctttaacggtaaaaaaaaatatttatttggtctctctacttgttccaactttattgttttgatcttatacttaaaaaaaaaataaagttttaacttctgtacaaataattcttttatattttattatctatcgtcaattgtcatgtaactccgttagcatttttttttttttgtcgtagagctgttaaaaattattttaattgggtggaccagcctcttgaatataaggtgtaaaaagaattgggctaattggctgctacttgatgggctacaaggtcaagtgagtccatgaattgttaactcagtattatgtcatttttttcttgcattatcactatcgaatcatgtatcttttattgtattccgtaaagtttttcattgccgaatataaaaacatttttacaatgaacattccagaatacaataggaggtgcaggattcaaataaggaagtataggattcaaatgccaagtattattttttaaaatgtatataaattcagacacaaaatgggttgatttatttcggcacattgggcctacaagtcagactagaccaacaaaatgtagcccatatgaaatccacctcaacccagcccgtttttcacatcttggcatcaatgtatggtgagttggcaaagcatttgtgtaatctcgatgggaaaacagaaccaaaatattggagacgaattatggatgaagaaatacctttttattgggtaaaaaatttgaaaacatatcaatcatttgcctctaaaactatgccctcacaaagagccgagtcaacagactagaaatatattctcgtatttctccaactcgttaaaaattcacagcaagaacaaaatttaatatgataaacaggcctagaatgtaatgacaaaaattataggcaaacaagactggactgaaaaaatcaaaaacacaaacagcaaag

SEQ ID NO: 11 - DNA, 1721 bp, Glycine max
  Soy_ogl_5487 Gm17:3580480..3582200 Cluster 1
aaaataacaaggtccaacatttacaagacacctgtttcatagtaaaaataaataaagtggtttttaaaaaaatacattgtgagctaaagatatacataaaaatttaaagtacaaaattacaaactttttaaagttagtcaaatctaataataaataaaaaaaaattactatgaagttataagattgatttaataataaaagaaaaagaaaaaaaaagttgtaaattcaaattctccaaagctctactaaaaaaaatactattaacgaaataagtaccatcgaaagttatcatataaaaaaggttaattatataaaaaaaggttaattatacttttaatctctaaatttcttcaagttttaaatttactagtcaaaaactgaaaaaaaaatatctgttgtgcattaggatgcataaatatttttatgcattaaaaaacgtcacaaattgttaccctaacataaaaaacaaactcctcatctttagccccgttaaataataaaaaaaaaagcatattatgaaagacatagattattccaaaatcaaaatcaaggcgcatttgactgaaaccaagaaaagcctcttttcgagctctcccgtcatcttttcctacttggttaatgtgaattattgctaattttcgtcaccatcgcaacacatttttcattgagaggatctcttctcgctctcttcatcttcaaatcctcaacacactctaaaagaaacttgtttcaattggatccccaaaatcaccaacggtgcaattcaaatccgccatcctctccttcgcgtccttctggatttagatttggatcttcatttcagtttgggggtttgggatcagtgaagatgggtgtcggtgtcctcgagaaaatctggatcttgaattcgttttcacttttgggaaaattattatcgttagaagtcaaattttgatattagttctccataaggtttttagtaattagcttctgatttagttgtgcaaatttaaatccttgaagatagctttgtgcttttgtctatcatttccgtgcctttgtctcccacaacggcattcttattgaatgggaatcgatattgataaaatatcgcttcaacgttgtgttttgatttgatgtcggttcaatctctgtaaatttattcagaaattattaaacatcttttattttatcattttttttgcagttttaacggttagaaaatgagccgctaaaaaatataataaaatactaaaagacttataccacgtcacaagaactaacctaaaaaataattaccagaacaacaatttagaaactaaagattaatcaaacttcatgtgaagatgcatgatgtgttaagttggctctcgtacaagattttctcatgcattcagtataaagaaattaaaaatcagttacatgataaggtgcttccctttcgataaaccatatgatctccatttgctcccaggccagccctaacttggtgcttgtcatgctgcatcaaccattggttgaaaaagtagattattcaattctaactatacggtttaattaattaaaactaattaggactacttatactaaaataagcaaaaacattcaacttttctatagaactaaccgaaaatttaaacctaatcataaacaataattataaacaaactgacgaagttatagcgaaccaaacatgaataaaataaaaagtaacacaagaaattgtactatttatgtattta

SEQ ID NO: 12 - DNA, 2500 bp, Glycine max
  Soy_ogl_5636 Gm17:11845401..11847900 Cluster 1
gaccgtcaacttatataatgcgaatatatttttgttccattatttcatatccaacgacaccaagattcaaattttaaatcattaaattaaaaaataatttttttataacacttataacaaccattattgttatattattgttatatatcctctttttaaaattgttttttttctctctttatgtaactaaaaacaaaaaaatatttctttttatttatatgtagaaatccatgctagtaataaggtgtttataatattcacatattttgtaaagacaaaaatatttatgtttatagtatcatttattttttttctctattcttttaagaaaaaataatttattaatgaatgatagtattaaattattttagtatttaacgtctttacttttgcagtaagtctcctcctgtttttgctgattagtagtaccgaacatgattttgaaaagttatagaaataatcagaacaacgttgaaaataaattaacgggtgcgaaaaaccgacggcaacttattcttacctaacaatgtatcatatttggaaagtgccacgctactggatagttagaagttggttgcactaagtattgataatcgcttcaacaacttggaggctaaatagaccacgcactaactcaacattgattccatatagaaggagcacaataaattgggaagccaataaaactgaaatcataccagtaggtcctttaaaaccaagttaattatggctacatgctttaggagtacgtccacttatcatataaaatacaaaaaaaacaactaaatatctagtagggatgcaccttttttttttctcccagttagtcatctgtgtataaatgaaatcaaattcatttgggtacattttaaagtatatgtgtatgggaagaaatttggcccattcaaggtaggaaatcccacgattctggtttgttctattgttcttgattcaacattttttagtagaataaaatcgcattatttacgaatacatgtctccttctattttttttaatatactaacacatttagaataaaatttatgctttcaattcggcttaccaaactttataaattacagacattatatacaattaatagagtgtgtaaatcaattgggacatggttattgcaacttatctgaaatattggaaaagagagtttttttttttttttttatgtctataatgatcttacttatgttgattaccattgtctttcataaaaaatgtatgaggtttattaaaaaagaaaactttataaattacagtgtgattattaggctttaaattgaaacgaatcaccaacggagaattgagtctaacaaaagggttagtctccaacaactatgtcttaggataacttgccaaagagaatgctggtagggaaaaaaatgagtcacttccacccacaattaactttctgccttgtgttgtgaagaaaattaaaatttcaatcaaatataaaaaattaaaaactctcgtttaggtgcttaaaggattttcatactatcaattttgctagtaaaaattatcacattaattttgtcaatgattaatatttctcaacgatcaaaatagttcacctattgcttttctttagacaaaatgataccataataaaccttttaattccctcttcaaatttcaagcatttacaaccactattttacgacagaagcttcctattctaaaatcaagtccttatatctaacttgaagttacacctactttagttggttacacttaaaattgattgcaattgcttgcaacgtcaaagattcgaatctactttgtgaaggactctacttgatgcatgtaggactggcaatctaggatagaacaccccccaccccccaaaaaagaaaaactccatataatgtgcttgcttgtcctacaaactgatcacaaaagcaatttttcacgttaagactcaggtttataattgttatgctacaagaaatttaaaacaaattttaattatagaaagaatagtgtttaaatttgttccacaaaaatgctagcgtactttctttgatattttctttctaagactctctctatgattggttatgctgctcaagcaatgatgcaaacaagttcaatacctcagtataaatctagacaagacacatttatagaaatcaagactaaagtagactaaagacttaacgttaaaaggatagattctcatctcaatgggggtacgaaaactcttaaaatctgtggctataattgcctctttagtctttgcactatgcacccattttagttctcaaatggtcttacttacttgaacattcaacaaagcatgcagcggtacgagaaaagatataattggaactctgcatacgcctaaagtaaaaagggaacgtattttaaagattttggcttttaacttaagcaatgttaattaactgatttgcaaacctaaaggctaattcaaataaatggatcactcttttttactaatttttttaaagacaaatacttgttcaa

SEQ ID NO: 13 - DNA, 2820 bp, Glycine max
  Soy_ogl_6279 Gm18:59648320..59651139 Cluster 1
ttattatttagtttagcactttacattttcttttcatttatttttattttattttctaacaaatcacaactcatcattataatactagttttaatttttaatcatgttgaaactaagaacctttaattgaaactatgcaaagaaaacaaactcttacaatttatttagtcatatttacaatatactccacaagtaccaatatgatgtctgcacttctaattgtgattatttttttataatgataattagacgaaaataccaatattaaaaaaaatagacaattaaaaaaaagttcaagaaaagcttattttattttttatagtgaattgggactaagagacgggctgacgtataaggacccattatggttgattgtttgagtaaaggagcagcaactgagtccttgttttctgagaggaatttaatgtctccagtccaactccgaccatcgcgggtggtcctgaagcaatttgggtgccagttgcatgtgcccatggatatcataagctgtaatctgttttgcacacagtagcaaaatagataactcaaacgtgaatagatcaaccaatgaatttatactttaattatcaagatttccattactactagtgcagggtggttcgtgtctatttttctaagcaaacagaagatctcaagtctacgcttgcttttgatttttgtttgttttatggactggctgcaacaagtcaatgtactatgtgtggaaatttcagtcacggcaaaaataataatgactagtggacaacgatgttaatagacattaataaaaagaaacagataaaaaaatatataaatatttgaaagaaaaaaaaaagagaaatttgtcgattggatgtttaaaatttttagttatgcaaatatcatcactcatttgaaaatgtcagataggaaaaccctatttatatattagtgtccgcatatcagttttgagattttaatttttttctcagccatgggtcttttgtgggaagacttcatcagtgttagctagttttcctcgtatggtctaattaagccttccttggtagaaaaaaaaatgttgtggtttttgtttatgttgcattatttaagcaataattaacatattgaatatggtagatcggtattgtatttaattttgttttatgtttttatttgtttaatttgtatatgtgcatttctaatatatatcttaaaacagaaagagaccgtttttttattgtgccattaggatatacagtaacttcaattttattttattatttagatgatgaaagcaccgtattattttatgaagtttacaggaaaaatgtagaacacatcgttttagaatgtattagaatcataaaagacgatgtctatcgtagtctagtaacaatatcatacatctcatgcactggattatgtccctttcctctgattttttttttctctgaaactcctccatcaccttcaccaccagccacagcgggtccaccgccacctgaaacatcacactgcaccaccacccagtgcttcatctgccccatggccacatggatatttggcgccagccagatcatgtcgggattgagaaggtgcacgattgtgtggacaataaacaataaacagaaaatagagaaacaacataccaaatccagaaaaacaaaagcactgtctcttctgattttaacccttttatttataagagttgcaagttaggtttaattacactttttacctcaaacttttatttttttgatgaattttacctaaacaaatcattttgacgcatcttaaccctcacttttaaataactgacgaattttgtcttctgtcaattgtcgttaattaattaacggagcaaacactttctagttgtttttagccgctactaaacgcgcgtatttaacataagtgtttttaacataagctgctactattattaagtttgtttttttatttttatttttcctctcttgagaaggtctgggcttgcctctgcgtcaccatatgctcctagagcacattcacactgttgaacttgtccacgatgttgtcattgttcacgagcccaaaggcaaacccgagttcaagaggcatgttagttagtcttagccggtagcctataatggagacgaacgagctcaggtagacttgcacaacgttgtagagctcattatattgatgttgtcaaagtagcaatacgaggagaagtagtggaagatccggtcgaagagcttcacaaaggtgaaacagagctcgggtgagaacattgcgtgaacatggttaatttggtcgaaggcaaacacacccaaaagtgtgacgccaacgattccaatattctttcatcctttttaaaagtgtaaaaagggtgttggaccagttgatgaagggctttgcggagcttttggggagagggtgtttgagaatcacttcaaaggtgattcaataatgtcgaggcaggcaaaaacaagaaaaaaaaattataatagtgatagttttttagtgtcattatgttaaaaacaattattttaaatacgtgcacttggttggtataaaaaccctcaaaaactgttaattatgttagtcaatcaaaagacaaatgacggaaggcaaaaattaccaatttttaaaagtgtacgataaaatgtcaaaataacaaatttattgggtacaaaatttgtcaaaaaattaaaaaaattgagataaaatcacaattaagccttgaagtagatataattaggcataacaattaaatcaaaacttatcaaaaattactttctagattttctttttgttattattatgatagtttgctaaaaaaatcccaagttttat

SEQ ID NO: 14 - DNA, 1700 bp, Glycine max
  Soy_ogl_6166 Gm18:54127601..54129300 Cluster 1
agcattgagcatttgtcactataacagaaaaattgaaaaaagaaattgcaatggacagaaaagaaacaattcactatatcaaaattacaagaaagatacaaagagcaacaatattataacattattatattagtgcgtataagactgttatccaacgcccaacggcataaaggttcatactcgaaacttttttttattttagtataggtgacaggtattttttaatactgcaaacaattctgttaaaattggatagaaaacaattataaacagaaaaaaatttatgctctaatattcaatatagatgcatattaattacatgtcaattcattcacattctttgtaatcatattggaactttcactaacatcacatactctcagagtatcaaaaaatatttcttcaccaaaatttctgtactctgtagcactacgagcttttggattggaccaagaattttagtcaccaactctaattgtcaccaaaatgtttttgatagattttgagcaaattaaaaaaaaaaatctccaaagttagacgtactatgatacgtaaaatgatagcttaatttaacgccttgtacagaaaaacaacaaaagaaataaaagactagtggcaactttaatttaagggaaattttattttttagtcttagaaaatagatttcttattaactttattttattttttggatcaatttcagtgttttaattagtttattttgtcaacaggcttttggtttatttgtcaagttaatccatacataactcgcatttattataggaaataccaaacagttgggttgaacaatccaatcaaaatcaaattcatgttcgactacagtcaaaataaatcaaaattgctgtaaaacatttgaattggccacctgaactaaccaatcacaaaatttaatttggagtaatgacatatgagcactagaataaaatatatacacctagttatatctttttattcttcttttcttattacattatattacttattgtttttttttacttaattacatttttgttcctctcggtttgacatatttcccatatttgggtccctgcattttgaaattagctaattggatcctcctaaatctttccgtcttccataatttaaactttgtagcaaagtgtttaagagatatgatattaaaatgaataagatattgttagttttgttatatgatacatataactttatatatatactacaatttttacttatatatacttattggtttagtgttgtgtgcttgaaataatggtacagggtcataaaaataaatattttttcttgacatatcaattgttacgtcaaaatccaatggcacatctctgaattttgttaagttattaataaaaaattaacagaaggatttgattgtaaaacctaatatattttaaaaaccaaatagtacttcattttaaaatgtagagtataaaattaagtctttttttcttttgtatctgtctctttgtatgtctaataacacattggtgtccatactttgttttcaaacattataaaaaatgatttgcatctactaaaggtttttctttatttcataacattgatcattgatttctttgacgctaaaataaattagttcatttaaattaatgtaacatatctcttttgtctctaatatgaagtagtgataatttaatttccaaaagaataaaaatttt

SEQ ID NO: 15 - DNA, 1500 bp, Glycine max
  Soy_ogl_919 Gm03:36976001..36977500 Cluster 1
atgtatggtattttcctttgtatcctgcagacccaatagactttaattaattatttgtaaaattgcgtgtgaatgatctcttcaaagaagccagctacctgcccatagaagggcatcttttttattttcggctttcatcctcatgcaatagtacatgtgcgtatgtagctgggattaatcttcataaagcaaatattttaaaaatcttttcaagatcttgataggaaaatattatccttttaaaagaaaatgaacaaataaataagactaaaaatgctttaaattataatgaaaactgttttttggttatttcaataataaaaaaaagtaatgcatatataacatgctgaaaaccacacaatgcatagatcaactaacattaatcgaagtctcgagctagtttaaaataattaaagcttaaatttgacttgtttaattcatttataacttaattatttttaatttatgaatttttttcttaaatgatattttaaatctatcaatttaatatttaataacattttaatactagttgataacttacatataaaattaagtgttaaacatgtggtatgataatgtagaatctatgtaattttaattttttataatttatatataaacgaataattggtatcgaacttgaaaagtttagatttgactcatttaaataatcaatttgtttatttaattaaaaaaaactttaatcaagcatttaacaatcaaattcaaataattcatgtcatttatactctccttgtagttagggatggatagaaggggatagacaggggtcctagcccccctccctcgagatattatgattgttaaagtaattgtaacttagtttgttgtatacaattattggctttgttactttacaagaaaatagttgttattttttcttactcttagttttgataggttgatagctattagtagcttaccttcttatttttatataattagttttttaagttatttgctctctaactttttgaaaccttttagatgattgattccactattttttttacacatatatattcatgttagcgtcaacaaattatgattcagtccacatgtcatagtataatcataagtattatgtaattatatgagattatgttcttttatttttttacaaccgtatcaattaaattcatcttatatattttcctttactaactatagtttatgctctctatatataaccagaattgcattattatacaaattagtaaacaacaatacatcttttacttcaattcatatacctacattttaattgtatttttgtacatacttcctgctaatactttaaattatattttttttaaagcattcttttttaattattgtgtattccggatcacaaaaagaaaagaaaaaaatttaaccccctttaacaaagttggagatccatccctacttaattacactttcatctatcacccaatacatgttatttttaacgatgatttagtatctataactatc

SEQ ID NO: 16 - DNA, 1652 bp, Glycine max
  Soy_ogl_1778 Gm06:3179001..3180652 Cluster 1
aatgaatatcttgattatttgccctaaactgctatatatagctcattacccacattaagcccatgatcagaactcggtcaatgaaatatagaacttggaatttaaattttgagcacttattaaatattgatatttttaatctaatttcatcatgcatcgatattatagtaggataggatattattgtattacatatgattaaactccattgtacgtattacaccagttcttgctcatagctagaggttggaggcgcataaatttcttcttttaattacattcatacttaattgtatgatattataatattgagaaatatataataaatggatgtgaagtgaaactggaaaacaaagtgaacaaaagtgtgaaaaaacgacaaatattagcacgagaatatatatatatatataaaggttttaaattatttaaaattattatataataaatcacttgatttttatataactttatatatcttgaaaatcgtatttgggatgatttctgattaaattgataaggtaaaatggggtgttcgtgtcctcccctttcgaatgggcatgggagctaggagcccccgagcttaattttaggggtgcgtgcttctatttaattctctgaattcctttttttatttattattatttagttctgtgttttctttcctcacaggaaaaaaaatgtaagaaaaatagtataggagaaaatagccttacttaattttaatgtacattagtggagtattaaataactgtaaattaatgagaaaataatatattatttattgaaattcatatccaatgatagttttattatgtgataaaattattaaacaaggtgttatttaatgatacatgggaagaacactattaaatgagcgtcagatgtacgttataatcataagttattttaattcataaaattgacatatattgatcgttttaatccttgatatcaagggccgcctcttaattagatttccgactttagtaattattagtaatttgaatacctaactttggaaaaatattaattattaattagtttaatcattgactttattatacatcaatcactttgatcttataatttaaaggattaacataatgacgtcagatcctattacatttatataagttgataatgatttatttaaaaaaagaatttgttttttattcttattattgtatgaaaaattcttttgattgtcacacattacaaacaaaattgatctctaacctaatgaattaaaaaaacacatctaaaaaaaagaattactttaatttattatcagagaccaaaataatgaatagatgtcaaatttagagacgtaattgtcaaatatataaactaatttgattgattttgtaatgacatggaccaaattaatttgtaataccaaattcagacactaaactgattaacccattcaaagttagaaaactattgatgcaaaactgtcggtaagcaagttaaaatcaagataatcgtctcatctagctagtcgagtccaagataccaaagggtcaggcaataattgaccatgattatgggtgtttaatggaaggaagagaagagagaaattgaatattattttgggtaatatttaaaataaataaattattttttatatgaatatattgagttttata

SEQ ID NO: 17 - DNA, 2400 bp, Glycine max
  Soy_ogl_6811 Gm20:339601..37492000 Cluster 1
tatttatttatctatctttccgtcatttgttagttttcattagtgggtgagtgggagagattctaatctacgatctcttctttcccttctttcttcaattaccaaactaaccttgtaacttcttaaaccaaatgctttctgttgggagggatatctggcacacaagtcagcccaggttttctgtctaaacggaagtagcaccaattatgtatgaaaaatagttgcttgtttaagtgagtgtgaccctgttgcaattaatatcaacaaatgaaagttagtaatctataacttaaggtttctttaaacatttctatgatttttttttaattttataatgctaaagataaattactcatacatattccttgtaaaacactcataaagccaatgaggattagataaatcaaaggtgtacgtgtgagaggaagaaggagcagaagacgcaaggaaaggagtggaagaggatatgcagtagtaagaacttagaaaagagggtaaaagcaagcattagagaggtcgtttaggaaggcaatactaatgaggtagtgcgtggtgaatatgagagtaggggagaggcataaaaggtgggtaaggaaaatagtgaagaaaaagatgaggcaacaagaaaaaagaaaaaaaaaacagagaggaagaaaatgttagccaatttagcatttaataattgtgttaaaatcattcactttcgaaagaataagactcaaactaaataaaaatatttaaagactagaactaaatttcaatatatttacggcaataagaaaacataggtagaaaataagataatactaaaggaccaaatgcttaaataaagagttttattgttcgtattaattctactcaacttgaacaaattgcttatacaagatacatttcattatgttaaaaaaaagacatacggattaagatacatatgacaacaatgaattaaattattgttagttacttcaatgttgatgatgatcttatttaatttgattaagattatttttattagaatatatttgtgatctattaaaacaaatatatgttcttaccatgttcactagttaagtagttcaattttcatcttcttctagtgttggtatgatctcttatctttcttttttatgcacggtaacaatacctacaaaaacgactttgacgatcaaattaactaagttcgaggtactcgtgtgtttgaggatgagtaaaatgtatctttcgtctaaaattctcttgtgtatgtatatgtatcaagtgaaaagaaagatacatttcattaactactttatcctagttcgcgtgtgttttcgtcatgtagatagtgtctagatgtgtctgactatgagacatgtgaatataggatatgtccaactaggtattgagcttatggtttattgagtatacatcaaatttattatttttaagatacaaaagtagtcctccaaactctataattaatatgaactagagaaattaatatatctattaaatatacaccaaacttatgacctataggatgcagtatatattattacggcagatatcatcgttgagcataatgccttcatgtttagttaagcatttttttccaagaataaaagtaaaatgtattttagtagttatcatctcatattgcattcattaacttgagttcaataccttggctttaattaattgttgtgaagttttcgatcctcttcttgctgctcgtgggaaggagtccaaagtcgatcagatcgaagctctccatgtcccaaggttggcttgtacaatgatcccatagtgttaactaaaatgtggtgctaacttcattgtgatagattaaacaaaatacatttttatgcatttacgcaacaatttaaacttttgcaatataacgtgatattataaactttttacatgatatttttattaaaaaaaagatattatttatatcattttttttatcactcgttatttctgtaactttttttctttatacatgcagctaaaacttcttaatgaaagtgaaaaaaatatttttaaaagtcaattttcatttcttttttcttctatacgccattatctatatattttttttatccctcctgctattgctaaagactaaacatacataccgtaaagaaaagaaaaatgggttcctcttgttcctacccaacaggcattgcggcccctgtaatggattctctacatagatttcagtgtgagaaggctagctagtccaccgagtttctccagcaatgatggcaatgcattgaactgatgcaagaatactggcaatgacgactatgtggaattgacgtcaaaagttcagttcattgagacgtttgatgttacattacattacgtgctcaacttttgtaatgagaagaattgattccaatgccctagatcatg

SEQ ID NO: 18 - DNA, 2100 bp, Glycine max
  Soy_ogl_6851 Gm20:38706001..38708100 Cluster 1
gttttattttccccctagcttttgtcatattcttgtcattgctcttcttcgtcacctgcttcctttgccttcttcaccctcaccaatatgccccatgccactcctgatctcatcctgtcacaaacaatcttctttcaactccaacacaaacaagctacaaaatcaaagcaacaatcttagaagatgctatcaagaatagcataaacaacaaaaggagcatctcgtgcattatcttcaatagttttacactataacacttattttgctctggcactcgaagttaaactacaaacccccttgaaattcatttaagagaacatgaagttggtcctaaagttcatagaggacaaccgtaagtattcaacaaaaataggagcagggtcgatgggttttgaaaaggggagttatgcttttatgaaacttatggttggagtacaaaaacaaagggaaaaaatgtgtttttattaaataaaatttaatagtgacaactttcctctgtcactattaaaaatacatattttaaatatacgtttggtgatagctaaaaactatcagaaagtgttagcgtcgttagcaaataatggacaaaaagtaaaaggtaaaattgtgtgttttataaaagttgaggataaaatatactagaataatttgttagaataatttgttaaggataaaatttgtcaaaaataaaaattaagagaaatataaccattggtttaaatataatttttttataaaaaaaaaacttcacatttggttatttatctataaccattggtttaattaagagaagatatttttttacgacaaaagtgaaatattttttattatcttttttaaaatatgtgaatataaagaataaaaacaattatgcacaatacagactatccaatcttaaatagacagttaagattaaatcacaaattatataattttttttactcaacacaaattattattaagtggtgatataatcattattaaataacttttaattgaaaatcgcgagtagttgcaatgatattgacatttgacagcgtaaccacctatgcattttttttagtggcacatcgagtcggatctgtcatcaccacaaactgataaagtcacctgatctgcaatgctatatatgctaaatgccttttttttattgcctatttttttatgaattaaaaagtagaggctcttatgagaggatataattcatattcatgtaccaaaaacagggggatataaataattccccgcaaccctctttcccttatccatcacaatcaccaaattaaagttgccttctctacattatcagaatttaaaagttcaaaattaaattaggtttggaaatgggtgagaactaatgaaacaatttggtcgggtactaagatacttatatcttcataatattcattaaaaggactactgtccaaattcatattcaatccaacaataattttaatttagtgctcatgttcatatttaatgtgtatttatatacttatataatgagattcgacatcaatactttatttaagaaaaatattttaatataccatattttatatataaactagtaaaacaaaaggctatttcaaatttttagttatagaataaataaataattataattatatgtataatcataccgtgcagttcaggtacagataaggggtagattagtatctataccacaaaattttgtggtagtttactaatgaccgtatctaaatctgtttgatgagtaaaagcttaacacattgtaggtaatttttacgatcattaaatttgagcctagttgtcatatctttgctgatgatagacactttatattattctcgatcctttaatttccttaggatccttgaacaactttggttagagtactagaaaattaattaaaagaaccaagacattctctgccgttaaaggcacaattgttctttcgtggacgtctatatcttataagtagtttctcactgttttatgcttcacacttgttttgttgtttctaataaaccgtatggttagttaaaaacccatccttgctggcctaatttcaattgcttgaatatagactcttctaactctcacttttagaattag

SEQ ID NO: 19 - DNA, 1927 bp, Glycine max
  Soy_ogl_1678 Gm05:34877701..34879627 Cluster 1
ggttaagtgatggccatgggtcatggtcattttttattattatggaaagataataaccgacaaatcagcgagtaacaaaaggaaaatctctaaaacatgttagaatgtgaacactttttaaaaaaaaaataatttaccttgatgaaacttatggcattagttgtagtataaaataaaattatcaagtaaatattcaattagactatttacgtaaacgtagtttcgtttttaccaagccaaggccgagggattaattaggaatgaggagttaaaaatgtactatattgcttacatgacctaatgaccccgaatatgtaaatacagggtgttttcttctatatttgaagaatgagcagcatgccatgtattctctaatgtaaacttctgccttaattcaacgaatgatttcattccacagaaaattaaatgaaattccgttatctgaagatggttgtcaaattaagactaatgcatagtgggaatgagattagtggtcgtgacttgtgagcattcatatcaactagcaaaggcccctgccagcacttggtttcaactttgaaatctcaatcaggccaacagctgcaaacgaaaaagacatatccactcttattgccgtgtgtttaggttagatgtatgccggtaaaattcattttgaatggaattaattttaaaataatgtggtttatgtctcaatattttattataaaataagttgaaaaataaaatttagtataaatttagaatcaatttctcctcaaatcaaacacatacataggttctatttgtcgcaaagtaagtacgagtttcatacatctatgtataatatatatatatatattgtattcactaaagtactacaatcaattaaaaattcaaaacttttaacaaacactttatcattttttaattattattttaaagattaactaagtttttaatttctaaattttttaaaattatgtttttaattcataaatttttgtttaattggttaatgtctcttaactcttttttattaaagtttttagtctttaaagacaggccaatgtctcttaactttgttcattaagtttttaaatccctaaaacttttgaaaaaaatcagattttaatccttaaaatttcattaaataaataaaaataatgaattcaaaatttttatttagggattaaaaattaatttttttaagtttaaggaccttgatgaatcaaatacaagtttgtgaattaaaaatcaaaatttaaaaaatttaggaattaaaaacttaattaaccctcattttaatgttttttaattaattataattaatatattttcgtcctaaaatcactctattgacgactttacttgttagttatctctggttcacgatttgaatctgctaaggaaccattcgtcaatcaacatgcacctggggagctggtttataaaaacttttttgttttttcccatgattttcgacgccccctttcttcgtaaaatgtcacatcattttttaatataaaaatatgttaaatcgttttttttaaatcttaatcattcattattttctataagtcaatattttttttataactgcagtgaagtattttaagaatcttcagctcccctattccagaactcagctctttttatctctttcctctttttgcctccgtatacaacaggaatgaaaatggatgatcataactaatcacccgatctttctttgtaataaataattaacagaaatacgtatactatttatcccgtttatgggagcaccatgatttaagacaaactaaattaactaattaaggagaaaaggattatgaccatgccactagattttttccctgtgcctttttgtctaagtggaatgtagtaaattacaaaaactcctaatttgaaaaatatttaattattcgcaagtgtaagtaagtcctct

SEQ ID NO: 20 - DNA, 1449 bp, Glycine max
  Soy_ogl_2904 Gm09:399201..400649 Cluster 1
actgggctagtatgacaacataaattatttactcattcaagcatgcgcgccagaagttagggaacaaaaatatacttgtgataaaataaatatatttcttccctaactctattttgctaagttagtcttaatttaaacatttttgttatacttatatttatatatataatctttttttaagtcattaattttaataaaggttaaaaatgatcataattgacaaatagtagttgtaattaattgacacaaaaaaatactaaaatattttatgctcgcaaattgtcacaattaacaaaatacaaaattgaattgagagtagtacgtagttgatcttgattgtataatttaaataagtggttaaaattaaaattagttaaaatttaaccgtgctaagaaaaagtgtgagtacgagagaaataagtttaaccatataatttaaatatttaataaaaaataattaaaataaattattttaatatataagctaggtggtatatccaaaaaaaaaaaatatttgaaaacaatatctataatgataaaattcaggcgtacgcgtttgaaggtgacttttaaattaaatttccatgaaaagttgatcagatacgattcaaacatgagaatttataataattttatttcaagaaataatataagaataaatattccttattttatctcctggaattaaacttttatagaagacttttctcctttgattagtgatttttgtgtatagtgcacatattttataataaaaataaagtaaattgaatatttttattgaataaatatttttatagaataatatcctttgattagtctgtgtttgtgttgctaataataaatatttttattgtattaaataagaataaactaaaaaattaagagctttaacattaagaaataaattattgaatagattgaacaacaacatctttattgttaggaaaaattacttcatctttataattttctaatttcttacgtagttatgcagatttgaggaaattaatgtaatgtgaaaagatggagggagaccaagtgaaatttcatcaaaattcaaggagtgtaagagttatttatccttatggttattctatttaaaaatataattttttttaaaatattcatttattaaattgctataattttaaattcgttttatttaaaaatatatttttattagattttacttattttttttcttattaaactttaaattaattaagatttctttaccttcacgaatcaaaatattaaaacaaaaaaaaaaactaatcatatttacacaacccaaaaagcatgctggaaaaacagatcgatgaagtgtctctgccattgctgtatcattgctattactgtatcattgaggccaccgtacgtgccgccacctccagcgatgactcttttacgtcgtgcccacaacgccgccaccgtctccatcacgtg

SEQ ID NO: 21 - DNA, 2400 bp, Glycine max
  Soy_ogl_4785 Gm14:46021801..46024200 Cluster 1
ttgattggtgatattcaaatgtaataatgtcttggaattttacttgtcatcaaaagtactagccttgaaggtttaaagttgttataagaagatcaacctttgtttgtaaaacttcttgtgggccagattctcttttaagcccaaaacaacttcttctgcttaaagacaggactgaactaggcatatctaggctcgaatcgatgcccttgttaaatgggatggtaattgagtaatggctattgctatcttcactaccttttttctaagtacactccccttacctttttaacataaaattacttaaataatctttcctattttaaaccatcttctcttaagggtgttcacatattggattggaagaataaaaaatctgatccagtcactttggtttttataaaaaatttaatataatccgatccaatataaagtggcttggattgtattgattttaatcatgcttttatttttttgagaaaatattaaataaataataagatatatgataaatataataaaaaataatttaaaatatcaaatattttatttatatgtcattatatagtggtaagttatgtaataattttataaatatagaagaaataaaaatataaacatgagtgatgttatcaaattatgaatacaaatatgtatgtgtaaaattctgtttggattcgataatattggttttgaaaattaaatccaaaatctggtgcaatccaataaaaaatttcattttttcaatttttttatccgttcaattttcagttttttgatttttttttttttgatcggttttttaattctcattggattttcataacaacaacacccctctcttttactcccttcacccccatttcgatctcttgttctagtttttctttattcgtctcttgcttgacttgctctagcattagaatttttcttcctccaaattccaacctagtatgtttacacttcaagttacttttcttccttgttttatttttgttacccatacaacaacattaatatctctcattttatatatgtgacaatttattgctagattctaaatttatctgatatgttgcaaaggagtgccataactgattcattaacgtcttttttttttttttttgcaggactgaattttaaaaatttatagatttaaatttttaatttaacccaatatattgtaatcaaacattttcaagatacccttcaatctactttttgatcatttactcatatttcatccttatttcttagagtcatcaaaattgaaggaccaatattaattatatggtttctccacttcaattatttctctattgtacaacttttttggttatataagatttctaatgctcctagcattattgcattttttcagatattttttaacattccaaaaagtgcttttcgcactataatattttgaaaagtattttttgaaacacaattttattttttaacattttgaaaagtctttttttgaacacaaaaaaatatttcataagtaactgttcgagatgttaaaaacaaagcattattccaaaaatacagtctgaaataattgctatatgtacattatgggtataaaggatatatatgataaaaattagaagaataaaatcggagtgtacttaataaacagaggaacgaatatagaaaaactttccataattgtatatcaaaaacatattttacagtcagtatattttatgactaatatctttttatataactaagatgatgtataattaatatgtttatataactaaaatattttttatgagtgaatcccacgtgttttttaataaaaaaaatatacgcagctttgaaaatcttttcatggccatatcactttcaaattgttttttaacaattaatttataattttacctcactttggtcaatgtggccctaggacggcattaaatcagatcatctatcactaccatccaagcataatgctgtattagatttacacttttgattcaaatattacgcactaacaatttgcaaattaattaaaattaatagtcattgacgcaattacgaataaagtattttatgtctttgggtgttataccacattgttactaattgattcttttatggcgtggtggcttctccattgcgttttagatttacatgtcagaagccatccataacttggcatcttcttttgactcaaacatttattttaatcaaagtgaaaataactagccattagccacacgacatatatgtgtccttgtaaaaataaaatactcgtgctaattaattaactgcatatgccgaaagtatcatttagccattagccacacgaaacgttgggatataaagatcaaggaacttataataaaaatatttttattagaaagtataacattaaactgttaataatct

SEQ ID NO: 22 - DNA, 1500 bp, Glycine max
  Soy_ogl_6518 Gm19:42564101..42565600 Cluster 1
tgagtggagttttttctttttaagccaactggttggttcgcaaacacacaacacacctgtataatctcccctctcccacccacatgtttttccataatagtgtatctttcccatccccaacctctgctgaaatgcacaatccttcctcaactgattcaaatctaaaaaattattaaaaaaacaataatagtaatttattttactattcaaattaaacaagtttaaggtataacggtacgcatatccagacaatctgtgtatcctcactcatctgcttcctctttttttgtgttttatttttttaattaatcatttagtgaaatatatcttaattaaatgtaaaattaataatagattattttgttttttaaaaatatttttaataaaaaaactcaacactgtttctaaatttaattcataaaatgttatactctctcagacaaattatttcaaatatatatttttaaatggattgaaatttgttgatataatatgaagtctgagaccaattgcaacaaaaaaactttcgtgtaggcaatgcattgggataacgtgcattgtttgattgtcattattatataccaaaaaaaaaattgctagatttgttttacatcgattatttattctgttttggctatagttttcttgattggcaagttatgtcaatcaatttgataagttgggtttgattactctggtagagattctcatcaaatattgcaatagttcctaacattatataatttgctcattatattattataaatattgtttcaaacctattttctgattaggaaacttttttcaagaattgttatttttgaaaatttgaacttcacacccttctaaatgcgacgcccttattcctataccaaatacttcttacatcaaactccgggatccaacgacccatcaaaacttacgcagtaaagtacattcaaatacattaacttaaaaaccttttgtgcgagagggaataaatatggtgagaaatatattagtaacacgttatctaattttctttttatatctggtgaaatttatgtaaattaaactaaatatgcgagtttatttttttatttaaggaatcacattcttaaattaatgagactgatcacgtaaattttaactaataaaagatattagcaaagatttaagatgtatactcgattgtattaatgcttttaaattatgaaatttcatcatgtactaaaaaaattatgaaatttcactcacctatcaaacttttattgattaaacaaatacataaaaagaatttacagcaaattcataagaatattaaattttaataaacatgtatatgataatgaaacatgcacgtacatttatgagtagatatattttatcgtatttaatatagataaaaactagggtgggagaccaaatcatgtctttgcttctctttttgatttatgacttttattgtccaaggctacaaccacgacgatggtgccatgatgactataagccttatcatcg

SEQ ID NO: 23 - DNA, 1100 bp, Glycine max
  Soy_ogl_6916 Gm20:41834201..41835300 Cluster 1
agcccattaacggtgtcaacctagcaatgtgtttaaaagggaccataaaggttattattttgtaataaaaaagacaaacaacaccagaacatatctaattacatgtataatgactaaaacaagggataaatagcatgcctgtataaggtatttgaattgttaattacacaataattagcatttcacatcaacagaatcattaatcttaattgttaaatttaaatgaaatacttatattaaaatacttatttaagaattcactaaaatctcacgtgatcattaaatttaaattataatattttaaaatatgttatttatcaattcaattaatcttctttaagattattgtccatcatcactattaataccatcctcatgagtgtgaacacattggactaaagcacttatctcagtgtaacaccaattaattacttcattcatttttaattataacgtcccttaaaaaatagttaatcacattaaatatgttaattaattgtagtatcatttcaaaattatatttttcttatctctttattcactttcttattaatgtttggaaaaaaaataattatgtaaaaatatgtaagaaaaaataattaatatatttaaaaattaaaaaataatcttataattaaagacgaagaagtatacaatataacttcacaatttaaaatcaaggcaacataaatagcaaaccaaatttataacccaggagtagagtcagacaaagaaagaaaatgagtgcgatctcatgaaaaatagtttcggtgaaagtaatttttatctcttttttttttttgcagttaagatatttatcaaaccaataattaaatgttagtacaagaaaaagttgattaatctgcaaatttagaaaagagtaacattgtgggataaagataaggttaaataactagaatgttagaaaaacgaccacacaataacattgaagaaaatgacagtaaaaattgtacatttaagactgagtcaaaatcgataaacatggatctgcagaatttattaaatcacaagacaaaagttttgggaggcctattatcacatgcaagtggagggatcagtgaatttgtactagatacggc

SEQ ID NO: 24 - DNA, 1393 bp, Glycine max
  Soy_ogl_1134 Gm04:459501..460893 Cluster 1
attaaatgcttaggttattatatatttttgtttaatattatttttaaagaaattaaaaataaaattattatttttaaggtaaattttatttgcatatattgatatttttttagatgataagtattttttattagagataatcttgttataattaaatagaatcattatagataacaacattctttttaagagtatttaatgtatttatacataaacttgaggtctctaattaagttttaattaacaatctaaaaaacatgcaaaaatgttagagtctaggaattagtatataaaataataaaatgaaacagtacgactaaaaataagtatcaagtaaaaatagcagcagatggtatttgaagtagattagcatggctaaaactccgtgtaattaaaagctcgtttttaagatttcttcttccaaaataagctccttataattttaagaactcttgtatcaatagtgtttggcctaatttctatttataagaaacaaaaagccacacaaaaaaaatctaggccacaaaaatgccaaaaaaaaactaattgtaacctaggagagttgaatctaatgtacggttaattttcgaatattacgataaaaacaaactaaggtttgaatttttgcttaaaaatgtatttatatttactacttcatctggtcttttttattacaaagcatttttaacataattacacaaactaataaaagtaggtaaataagatggttttattggatttaaaaaaaactaatgtactaatttcatcattgttaattatcaactttacaaataacataaagagaaatataaccaacgtttattggaaaaaacaacctcaaagatttgggaccaaaagcaattaacaataatcattgaataagtttcctcagcttaaattgagttaaaagcttgtgctatcaccatctttaaataaagtattttctactctgatacaatgaatagcacatagtagtgttacgtccaatacaccagcaacttccatcatatgaaatgggtttaatatccaattatgaaatccttaaaaaaagaggatgttatggtgatacaaaaacattaaagtttagagcattatctactttatccaaaaaaaaagagcattatacactatcatcaataaaaacaaaaatatttaaagtaattaataggaaaaaaaacttaataaatactttataagaattgttaaatgtttaactttcaaaaaagaaagaactgtaaaatactttataaaagaaccctcaattccttctaataatttgtgccttttagtattaagaattgggagtatttaatagtattttaaatatgatttccttcttaaaaaaaatatctgggaatgataaagctacggtaaattaatgagagattagata

SEQ ID NO: 25 - DNA, 1200 bp, Glycine max
  Soy_ogl_3558 Gm10:45963001..45964200 Cluster 1
ccaccctccaaacccagcttgcccagggttgccttggcaactaccaccacatgcaagaatatttggttccccgtagccttactttgactattcacacacattgtcaataaatatattaatgataggagaaaaaaattaactaattataatttttcagacaaatattgacaagtgtcattaagacattaattaagaaattaaaaagaaattttttttaatgaaacgagtgcaaaattatgttgtcataatttttttatgtttttctataatttttacaataaatatttcattcttttaatttcttaattaatattttaaacacattagactagttagaagaaccaatttttttatatactatagatatctcaagtatcatttgcaatttgaagtagacaatgttgttcaatttgagatggaaataatatacgatatattattttagtatttatataatatgaaaatggaaatgtcatttaagatttgtgtaagtataatatcatgcatagtgaatataaaactcaagcgtgcaatataacacaaaatataaaatattttaataattaaagttattttaaaaatatttattttatatcaacttttaaataatttgaaaataaaattatcaagctcatgcaccatttatattaaaaaagagtatttaatttttaagaaattattatttcatcaatggtcccggatcttttaatttccatactcaacaatcatattgaagattgctttttataaagagtatcatccgtaataataacatcaattactttttcttgatctgagtgtaccgtttttattcctatcaactagatccgtttgaaaatgtttggtttatttgaatcattaaattattcagttagtaatcactttaaaagggtataaattaaattgcagatcataatattaaatgaaattaaaagggaataaagtaagttgcagataaaaaaaggaaaaaaatcaaaacaagtaccaaagtctagaaaggatatacgaattcgaattgattaaaattgaagtaatccaaaaataataaaaaagaataggtggtcttaagatccgttgaaagaagtgactcaggttaaggtatttaatgtatttgttacatggttacaaattcgttatgcttacgtgcacgcaatagttaattataatattgttatttttctctcacgtatatagaaaaaa

SEQ ID NO: 26 - DNA, 1500 bp, Glycine max
  Soy_ogl_3561 Gm10:46077001..46078500 Cluster 1
aggagaaggggagggttgtgacttgtgacggtgaaaaggtggtgcagcagagagtaacgtaaaggtgtgagaaaatgagttggtggagagcaatagctggagatttccgataaaagcaaatgaaggataaaggaggacggggttattacttatttgaataggtggtgtcatggttaaaaggaaaataaactttatgaaaaaaatgaaggtattattaggaaaaaaaatagtgcaaaagtgaggcccagattttggttattggttgggcctgagaatagtcaaaattttcaaaattgttcatccacttggattataaggaactaatatcttggagttctatttatcattactccattatcatgtttcttctatttttttcacctgctgtggagatatttattttgttttttcatgggcattatttgccggccttttattcttcttttggaataacagataattctgtcggaaataaaatttaagtattaaacgtaggccttatcttaaatatgttttattaaaaatcgtgaaggcctttattcttcttttgaaagagcaggtgtcatcagattaagagtattcagattaaaataacctactttaatgtataatgtaaatgtgatttttttttttgctgaaatgttatttaaaaaagttgtaagtgcaacaattcttgtaaagattagatctaattattttaactagaagtatatatgaaaaatcattaataagatttgaaatttgtaacatcattaataagatttgaaatttgtaacatattaataattttggaataaaaagaagactaaaactttaattttagagccataatagtattaacttatctatgctgggaactgggaagttttccaatatgttttactttgactgttgttcactgcgagctgatgctgagaaaaaagcgaaatgcatttccttttgccttaccgtgcctgggacaccaaatttctctcatttaaatctaaaacagataaaagcttacatggatgtagaaaattaaaagataaaaaagattttttttttaaagtttctctttggaaaaatgaaaagaaataagaaagaaaactaacttcgtcaaacaaaattttaaattttactttctatatgtattctccaatttcagtttttttttttcttcttctcatccactacaaagcgagtttcaaatccataaagtgcaagccaactacgcatatattaaattcagctactcaaaaaaactttatttcacttgaactaaaattcttgcccacatgttgtgaattattctttgcaagagattctttagtttacccacttttgaccaatctaattagagacacttttcaaaatttagtgcatatttctcacggaaagaagactcattgaaggagagatatgtcaatttgactcaactaaaaagattatatgcatatataataaattatagacctgttaaaatttatttcattaatttttaataaataattataattctat

SEQ ID NO: 27 - DNA, 1232 bp, Glycine max
  Soy_ogl_6250 Gm18:58397615..58398846 Cluster 1
ttactataaatcgaaacaaaattaacccataaatatctctagtcacttagtcagatgtattcaagagctttatccatttttcttcgtccttagcgaaatgattcgtgagggcaggaattgttgctggaaccagtttactactattattagtggattaccacttgctggttgaaaagtggatactgattcattggatgcatgtttgatatttcttgctgatctctattttgttttttcaatgtttacgtgtgggaaataggtttatttacatatcatcttttgagtaaacaatatttattacaatgaagaaagttttttagccaatggatcctcaattaatttaattaattgacttcatcgactatgtatataatttatttggatttgattacaacaacattgggtggcaatcggtaattagtgtatttgcttccacatttcaaatgtgatttttcatattctagaggtgattttcaaaagttaaaagttataattttcaaattttcatttttaacgaattttcaaacatactaataaattatctttaaaaataaaaagtatcaactttgaaatagaatctactacttcagaatttgaccaaggagtaaagaaaataattgtttctgtgttaaggataaaactctaatatggacaataacttaattattaatgatttataaaaataaacttgttagtgacatttttttaaaatcagcaaatggtatatttatagatattatagtgacaaaatattaattaacacatatgatatcgtaaaaaaaattctttaacctagcttgatttagattttttatataaaaaaaaaatccttcttttttttcatattttaatcaattatattactatttttataagtaaaattggtaagaagaaggatatgcacctcattagatggttcaaccattaccaagagttcatgggttggttctactgtgacgattttattttcttttattttcatggattttcattgggtgtttttatttttattttgagatgataaatgggtggtttagatgaggcagaggttttggtggtttgcataaatggaaaggatgaaatcagcaaatatgaaaccaagtgaatgcacatgacatatataattgagcaatgatatataaaaattaattaatttgttttaaagatttcaccaatacctctaatttatgtgtatttttgtctttcattagatcataaattttataataccg

SEQ ID NO: 28 - DNA, 1669 bp, Glycine max
  Soy_ogl_2715 Gm08:15820532..15822200 Cluster 1
gacacttattttagaacagagggaatatttttaaagtagagaaactattttaaaatattatttccattcttatatatgagaaatttttgagaattttgtttgttgtttttataaaattcgttttaagttgtctcatactttaattattattatttttaactaaaatatccttaattatttaacaatttgtagccaataaataataaattcagtaaattactaagataatttgtttttctctcttgtggaaaaataattaagcaagtcaggtgtcacaatcttaccgtttattataaaaaaaaaccttagttttaaaataaaaatatactatgttgatgaaatttattttagaatctcatgcagtgataaactgataatatgataatgtcattacgaagtatccttttccgattaaagagatgattggccgtaaattaataaaataaactgcataactattattattaggtggaaagagtgagatgataagtctcataattttaactacaaatttgaaaggaaatataaattgttaatatatttaatatcatttaattaaattaatcattttttaaatttatgcgaattagttaaaaaatctgatatataagaacaaagttaataaaaatctcatctttttagatcttttcttgttctttgtaagaataaataattcatagctggcacggatctacataggaaaggaagggggcaatcgtccccgataatctttatttttttatatataacatttatgtgtagttattaattatctctataacttttaaatttagtttaaaaaaataagttataatataaattttgcccccactaatttatatatgtgaaaattacctccacagctaaaattttcttgatcggtcacttattacatggatggtgaagtgaaattacatactcttttcaatcacaaactattataataattcaagggtaaactcttcttttagggttgatttggtaaggtgaaagaaaaaaagaaaaaaaagataaatatttaaattaaaataaagaagagatagaaggtgtaagatccatataaatttttttaaatttttctttatttcctctcttttattctctaacccttctctaaccaaagaaagggttaaagaggtaaaaaagaaaagacagtaaaagggtatgcaagggaggaattttttattgtattattcttgaatttgattaaagaataaattatttacttcatctagactagtttcgggttcgagtctcgggcaacctactagaattaatatatcgaaattctatatatagaattatagcaatccatagaaaatcaactcatttttaatgaatgaaatgaggtaaaaaagtaaattcgaataaatctaaataagagcatacttactatggatattggtattggttgacactggtattctataaaccaaatactaccgcagtagagcaaaatgcggtgagctaatcttttcgtgtttcttttctcaccccaatttaatgtttcaatttctaggtttcgctaatactgtgtcttttttgaggcacttggcaatttccttaacccgggatatgcaattagccaatgaatcaccctcaaagtgaaactccgttgtagttaatttgttagttgtattgtatttttcagttttctattagtccaaaa

SEQ ID NO: 29 - DNA, 1600 bp, Glycine max
  Soy_ogl_6471 Gm19:40294901..40296500 Cluster 1
attagatataaattctacctttaaattcaagtagttgtaaagtagaagattgatatgaaaggatcatgtcagatcaaaagaataaatcctttacttttcagtaaaaaatggattttaataaatttttatgagtttaatgtttatatattaataatgtaaaataattttatatcatcattcaattttaatttagataattgtataaaattttatacttttaatatataactttttttctcattttatatttgtcctattaataaagaatggattcaagttagtatttgcaaaaatcaacatttaagttcataaaaaataaagtgttaaaaatatatgatagtatttatattttttttttttgttgaatatcgatcatccttattactttaagtctttttgtactcaggatgagaaattatgtatctttatgatttttattggatcaatcaacctaagttgacttaaatatcgaatgactcaatcaaaatacaatattattatataattcatactaaacctaaaaagaaggataactctaactttccacttaaatacttttgaattagatctcttttctcacatggacaaccattgacatgaataacttatgtgttagtactgcatttgtctaaaatatttttttacttactcaaaaatatattcttagaacctatttgattggctcggaaatttaagtttgcgtgcaaaaaaatcgattgcccaaattgtaatgagtatttgaattttttgaattcaatatgcaatcagtatgattgatcttgaaagatgtaaaaattactgaacttgaaagatgtaaacaaattatctctttttttagaggaaatttttttaagctcttgcattgagtgcattaaaatgcaaagacttatcagacttattaaagcatgatcatatttacattttaaaagttatcttaaaatgttctttagataaataaaaaattaaattaacttttaaaacataattaaacttttaaaaatcaatccttttaaaattattttcaaaaattaaatttattaaaatttaaaaggaacctaactttaatttcggacaaactgctttttactttttttatttttcctgctccagatctagtttgcacaggatttccacatgatgctgatcaagggctttcgggtctcgaggtagaaatcgggctttagtccaccaattatgagaaccgtgatttatattgggcttgaattggcctagttgtccagtagttgggtgtttgctcactccaatgggcaaatttaccattgaaaatgccctactgacattgcacatcctttgggctttaacaggccgataattaaaggatgattaagcgtttgtcttttggggtgctcataacataaattatttttttaatgttttgaagtatttatataattttttttactgtagagaaagtctttaattaatataatttttttaatgtacttgacctatattttttaagtatacaaccatgaattttgtgaaataattcaaaaataaatattatctttattttatttaattagaagacaaatttcaatatttcatgatattttagaaaaatgaaccttacaattat

SEQ ID NO: 30 - DNA, 1297 bp, Glycine max
  Soy_ogl_3985 Gm12:2958077..2959373 Cluster 1
gatttttttatttatttataggaatctagatatcaatgagttataataacttatattcaaccaattgagctaaccttgtttcataagtatttttattgataatgataacacattctaatcttatactttttcttggtttcccatagtttgaagtaagatttaaatttatttttagtcctttaaatttagataattatttttttaatctttaaaaaatctatttttattagtctctccaattttcattaaattacttttagtccctccatgtaattgtattcatgattctacaactaatagagaaaatgttaaaaaaaaggtgttcctaagcattctttcaaacgtttaatatgttcttggttattttaaaactacattaacttcgattctaactgcatctttttatgaaagatttaaaaagaaaggattataataaatataaattttatctcttgatttttatccttacttattattataacaagtataaaatttacataacaagtaacacctccgcttctatttataataacaaattacataataatcaactaaaataaaggaaaataattaatttagtttatgtcaataagaacatcataaatttatatatttgttcaaaaatatcattatcatcgtacttctctttctcttctaaatgttccaaaacactcgacaaaacttctctcttatttaatcagagtatttaaatctaaatataattaatataagcaacatttttttacgaaaaatatcagcaacattataaattaggttttatagaaagaaaaaaaaagtatcacttttaattcaggccttataagtaaaaatgatagtatagtgttaaaaatgcaaataactaagtataaaatttaaacacgatgttattgaaaaattatttgtttacctcacgaattatgtgagatgagataaacacatttggggaatacaacccatttattactactgatgaaaataaataaatacaacccagtttaccaaaattatatgatcaaaatcaatgagttgggcccgctatgtcatctttatttttaattaatttaagtaaggaaaataagataataagagagattttggggcggtagaaatgaatccacaccatccttttaaaaaaagaataaaaaagaaatcaatccaccaaacacgcttaagggtcgttttactttcgaaacacatgttcttacaccatttaattgtagcagtggcacgacgaattataataaagataccatcaatacattgtagttactctctcttgttataattataggataag

SEQ ID NO: 31 - DNA, 1500 bp, Glycine max
  Soy_ogl_4335 Gm13:28946101..28947600 Cluster 1
acaacatcgataaaaataatgaggacaatatcgaatgaatacttcctcttttgagataaaggttcacttcgttcatcacacagcataaggattagaaatgctcaaatgtgaccataataaggggataaaaacaatagtttggcagagtctaagacaaaatggatataggttgatccacctattccccgctttacctcttttagctaagggttagtacaaaaaaagaagtaaaaatgtgtgtagatagatgaacattcctcaaaaggatatagcaaaaatagaaggaaaaataaagtgatgatcgattttagtctttttttaagagatgttcatttatattgaatatgtcgatcacaaaccacagtgtcctctttccacgtaagaaaacaactggaaacaaatgcgccctctcatttcctacgtgtgtgtaaggaatcgatcaaatgagaacttttattgcggtaagaaatcaaaactaaaaattgatgatattaaatcatatttgaatagataagattacagatgcatattacttatttaagtgtatagtgtgtttggtaacacttttgagaatcttataaactcaatcaaatgagaacttttattactgtaagaaatcaaaactaaaaattgatgatattaaatcatatttgaatagataagattacagatgcatattacttatttaagtgtatagtgtgtttggtaacacttttgagaatcttataaactcaatcaaatgagaacttttattactgtaagaactcaaaactaaaaattgatgatattaaatcatatttgaatagataagattacagatgcatatgacttatttaagtgtatagtgttttttgagaatcttataaactcttttaactaactaatgtttagtaaaactagtttataagctacctagaagcttataagctagttgaaagcttatattaaatcagttaattagtttataagttttttttactaatttttaatttttcaacttttagcttatgacaatatatgtttggtaaggtctttgaagaactaataagcttctttaattagcttataagtttctttgagcaaaataagtttgtttggtatctaacttattttaatagtttattttctataagctactacttcaagtaatttattttgataagttatttgaagtaatttatagaaaataagataacatataaattattattttttttcttcttctccattttacttttactattttatttgacatttcattttacccttatattcaattaaaaaatcttcttatcttttttgtttgttgtatgaaaaaactttggtatctaattttatgtttttacacatatgatatcaactcatcaattgttactaatacaccatttcttaagattaaaaattctttaaatcatatcaatttataattattttctgaatcattttatgtttttttgtctaaaattatgtgacctatttcatttccttgtatatctttta

SEQ ID NO: 32 - DNA, 2200 bp, Glycine max
  Soy_ogl_338 Gm02:3057801..3060000 Cluster 1
ttaaaattctaaaattttaaattcttcacaaaaaaacatccaaacaataaattttagattacagaaattcaaattatctaataaattactttcctcaattaaaatcctgtatccaaacatactctaagagtaaatatttatatgtacggttctttatcacttagcccatgaattaattcgtcatggattgttttagtttctttaataatgatattgatataaaatcagatttatttataattaaactttatcaagaaagttgattaactgtggtgaaattatcttaattatattttcttatcaagaactgaaatcaatatcattcaagtctcgaattaacattttatttaaatgttattttagtttgatgaatgatatagtgttgctttaaattttttgaaaaaaaatattttttgcatatagaaatattatttgacttcaataaaattattccatttttatattgaaaatatatgaaattatcatattttattctttctagtttatatttgaggggtttacaacaagttcttattaataattttgtacatgttttgtatatattagtaattttggtcagcacgtgaatgataaaagggtggacatcacatcacattcccgcctaacttgttaaatataatgttttatttattttttaaacataataaagataattatctggttttatttggaccctaaaaaattcaacacagaatcttgccaaaatatcttacaatgactaatttagtaacttacgattaaaataaatgaagaatggtaaaaaaaaatgatggattaacatgcagccattgatatgaagggcgaagtaggtatgcaccaaaaaaacaaaacaaaacttaaacataatactgtagttaagttctataaatctaattcggtgggtgggtagcattttaaacataataataatagttaaatttcaaaaggtaattcggttggtggcaaacagaaatgaaccacaattcgatcagctgcctatttatccaacaataattagctatataatagaagttgaccttgacattaaaatcaattttatctttacaatgatggcattagaatttgaatttatagttttatgcaaattatttaagttgctttattatattaatttaatttgagttgcttactttagttgtaatttaagaaatttgatcttaagagtatgtcaaaaattaatttatttgtcattttcaatctaaaattgccctaataattactttgacccccacctaaaaaatcaattacctacgtatagattaattcatctataatctataatttaaaaacacaaaacagggccattcaatatgacatcacataattttttgtaacttgtcaatgtaaaatttcaaagtggggataaaaaaaaaataacaagatgcccaactcttactattttccacataccaagaaagtacacaaatcacaaaccacacgcgtcaagatcgctagaatcacacgcgccatctcgggaacggtacggagagaatcgcacgtgcgagaggacaaatctaagtggggccggcacgtgccgttgtggatggatcccgttagtgtgaaacgcgtggtgagcacgcctttattggtagatgaaaggggatgtggggcccggcttatccggtcgccgcgttacgcggaaatggttttaaaataaataaaaaaaagaaaaaaaaaagtcagttcagtttctgagagaggcttatcctatccgcaaaatgaaaatgataaaaaagtgacttgtgcaacgtattcgatagtggttataattgagttcagatcctatacattacacatcttcgtttcttttcacctcctcatgacatgtggcatttaaaaacttcaagggctgagattcaattcctattaaaaattttaaagtatatattttttttttctcttcacccgttacacttcccctccttctcttgtcatgtggttcagttgaggtggttgtattttttactcttttagatcatgtctcgccagtgtattgaagtctaaaataaattttgagaattttgaaatttaaaacaattttttttttgttttaagtaagaaagctatacgttgaatttttttttgttaatatatgcaattttttaattattataaaaaaaatattcttatatactccttgggtgtttacacctttgagagataagaaataaatgattaa

SEQ ID NO: 33 - DNA, 2301 bp, Glycine max
  Soy_ogl_3557 Gm10:45959900..45962200 Cluster 1
tttagaaaaccacaaatagtctacttattgatttaataaatgcttgttaaattatataattcttacccattcatttttttttataaattttaagatggaatacaagtgacccatgaggccatgacctatttatcgacgctatccattatttattctcatctggcatcattgcccatggaaggtggctatgagcctacgttgacgatggctccacctccattcgaccagtagcttgtaggtgacattttctcataccaataagaacgtgccattcaattacaatcttttagaaatggtcgagttacagtagagattttgtgtgcactatcactatatgataacataacatatattattatcttagctatttgaaaattcttttccttcacagtaacttaaacgcgaagtttttatgaattttttgagagtactaaactcagtatgataaaaatataattcgtaaataatataatcatgcagccaaataaattaaatgactgatattaatcaataaatttaaaattaaaattaaccattgataattacttcaaattttcagttcgtttgttgacaatcaattcgattcaaatcgaactgttttgtctatttaaaattgaatggctacatgattatgtattcaagaatttgtacgaattatgaatttattatttttggtatatttataattctttgagaaattgtaatattaattttaacttataatttgaatttgtattttgaactatgtttgatgtgagattaatttgtgtattttgcaatttattttaatattttaagctcttggaaaactgaaaatcaattcgatttaaatagaaataaactggattcaatagaataatgatggtaagaaccaaataattagtttaaccttttaaataacaataaaaaataatagtatttaccatttagtatgatacttttatgcagtaaaaaaagtatgatatttttattatatatattggttatggaaaatgttaataataattttaaatataatatttaaatgcagttttatttattaaatgcaagttaggtgatgcaaatcccactctctatttaacaaatcacacataattttattttataataaaaatatatttaaaaatgtattagagcatgttactagttggctagttgccccttttcctattagaaaattttagctcaaaatagattatcatttagggatggattcgcgggcaatttcatgattccaacacaagggacatgcacgtacacttgattgcgactattcttaccatcaattttacattttgtgttgttttgatcgaccaaacgttgtcccactgtcatgtcttctatctcttttttagtatgaggccataacaccactctctgcactagttttcgtgggttagcacccgtgtaatccactttatatttatttcaacgattttataaaggaaggaaaaaaacttaattttaactcttaccccaattcgaaagtgaaattaattgacataatacttcataacacttcttttgaggtgaaaaaacgggcaaaaagctgtatacataagttacacaacgtgcgaatagacgctgttttcaattaggcttgaggcccaattcatatctcaacttaaaactttttttcttcttcttaattatcaatttattcttcacactattttaaatggttcaattagatcttaaaattttaaaaataaatcaattttttcctctaattttttaatttttttaatttgattctcaagttcttaaaaataaattaatttagttttcaaattttttaaatataaatcaatttgattatcaatttttttaatacttgaaaatcaaattaaatcataaaattgatttatttttaaaaacttttggtatcaactgcttcaacaatcatctgctgaaagggtcaaagccaagatgaaacttcagctttctgaaactgataaggcaaacttcataaatacattttcaccatatattatgaaataaattacttttcttgttgtttataacattgatctcagtagcaccgatattaaatgttctaacaaattcttctgtagtaaactagtttaagaataattttcaaaaaattatcatgttaatctatacatggaaaacttagtttttggcatgaatggttggctagccttctctgatgttcttgtagtgtataatcatttgataatagaaactggtcaacgtacgttgctactatctactaatgatatatatgaataagggtatgtattacgaaccaaaattttaacatttaatacttgaagtgtt

SEQ ID NO: 34 - DNA, 2300 bp, Glycine max
  Soy_ogl_3744 Gm11:5187301..5189600 Cluster 1
atagttatacttttttaaatacacttattgttattttgtaaattttaattaaacattaaatatctataaattcatttttttatcactacctagggcaccagcgttgatgtggcattgctttgattagatttttatagttatacttttttaaatacacttattgttattttgtaaagtttaattaaacatttaatatctataaattcattttttttttatcaatttgatgtatttatttgtaattcaaaattcaaaattaaatgatgaagggcgtgttattaattttttttttgtaatttatccttgcattttaattaaaaaaataaaaggctaaatcatttgaattgatattatgattactatttttactaacattttattggtaaaataaaaaaaatgacttatcaatttatataattaggagaatttattgtaataaaaggcttaaacatttttttctattttttttataaaattagtgtgaaatctatgaaatgggtaatatgcatcccagttatgttgacaccaatgcaaaactcccaaaagatcacaccaaataacattaaagaagggggaaaaaaggaggaataagtagatggaggactaggttaaaacccaatcaacaaactaacaaaatttgcaattgggaagtgttgccctattatgaaggaccttgccgctaaaaaaacttggggtatgatcccaccaagagtggctaatcctagaatcaacaccatgattagctagaaggttagcgcaaatgttctcctctttaaagatatgagagtaaaccaaaattatatctttacaaaaaaatagacactttttctaatcaatgacaaagttgcaaatggactaatgtggacttcttgaaagcttgaatcactaaattggagtcacatttaatctataattttccctcttgttagcaagagcagccttaaagccaaaataactacaaaaagtctatgtaagaaaaacactctaaatgccaatataggaagagaacaaacatgaatccaagggggcaagtaggaacctcgaccctccttagaatcttttgtgtataagtgagaaaaaaaaattaaaattaaaaaaatcaataaaaattatatataaaataagtttttaacttgatatttacttaaagaaattataatagtagaatatatctctaattttacccataaaattaataataaatattttccaattttattatttattaaaaattaaatatttaaaaaattatttaaaagagatactcatgtattcgtccctactctctagaagagaagcaaccaatcaaaacccgactgtcatctcttcaaattccattacttagggcgtgaccacctaccggcacaacccttttctattttatttatattacttagttatttttttaggtaaatttattttttctagagtaacatgttaaattaagatttaattatattttaagttcctcaatccatttttaatcattcaaataaaaatttgaatgttttatttttgcttaagatttgaaaaaatccttttaaatatttcttctcaaataaaaatttacattttaattcatcaaattttgacggaggaactaaaaaaaaaaagagattgaaaaaaattaagagaataaaaaatataattttttatttggagtatcaaaaagaataaattctccaacttatgaaactaaaaacagaattaagccttaaatttgcgctctagttttctcccgctataattttttttttctcttataagattgtaactcttgaaagttgccgctcccgcccttgaatttactttgttctgggacaaactttctggtttccgttgcaccgttctccagagttcagaatcagatctatgatgctcttaattcaccacttcactgccttcaaatgccctaaaaccaaaagagcattagcctttggtttcagatgcgccatatggctttgtcgcacgcttagtcagagtcaagaatcattgaggtaaggtaaccattttcttaatgcgcataataatctatgaaaaaattgttccgtgctgcgtaagctttgatcattctcatcaattcttgttcggttcgttattgttttcatttctttgtttccatctgtgcttcataattaatcactcactgcgctttcactagtgttttccccactttgccgatgtacacttttacttttccgttctaacagactcgattctgtttttccacaacactccaaaattgatcatccaaacattaggtgtccctggctatattagtcctctgaatatttttttat

SEQ ID NO: 35 - DNA, 3010 bp, Glycine max
  Soy_ogl_4402 Gm13:32027301..32030310 Cluster 1
cttgatttcagtttgtttttaaaagcattaatcattcacgtacttgcaagttgcaaggtgtgaactgtgaagtaaagccccaccaatttttagctggctgctttgatgttccaactaatttaattttctatatgtccatttattttaatgaagaaaaaatcgattaaaaaattgtttcatttattacgacaaattattaattttagcaaatatttataatttataatgtttttcttaacattaatttccgtacgtatatatacataagacgcgtaattatatcatgaacaaaaaataagtcaaactcatttgtttcatctttattatctttagaaaaagggagagaaaaaaaaaagcaatcatatataaactgattaattttagtaataataatattttttattctctgattaattcttccctccatttttcccacttaattttattacacagaacatgtaattaatattttttcatggaaattattaattacaatttccaaattttccaattatatatagtttattcttggtattattgataatgaaaatctttcaaattgttcaaaacacacatcattaattgttgtgagtcaaattaaaaaaaaaagtaattgttcactagtaatatattttctttttggaaaacgctcactagtaatataaaacagcaattaaaatgaaaaaaaagttcctaagacgtgaaataaaaagaaaattgaggaggaagtaatatgatgaatttccacaaaagaaatgatgtgtaatttttgtatttctctttctctttctataattttcataaaacactatttatataatgcctgtcaagataaaaaaaaataataatgtgcaattcgaaaatgagaagattcattcccttgcataactctttcttcctacttctttcatatgtttctatgcaattcttattataaggaatagaaatacagttgcccatgatttttatatatatataaaatattcttttttgttattttataataaaatcaactgtcacgcaattttttagtggaaggtaataagtatataaaatttaacactgggaattttagaatttaaaatcctattattacgaacataatttatttgaaattaaaatctatttcaattataattaaccaattatgttgaaaaaaagaaaggagtgaacggcaaattttgtgcagtgccatcaaagttaaaatgtggacaaaagttcgttatttctttgagtgaacggcaaccacttagtgagtggcatagtcttatgttcaaactcatccaaagcatctcaagtgcttttctgaggtcaacctctccatcaccagaatgagaacgccacgccacaggtcatgcaatctaaagtttgaaatcaagatgttggactataagcataaggtgatgtcccatatggtataaaaacaaaaaggttaaacaataagtgaaacaaaaattgataaacatgaatattaagattatgaattaaagtgtggtataaaattttagattaaagtttgatatgaagtttacattaaaagattcttagagtataaataagagataaagttttagttattatatatcaatcttcatctttatataacatatagttggtttttttaatttgagaaaaaattaataatagtctttcggataataatatatcttaggttgaagttagtagggagccataacatttccttggcatataaagctataaactattcaaattccgaggaaatatctaagatcagggttgatatgcttatccgtggaagattggaagtattacatctctaatacattagtattagttaaacaaactaaattatcagcgagtttataagaaaagaaaagttagaaaacctatcaattttgtcacctaaatcagacagtcaaaatatgatttatttctacttcaattgacaggatttttttttaaaaaaataattactacacagtaccttttctagatcaataattatttcggaatgctcctctggagaggtctaatcctgggggcgcaattccacaaaacaagttactacttcagcctacatgtgtctgacatggtgactgatggacatcatcaaaatgcacttagctgggtggtatagttataggacatcaatgtttagtgggtcttgggagggtgtccttaaacatatagctgctacttaatttgacattatttgtattgagaattgtccttaagctaattatcttttattttatgaaatcctttgcttaaagtctctaaacatatagctgctattaatctttgcgagggtgtccttaaacatatagctgctattactatatgcgggcggtattttagaggtggtataaaagtctctaacacaagaaaatatagcatatgttgggctatagagcctacaacatcatgcagaaaaacaaattatgtagtttaaaggctgaacaattttctgttttcttcacacctctttctgcaatagtgcatacacatgtagtatttatgtactgataagtgattcctacattactaaaacagttacaatataaaagagtcacacacacttaatggctaaatattctactaaacattaataccaataagtgacagcacattattaaatatatctccactaagcattgatgacagtgcattatttaacacttccatgttcgttgtgacaatctgtctaactaaactcttgtctttgtacacctaggtaatagataagaatagttaaacatatttgtaacacagacagttgagacctaactagtagaaaaaaatgaaacaggtggctaggcctaagcctttattgtcttcatgtaagagtcaattatgtacagagatgcgaggaaagcaaatatattatgctcgggaagaatacattattagagtgaaagccaagctataattttgtcagcaatgatgcggctctagcgggtacatattctcctccatatgttatatagtgcgtttttgtttcatttttctcgataacagttaaaacaat

SEQ ID NO: 36 - DNA, 1800 bp, Glycine max
  Soy_ogl_4526 Gm13:37650701..37652500 Cluster 1
aaggcaaaaatttaagatataaatgaattattcattctgtcaaaaaatgaattattaaatgtacttttggttttccaagtattttgaatatacaagtttgatcctccaagtttcaattgcaacaatttaattcctaaactttcatttcttttataaccgagttccttcgtcaatattgtattaaatagtttagatatttaggtggagataattggcgactgatgtgacattaacatgctgtgacattaacatgccgtctaaatgagtttagaaattaaagtggaatttgaacccacaacagcatagttaaacactaataccagaacaactagtataattaattaatttggtattatctttcttcttatatgtaagactcttaattttgaaaattttgtttgttgttttcataagactttctttacattgtctctcacactaattgtttttttttaccaaaaacctttaattaacatttaatttgtatagtaaagaatggtatattctataattaaattaagtaaattcaatttcttttttgtaaggattcaatttttttgtaaggattagagaagatgaggaatacacattaattattatttaattagataaaaactaattaagtggaaaaaaagatgagtttcaataattttaagggtgatttttgaaaaaataatataatttattaataaatttaatattaaaaattatattagtcaattttcttaattcttgtgaattgtttaaataaattctatatagagagtcaaaggtagtatatgtataaaaatatatattatacacaggctagaatacaacctaaggagtgagaaattgttagtcgtagacatttcatatctccttcagaattggttatcatgaaaacttaacgtagaatttgactccgctgtggatactcacattttggatctccttcctatttgtagcttattttcttagaagggtacttggctctaagaaccatttatcattgagattaatatagagccacctacgttgccgagcagggtactctataacttcactcattactattccacttgtaatttagatattggcatggagtggttgtagtaataggtggttgtatttaattcaatacatgtttactaatttctcatgtttattgtagaaataataacatgattcgagactattatgatcaaaactaacctcaaacctagctagtgactgatataaatggcaccaacattcaagactccatccaaaaaatcacttttattacagcagcaccaaccaatccaatatacacctttccattaaactaccatacccttcagaattgcacgaatcacgtttgctctttccaagtagagtaaatagagggctattattaatatacacaatagatggtactccttttgggtattatattttcgggttggctgtctgattgtcagccatggtatcttttattggttgctggatgtctgattgggttaaatattagtgcagctacgtacatcgatcaaaccaattacacaattcgtttccaacagatgaagcacaagtaaccttttcatggcgtgtttgattaatcatatcattcaaaaagtattttcgagtgttgaatgtatttttaaagaataaaaatagttcaataatttgtttaattaccttcacaagtgtgtttacgtattcaaattttgtttgaaaactcaattttaaagaaacaagtctcgtgttatactttagtaaattttaatctaaaaatacactcatatatttcaagttcgtagtattgttgctgaagccaca

SEQ ID NO: 37 - DNA, 2100 bp, Glycine max
  Soy_ogl_6200 Gm18:561901..56451700 Cluster 1
atattttaaaatagtacaaaatcacaaacaaaaataagttaaatatttagtttaagagaactgatgcagtttagtaaaaaaaaaaaaactatttctaaaaatctcgttcaaaaatgagaatttcatttataatataaaggtgaattattagctataattaatgttatacactttttttaaaaaattaactaaatattaaaataattcactggctaattaaaatctgccatcatgataactttacaaatggaccattctatagttactcttgtctaaagtacccacatagcatgatgaggtgctccagatatttgcatttagctttgataagagtgttcacctaagatttaaaccctccaggatattctccctctggaagtagccactgccctactatgataagagtgtccaaccacgacaatataatatattaaggtaaatctccttaagatattaattacaaattaaaaagagaatttttttttagaatatgtaaatttatgttatttataattttttttatatttttctatgatctctacgataaatacttttttttaattctttaaccaaaggtattagtcaacaaaactcatattaatatcaaccaagtctgaagtggaaatttatcatatcattataatttataaggagcaagcttaattaggtgtgctcatatgcttcacatgcaagtcaaaccaaacaacaacctaatttttctaagaatttatttagaacaaaaacaacaacctaattctgttctaccaatttttgtaagaataaaaagaagaaaagaaattataattcccatgaaaagcaaagttaacgggtagggatggatttagaggagggcggacagggtccgaaccttcctcctttaaaacttttcatgtatataatatatatttttaagttaattaatataaaattaattttgtgtgttgttattataatattggttaagattaatcagtataaaattgtataaaattagttgtgctggttattttactataatgatgaaagtgataattagtataaaattggataaaattagttgtgtatttattgttattatgataacaattaaggttattatatttaatataaaaattaatttcaattttatgtgtaaaaatactatttttttaaattataaatttaaacaattataaagaaaaaaaattacagctccccctttataagatttttggatccgtcctggtgaacagggtaatctatataattttctctttaaaaaaaaaaatcaaatcacttgatggtgaattttccagtttctaactcaatttcttttctcaacattttcggtcatttttttctcaaacattttctaccaaaaatgaataattaattattcattagcacgattgatttgtataggcgctgtagggtatttcctttattgtcatactataggcttaaacggcccacttggcaaagaaaaaggcttgggtgggctactctactggatttgaacattaggcttgtgaaataacattttgtattagcatgttttcttttttcagtattattctttttacatcacatttaaaattttgatttcaaaaaattatttggcacattctaaaattttaattgcactagaatgtttaataaatcctgaacattttgaatatgtttcattttttggacaagagaccctgcatcttgcatgcatggtgaaaggtgatggagtgagttttttgtatcaggggatgaaaagttgttgtgccaaggatctacgggtgctattagctgttatattttcattgctagacgatgtagcagggggagaaagtggaggatatataatgtaaggaagagaatttgcttggttgggtattattgttctcgggtagtaggaagtttcatgtattgtagttatttaatattctatcttcattggtataaatatatatcataaccactgcagtgaatattctcttcattttatggagttagttgactagcctattgactttagttattccttgtaagtgtatctctagagatgttggaagggctacggaaatggatacttagcttcatcaaggtgaaataattgttgggaaatttaag

SEQ ID NO: 38 - DNA, 2264 bp, Glycine max
  Soy_ogl_6583 Gm19:44975737..44978000 Cluster 1
atagtcaaattttaaagtacatataattgtaaaatacatgtgctttgcatacacgttaataaattatgaccatttcataaatgagttgatagtcactcattgtgtattataaataggagatcattaagtccaaaaaaaattatagaaattttctttattcacatattttttttcctctatttttcttagtcataatatatttatgatatatgttttctctctagttctaactccaaatgtacgtattagttcgtttcttatgattttgtaaattatgaccatttcataaatgagttgatagtcactcattgtgtattataaataggagatcattaagtccaaaaaaattatagaaattttctttatccacatattttttttctctatttttcttagtcataatatatttatgatatatgttttctctctagttctaactccaaatgtacgtattagttcgtttcttatgattttgttatgttatctggaacatcgccaacaacctaccgtggaagtaaaagctgaaggtgaccatgtgccaaacaaccaaacacgttcactatccatggactatggccacaaaagcacactggtcctaggccagcaacttccaaaaagacacattcgataaaagaattgtgaatttatcttataaactagcatttagtattttaaccggtgtttaacaaacacaatcaatatcttatataatatatttatttggataaaaactaattaatctttttattttcagatcactcctgtcttaaagtcggcacttgagacaaattggccaaatttaaactcacataacgatgagattttggaggacaaagtgggacaaacatgggatgtatgcaatgaacaagttcacccaatataattattttcgctggaaaacaaattgtcccgcatcattgaaccgcacatacgataaaaagctcgattatccaagcaatatatggagttattggcacatcccctcaacttacttgttataaatatagttcaaatagaaatttgtattaaaatctttctgaaataagactctgtttagatgacgagggaaagaatatgatttgtcctagtcttaccacaaactgtaatgccaacatcatatgttggccaatataatgtatgagtttatatataattataattaataaatatttttgttttgggcatatgagaaagagggatccatcaatggtattacacctgaggaaaaggagaacacccaaactctctaatatggaactttctactgataatggatagtgcacacaatcaacttcagtgattttttttgttgctccccatgtaacaccatgattttcatgactttatgatttagttatttaccataactaaaagagaaaaacattttatttttattttttgaaaaatattaaaatgcacgttgtgtagcacttgttttccaagtatctggttaataaattaattcaaagtaatcacaagagaaactaaattttatttcatgaaaaaaataagtgataaatattcataatttctttttgtaagtttcactagaaagttttactgaattcgggattacattgtacacggacaatgtaacattaatacactgaaaaaagagcaaacaatcaagaaaattaaagaatttaattttaatgcttttgcacagttaagtattctgcaacttattttgacatgccttttaatgaaatatacagccttttcgttgactcgtttctttttatagttttcgttgcaagatggatcaaaatatcaaagccttaactatccataaatgcacatcagagtctaacatatatcatctgttgacacaaacaaaatcagttagatgcttttgtctaaaagcaataagctgttattaaacttaatattttgtttgcataaataaaatgtattatgatttgtcttaataataataataattgtggggctaccaatcaaccttaaaagtccaaagcttatttggatttgtgatattgaggtattatactttaataacttttgtttagacttacgagaaaaagttatatattagtttattaacttttgttttcacttatgagattgaagtattttaaatttaaactatgtttctagttaaattgaataattatgtagaataattgtgtaaaatatttgaataattttaattttgaagtttaaactattttgttaaaaatggttcgaataaataaaaaattacattaaaaatgttttattttgattagttaaattgtattttaaat

SEQ ID NO: 39 - DNA, 2200 bp, Glycine max
  Soy_ogl_5173 Gm15:49307801..49310000 Cluster 1
aaataaaaaaaaaagagaccgaataaaaaaaaatcttatttgacttgtgtacattcgttgaacatgatttaagagcctcacctcttaagtttcacgttatctttgcatgtacttacttgtgttatagtaaatacaacgtagtaccttaattttttcacgtgatcttgttactttttcgtgattattgccgcatgtagatctaaagaaagtgatagaccaagacaagttgggttatcaaagacaaggtatatagagaaaattggaaaatatgaagataaggatagagccgtacgtaatatatattagaaaaaaaaatcctagtttacttcaagctccaattcgatcttcgcatcaaataaaatcttgtcaaattttgtgaatacgtaaagaaaagagaaagagggagagataaacacaagattttacgcatactaattaaatatatcatgttgaatttttatataagagaatttgttaacattttgagaagagttatttaaatttttacgtagaaacagtaacagaataaagaagaatgaaaggagacggacagaaattaaagagaagtctgactgtattattccaaaatccaattctgaagtctgaaccccattttacaatctgaatctacccttgcatatatatattgacctgaaactaattactaatatctgttgaattatattgtaacaattgactactatacttattattcttctcacttagtctgcataatccatacatgaaaatacatcatgatcataactttgcaacaacttcaattttctccagcatctcactcaaaacgccatcactttgcattgttcaattatataatggtttcaatttaaagcagcaacatttttcagcattcttaagattttaaatattctgccggaaattggaaactttgagaagttgaaagagatgaagatgactaacaacaattcattatcttgcacgattctgactggaggttgttggatagaggattttgaaagtttggagataaggataagggcagtaaggacaatgtatatataaaaaagttaaaagaaaatatggacagatttttaaatgacatgtcaaatttttacaggtgagaacaagcattaagattttagacacaaaggagacaagtgatttgaatttcatggcccctagtgtacttatcaaataattatgccttttaaatatacataattaagagtttttttgggttgatggaaagtatttttttattttattagaaattaatccttgatttattgtaaaaaaaattaaatctttcccatcatgatgtatttttcattcaagacttgattataggatttcactttcatttgacttaaaccaataacatgcttaaatataacctagagttcgttgatctccaggtttaatcgtctctctctatataaattttaaaaaaatctgtctcttaattaaatttcgatattaaaagattaatctttaactctagctagttatacctaattactcatacacctaaaatacatgggtccatgcaaaactcgacattgcagtttgttttctaccgcgcgcaaggaatcattagcattcaaaatgataaaaaaaataaaagtttaaaatttttggaatcattgaactaaaactaccacatgtgatagtgttcctagatcgcagggtggtgcaatttaaaaaaccttgatcaaggcatgtgagtcccgcgtctagaaatagtatgaaccctacaattcatcaacagtgaacgccattgataacaatttcaattttggaaacatctcggttattctttatatattaatagtagattcagatacacttttactcaaactaatatgaaaaatatcagaaattctgtaacatttagtatatctcaatactggactcttttttttttcttaattatctccatcttattgacctttttgacatggcaatacgtaaaataatctggttaaaaatcacatataagttttttttttgaaaaaaaaacccttcaattttctcctccacagttacatgcaggtgtcatcatatttttttctagttcaattacttattttgctcaattttatctaattattaataaacagtttaatttggttcattaattaaaaatgatccaatttaatcccttaattattttttaaaaaaaatataatttggtcatttttgaccaaattgacataac

SEQ ID NO: 40 - DNA, 3276 bp, Glycine max
  Soy_ogl_236 Gm01:49809370..49812645 Cluster 1
ctctaaaagtagtagtattaattaatagtctgatgtctcttgataaattaatactcctttcactcatttcgtagtataaaataaatacttattaactagctagccgcgcccataaatttatttattataagataacaataattcttacaaatttatcagaaaaagaaaacacaagatcgtttttgactatacacagtcaagtataaaacattttacatgttaattaattgaaaattattaattatataacttttaaaataattattataaaatcaatgtatatataataatttataattaaataacagtataaaatttcattaaacattaaacactagacaatgctgcatagtgagaaaaataaccaccaaagctgttattataatattacaagttgtgttaccacggaattgacttaatatacaacgaggggattgtttatgcgtttagcatagaaatttttttgggttgcattataaatttgaatatatataataacactagtaattagtaaataacttataaacgtaacaacctagtattttagataatattttttttataatttttcagtgatcaaattgtttaatatagaatacatgatcggattaacagcaagtgagagttaaaataactttttttctaataaatatggtcttttttactttttttaaaactaaaagtaattttttaggtgaacctaaagtttaaattttaattgttttatttttggacggatcccgttagaatcaagtaatttttattattttaacattattcgtacctttaatttactaactttgattgtttgtaataaaattttacatgtatttcacttttagttatcttacaataaattttattaattttataattcagcaaaaaaacacaataactttgtactttttttaaaaaaaaatatttataataacaattagcactaaatgcacaataaattcagatgttgcaattttaaaccttaaaatattaactttttcctataatacatcacatcttccaaattcaattcaattacagacatcaatatctaaaaatgcaaaatttaaaaaaaaaatcaattcaaatttcaattttgctttcattatttcctttcatcccttcaaacacacccttacaattaatcaattcaaagttgttgttattttcagccgacccaggtcgttttgtatattttatgtgtattggtatgattgagtatggaattgataagtgacgttgttcacgaatctgtgatttgaaggttatccttttctttttccttcttctttaggcgtgatttactgcttgctcagttgctttcttaattttctttttctaaaaaatgccttgttgcccaacaacgacaatgggttcattaatcgttatccagtagggtttttttatatataaataaaaagaataaaaggaagaaggtggcgtttaaattcaagaaaaaaataaatatctaaactcaaaaagtaataatagcaggcttattctatttactcatactaagaaaatgaattaaagtttaaatctgcgacatgttacgtgtggggtcttattttagtttattcaatcaacattttactttattcaatgaattaacgttttaatatactcgtcataatcctttttaaaataataaaacaacccagatacctgaaaactttcaacaattttaattaaaaaatatcacttcagagccagtgatattacatgtttttaggtgtttttctttatctcaaaatatttattattttagaaaattaaaaatatttattattttaataatactatcatttattaaataagatcacaagtgcattttaactttttagcgaaggtaatttaataaaaaatattactttatcacaataatttatggaattaatatttttaataaaaaaaaataaacactagattgaaacatataaagaatacgaaatgaagggaatacctatttgaagtatttattaaagaaaataaaatataattaaaattataaaaaacatttagtgatttccatatttagtttcttaataaatatcattcatatgatataattcataagcttatagaaaaaggtattggaattaataaaaacatttttttttaaaaaggactcaaatcaaacacgcgtttgatacttattataaaaaatgttatttatctatgtatttaaaacttttttttagtaaattctttaaggggtttttttacgacataaatgtttgtttaatatgaagtataaattataattcaaaattcaattgatttatattttttttcaaaccaatttttacatcatatgaaacttatcctaaaagagaacaaaaaaaaagaaaaaaaggaatggcaaagggaactctgcgcgcgtgaagcctggctccaaaaagagaatgacaatagacttggagataccataatttgtctctgtgacgcatttgtatatgtacacacactcgaaaattcgtctagactacggatcttaataatttcattatttaaacatacaccattaacattatatataagatttatactattttttatttttatagatttatctatttatttatttttatcttttttcgcatgtatctatctaaaaaaacatatctaaaattatagagggggatttcgttattcaaaaaatattttcatgtacccaagggtaaattaggcgaatgacgttggcttgttctcttcaattttcgtagcgtaacgttgaaacaatgaatcgtataataaatgggaattaaacgtagctggagcaggtactacgggttactatacgtcttgttcgtatgagtttgtacgtaaaaagcagaaagtgataaagaaagaaaccaaaaatacggaactttgtggagtttccaatgaaaggcttttcctcagaactcagaagtgaacacgaagaaagagtgagcaagtcagagatgggaaagagtcctagattatcataaaggacacgtatttactacgacttgaggaaagctcactcaatactaccaaccctacgtacagtagcaatattatttaatagtagtattatattatatactagcgttagcctagtgatagagtacttggaataaacatatgaaaatacaattaaaaaatattatatgatctaataaattagtaacttagcagttgttaaaaacattatattaacaaatgaaaaggagccaaaatcaaatttttttggagtaaatttggacgattttcagtagaaaaatattaactaattctttaagatattaaaaatta

SEQ ID NO: 41 - DNA, 3100 bp, Glycine max
  Soy_ogl_239 Gm01:49923601..49926700 Cluster 1
atagtttttttagtttttagatacatttcaatcacacgatgatgccccacttagttaacgctcctctttcgccagttggtgatgctggctgcgaagaagctgatgaaaatcatgaataacgttatttttagtaattgttgagaatgagagtgattcagaaagaatgaacgcctcactcacacggagaaaaaacacaataagaaaacggtagtagcattgacagggaagagaggagaagacatttcaggaatttatttctttgcatgctctatcgcactcgcctcgacgtctatacctctcccccttcaacccccacggcggtagacgaaactcttctacgataacggtgttagcgaggggggagaggaggccatggaataggattaagaaatgagaagatatatggtgtgggagatgcaccataataatttgggagtaagattaatttaagggttaaagaaattatacatcatacacaaattcacatatttctctacaaacatatttgatttacaagaagaaaggcagttcgattttgttttttcaaaaaaataaatagtaaatattaaaaaatctaaacataaagtgaactaaaatttaaggttgaagattttttttttttttgactttttaaggttgaaaattaaattaacttatgttaacgatattacattaactaaagatatgactaaattaaaatatatgaatagaaaataataaccctcttataaaatcttgcatcaatatgtatgattgagtttgatcaaaattaagtttttatatgacgtcaaaactcgatgctaaagacaaaattaatgtattatgtatttttttttataataacatatatttcagatacaattttattctttagcttttagttttataatcacatgtcaaactcaaattttctttcattttagttttataatgacatgtagtttttattgagatcatttatttgagtaggataaaattattataaataataattttttttcctgaatattcaacaaagttacatattcaaaattatcatgtgtttgggggtttatgagttttcttttgaaaattttataatttttatttttggttttaatttttacctatgcttatatattacttttagagtttttttaatgaatatttttagagtttaattttgatgcgttgttattataaaatattttaatttaacaataaaaaaaacttatcatgcgttgtttacttcatttagtacaaaattgtacaggaatatttgagtgatgatgtgtatttaattatattaaatatttaaagagaaaattttataatattacacaattcaaataagattatttaagtgaaaaacatttataatctaaataaaaaatatctattttctattaaaaaaaagtgaaagaaattctggaccaattttaaaataattaaaatttgataaatactaaccaaggtaaattttagattcttaaatcactttatgaattataagaagtttttttcctttttttttttcttactttagtgataaatttcacttttagttcttgagacaataattgggggtctccaatgaatcccacttaaacttttctcccaaagcctgttgtctcttctccttctcccctcttccgacctcttctccttccctggcccttccattctccacaacccacactcagacccttccatgcctcaacccttcaatggttgttgttgttcagcgaggaagcatcgctatgatctatatctgaaagttgttgttctagatttcattcgaaaatagagatccgagttatgttgttgttcagcgaggaagcatctatctgttctagatctgagttgtgttgtttgatctgttctgttcttgcttcttcccttctcccatttcagttggttcctctaaaattagttagggagagcgacaataatttttgttaaaaaaagaggagttcttgacagttgtttcctagaacccaattgttccgctagagaactttgaaggaggtttactggtagatggtagatcttatgaataagagtttttgagataaaaatttctattaaagatgcttcaaggaattgattaaggaattaaaggataaatcttttttatgaaaaattatgttgttgatgttatttttttaagttttttttattggtcataattattaatacattgtgatcataaaaaaaaactatttttcttttaatataatttattttatatttaagtattaatcaaaatttaaattctaaatcaccttaattatttgattaaaaaatacatattactaacacttatatcaattattattaatattttatattttcaataatttatataataaatactttttctcagtttgttggaaaaacattcttaccaagatactaaaattttacatgattccctcgtccgtttatctctcaatatgtgtaaagtatatgtccatcatcgaggcaacaattttggtacggaacagaagacgttgtctgtcttatgactaaattgaccttgtatacatactcttcattcattgtttgttaatgaaatgaaaaggagtaccatatgttttgatttcaaccagggtaatgtgtcgctgtcaactttacaaataatcacttaatcacagctggcttgctacagttgcaaatagtaattcaactctatagtagggagttgcagatgaatccccaagatcttacagaaataaagagctataaattacaccgtataacagaagtttatatttagaaaaatatgaaataatgacacttttttttataatttattttaagcatttttattattaagaaaaaatcatattaactcttttgattgaaaatgattttaattagttcagtgaaaataatgtataatctgatcaataattaataatattttataaattctgtaaaacaatatttataatttaaaaaatatcaataacatttctctttctcacatttgttaaatataaaaaaaaaatatgaaaagcaaatacaggttaatcttccttttaatgcattaaaaccatattttggatcaatctatgttaagttagacaaaactagctcaaaagttagttacttggag

SEQ ID NO: 42 - DNA, 2200 bp, Glycine max
  Soy_ogl_270 Gm01:51618001..51620200 Cluster 1
tataaaggttttgcgttcagtaaacaaaaagtgagatcaaactagttatagttgactattaatttttgagaaaatattcattttaataagatagtaatcaaaataatcttattagattaattattatcaatatatactgataggataatcaattaattttttataatctttatattttaggactttttaataaaatattatttttaatattttcactttgtattatattttagaatgaaagttagttacaatgttataagctaggttatgagtcaaggacaatctcttaagtatactcgtggtattgatcttctttggcttaaactaattttagtttatttaaatttttattttatttttcaagtataaatacttacgaataagtttgtctaaacggaccttaaaaatttacatattaaattaataaataattcattaatttagtctcaaattaaatattacttccttttcttaaaataataaatttatataaataatttctcaaatattgaacattcattaatttatttactaagttgatatattttactaacattcagggtgaaatttaaaagatttttcaattcttaaagtactacttaacatgatttacaatactttgagaattattaatataaatttttattcaagggttatttgagagagagggcaatatttgagagatagaattgatgattaattttaaatttaactgcattggttttcattgttgattttcttatttgtggaattaattttgtgactttttttttaagattcacctcaatgatgaatcttttgttaaataatatacaaaattctgataacttttattgcaagtaaaataaagttttggggagaaatatatgttcctctctttctgtcaaagaaagtgagattttgaaatatgattagagatcaccaattcaggattctagttctcccgaacttggatgcaccattttgtcatccctcaattatgacaagtgaaaacggaataaataagcgcacaaactatagattgctatacaaaagtatgttttcacgccatagttttggaagaagaaatagataaaaaataggaagcaaagaaagaaaataacaactgtgatgaatgaacaaaaataaaatagaaatatatgtgggtgtaaaaatttaaggttgtgtgttatgattagaggaataaaaaagtttatattttatttttgacaaaaaaaattatattttatagaatatatttaatgaacttaattacacttcaattttgctaatatatttgtgattttaaaactaaaaaattacttgtatttaattttaataaggttttcactctaaattttgtatttctgttcaatagctaatacgtatgtatgtatcatataaatagtttatacgaatgtaatcaaaatatgacgtggcgttgatttacataggttaacaaagaatatatatataatatttcaataagttaaaaaaaaaacaaaaataatgccaaaaacaatacattgaagtcagttgcgttttaaatttaattatttaaatatttgtatatacgaatgtatcatctattgcatttttttgttagctatttttatctgtaaagctctcaatatggatcaatcaacattgaagatgtaaaaaatgtgtctggttaatttgtccaaatttcttataggcgacacttttggcttgggtcgttgccttttctagctaaacaaaattgacattttttcaacaaaaaaaaaggtttaacaattagtaatatttcaaataagattgttttaagaaagtgctgaaagaaaatatatatgaaataaaagacatgaaaatttaaatattaaaaattgggatctgaataaatttgcattaattctggtgaatatctgaaactctattcatccaatttattataaataaaaaaaattaaatgtatttttggtatttataatatgttgtattttttaaaatatttttttgtccttataagattgttttttaaatgatctttgaaaaattatttcttttttttatgtttattattttgtttgaagtttctaatatatctttttttttttttcatttttatctctacaatatctagttccctatcaattagattttttttttaatatctcatggagactaaaagcaaacactctttatattacaaggacacaaatgaaaaaaaaaatattacaag

SEQ ID NO: 43 - DNA, 4437 bp, Glycine max
  Soy_ogl_308 Gm02:1204801..1209237 Cluster 1
ttattttaatttaataagaggttttaattcttttttattgaaagagacgttttaaagttaaatattgaacatttaattaagtttcggatataaagaaaaactctaatattcagtgctgtctgggatattcttggagcttgaagtaaaaactaaaaaaggaccctacagaacaaaaaacgtatttcataaataattcatcaacataaaatttcatgaatttataaattcaaatataaaaaaataatacacaaaatccttatattgaaaatgaaattaatacatttttttccaaattttttaaaagctcaaaatgggagccacaagccgttcatcaccttgtgcatgcctgagccggcactgctgatacctatggtcaacaaaatgacaaatacctatagtaattttatttagttaagattgcatatcctaaaaaatacttatgatttcagttattgggccgttcttctggtgtagctaagcaataattaagtagttctgtttttttgttctttctttaattttcaagaaagaatttcggcggcgattgttagaattacacaaattaaatttgccctccttgcaccaataatgagtgttcttaaaattataatgaaatgtagttaggtatttcaaccatattagcatacccatccatcacagaaatggttccctttaaacataaatatacaagtacaacccattttttcttaatttatatataaaaaattaaaaaatatatattaatcatatgtcttcttagctaggtaagtgatatatatttgattaccaagtaattcaattataggaataagaataaaataggagcaaataactaagaggcaaacaacaacctatataagaatctaaatttccatgtttcttttttgttggaactaggatgacagggaggtggtgtgggggtatggatagtaaccatttgtcacctttgttagataaaaaaactgtttcatacttgtacagttatttgttaagtgagcatttataaattttataaatactatataacaggttttatatgtgatttgctctctcgtctcattcagattttcttttctttcaattgaataatgaaatcacagtgtaacaatttttatctcctttaaatgtaaaattttctctcttcgttgtggacttctttttagcggtgttgtgattatctatgttgttgttgttgttatatttgaactgacataaatttgattccctcgtattgagacagtggggcattggtggcatacttttctgcgtttaagtcaacaatacttataagcatatgatatgcatattggaaaacaaacaaggagagagcgaggggaaaagaaagagtaatcgcaaactaattggtaggtattcagacatgcagttgcatcagaaggaccatcaaccttacctgttgaattgtggataaaaaacaataattggcaataatagaaggagaatgaaaacgaaacaagggtagatccaaaagtgaaggaaagaaaacgaaccaataatggctgaaccaatcaaacagtacccaagaagaaacattagaccctgccatggggtactggatgagaccatcttgtaaaacttgtcatttcattaacaataagatgttaaaacacaacatgtgtgtcatagcagaagcagaactaaacctaaatgggtatttgatattgttagctagttttgtaaatttaaattgatgctccgaaataaattctataggaccccattgtcacacaaacaaacaaagatttcttaacagatcacgcctattcaaaaagttactaatatcctcgtcttggagaaaaagatttaacagaaagtgaggaagatcacattttaacttaggaatagtagctattggtactaggggataaagtagtgaagaactttaaactgaaagatccaaaacaaaaatatagtacataaaattgaattttgggatgtgggacaagcacaaacatcacataaaataagtggacctaaaatcgttcatgccttagtttccaccattgatgatctctaccaatgaaacggaacatctcatcacaatgatggaccccaattccttacaacctggaactccttagctgttctagcacagcagagaaacaactacatgtgtggaagataacaaattatgtagaccccgtttgtgtccttgccttgggcactccattaatggtcccaaacctatgggaacaacagcaatacaaatgctgcttacatctctagattcatgtgtaattaagctaatttctctagtaaagtttatgtgcatacgttttatgtattttaatcgataaaaataacttgtttagaaaaaccatcttttacttcgtataaatttttatttataaaagattcttaaaaaataccaattgcagagctgcacttctcgtacgtacggctacattggttttcattccctgttttcgagttttattgcagggtattttttttttcttctcccgtttcctagtaataaattttacctaagatatacagaaacacatgtagtattacaaaatttaaaacaaaataatgtatgacattatatataaaagctaaaacaacatttatatattaattattaaagaaacatttaaaattttattttaattcctattcaccactaagatgttagtttgagttaaaatgaactcaatctttttaactaaaatcttattttaaatcttataaatgaaaaatatataattaaaagttttttcttaagtaaagttttgttaaagataatcatttaagttttttttatatataatggatcgatcaatcgaattctttaacaaaaattttaatagataaatattacagtaaaaaaatctagtacctattacccatcttcgaacttgaagcctaatagtcgttgtgaagttcccaaatgataagtaaatttgtcattcttactaataatttacattaaaaagtatttctttttaaaaagctattctatatgataatacattctatattatttatttcatcttttgagggtatcatttgcacgaaagaatgatgaatactttgttaattaatgaaagatgtcaacatcaacttattcttataatttccttacgcaaccgtgtcatcataatatagtgacatatggagcatgatacgaaaatcagaaataatactcttccatatattttcatcaatcttatttttaaaatgcaatgaaaactacaaaagaaattaaatctaacaatattgttgaagttgaaatatggcacacctcaatcctgtgtttgtttgttgttacattgttgagaaagcctaaggtcgttagtttgagtttgaattgttgctttacttttaaatataataagttttagttgatgagcagcgcacctaattacatcattgaatatttgtgcacagtattgattgattagttttattttgtactgcgtattgattgattagctaaacattacaatagtgtgtattacatttctaaaaccttacatattccatataaagtattattagagctatttgcaacccaatactcgagtactaaataaattcaatatcatgcatgagagaaatgattctctcttttttgtttgttagcattaatgatttataatactagtgtctattagtgaatttagttttttcttgttgacaattagaataattttgctggaaagaaattctgtatcatgagagaaagaaaagcaaaacaaaacgtttttaatttattgaactgttcctgggtttatatgcaagggtcaaatcattgatcatgttatcatacaaaatatgaactatccaatccacaaaaatgcaacaataataacgtcttaaaaataaaaataataataacactggaactaaataaaacaatggataaatatttatttggatccttaagaatgttaaaagttgatatttcaatcaagatgaaaattaatttttagtctcttaatatcaaaaaagtatgataaaattatcataccattaacttttgaatgttaactctcactattttgtatatgtgacgtttttggatcaaattataatgagaaatgttgcttagtcagagaaattagtaaaatagacttaattgtatgtcaaaagttgatggattattttattacccttaaagattgcttttattttttccttccctcgtttttttattgttgcaatcccaacttcactcccatcatctcttttctcctcttccttatatcttcttctccctcccatggacttattgtaatgaagtttgaaacatgaattccaaaagcttactcctaacatacaaggttaaaatgaatttttttccccttttgcttttgattttgttccattgaatttttttttgtaaaattgattgagtgttcttgtagaacaatcgatttcaagcaaaactcatatttaaacttgagtaactgt

SEQ ID NO: 44 - DNA, 2382 bp, Glycine max
  Soy_ogl_421 Gm02:6716301..6718682 Cluster 1
taattagaagatgcaaggaaaaataacgaaaatactgtgggcagatatgtgaggaatgaaagtaaaaacacaaaaagagagctactgagatttatatgtttttttataatagtattaattaagtaaattgaaatcatatatatacgtaaatgtttttttttaaaacattatatatatacggtataatacgtattgtttgagttttgattcagatcgattttttaataaataaaaataatagacactaatcattcatgaaaaataaagactaatacttgaaaaaaaaaaagtgaactattgaattaaaatttaaaagggtgatcatagaaagtggtacagtttattttcaattaatatagctttgctgtctttattaataataacgaacaggataattgaaggagtccagctccccagagtttttttgtaagaaaaaaaagaagaagaaagaaacatatagaacattatagggaggaaaacatgaaccaaaaccatgatttagatttaatatgctaaaatttaattttcttcgtcttatatttttattttttaaaaaacttaaaaatttagttctcctatttttttaaaaaaattgtaattttaatatcattttttaatttcagacttgattatgtatttttttaattatttttaataaattaaacatattagcaattagatgatttaaaataaaaatatttattatgtgaataaataaacaaatatcaaacaatatttatagagtaaatagatcaattttaaaatttgtcaattgaaaattttttgggataaaaagtctcaattaattaaaaaataggaaactaaaaccacataattgaaaaaatagaagaacaaaaattacattttattctatttaatataaacatttgattgattttaataattaatttattagtgtgattattttgtataaatttacaattaattgctttatctatatttcttttattattcacaatattttgatttataaatctcctcaatgagatataattaacataagatggccatatatgatcaaatgtcactattatgttatcaggtaaactcaactttaattgtatgaataatagcagcgggcgtgcgcactttaaaatttaattaaaataattatttatcatatttgatctctgcgtattgcttctgtatatgccctttctattaatgcctatgattccaattctaacatccaacataaaataaaaaaattcttcagtttcttagtttcatatgacatatatagctaattaacttatgggaaattaattacatacattgcatgcaacatggggcccttaatggaggggtcctagctagccaacaactcacaagcatgcatgatatgatcacaaaatggttcttattggaatgtaatgaacacgtaacagtgtttgagtgtttcctttatttctttgtcgctacagcacatgcatgtggagtggaagaggaagttatatatacatgttgccttcctttgtcgcatccacagaattttccaactttccaccacttatttgaatacactttttttttctttcatgttaattaagcatcttcttctttttgttttcaactttcccctttttatgataaaatggagagattttggaaaagaatcatttgattatattttcccaaaaagtgtatttatataatttgaaaagtgtataccggagaaaatgcatgtacatgtggggtgtgtgggtgagattttgtgcaaggtgtgatgagaaggctgctaattaacatagtaatataactaattttgtttcctataaaggacatcctttttaggatatggaccaaaagttgataaagatctaacatttagatttacatatatatgaggggcaattcaagatatatatggtcatggtcctcgttcggtgtgaaggagaaaatgcatttattattgcggtagcttataaatataaaattccaaataactatacaggcaacataaattatgtaaagacgaatatttaatatttaataatgtatcaatatttaaaaattttccaaacaaggactattaaaagaaaagttgacttcccagccgctccaccgatgtcagtgacttaaactaatttggttgcagagttaaatataatttatttattaaaaaatgttattacgatatttttataactttcaataatgtatttttaatatatatttttcagtaaaagaaattgttaatattgattccttatccattattctctctaaaaaaataatctctaattggtaagatttgtattcattaattagtgtttttattttcacaatagtgataataaatgtttgaaatctaaaaccccatgcaataaaatttcagaagtctatactagtagtcaagtt

SEQ ID NO: 45 - DNA, 2041 bp, Glycine max
  Soy_ogl_647 Gm02:44552301..44554341 Cluster 1
ctaattgtttgacaataattatttttaaatatcaattttaattattaatttgttaattttttttatgaaaaaatatttgaattcacattctcttccgttcttcctttttttaataaatattagataatttaattaaaatattttgacaatgcaaaaaatacattatcatgtgatctaaaattatcatataattacttgacttctatagtaattaattaaatgtcatttaagaatgcaaaaaggtcttttttttaaaacatacactgtaaaataggatttagccgtgtatgtttaaaacaaaaacattgttagagatgcactgaaaaaaaaatttaaaaaaaataattattttatcattttatttttctgccttttaataatataataaaaaataattaatatatgctttttgactggatataaaataattaatacttagaacttattaaatttgtatatttatttcctttttagtaaatatcaaagatttggaatacatttatagaatttgaatcattatttaattatgaattgtcatataagcaaaaaaaatttatattttattttttgttgtaggtaagagaccacaagtgtctctaattttattggctcacaatttcactcatggtaagtatctgttgtcggttaaaggaattttacattatcaaataattaaaaataatcttaaatatgattttcaaataaatcattacaaaagtcaatatttgtatcatccataattaggtataattgaaattctcaatacaactaattaaattataattaaaaattattcacttttacaataactactctataagttttatttaaacttattaatgcttatttgaaagtgtaaaaaaaacgatagtaatttttaaacctccactgaagagtttttggtcctgtctttcatcttttcaggctagttccatgggtgcttgtttgactcacgtttagtatttttgtgttactgtcctttttcttatatttttttgtcatgtttttgtaccaaaagaataacatttaatgagggtattgtagctattctataccattaaaagcattcttttttttaggatcattaaaagcattcttcaaaagacaatgcttcttgttttatttaatttatataaaaacatgaaaaattagtattcctaattctaggatattattacctttttatatcattaaaactttcttcctagttcagaaagatttccacctccctgttgaaatattgtcatgggataaaaaaacattagaagggaataaattaattttttttaaattgcataataaatataggaaaataatatttttaatatcatattcttgagaaactaaaaattatttttcgtactaaatgttatctaaaagtaatatgtaaggtgatagtgaaaaaaatctctatactactggtacataaaaactgaactctatatttaattatttttaaaatattaaagaatgtaattaaaatacagtgtaaaaaatacattgttgtttaattacaaattatttataattttttatttttttcataattttttgagtttaatggtcaggatatttgtataaaaaaatttacattatcaataaattaaaaattatctttaaaatgatttttaaaataattattataaaaattaataaatttatttatgtaaaatttttgtcattgaataataatttaaaataaactattttctctaacaaagtttgtgcataaactattttctctcacactatcaatacataaactatttctgttatttaaatgctgtttaagatgtttttagtaatcacatttttttagttgtatctttaatatgtttacttgttggttaacaatgcaataaaaaacttatttacaaataaatacttaattcttttattgtatattttactaattaataatatcaccacaaataatcaatatttaaatcttgttaattttttatttcgtttttagtaaatattacagaatttaattggaaatacatttatggaatttacttactatctaggtataaatagc

SEQ ID NO: 46 - DNA, 2300 bp, Glycine max
  Soy_ogl_661 Gm02:44944801..44947100 Cluster 1
cccaaagttatggcatggagaatattttttaacaatcaaatcaatcttaaataggagaatattcaatttttttaatgttttttaacctactaaggttgatttagtggtggaaaatataagtgatttttgtacaagatattaagttaaaattttggtgctttcattgtattattatttttcggttacagaaccattaatgtttttaattctaaagaaaactcacatgaacacgttaaattaaaaatatttttagtttgtatttaatatttttgaaaattcagatgataagaacaaagtgtcaatgaggtcgaaacttaaaaattgggttgaaaaataaattgtatttctataaaaacacaataagttcatttctcatcatcaagagaataaaaaccaaataaaatataaaaatatcatttctttaaaaatcaataatgtcaagtcaataatattttaattagatttctaccaaacataataatcaattatattaatataaaattagtcaggttcatcaataaaacttctttaacaatataatcagtgatatattttaagcaaatgacaatagtaaagttgatggattctaccatcccttttatgggtttccttcacatcatacacggatatgatatatttgcagcaagtgtagagaggatgaatagttttttttttagaataaagaggatgaatagttagttggtaatattacaaactatatataattcttttatcaataattttttttgttaatttatttgttagttttattatcaaataattttttagacgtcatgcttgctgttataagggagagtttattgaatataagtgcaatgaaaaaaaaccccttttatgtcgtttaaattaatttacattattttttctttaaaaaaacttatagtcaaaatatttcaaagataatatttagttaaaagtgttaaattagattaagacttataatttcataaatataatggaaggattcatttttaaaaattaacaacactatgatatgatacaatttgtgcttatggcacatttactattgtaattgacgatgacacattttgtgcctacacatattaatatatacttattttgccgattaaaaaaaaacaatacgatacatttttttctatatttttacaataataaattttcaaatttatataaattagctatcaaaaaaattgtcattatatttatttggattttaaacacaattattttcagacatgaacatgttttaattgttactctttttctcgtttactttacaaaataattttaattcaattttagttgtgcttgataaactttccttaaagagatacatcagatatcatatgaaatctatattaatttactacatgtcatcttatatatttttataaatattttgccacatttcatgctaatatttttagtatagaaaattgtaatataaatcaataaaaaatacatataataatattattatttaaacattttcttaactattcaagagatgacgaagaagtgaaaaaatggaaaataaatgaattgttataatccaccctgttaaatattcgattgtaaattaggtaaatatctcaatccatttattgtttttctttttcttggtaatatgtaacctattttgattatgttctggattcattatatgggccatgcaccaaatcttgaatcatacttctgaaggattcagggatatccggatctcataattgagaatctcgttgttcttaagctgttatgtacttatatatgtatatgtccaaatttcagttaagtcttccaatagactcatctcacttgttctaattatgagtgacagaaaaacatctatataaaggccaatcttttgattaggtatgtatccttttaacattcaattcatctctatataaattaagaaaggctctatgatcttttggttaggtatatattcatccaattattcagtgcattgttataattttcattaatttaagtatgaaagtaccttccataaatactcccccatacgccttcagttagaaaatcgccattgaaaaaacaaggaagaatacccttatcttttgatgaggttgtgagagccagacacttttaggaatgttgtgcaaataattaattttgtttcaaaataaaatgatgatagcttgtttgtttcttattttttaaactatttctgtttttacaaataaaaatgtttaataagaatttttaaaaaaaaaatatacttgttgtttagacatgtaaatgacatgtaaaatgtgtcacatatcacttaggcg

SEQ ID NO: 47 - DNA, 4100 bp, Glycine max
  Soy_ogl_684 Gm02:45903201..45907300 Cluster 1
ttgcttctcgttatccatgttgaaacacaagtttttaattttttaaacttattcaacatgtgagaccagaaatagatctagaggaggtaaacccctcccttcggacttctcatgtatatacatatagtttttttttttcaagttagttaattagtagtgtaaatttgcataaactaattagtatattgattattataacaatgattaagattagttgatatgaaattatgtaaaactaattgtgtttattgttattactataatggttaacattatagttaatataaaacttataaagtgttgttgttattatgatacgaaggtaaaagttattatcatttaaaataaatattagtttcaattttatgtatagaaaatgttattaaaaatcattatttgttagaagttaaacgaagaaaaagaaaccagctccctttaatggttaatgttgtgtgaaaagtaaatccaacgagaaataggtttttttataaaagaaatcatattcttttacacttactcgtgaaactcatttatcatgctttcaaaaagaaaaagacttatttctcacctgatttttaccttgataattttattagctctttttagtttaaacattaattgaattttataaatttttatgtaagtgaatttaatggaacaaattttacgtctaaaatttataaaaaaaattaaaactgtgtctcaaaataaataataatgttttgaataaacattatttctcaatttaaaaacataaatgactaaatgtttttttaagataaaagactaaggtgaatataataaaaaatataaaggattaaaattatattttaacttaactaaaaagtggtttttatgataatttattttatttaagttgtttaaaacaatcaattattcaatagtaaaattacaaaaagaatatgaaattattttttatagtaattttgtattaaatctatcaattgctaaaaaatgatatatgaaaaaaatggctaaaattaattttttattttttaatcataattttaaaatcttattcatttaaccaaaaatattttaatagaaatgatctaaaattataattattttttatcaatattaccaataaaaagaataaaattataaataaattttcattaaaacgaattctaattgaaaaaataattcaggtcaaacacttctgtattccagttgaataaagaaaggttcattgatgtaaatgaaaaacaaaatcattgtaagcaaaagattcttgtatgatgaataacagtgcgaggaacaataaaatatattatattttgtatcatattgatttgtatccttaaaatgagcatttaagttcctattatggcaaacttaatgatgataccagcaattataaaagtaaccacacgataataacaattagtcaatttaaaaatatagtttacagcataattaagcttgaaattattcaccaaaaaatattaagcttgaaataagttaaattattcgctaaattaatctatgactattagactatgtttatttattaaataaataatttatttaaaatgttttaaaaatgttaaatttttttacattattatcgatcacaaatgattttatataagaaatttattgtgttttataataattaattttaaaatcttacttaaaattattcaaataaatataacacgcgtgaaaacaaaattgattcacacattgtaaatataaataggataaaaaaatggtcgttacaagctttgtattattttggctataaatgggtaggccaattgatttaatttaggggtagttacacttctgcattttataaggtagtcctttagcttgtgtatataaaaaaaatatgggctaaattataatttttatctcctttaattaatttataatctataattttgatttaattatttttttcataattttggctcttacatttaaaatatccataattttgatctaataatcaatttaatttacttatatttattttatttttcatgttaattaactaattattttttatggtaacttaaataaatatattaaatttagagtttaatcaaccaaaataaatataaaaaatattaaggactagactttttaaaatatacaaattaaaatcacataaaaagtatgaagactaaaatcacttatgaagatttaaagaaaatcaaaattataatttagtcaaaataaatgttctctactcaatttgattcacacttttaattttcataaatgaaacaaactttttaggttaaattttttaatatctagcaaattcaaatttaaagcgtgagtttatcgagtctaccaaatataatatgagtagtctaccaaaaaacaaatgttgttaacaaattaacttagaatgtatatgtgaagttgtgagtttggtaaacatgatcatatttcaacaaataaaaacaagtatctaactttatatcatccatatttaaaaatttaattagaaaaaaattagagggaccttgtacatacatccatatatccctggatgccaatactctctaatgcaatacgataccaaacacgcacgtaataacttaattctaaaatctaatttaagcagagaaaaaaataatctcccctaaaaaaacaaatcatcaaccatataggatcttaatatattctttacaatattcaggaatgaatagcataaatttgtaaaattaaatatttatggatcaatcaacattaatattaagattaatctaaaaaaataattaaaatatataattgtacaaatgttatgaggaatgtttaatttgtctatatgccgaccacacctttttattcttatttcgtgcaaaatgaggattacagttgaataatattacccacacaacctggatcgcaaatacatataacaatgtacgtggctagcttaatccaaattagagattgtcgtggtgcatgtttaagtctataaagggagcgatttggtagggtcatttttatttatactgttatataaaattattaatttattctgtcggttcaatatgacaaaaaacttgtatttatagaatctctaaatagttatatgcattattgagtcaaacaaaatacttttagtcatattaaattatgataataaaattgggtcggctaagatgtatcagtttctggttgaatcgagcctggacttgaaaaaaaacggagatactattattacttgaattagcatgtataggttgagttacgtaagaaatttaactacaccaaaaacggatttaatcaataattgggttttttaaacaactaacatttttcattcacattcattgattaaaaatcatttttaatatattgactcaggacaataattatcccaaaacattaattgtctagtttttagatcaaccaagttggctcaaactgtgatcgtaagctagggctggtccttgtcaccatatgggagcctctataaaaagcaaatcaagataataatgaaaatgacattccaaataatgaaaattatatcctaggttaggggaacctacccaaatcccatcatgcttagctaccccactaaattttatccaagtacgtagcattatatttagtcccaatttttttttactacaaaacaaaaccaacaaataaaaaagaggatataagctgtaaaaagtagaaaagcaggattggggctcacatgcatgtttttgtcttgtgggtcactcgtcctaaacgttttcaattgtgccattaaaaccgagcaaccacatgattaagtgttagtggtttcaagttaagtgttaacgaaaaaaagaagaagaatgaaaacaaaagagggattcttctaatctcttttcaagtgtgcacttaaacagagtaaaattttatggtaatttttgttacaagttactcgtgctgattaaaaagcgaaaattacaagaccaaacatggtaattggtaagaataaaagttacattattgtcgtgcctgtgtgagacatgaatattaagttgataatgttggtcaacaaatagcgtattcctttctagtttgttgtttgttttgacaatgttccaatgttcccatggcattaacggattaaccag

SEQ ID NO: 48 - DNA, 2700 bp, Glycine max
  Soy_ogl_685 Gm02:45910501..45913200 Cluster 1
agagttataagtaaatgaacactgattataccttaacatgggtagctagctaagatctattgcccatggcagatagatgcaactagcttcttattttccatgaaatttttcacaaagcaataactgactggttcaatgccaaatatgcaggggatcaaccaccaagtataactagagcatcatagcttcaagggattcacactcatgccaacaaaagcctttaaaaagtatgtaacataaaacattagtttactttcccatttctttttgagagaattcccagaaaaattatctcattaatataattactataaagaacaataaactctcaaagtgcatattaaatctgattaaagtcaacattataacttgcaatttcctttttttttgggtgtaatcatgattgagtaaacagtatatgttatgacaatttaaagagcttttacacactcatccaatttcaaattaacatatatgataagttattcacttttataataaatatcttaaaagtcatacacctatagtgatttccaattgcttaattggttaatagcataaatatcttgaacatgtgtggtaagactattgaatgtacatagaaattaaactcaatcatgattaagatagtctgattttgttattcagtttttagttagctccagttgttacaagttagttagattttggcgggaattagtagaacccttttctagcccatttctgctagtactgcatctgcgaagggaattctgcgttatccatttttgttactacacgcgatcattaattatcacatgaacattttaagaactgtggccggcccaaccctaaagtaattaaagcattctctcaaataaataaagtctctaaaatatattattttattaatatttttctttaaaaataaaagaaaattaccaattattaacatgtaataatgtttatcattgatcatgaattttcttgcgtgttttgatgaacattgctaatgtgatatatacaaaaaaaaaatgtaatgtttaaagttcacacatttccttcaaaatacgtttctcaatttatccttttcctctcttaattagctattattagtacttagtactatcaatcttaataaaaatgcacattttctatcattaaacattttaaataatgataagttccaaatacttgctatgctttctactgatattttaaatattctgaaattctgattaagataattggagtgacttttacttaatcagttaatctcctctacttcttcacgttctacgtttgctccctttttcaataatacaaaagtattgttgtatttggaaataagtgaaaaacttagtaatatggaaaacttaaatttactttcaaaattaaaagtttaaaaacgaactatgtatgtagaaaaggaaatactacttgacatattcaataattcaagtacacgagaaaacttaattcttgattttaaacatgttaatgttatgtagtaattgttatttcagttgaaagaaaattttcaaaactacaattaataactattaactactcaagatagtcaacgtgtaaaaaataaaatgaattaactttattgttgattgaaaagagttaagtaaaattgattgtcataatttaataagtaattaactttgttggaaaaaaaattgaaagatgaatttcaaaagtcttgtcttaaattgtatattaggcttaaataagcatcgagttaagtcaaccctaatacttacatcttatattttaggttaacttcttctttaagttacttaacaatttgaaacaagcatgccacagaacccagacttaagtgtctttttttactgatataagataatttgtttttaaaattactaaagtaatgcaattttaattctgtaaagtttaccatatacatactcgactttttttttacacaataagtaacttgtaatggcctatatcaatatttttaaatgctataaactggaaaacatgtttttttttactgcaaactggaaaaatattatactttataaatacatttacaaataatactattttttttataacttccattaatttaataattttaaaaacaaattgggctagcataataataaaaaaaagcccatgggtttaccaaaacattcaaggaagcaaaatcactagactgaagtcaatatgttaaatcgatattaagaacaaagtcggaaattatgccatcaggtggacgtgccggagtggttatcgggcatgactagaaatcatgtgggctctgcccgcgcaggttcgaatcctgccgttcacgttttttttcaactattaattttttttgagtaattatttgattttttacttaaaaaaaatttaactaacaaaaaataactatacacgctaaaaaaaattatttttaaaggaaacgaatgttcatttttaaaaatatttaagagaaaaatgtccccacatgattgtgggtggaaaattgttctatttttgtaaaacatgcatgaagaaatcttttatgaattagaagaaaaatcaactatgagttacaatacaagaatacaaggcctgaacttcaaaaacgttctcttgaaaattcgattaaattgtaatttttacattatataagcattcacaattggtgactccagaaaaaacatgcttgaaaaacaacttatgatactacgttgtatagattgc

SEQ ID NO: 49 - DNA, 1920 bp, Glycine max
  Soy_ogl_686 Gm02:46019566..46021485 Cluster 1
ctagtccagataaatatgtatactaattaatcaatatgataagaatgatatttttatgtttttttttatcaattgtttggtaagagatttcaaggactaaaaataagattatcataagtataattgactaaaaacttattttatcttaattattattatatctaaagaattttttcctcttttttatgatgaaattattatctggtttattgttattgtacatgtgaggttaaaaagtcttttaaaatttgaaacaaaaatcagtacgtattatttatttcccatatcatttgaataaagaaataattttagttttaccaataaaattaataaataattttataaacatcattgattaaataattttgtatgttacagtatttgaaatgtattggtttatatttttcgaacattgataatgacattaggggtattgtttttctattaggggtgggggtagatgttgccattatttgtatctgatctatatgtgtgtacactgtgcagttttaacataccttatgttaattctgattcacacatttttattaatacgcctttgttttgccgatgaaggaccgaagcttttttttttttgttaactggatctctttatgtggttagaaactaataaatatttttgtcaactagagcttctatttttctttttcttttttttgtcgatgaagcaccgaagctttttttcaggtaagaagcatctaaattcatttttttgggtaaaaagttatctaaataggacagaaaataaggaattttattaaattattgaagataaaaaatactaataagtttttttttatcattactaatgagttctaaaatattattttaagtaacatccaaaattactactatctccatttcatatttttaatgccttaaaaattcctctttaaaaatatcattaattatttgttcacttatatccacctatatttaataattattacgataacaataacttaccaaaagtaaatacaacaaaattttacatttattaaatgttctttaatttcctttaaaaatgttctttaatttatatacactgactttaagcacacaaaaatataaaacaatctatgaaacagttttactcagtttcttttacacgtaacacttatttagttaaacaaacttctaaactaatggaattaatgaactgattaaaatgtcttctctaaattctaatgatcatgaaatgtcttatctaacactgattatcattaaactaacaaaaatatcttatctaaaaaggatataactcaatcatgaatcaaacttagagaaaaaaaaaataagaaaagaaaaatacttaaaaaccaaatgatattttaaataacatcgaaatcactactatctccatttcatatttttaatgctctaaaaatccctctttaaaaatatcagtaattattttttcacttatacaccgtatttaataattatgataacaataactagtttatcatacgtaaagtataacaatattttacatccatcaaatgttctttaacttatatacattaacttctaaactattgtaatggaattactactaaactgattaaaatgtcttctctaacactctttatcattaaagtcattaaactaactaatggaattaatcaactacttataaaatgtcttctctaaattctaatgatcataacatgcatatcttatttgacactagttatcattaaaaaaacattaaactaattaaattatcttatctaacactcataatttagtgaaaaatcaaacttagagaaaaaaaattaagaaaagaaaaatacttaaaacatctttaagctcaagaatttatgtccaccaaatctattattatttttgtttaaaattttttcatgttaaagattaagtttcaaaaaaagaattctc

SEQ ID NO: 50 - DNA, 2294 bp, Glycine max
  Soy_ogl_789 Gm03:1439707..1442000 Cluster 1
ttaattattattctcatttgtttaaattttgtgtgtgggagaatctggaggggtagggcccgagtccccctcccttgaaatttttcatgtatacacttgtacatttttaacttaattagtatacgttgttattataataattattaaagcaataattagtgtaaaattatgtaaaattagttgtgtttttgttattattatcatctaatatataacttgttaatgcacatattttttatttttcttttttttagtatttaactaggcataaaaaatatcaatttttttttttgcaaaaacatgttatcgacgctctttattagacaatttttttagggaatagacaaaaaatttaagtgctataaaattttgtaaatataacatttaactagtataaactaaactattaatatagatattactaatttatctttatgatacgctataataacatctaatatattgataatatatactctctaattcaaaccaaattcaaccttttattcataaatataactttaattatgatttggtaaaaaaaaatttaattatgaaattattatatcactcatactgttttggtgaaattatcatatgtttattttctctttgatcgtattctctaagttttttaagtgaacatcttattctctaagttacttcttaattattcaatattgtttataactttattagttatagaatgtagttaaagaatgattaactttgtatagattttcttttagtaaatttttaaggttatgactaactattgcttttaggatattggaaatcacgtataagataactttgaaatattttttttcttttaatttttaaatcaatacccaaacatactggttaatatttgtcattttttatttaatatatgtaggaattaaattcagatactagaaaatttatataataatttacacatgttactcaatcaattgagttacactttttttaaaataaccaaatgagttacacttatttgttctctttagtaatctaaatgtaacgttagttaggtatattaatttcaactctatacacatttaaaatatttagtttttattatattatgtattatacatttcaaaatttatttattatttctaaaaatagaatattaaaaaaaatctgaactactttcgatcaaaataccaaattaaattaaatcaaatttattttataatcaacagggttagataataaaattaaaactttgataaaacgtatgattttttttcttcagaaattcaattaaatactcttgtcccataattaatattagtttcagatgaatgatatgttggggactgtttgttttttttttttttccctaccgaatggttctaagtttccagttttctgttttaaaatgtatttttgaaacagaaacgtgtttggtaaaagaggctgagttaatttttgtcttgttttcaaaacagtttttactctatttcaaaaacaataaaaatgaatttattaatttttgtttcagtttttatccaattctcacacattcccttcacacgttgttggtctctctctatttttttatcctcatcgtcattggccgttcgttattctccctctggcacggtgctttctctaaataaatattagcaacattctctctagacattctttattattaattggatatttttttagatttgtaaaatattgtgagtctctttatttattgaattttattcgtaattttgtggtttctattaaatttcattaagttttagagtattggaagacatgtattagaaaatattgttaaatcttctctcttttgaatgacatacacatatatccatctctttctgcaacattctcattattttgaaaagtaaatgaaactttcaatactcttactatggtaacttggctgcaatttcatcttttcatttaattagcatccatgttctgtcttgtaccaaaacatgttatactttcaaggatttaattaaacagatgatcaatctggtttaagttggttgcattccatttatttaaagtaatatgtccttaggtttgacacgttatataatcaacataaactggttgcaataatgatgcatacttgattgtgcaagtagccattctgaatgaccataagtatttgaaacttggaaatctgtgtaggtaaacaatgctggaatccctggagcacatgcatgtggacggtgaggctttggctgctgttggtattatggtatgattttaaaatatgagtcactttctagtattggaaatggatacttagtgta

SEQ ID NO: 51 - DNA, 4600 bp, Glycine max
  Soy_ogl_1036 Gm03:42105801..42110400 Cluster 1
gaacatgaccaagtctttaaaatactaagaaatgtgaaaaaaaatgatgataaaaattttaaaaaaaacttgtctggtaagaatcgtaaaataataataattgagtgataaaagatgtaattaaacattttgtttgtgagagggatgccaatatgatatatcctagtattctaccggtattatattcgtcacaataaaattaagttaaaattttttaagcaaatattttaattttaaatcttatggataaaaaagtaagtaaatagaagatttgacactgattaattatcaacaagatcactaaatattttacacgataaaaaacctaagatattaattattttctttatatattaaaatttattgaagagattgatctatctcactaaattagagtttaaaatcaaaatatttttattcactaaaattacattttattaatgttgtcgtatacttatatgattctttttccatacatttataattttataattatatcaacccaagaatatttctgtcgcatctgatgatgacggtatcatagtagcatccaaataattatttgaatttttttttagcacaaataattgggccaatttttgaaaaaaaatatagctcaattgttttcttaaaataaataggttgaccttattaaaagcttaactgaacattatgacagaaaaataaaaataaacattaaatgaaagaagactttttttagggaaacgaaagaagactaacactacgtacaacagggaaagttacacgttacaatattttaatatcttcaattatactaaatattttaatatctatgcgctcacaattcttttatgatctgttccgataaaaaaaggggggatatagaaaatagaaaaataaattaacgagtgttgagtttttagtgaaagaggctagtgtctcatctcaacatgtgacgaatagggttcaatctttttgtctgaagaaacattcacttttaatattgatgttgtttaaaataagattattcttaaaaaaaaatccttgtgagaaatcaagagaatagaaaaaagtggataatgaagaatttttatttaattaaaaaataaattgattcctataaatatataagattttttttttgtttaatttaaattttaagtttttttctctttatttttttttctagaacaaaaatgattaagtatcaatgtatggctagaaggattattcttcctatagatttaatttacgaaaaaatgtccatatttaatatcaaacagtaacttacatatgattaatcctaaagtggacatctgtagaaaaaaaaaacataggattaggctctattttatactttctcaaaaaaattaatgaacaataaagtaaaggggattagcttaacctcagatgaaattaaagttaactgttctaacaattttttcagtaggcgaaattagtatatttcaaggttcaagacttgtatttgaacttggggcggacccatgatgggaaatcagggggtcaataatggcaatttttttgtaaatttcttttttattagtcactaacaaccgtcaataataaagattaaaataattaaattatctaaataaatatttaattaattacatttttatactatgcaaattaacacacatgaaaataaataaataaacttcattctatgagataaaaaaacaaataaaactatcaaagcatgtctattaatattacaatgtgagaaaaaggaatctgcgtcaacgttatataatcatttaatcataaatcaatgtgtaataaatttattagcttttataataattaacttaaaattatataattgatgatttataattatatgattatattattcatgcatagtcattaaactcttataatatacttatgtaaaattgttctattaataaaagaatttattagagcatctacaatgataattatttattggattgcttaacaaaaatatattattttggtgttagatatgtgattttgagttgttaagattggagagagcaacttatataaacagctattaagttatttaacaattactaaaaggatctaactcagttatttgaataaatatttatgagtttagcaatttgttaataaaaatatctattaaaaagaaaattaattgagttacttaagattgaagtgacacaaattgaattgcttatattaccatcattggatatgttctacacttctactataataaaggaatttaaaaatttcaaatacattaaaattaaatgaattttcaaaatttatcctatactttttaaggatatttatttaacactcatgaacggactggagccacaaagaaaagaaaagccaacaaatcatgtaacaaagcctttaaagtagagtaaaatcttacctaataattaaaaattaacaaaataaaaaaaattatacttcaaatatttatattaattataaaactttaaacaaaattagaggggacatggcccccttggctaacacatacgtccgccctgattttaatatatattagataccaaatttattcaacttgcattagatgaaagtattatataagaaagataaaacttaatttctctatcaactttcattgaaacccctcttcctcattctcttaaaaatataataaagtgtattataagttagaataatttattattattgcgacaactataatctgtgattttacacttgtttattttattttttaattttaacggaactctttctagtctacttataaagttaaagaaataatggaattattcaaacaaataaaatagtggaatgtaattaagaataatatatataaaaagttgaaataacttcttaaaaataatatgtgtagatgcaataactaagtgataaattgacaagagaggagttgagtaattacgttaaaagaggtgtatattttttacttaaaagaaaggaaagtatcaagaatatattatcactacgggtcaaggatgaaaacgattttccttaatttttaataagatatgattcctcattgttgcaaaaagaagctatcagattggttgaaataaattacatatcccatttgaaatagaatgactcgatcaatccaaagcacataaacaagtttaacttttttaagttttaacaaataagcaccgtggatcataagtagatgacaatagttaatgagtctttcattatagtgtggacgttattaattagttgtgcatctctaattggagtattgtctgtcagcgtgcatgggtaatagtaataacaacgatcagaaaaatgataagcaatgagatagaatatgaatatgaacctgtaaaagctataccatactaataaagtacctaaagaattgatcttgcttagctgtttgcaagacctttcactgtttctcaagctagcttgtagtactccacatatattcacaggaccacatgcccctcgtgttggcaatttatcaaattcgaaacatttttttttaattgttctttctattatcttttagtaccaaattacgttagcttatacagttatacgcgaatattgacccagctataattaagtaatttctccttattcgttatattaatcgatttttttataactttttaaaatgataactattaaatattgacacaggaaaacaaactattatcacaatacacaattaagtacattggcataaacagcaaattaaaatatttggcatgcagtataagcgttttgctttgtcaaccgaaagattaattgaaatcaaggctgattcaaacatggcaacaatatatagttgattatattataccacaaagcaatgtatttttttttctttaacgcaaacaatgcctttgagttttgaaccaatgcaagcatggttagaataattattttagtatataataacagcaacaagattaatttgaacttaaaattttgtgctaaccatccaaattcttccaccactatactagaccaatcctagtaggcccaagcttggttagatattaaaaaagatttttagacactttaaatattattaaacacctagtgataaaaggtaaaaaaaaaagtgagaaaaaaaaatattataggtgatataatgtaataagaaaagaaacataaaaagaaaagataaatattaataaagtatttttttaaaaaatgagatgtctaaaaatcattactcattagatattatcccctaactattgaaattcaactcttttttggtgctgatggtgcagttgttgtgcttattaaatagtagaattaagaaagtatttttttatagggtcatacttgctaaaaaaaataaagaaattaaaaaatatttaataagaagtatacatttaataaattaattaatttaatttacagcatgaaaggtttttctttttttatatatatctgaattattgacaagtaaactaacacgtagcagatgatagtcaatgctgtgaggacgaagacgtgtggacaaccttgggattcaagactaagaagcatatgctgcagaattataataggcaaaagggtcgtgaagaagatgcaatgtccagtctaagaaaggcacacccactcaattcac

SEQ ID NO: 52 - DNA, 2437 bp, Glycine max
  Soy_ogl_1046 Gm03:42525701..42528137 Cluster 1
attttaaaaaatatatattatattaaataaatagcatagtgaatatattataaataaaattgactagtcaataatactaaatattgtattcattgattaatatatatagtcaaattgtaaactacgaatagatataaaatatgatcattttgaatatatgactaataaattgaagcatgtattatatttattaaatttaataagtatattttatctaaaagatatcatgattgatatattataagaaaattgatggtccgataacattaaaaattatatttacaatatgcagtcgaattaataaagatagaaattaagagataattattgtgtgtgcatataaatctatcaaatttttaatattatgttgatatatattttatttttttatttaaaatatattttataaaatagttctttatatattttatattcatatatttatatgtgaccagatgactttccattaacaatttattcagtataatatgtaatttagttaaataatactagcgtatatatgtagatatgaaaaataatgtggtcaataaaaatatatatgttatatttaacacaattatctagcttaattatatattatattgaataaatagtataatcacaatattatgttcattaattataatatatattcaaactttaaagtacatataaatgcaaaatatccgtgtttttttatatatggttaataaattatgatcattttttcatagttgatggtcaccatgtctaatagtataaataagagatcattaagtttaaaaaaattaaaattttcttcattcatatatttttttctctaatctttcttagtcacaatgcacctatcttgtttgtttcttatgatttttttattttgtccgaaaagcaacctaatctgaaagtaaaaatcaatggtcaccatgtgcctaacaaccagacacattcactatccatggactatggcaataaaagtaaatataggactaaaaatagactcatttttttggattaaaaatgcaaataaaaagttaacgaagaactaaaaattattaaataaattttaaagaattaaaagttagaatctaaacaaattaaaggattaaaaatttaattatttctgattaaacatacaacgaaaatttaattttattatgtatttcatctataatacacaacgaaagtatgttcattccgtgttattttttataaaaaaaaatattgcataaacatgttttcgtcatgtattgtgaagttatgcttttataaaaacatttataaaaacattctgtgttatgctttcaagggttgttatttttttttattttttaataaaaacatttaagatttaattattaattttatcctttttatttattttgaatgttcaactaaatcttttattattaaaacttccaatcaaaattttatttttaaaatgcctcaatatatttctttcctttttttatttattgcctaaatatgatctttttagtttaattgaggttgatgtcgttaagtataataagtgaaaaagatcacattgagagataaaaaaaataaaaagaccacaattgggcattaaaggattacattgaataattttaaaaaattaaaaaaccttattaaaactttcaaaaataggaggatatgataaaaaaaaatgtttttttagtaatataaaacaaatatttgtcttgtgcattacacatgctaaaataataattatattaaatactaaatttttgtactttctgctttcattttgtattgaataaaaaaaataaaaatttgaatcttttaaaattatcatgtgaataataattaattttcatgagaaaatcaacaattaatatttctaacacattcatcatttgttatacttatagacacgctatatcaatcaaatttttcataagtgatatttgttaattaaattgttgacttattaggaatcagattcaaaaattagatagacatattttttattttttaaaataaaacaaaaacatttaagataaacttgtaaaaagtattttttttaaaaggataacaaagtataaataataaataaaatcctaaaaatgacaagataaataaggatatgcataatgcaaatatttaattataattgaagaagactttgaatacaaatataaaaaaggaatataaaaacttttataacaattaattcttaattaagttaacatataatattttataataaagtaaaaaattaattttagaggtgaaaaataagcatgatggtgacatggggcataagttatacagatttttttttaaaatattatattaaatattagatatgttttatatttattttccttttattttagattaaaaaaagagataggcattttgattttttcttaaaatgaagaaaaacatttaaggcaattacttctcaattaagtta

SEQ ID NO: 53 - DNA, 2600 bp, Glycine max
  Soy_ogl_1055 Gm03:42873901..42876500 Cluster 1
aaagttaaaaattaactggctaatcgagttaagaaaatcaatttcagactatcggctttaaaccacaagtttgactttcattgatccacttgatggttttggtcaagtcaagcgccctaaaattttataattttaagaaaagtattgtcaaggaaatctttatcacagtaggtttgagaacacgttaggacttggaaaacttggatctccaatataattaatataatactcctaaatgtacttaacaaatcattagtaactatttttgtttttatcctagttactatgagtttctttaataggttaaagactaattatgtttataaaatgtgattgttatggacttaagagaattttgtatatgaagaaaattaaagataattttttttactaaatatatcattattttttcatataaacaaaataaaaccttattgctagttatcctatacgtatgacatgtaaatccaatttttctgtcactcacaattcacatttatatgatataacatgacctcctcaaagtttcacagttttaaatactataaggctgatctttaagcatttaaaaatagtagttttttaattaggaaaataaatatttattatattaaaaatctaaaaagtgtaatgaatatttttttataattaaaaatataagtttaaaatgctttaaattagccttaaaagtcaatgttaacatgttcttaaaaaactatgcataatttttttagaatatcacttgaacaagaaaggtgcatgaaccagaaggagtcaagtgcaatctctcggagtaaatgagttagaaatatttgaaaccataatttgacttagtatcaattatcaaaacaaacatggctgagacaaataaactaacgtggttagcatactaattaatgccaagttaaaagctggtaggccatgcttgttttgacattgatttaaagggcacattttctcacaaaaaattgatagattcatatactactaatatcttcgcatttctcacgtaagattgactttaaaaatatcactatcaaacatgtaaacgtgaagagttatgactggtggtgggaaaaggatctaaggatacattattttaatgtcgaataaaattcattttaataaaattataatttatttattttgcaccaaaaagtaatctacatgttctgatgtaaaatattttactaagattaatttacaatgtttaatcattgaaaattagttatattaaaatcaatttcacataattttaaaacaaatagatacataattttaaattattaaacttagtaaagacatgtatttaaagtaatcttaataatcaattttatattaaaccatatactgtaccaaaaaaatatttaaaaatgtactacgatagaaggccctgattttaagctatcacatgcccgagtggaaaatttggtcaatgggtgcccaaagccaaaataaaaataaaaataataagaagcgttgaatgggagccaagtttaaaaataaaaacactttactttaaacaaaacttaaagcttaaaaaaattaagaggaaccaaggccccatttggacatggcgatttggcgggttttgttacattaaaaacatgtataaagcctttaatgttttttttcctcctgataaacaaagactattcaaatttatgaataactcgcaaaataaattcaaatttatgaacaaaaagtatttgtgtatatcatatatgttttaatattttgtttattcagataatattattttctaattaaaattaaaaataatttgcatatacctttaaaaacaagttttcatgtattaaggtaatattagtgttaacatttaattttattataaaatcattgaacatataagttagatgcctattcatgttagtactgaaatgtcgtcttgctggaaaaaaattggccattcattataaaatttaattatttcaaaatgtaacatttaaatataggaatgtaatattatgtttgttataagtcttaaaaaatattcttggaaattgtttattcctagagaagtttgcaacttttatttttactattctttcttacactgtcattcccatgaaaagggaagaaagaattatattcttataagaggatgctgtaagaagttatttctttttaatatacatgtaactttcatttttatttatttttaattttaaagatatttttaggaatactaaaatatagcgaagcacgtttataaatatatatattcagaaataacctccccaattataatattcccaaaaatatgattttttataatacaatattccgtgaaacaaatcctcctttatggtactacctaatttatgtacgaaattaatttatttcagttaaaagaatcgttattcgtcacactggatgatttctgttgtcagagtttccaaatactataatctactgaaaaataaataccgggagatacataagattaaatatgagtaataaaagaggatttttttatgggagtgactactgcgatgcgacctatggcccaactcaggttcatgatcaatcctgttcctctagtgcattcaatgaaccctaaatcctcccttaaaagt

SEQ ID NO: 54 - DNA, 1800 bp, Glycine max
  Soy_ogl_1056 Gm03:42881301..42883100 Cluster 1
gatagacagaacaaaaacttccatttttgttaccgaaaaatcccgatggtgagataacttttatttttttaatctcaaatatactgtaaagcgttcaaaagataaaaatgctcatatatctctttttactctctccctcgtgtcttcaccccccactttgctgtttccactaacttaaataataacttacgtaaaactgtaaaattgtcattccatttaaactttatttattatattatatctttcttttctcccctcaggccaaattttcacctcccctgcctttcaatcgaccacaggtgaatttgacccgacatttatgtaatcttctcacttatttattactcgatctcaatctgtctatttttatctaatgtaaaattttatattcatacttacactccaataaaaatgacaaataagaaaaagaaaactaattaaaatatctatcacattcaggactattttggtgttatcatgtagatatgtattgtgtaaaaattcaactaagaacgatgctatgacaacttaatctatgaaatgatcattttttaatgtcaagttatttttggtttcccaaattaaaaaaaaaaatatagtccctataagtaaaaaaaaaatctatttttatccctaactactaatgacgtcagtggtatcactgatgtagctaacaaagaatatgtaaatttatctcaataaatattatttcccccccaaaacttatatcattctatgcaataacaaaaagtatattgctttagaaaaagtgttttctcttagttattttattcctttagaaaatctagaaagtaatataaatatttttctaacttttttccctttttgtatttttactcaatgacatgagaacattatggaagatgatattttcagtaatttaataaaatataattttttacagaaataaaagataatttaattaaacgttgttacattttttactttactcgtgtcaaattatctatagttttaggagttttaatttctaaatagttgttactttgaacaattaaaatagtattaattgttgtttattaaaaatactttcacttaatattatctcacttaaacgttaattaatttataattttttaatgaatacattttagttaaagaagggagtatataattttaatttcaatacaataacgccgttatatttttttttagaaacttgtttacattgtcggcaagttatgtttaatacttcgtctaatgaatttgaccacgataacaaacactataattgcatttcaaatttattaattacacaacaatttattaaatgccaatatgaaactcttttatgcttacgttatataaaattaaattcttcacttaaatgaagttctctaataataattatccaatgcttacgttatataaaaaataattttgaaaaaatgatcgtttaacaaatacataatatttgttttctaaaatgagtagaatttttttaagtaaaaaaaattagacaaacaaacttaaacagaaaattatttattttattaaataagtgttttttgaacaaataaatttattaagcaaattgacccaatgatctcacaagtaagaaaaggaacaagcttgtcgatccctcttattttatatttgtcaagaagaaggtgtgtctaaatttcaaattgaaaattaatatgttcaaatgatcgaaatattgtagaaatactttgagattctattaaagaatcgaagactatattaatcagagttgttaaaaaaaagtgataagtgagttttctttttttcttttttcaa

SEQ ID NO: 55 - DNA, 2000 bp, Glycine max
  Soy_ogl_1168 Gm04:1965001..1967000 Cluster 1
aggttagaatattgaaccgaagcaatccaacgatctaaaccaaaaatggttacagtggattgaccggattcataggccaatctgtacctatgattcatgcaacagttatactatcattgaattaaattaaaactatttctttagaaaaattaaaaaaaatcaatcaagtttgttttccttcatttactctagttcttttaataacaagaaaatatactttttaagaaccttactacaaaaacttaactgcttggaatttgtattcagcccattggatataaggtgttatggatgaattcatccaactataaacactctcggtttcattatcctttcacataaatatgtttggatacagagtatattagagtgacagagaagtgaagataaacttcttcatttttactataacataaaaattcatttatttgaggatttttaaaaatataaggaacaacataagatattatcatataatactccaatatctattttcgttcttataaatattattttcttattcttttcaaataaaataaagatacggctagaggaagtattaaaattaaataatttttcgcataaaatatcataattaagtaactattttaatgggttttttatggtcacataatgaaatataaagtaggataatattatatctagaaaaggcccagtaacacgttcaaataactaccttcttttttttctttttagtaatcaaactctaataatttgattttttttttttaattttagcctggacggatatttcaaatagcgaatgagcgctactggttccgtttttcagctaaccccattaccatgacaagtatgggcattcaaccaacttttttatttcttatgtaagagtgattacaggttagttggattgcatttgataaaaatataaaatctgaatcaaaatcttagttttggaacaagaaaaaagaactggaaaagaagaaaaacaattctttgttgtattgaataatccgatataatgtacgtgtaatagaaaatagaattgagtgatgcttatatcatactccctatatatttaatgaaaacgtctcaattaacccgtaattttaatttagattgaattaggttaatacaaaagagttggattgaattcataattacctataggctctatcactaggtgaggccagatcatttgctctctccgtttctcttgacaactttacagagagacgaaagtccttaaccttttagcacttgaaggattaaatgctcctttctattaaaaactatgttagtcaagatactctaagttaacttaatcctttcattacaaataatctatcatttaaggtaatatatagatttaaaaaataataattacagtaactcttattaagaaaataatatactctgactaaaatatccatattgaaatttgtcttcttattgagaattttttgaaacaaacccttagatgaaatatttttacaagtattaacatcttatgtctcttagatgatcatcttagaaaataacttaatttttttttttaatttaatattgtaatattatcttttgcgtgactttgactgcaaatttagccgtctgttaaatgatggatttgtgaattgtgggtaattaagctttgtggtataggtcttaacgtgggactgttagatgcctggggcaggttgtgaacctttcatacattttctttgatatttacttctcttgaaaagaaaattaataaataaaaaaaaaggaatgtaaattgttatctgtcttccttctaaaagtaaaaatttgaagaaaaaaaaatattgtacatataaaaaacttccgaattctactaacgagtgttacatgagtgttaattaatttaaataaaaatattcattaaaaaatatgataatagtgcattggtaactttttttagagcatgcattggtaactttaaatataatgtttttataaaaaaatattttaaatattcttaactaatgtatttaaga

SEQ ID NO: 56 - DNA, 2717 bp, Glycine max
  Soy_ogl_1238 Gm04:5585384..5588100 Cluster 1
caatctttttctctcctatgcaattaatgtaaatagtactttaagaaataagttaactttttttatggagactattaaaatgaaatgatcttgattaattttcttgatatgtatgagttaatcttttcttcttatatttcaatccagaggaaaaatttgcttttgatagccagcaatatccaagatattattgttaataaaatttggaaataagttttaccttgtgtatagcaatgcaagaacaagcttattaactacaacttgtacatgttcagtgaattttaatttgcatccaagtcaaggaattgactcagaatagtcctgaaaaaggatgatcgaggtgagattcagcatttttaaaccaaaatatgctggtcattacttcaaggtgaggaaggccttattatttaattagcaaaacaaaatcgtaatataagtaccttatacaacaaaatagaagagtaaattaacaacatcaccagtgaatctcttattattaaagcaaaaaaattctacaatttttttttcatttttttacatgcaaattccactaaaaaattcacgtaaatcacataacattaatattattaaagatattattaaagaaatttaaattaattattgtcttattgatattaaaaatgcatataaggtgaaaaacaatgaataataaaggcatgactcaatacaccccaagttttgtatcgaattaatccccttatactattatataatattatttgttacatcttatcttaatggatgaagtcacacatataaacatagaaagcttttatgtgttgcttcgtaatcttgcatttgcagttgctacttaatatttttaatattcattttcaaggttgtctttaaaagttgaaccattttagatttttgccaattagtatttttgactatattcagcatataatcgtaatataaatcttttacagatcaatattttaatgtattatcttttacaaaatttactacataattataagacataaaatattctagaggataattataagactatatcttgtgaaagatgtacggcactattgcaggaagatattacgtggtttcagaagtctagattcaaacgaatgactttttaagacaaaaatatataccagatacttttatgccattactaccccagagaataaggaaggaaattaagtttctgataaagaaaaactagaatctaaggtctctctactataaattcataattgtgcacattataatatgtgtgtccagattaaattaatctgaatatatatagaaacttccttcatattttgccttaatatttttgtgtacggactttacataatatgtatatgtattgataacattaatgaataaaaaaatacaaagaaaacgtagaaagaattattgaaaattattaagttttaacaatggagaaatttatttttatgtaattaaatatagcgcattaaattcaagtatcattcatccaaaaaaactgtgtttttctttttttaagtaaaatttcaggtaagagaaatcctattaaaaatagtaagttaaattctcccgtacatattatttaacaataaaataaaactaataaatatttgcatatgttacgttaaaaagaaaaagaaaaaaaaaacagtgcattaactttttcctattcccacttctctgactaacgagggctgcgtccaagtgagattgacccaactcatgatatgatataacagtccaacagcactttacattagaaagtcttgtaataattcagacttcacgatggatttgattgtgaagaaacaggtaaatttttttttttaaaaaaaaaatatgctggtgttatatttctgtcacactactttaatttaaggtaaatataaagatattgattaaaaaattaagagaatacaaaatgtccatgactatttctatagatttttttatgatttttataataaatattttttttaattccttaatcaataacctaaaaatattagttaacaagatttttcatttttttttaattttatttgattttcattcactctattaaaccagtctgagatggagtgtccggatagatgaattatgatacaccaaggaaaggagagatgaattataaagtaattctttaacaaaaaactttatactaagttacgttgttttttattttgcagatctcttccgattgtcctattatgtgattttttcacaagccccgagtcctcaataacaaggattattttaaaattattataataaattattcaataaaaacttaatcatgcaaattattgatattaaatcaataaaatatgattttaacttttaacatttaattattaaaaaataaattcttattccatcttatacttttgaataagtttctattacttttttttttatcaaaaaataaattatattatttattttgaagatggaaggatatgattttattatttatttttatgtcactataattttattctaaatcttttttcttttaaaaattaattaattttaaattcttactataacagaggaatttagttgtagtgtatttatataaagtagaaatttagtgtaatgttttacaaataaatggagatttctgtattgagacaaaatctataagaattaataagaatattttttgtcaattttatataaaaaaatagaatttaagtttaaatgtaacatctttttgtttt

SEQ ID NO: 57 - DNA, 3000 bp, Glycine max
  Soy_ogl_1257 Gm04:6586101..6589100 Cluster 1
gcgatgttcaccgcctatgattttgaacgccagtgacaaagtaaaaatctacattgtgcgctgtcttttgataaattaaaaaaaaaaaaaaagatatactggtaaattcattattcttacttgtgtgctgtccattattccacaaacggggtacaatctaaaatgttgttgtgtgtctcgctaggttgtgctgtgttgttcctttagtttaattttgtatcacgtcgtgaatcaaacggagccttagggaacttatcatgttaatttccttttctactcttattgtactctcatttttttcaactttatcagagcaggttctgtaaaaaaatttgtacatatacttatattacaagaggcaagactcaggatcggtgttactgcatgcatgcccctggacttggcttcaaacatctgtcatatagtacgtgcatacttactcaatagtcccaatttgttcccagttgtatagtgaagagtcttctcattcaattgattgcactagctaggtctagcgagcaaatatggaagcaactcatcaaacgaatgaaaggtctacacatttggaggagcaaccatggttagtttaattatgtgtgtgaaaaaagtaactaaatatataaaactaatacatatatcatacgttgatgataaaactaagccctgaactagagcagtcaaatgacaatttgttgattggttggagattaattaactgccatttacggccactatatgtataatttttttcactattcattatctcgaaaataatattacaaaataataaaaaaatatttattaaaagtttttataaaaatttatttataacatctaacattatactactttactgataaaaaaaaacattatattgtttttaaatttcttaaccgtatgttatcatgaaaataattattaacataacctgtttatcaaagcgtcaatttgatttgatttgatgtcactggcaattattaaagcatggtttaattttgttgactttatatgatttacgatgtaccagataacaaacaactacaaaaatttattaaaggttcactaggggttgtgtatcatgatttgcgcgaacactgtggctttcttctttcccagtcctagtttgtaatcctaattgatttgtgtttttaatattttttaatttgtagatgtattaattatttttttatatattattatttaataattttttattcaaatattaataagaaacaattgagtaaatacagagataaaaaaaaagataattttatactaatagtataaataattgataattttaatgtaattaattaaattaattatgattcttaaggggagttaattagttaaaaacatcttataattagaaataaagaaagtaaatattagtatcctttgattcaaattaaagagaaaaattactaactcattgttgatccaagtgaaattaaatcaactcattgtggattaaaataagatctcaaatttgattttattaatgaaaaaatgtatttaggagaatagattctattattaatgataattggttaaattttttgataaaaattataattattagtaaaagtcgataaatacttcataattataacatgctaattagtaaaaaaataaaataaatgttaactattatttttgagatattagtttataatttttataataaatacttttttcttttaatttttaactaatatcttaagaatactagttagcaagactcataaaataaaataaaaaaagcattaaatgatagaaacacattattttgaacacacttttttattagttaaatttattaaaaatgataattttatgaatctcacattttattaatgaactttttattttataattttaaataaattttaattaattaaaaaacatgttaaaaattttagctagtgcttattttcaagtaaataaagtggataccgacactcatttcttctactaagaataagatatttattaacggaaactaagttataaatttaattttatttaaaaatatcttaaaacatagcttcctcaagttataatttagtttaattgtaaaaaaaaagttataatttaataataatcacatatctattttgaaaaaaaaaacacttgtatttattttaaatataatataataatttatatttaatttttatcaatctctcacgataattaaaagtcttatctcttaatttctttcactctctgcatatctactataccccgattcgagttgaataagccttatttattatttagattttgttggcttatttatggacaattctttttgtttccgtccttttatccattgtttgtttattaagatatgaaaggtgtaagaataatcttcatttacctataattgtttaatggagtgggtcttgcttcattaatgggattctttgtgtttgaattaatcataaaaaagatatttaataattgattataaatctaattaattgtatgaattattatttttttgaaaagaaaattaatttctatatttaaatatattaagcaaaaattaatgatttaaaactaatttgtcttatttgaattatttaaaaaaatttctctttcataagttgcttataaccattgatttgttctaaatgattaattatgggagtttggaaatcaaacgaaaaaacaaaaaaaaacctaataaataagttataaactttttaatcataaattttaaaatttaatttatcataaaaaatgcttcttttgttaaaattataaaaattattataatttaaattaacaaacatattttcaaaaaaaataacaaaaaagcattttttttcattaatcaaattattatactgaaaaaaatctaatccgcccttcctctctattttttgctgtcttgcaatatatattggtataagcatgacgtccatgtaatacctcaagttaccatcgatctggtcactcacaagccacaattgcggaactccctcgtgccct

SEQ ID NO: 58 - DNA, 1600 bp, Glycine max
  Soy_ogl_1468 Gm04:47337901..47339500 Cluster 1
gcataataaaaacaccattctctctgaattttaacttttaaaagagtggtttgaaattcctcgcacactttttcatccgtttactttacagcctagtttgagtagttttatattcccccacagctattttataaagttgactttaacgtatacgagtaaattaaagcgccaaggaaaggaactggacttgtgctacaaggtaacacttattttgtctcaataataatttgggttaactaagttatcaaaatgaaatacttaagaaaggaaagaagtaattaatctccttaaactttacctcttttataagtagccattttaaactttaattttatcttaattcatccttaaattttatttctcatttgtgaattgatattatgaactttaaatttactccaagtgatccttgaacttctattttttttaaatagacactttaaaatttaattatattccagtaaatttataaaaaaaatatattatttttattgcagttagttattttctatcaaattagagtaaaattatttgtcttaaatagtaatcaccaattaatctttttcttattttgttacatattatttcttcatatattaaaatataataaaaatatgaatttaggaaaaaagaaaatattaaaaaacaataaaaaatactttattcagtttttttttataaattctatcacgttttaatgtttggaaagtaatttataaaaaaactaatgatgtttaaagtacactttcaaagggaaaagagtacttaaactcttttttttcctttataaaaatagggattacgtactctttcaccttgaaaaattatactaagtttaggtgtgcgaaggctttccaatgtttacaaattacaatcatactcataaatagcacatcaaaatagggtgagttgaagaaataataactttaaatgatttcaaatcttactatagttgatgacattgaggtacaaaatgttctaattaagctatttatttttatatcatattttacaatattttctagtatttttttttatcatgacatatattttatctgatatattttttttatttattaaaaaaatattaaatatatgaatgtgaataatttttcattcaaaagtttctcctcaataagaaatttagaaccattgttaaatatgaaaaaaatcaaataattgatatataaatgtaataaatacacaacttttttttttatcaattataataattctatccaattttaactcacataattgtctttcattaaaaaaatatatgtttgaaaaaaaaactcagctacaatgagttatttgagtgtaaaattcatttttatcaaaacctttggtactttttcgtaacaaacattttcatacatttatcgtttctttatatactaatttagcacacacataatttaattctagtatattgttagcgtaggaaattataaaatttaaaaagacttgttgaataaaatattaatataaaattagatacctctatacaaaaaatttactcctatgtcaaaattaaattctaaagttgtacgggttgacattcttccgttctgcattgcaccgagttaatgggaaattg

SEQ ID NO: 59 - DNA, 2700 bp, Glycine max
  Soy_ogl_1545 Gm05:2193401..2196100 Cluster 1
gagaaaagaaaaatataaatataatgtgaaagaaataaaaagatgaagataagtaaaatatattgatgaagtgtttaaaattacgggatattcaaatattattgttcaagaatattttttcattgtctagtgtgactgatctaaccataagtaagatttaaagtgaattttaagagaatttttttaaaatgagagaattatatgataaatatttttactaaaaaaacttaatttctttgttaatatatgtaacattttttgttttataaaaattaatagtagtttttttataataaacctaaagtttaagttttaattattttactcttggacacactctaccttgcaacttcttattcgttaaataataataatacataaatatttcattatttcaaatatttcatcaatatctttttttttatctctttttttatcaaacataaatcttattaattatagatatttttctctcgttaactattgttgttgttgtattggtggtaggtaacatttttttaataaaaaattgaccactgacctgtacataggacagggtccacctccaaaaatattgtcgtttgtgatttgtgtcggagtcgacgctgctaagaatttgtgaacgtaatcagccctagagtggttcgccgctgccgctgcctctgccacataattttcgacacttttccctttttttgtgtgcacatattattatatttcctcttgggatgtatatgcatgttattaattaatatgttaataaattggaggttctatcaaatattatgcactttttggtagaagacgcgaataaacaatgcttccatttgattgactgattatttccttttcgcctttttttcaagttcatatatgaatttttaaaatgtttatttaatttcttttttaatcctccgatttttttattgaaaaacaaattctgtctaatttgacatacaataaaaaaaacaaataaaatttaactaaaaattattttcgttgaatattaaatttaaatattatccaaataatttaatcttaatctcaatatattaatcatttgaatcatttgtacttaattacttgaatatataattcttgaattaagttgtcgttggatgtcttaatgaaatgatttattttgcttaattgtgtttttccctaaaatttatcaaacgggtaatttgaattaatctagtttaaataaagttttcctacttttaaaattaataaaatttagttcatcacttaatttactatcagatttctcacggtcaaaataaaaaggagacaataaatggagtgtttagtagaaaaaaaaaagtaggtagggagagaaataaaaatatattaatctcacgcctttttatttctccacaaaagtaagaggaaatgaacagtagccaattcatggctcgcagtcacagtagaagcatgaaatgtttttttttttctcttaaattaaactttccaatttctacttattgtcacttattttatttctcttttctctatttctattcaccttatttctcttctatttgtttattcctaccaaatacaccctagtacatgtaaaatataatacacaaaataagaaacgttttgagacttgtgtaaattttcacggtatataatttatctttttatacattgatagtgaaacattaaaaataattaattataaaactttgatcaataatacaatagttaataaaaaatgagatttgataaattacattaagtaaaatattgaatatattttttttgcctaaaactttagaattttttgtcacactttgcatttaaagaaggtctgggttagtattataggtatccaagtgtatgaaaatgaacattaaaattattatctacatgcatatgagattgagtacaaatatcttttttcaatgcagatactacgataatcagataaaaattatatttgcttctttttaattggtagattttgaaattttttttttatttgtcatttttaaagttttaaataatatcaactgctcttttattaattatactcttagtttcttcctaatctttcattaattttcccataattccataaacatttattatgaaatagaaatgaaaaaataaaataaaaaacttcacaactattgtattaggttctagaaattttaatacatattttttttatttctacatacatatttttaaaaatagataaaaaaaagaagaacaaaaaagtactataaaacattactcaaatcttacccattctaatgattaaaaaaaataaaatcttaaccattctcatcttaagaagttgatcatgtccttttttttaatggaagaagttgataatgtggaagtaggttaaaaagactttttttaacttgattgttgaaatgtgatcatagacagtagatactactttcaccctgagagaggattcgtggatctacggatagcatataagagaagtcaagtcaacctactcggagtacctcaaatttcagcagttacaccatattttcactacctacctacccgaggcgttacttctgttgctgctagtccttttaatttgatatggcatagttttttttttacatgagttttattgatgattaaattttgttgaataaactatcttatcatctttaatgggtcttcatctcaatcataattttttcatccataaaatttaaattcaaa

SEQ ID NO: 60 - DNA, 3168 bp, Glycine max
  Soy_ogl_1812 Gm06:6691801..6694968 Cluster 1
acctgtaagagaatcaggtgattaggattggccatgttaatcatatacatgaaaatgaaaaagaatggcctcctatccagaaaaagtacaacaaatagttaggaaaattattaaaattcataactttgctaaaaatttgttaataaattaaaattatcattgattattacatgagtgaataagaactattaggatcgacctaatagtgaagagttcaaatgattgcatgaagttaacaaatatatattattatttttttctttcacatgtatcctccaatcctttcaagaattatgttcaaggtataactaaatattaaatgtggatattttttttttgtgtgagaattccaatcttagttcattatattatgttaaatttaatccttccactacattaaactcagttggtaaataatttttattactttaacttgttaaaaaattattttaattatcataaattcttacgaaattctatataggtttgtcgactgtataacgctgaaaagttaacgagtacttagtctcgtgaacctaactgaaatgaacgattgttgagggtctacaaaagaaattatcagtggacctaaatattatttatatagcaataattgagttaataatcacatagaaactcaagctgcgtgttgttcatttatttgatatcatgtaattagtgcgcaatattcatgttgagcagcaattatcaaaatctcagaaattagtagcaattaggcaatcaaattgtttggtaagagcgtgttgaccaatccatttacgattttacgctaaattttccaaaggaaactttttttcttaataaaaaactattttcattttctcaaaattataatgcattttttttttactgaaataaagttcaattatattaaattcgagttcaataagtttgaccaatattatccactagttaggataggatgcgggaatattatttcccatgggattcccctatagttcctttgttttcttttagagaaatatccttctttttacatgcacaaaaactattaatctaattaaaatatttccccacatatataatataaaattgtaaatatataattatataaagtgattcatgtatgtatcaaaaaaatataagcgacttatgtgattttttaggcaagtgacttacgtgataattagggagtgtgatatattaacttacaattatattagcgaaactctttaaaattatttaataatttgtttcaataattttaacttaaggagaaaaaaattattgttgaatcaaatatttttatcatacaaattatatttataaaattttatatcaacccaaaattccaaaatcatttgatatttcattaattagtgtaaatcaaaattaattcattagagtcagcttaatggtgaaaaggtttgagtagctactgtgtatgagatcatagattttatcaccattatacacacaaaaaagtgtatattaaaatcaatgtgtaatatacatatgaattgattattttcttaatttgtgtgtgtgtgtgagaaatgaattgattattttcttaattttttagaaaatttgttatgaaatgtctagataatatacaattctaattcaatagctatataaattaaaaaaattatatgcaaagtcaattttttttttgctttactggaggtaaagaccaacatacaaagtcattagtaatgtaaaagcaaatacaacttacattaatataagtttatctctcatcgaaacaaaaaaaataattcaccaacaaagtctgaaaagtgataaaattaattgattttgataggtaattaaattttaaggatgcatgctaaggttcgatttctaattggatatacgaaaagagatttattaagagaaaacctatttggtaatctttaattttttttaaaaatattattctttaattatttataagagaatatccttattatatacaaaacaatcttcaattcaaaattttgagatctcttttattggaattaataaatagtcatgtaaatacacacacaaagtatataacattctacattggcagcatacaatattttacattagctactctaataaatatatttaacatacatcaaattatgtaggtgatattaaaatcacacataatacgcatattttaaaatgaaatttcgcatatatccaatattctcttggttgagttggttttacacctgtatatatacttcacacagttcacacaaacaaattaaataaaaaatttcagaaaaaaaataaataatacacatatatgtataaaaccgtgtatggcgtgggaacataactagatattactattacttttccagctgaagcatgtctacatttagtttattatcttacttttttttgaagtgagtttattatcttactattatattatgtattttgttgcatcactaatttcatccttgagtgctatagtctacgattacaagcgtatggcccgggattcgcgtttctcttaagtcttaacttccacgaatgtagaaatgagatttgaaattgaaatacatgaaataattagcaacctctttagactttatatagcataattattttttaccaagatgatcctaaaatcaggttacgtagggcaacaacgtcgacccaatataatagataggaaaataaaggtagaagacagaatattttgtatattccactacttaaacaaggcttcccccccataaagaaaccgtattgatcagttcacgtataataatgaaaatataagaggatcttcttggccctccctatgctgccaatgtagaatgttatatatctttgcgtgtgtaattacatgagtttcccatgttgaatatcatgtgttttacatactatgcatatttatgacatgttcagggacgaattcccaagggcccgtcgtcttcccctccaaatttcattttttgacgcaatttaattgtattcctccaaatttctttcaaaaaacttaatataatacaataatttaattatttatcagaaaaatatcgtatattaattattaaactttagatttaattttattggcaaaatgttaatttaattaataaaaataaaattttaatttagatattatagactttgttttggataatttaaaagaggaaaatcccaataaacatt

SEQ ID NO: 61 - DNA, 2164 bp, Glycine max
  Soy_ogl_2266 Gm07:7921501..7923664 Cluster 1
atactaaaagttagatatatttattcttgaaaaatcttaatccgacttaattaatatcaaaataaatatatatgctaaatattattatactaaaataaaaaaattaaggaatctgcttgttggaaatggcagatatacagttctatgacgaagatcttggtcagaccttgatatctaattgtggaacaagatgttggggtgcacctgcaagcattatgatgcctaagttagtgtttgagagaaaagagtggaatgagaataagattagagttgagttcatatacccaggtgcttatttatatgcttgaatctgggcaacgaattagttaggcagttacttacatatatatgtttttcagtacaaatctacatatcggataaagtattctttatatttttaattaatattttttttcttaaaaaaagtgatgatatgataaatatataggattataggtcatatcccaaagcctaaaatcaattattttatgtaaaaaaattatttttatttataaataaaattattacccaaatatatagtaaacaaagaccgtgaataaatatattaaagtctctcaacatataaccctgctatgatcaaacaatatatcctactaaaatgctagtagggccaatctataaaaaccaaaagaaagatgttagtgggggagaggaaacgtgctcaaatccaaaaagagacgagatggatgcattatcttgaggaatcattgctcatatgttggctcttttcttgctttgatattatatgaacataatatttttattttgattatgatgaataagaaatcaataatatgggatatatgataggttaagggacaaaagaagataaagatgggaaagaattaaggggttgttaaggatggaattaagaaaaattcatggggcaggcaataattagtagggaacacttttggtggtcctgttttggattgtaccactggaaaagggaacccttgatgctgatagtctgcaatgtttgtgtgcagtgcaggctgcaagctaaggttggaacttactcactgcttatgagtattcgtcttctttcaaaggcttaagattctgtgtataataagcttaccaacactcttactcggtcggaataaaacacaccaacatatctttatcttaataccgtaactaactttctcctttatatatagctaaatttgtcattttcaattaaaatctaaatcatttgcggtttatctcttttctagaaatatttttgtaccagctagcaaggggttttgtctaaacaataaattaattaagtcctctatactatgtataactagtgtacgttacttgcattatatgtctgtctgtgttatatttaaaaaaaaaaacttttaataataaggaatagtcaaaagtacatgatcgatcgcaataagaagatagtcaagctcacgaccacagatagttttaagatttattcagcaaaaaaaaaaaagatggtttagagatttgaatcttaaattttgtagcctgaggagggctttgcctaactacttaccaccccgattagagaattaatcttataaatttttctataaggatttcctgtcaaagacctaacaaataataataataattattattattataaaaattgacatagtcaagtaagctaataattgtttaaaactcaatagttgattcaataagaaatatattacatttcttcaaaaaaaatattatataagttattaaatgaatcttaagtctaacaacactaatgtaacttaatttttctctctcacacagcatatgtgtgtaatttcttttaatcactacactctctaaagtttatagatgaaagtgaaaaatgttctaacaatggtttaaattgtggttaataacaacaccaaattttttttggttaatgtgcctaaacccacgagtaaatcaagcaataagggatgaaggagtttagtgatttaaaaaaacaaagtatagaggcgtaggttggcaacgtgcagataaggaagtaaagtggaatttatcctatatgtgtgtatcttcatttttcataaaatgaagcttaaagtattttttttaatcaaaatgcattaacagggtaaaaacattatgttatcattcaatcataaatgattttttttttgcaataattacttta

SEQ ID NO: 62 - DNA, 2800 bp, Glycine max
  Soy_ogl_2562 Gm08:8445901..8448700 Cluster 1
atatatttctcaaatttacataactattcactaacatatgcacacgcttaaaccgcccaaattgaacataataattaaaaaccttcaccgtttcgagttgatttctcataatgtaaatatcaaaatgtcaattctcgtctttgttataagttttgaaaattatttttgagaaagttataacttctatttatactataaacatgtttgtttcaaatcatataaaatcggttccttatatgtgaatttaaaaatgtaacattttcatgtttgatataaattataaaacaaaattaggcgtgaattattttcaaaagtatgtattttatatatttctcctttttctatttatatgtgaaggtgttgaaatcctatattcccatgaaatagaagttttttttgacataactttcagttcgatcatcttattttaccttttttttattaatattttcatttttgaatgaaaataaattttaaaatattacaaagaatgataagtatttatcaaacatttttttatggggataacattcttaaaaaatatcattttcaggaatataatttattctataaaacaaatgtctccataatttccctacgttttcatttccttggaaaggggtgatatcttttatggggatactcgaaaaattgttttaaacacacatgtaaccatttttttttatttctatttaaattttaaaattctttcaaaaatatcaatatgtttttaaatatgcttagaaataagattttgagttataatatttctgagaatctaatttctgaaaaatataatatcatcccttgacatgaaaaaaagacactaaattatatatctatttaaaatattttgtaacacttctctaattaaaataagtcataccttatgtatccttactttcattttttacttgttaagatttatttttttaatcagaatttgttaagtattcgcaagaattcttttcacgacttcaatataattaaaaatataaaaaataaataaaatttaaagaaattatcacttaataactgtaatagaagaattttaatatcagatataaataaaaatatagatataaaagttacttaaaaaaatcacaaatagattgaggtgcaatcaactgtacaatacatcggtattattttcctcctatattatctccattttttagattaacaacattcaaataagattgtaccttttttctatctcgggctcaaggtaagattagtttttttttttttttatcaacaagtgttagttgttagtttgtattagtgaaagttttaaattcacaattttttcttttttttttccttaataaccaaactaatttctatgtaagagggaaagaaaccatttagataagtaacgtgtagttttattttgacatgtagattatatttcaaacagttgacaaataccatttgcccacattattaacatcagttaagtcctccttaaattggtaaaaaaaagagttctccttaaaataataataattaagtccacttttttataactatttaaaaagttgtttttaatagttatagaaaaaccatttctataagttacatcttttattattcttaaaagttgttatacctaatcctttatatgtaaactctttttgacatgtagactatatacttcttactgttgacaaatacctgctatttttttaaaaaagaaaacagttgacaagtaccatttgatccactttattaacatgtttaagttaacttgtattttttataattatgatgatccttatggttaatatacttctaaaatctacatcactattcagtagcatgctgctacacggtttaaaaattaaaacaacccaaattgcatcctgacaaacaataaagaacatatcaataaaacaccttcatcattttcttaaaaaaaaaaatcaccattattattatgagttgaaaaacaaagcactaagttagatatctataataatcaatcataacatgaaaaaaaagtaattgaatctctaacatccagtttacttaaaaatctcattaacaaatcttatttatttatttatttacatgagaaaaggaaagaaatagttgtttatttctttcatttgaatagttttatcattcaaattttatttttgtattataccttttgcaatatttttttacaatattttttttataaaaagattgtaaaaaaaatcttacaaaaattacaatacaatagtttatatattaacaatatttttttagtccttatgttagaatttaaagactaaaaaaatgaaaaattttatttgaagagaaagactaaaaataatatttttcaaaattgagaatataaatttttatttaaagactaaaaaaaattagtaatttgagagactaaaaaaatcaactacttgataaacgtttttttgtgccttgtagggtgcttccgaatatatggaatttcaatttgagacttcgaaatctttaaaaatatttatctttttattaaaatatactatagtttgctatatatctctatcttttggtttatcctctctgtcggacattttcaagtcagcgattcagcaacgttaacttataacaatatattgtttgtattcttgtgttgtgttcatacttcttgacgttagtgttacaaacaaataatttggataatctctttatcgaattcttatgtcctcactgattgcgaacagtttgattgttaatttgcacatttactttgaacgtagtgctaaagtaaactaataaagccgccgccttttgagtatattgtttgtagtta

SEQ ID NO: 63 - DNA, 3100 bp, Glycine max
  Soy_ogl_2681 Gm08:14326701..14329800 Cluster 1
acgtggtcttcatgattttaaagacttgttctccgttaattactagctatattttcctggtcttgctcttttttgtttttgccttcctttttctttttttccccataaaataacccattaatcccttatataaacagaaatagaacaatcaagacattgccattatatactgatttattgaagtttttaatacaaactagtagactttatcaaacattctagctagcttgaaaaaagtgggactactatttaaccttaactaattcctccataaactttagtatatcaccaatttgagtgaattgaaattcaaatgacaaatttattgttccctataacttcgtcattcacttctatggtttgataaattacagttcagttgttgatcggattaatttcagctgtaattagctggagttgattcatttagattttagttgaagaaaaatgggaaggggaattaatattgttgtcttacatttgtttgagaagttttaatgcgcttctggcttttgtttaagaaaataataataatgtgttccagactttaagcacacctctggatataccactatgtcaagttgtattgggcattttttgtcaagtttttttttctaggataatatttatcatcaatatgaaattctttttctctcactttttaacaatttgaaagcaactttttcttcaatatttgttggtcgctattattgtaaaaaataatttggttactaatataatttattctaacttggtatttttttaaaaaaatacaagtaatgggatatttggaaatttaggtcttaaaaagtaatattagttttatttttgtaaatatatttttagttgaatatttttgcagccacactaaagaatttatttaatttctttcggatttaattcttttgaaatatagaatgcaatttaaatgataaaaaataattattagaataacaagattttccaaaaaaaaaaacaagaataataagttgttgatttaaatgatactaaatttgattctttaaataagatattgaatttgaattttataaataaaaaaaatataatttaaaatttaaatttttaaaaaaaataaatgatcaataaaattcatggatcctacacacctatgttataggaacaaatgctatatatattaccttctctctctaatcattctatttaaatagagtaataagcttaattaattataactatttattcaagaactaagattatgaagtatgaaccgaacatacatgtactggataaggaatatgaaaggtacttcatatttgattacctaataacatcataataaatttctcttggaccctcacccttttaggataataaaatttaggagagaaatcgaaccgcatataatatatatgccacgattatttctcaactaatattccaatgcattattaattgtggcttaagattcttgaacaatgatgtatgcatttgcacattaaaacctttcctttttatctaaactgtaggatagccagtagctgtctgtccaagttcgtcctagtgcatgtattaggagaaagtcagcatgtaatacctaaattaagtatataatgtatattttctatcaatgtctttctcaatgaactggtgattagtagtgaatattgtgtagacgttgaaacatatacattgtattcaatggatatggatcctctagggttaaaaaataaaccttacccggagtacttttgattacatggtactcccggagtactgattaataacacatagttatttgtaacttttttataatacacatttattgtcttaatgtcaagatctcactgtttagaaaaactataaaagatgatagacatccaatgttatttcacatcttaagagaaagagagaaaaatacaaggtatcataagtcttgtaatttaataagaaaaaagagataaaaaagaataaaaaccaatcagatatttgtaatatataggtgcttatatattattatcttttaaaaagtaatcgttgagaatttaaattcgtatccgtgtgggatgtacgatttttttttacatgtatcttttttttaagtgtttgacatgtatctatatttatgttataagggcatatatctggtaagaataccttgtttacataaaattataaatatattattttatatatgatcatataattataaatttatttaataatattgattgtttagtatatattatttttacataattcatgtgacttgaccgttgatgaaaaatacatgaaagaaactaaatctatactaataataaacaaaatagtcatgtaattatatgaccattgtttaataaattgtgtttactattcatttcgaacattgcttgtggtgaaggacatgtaatctttacataaataatgattctaatttataatgtaaaacataaagtagaaatacgtacaatttcttttttaaatgtggctgtggcgaagtattcattgataatttgcatagaaaaaattaattatttttttgtgacatctcttttgatcaattttttctatccatgatgtggtttaatattatgtactaatgtttttttcatatagttttatatgttttgtttatatttgagaacaaactaaaataaaaataaattaaagtgatatattactaataataatgcatatttaattttagataaaataagttaaaaattaaaacttttaaaattaaggataacactaaaaacatatcaacagatcgttgttgatacaagtaaaattaattaagctcaattccctaaacattatgcaatgccatcatgcatgccacggtgatcataatccaaaaattataaaaatatattatttaaacaagacatcataaattgcatggaaatagattaaataaattgttagtatgaattgctaaaatttaaaatatattaaataaattatattactcttaaaatccactcttgctttttaaaaatatattgtcaatttaataaagtacaccaaagctcaaacttaaattgaaattgaatttaagtaataatgtttgaaatagaaaatattatataaataaaataatactcattataaaaatata

SEQ ID NO: 64 - DNA, 2590 bp, Glycine max
  Soy_ogl_2682 Gm08:14352111..14354700 Cluster 1
acactaaaactaattatgaacttggtttgtaagaaaaaaactatttataatcttaattgttactgatattttaatcaatgattgtaagtgtattacatttaatctaaagtatatttttattttattttaaaggagccaaattattttaaaggtgtctatatttaatactaactgaattttttttaaataggattgtattcagaaaaggatattaaatatataataatagattatggaaaaaagtactctattaattgtttttagggattattagttgcattgaataataacgctacaatcaattagtattcaatatgaacattcactaaaaacatgcagagtgtttttaaaattttgataaaattaattttaaacaatcaagtatatatgattaaaatgaatgtttaaattaattttaatgtaaaatatatgccacaatataaacaaaatatataattttaataaatcaacagtcgatctctaattgtttaacttacataatcggttgtcatatttgtagtacaatttgaagtgattgattattgtcatattttcctatgggtgtaaatgttgagcgttacgtgtttctttgttatttgacttggatttatgctaaaaaatcaacaaattcttgaggcgaagttatgaacagcgcatcactcgaaaatgctgagtaaacgtaactcataatcactttatattgtttccacagattgacactgactaatttgaatattgggagagatatgcatgatgtaaactttcaattaagtttcaagctaccgaactttgctggaaaaaaataaaggttcaagcttgctacctagcttcctgacctcagtaaagtatattatatgtgcatatgtgatataggtaaactgaattgaccttgtaataatttgtaacagtatggtagttgttcggatctgaagaataatgaatgggtgtgtcagtgaagtgaagtgatgtgataatgggccttgcagtcttgcctgtcattaattttggttgttgctgcttttattgtttctttaactatcacaactgcactcatggatcagttccagtagcaactggcaacattgacaacaccttaccagcgtagctatatgaattagaaagtaaaaacattttatgcatgttggagctacactcccacgtacccttgccattaaaagttttatatattgacaaactttctcacattcacataaagctcaacctcttcttacaccatagaagaaggtattaccatatatgtcaaaactaactgattaaaacaatattgatacatatatgtaatagaggagactaaaaattttataattaattaaaattaaatttaatgctagcaaaactaagtgtgttcttacccacattaatcttttttatgagatttctaattataaagattaaattaccatcacttgtttattttttggtggcttaataaaatctcacatctctcgatgttttaaataataatttttactgtaggggttctagtcattggatcagttgaatttattattgatcccacgtaataaatatctatcttttaatctattgttttattatattattttttgatttatattccaaagaaatatttacttaaagtgatatttcaacggataagcatcataaccaaccatctcgtgagtaataaattttaacttaatacttatttggttgatctctaagtaacacatcacaactaaatgtaataacataacttatagtaaattttatctcataagaataagagattcatttaacatacaccatgtaaataccatgatctatggtatttttttcttaaggaaatcaactgtgcctcttaagtatctcattatgcaaattttgtaataaaaaagaccaacacttgtcactacaaccaagtaaaattaattactcgattgcttactgttcacaaagtctcccatgtctaattatgtcacaaaagatagttaatttcaagagaagaaaatagataattcacatatcaaatataaaatcactatttaattttatttattaatatttaaatttattattaattaaaaactaaaatatgttttttcctataaatatgtcaaagtcaattttttttgtaaacttttcatcccaataaaattagaatatactattttttttttggacgagtctaaatcgtctaatgacccagcatacaaaaactttagtatattcataacaactgaaaccatatttttagcttctatttaaattacgagttgagtattgtgctgcatgcgtttttctactactcgagaaacaaaattgactacgctgcctgtgttagatgtagcactattaagtggagggtgctacttttatagcagttgtaaaaaaaaatccaggcaatagaggaaccagcacaatgtcacgtgtgagcatgttgttcgctgattggcatttgtttcggctgtattaccatattcttttcgggggcgttacaacgttcaattacccggaatgctatgcctaagaatattattctaggatagataattatttttattgttaaacgtagagtcctcataaattttaaaacatgaaaatttaaatt

SEQ ID NO: 65 - DNA, 2433 bp, Glycine max
  Soy_ogl_2694 Gm08:14939168..14941600 Cluster 1
ccatgcatcaaagtggaagaaactcgtcattaaagctcagatcatgcagttctactccatcttcctggttttggaccttcaatgtcattttttatgcttctcttcttgttttgttttgtcgactttcacaagacgacttatggtgcatccttcaagaaaagtaatgtctctgttaaacctaatttcaagccctttttttgttctgatcacactcacaagtgatctgtattattaccaaaaattttgtatttctcaaattgtctttgtattaattaatattttactaaactatctttaattattttacaataaatattatcatattaagatttttgtgtttttgtcttcaattggtatataatgagtttagttatcacaatcttacttatacaatgtatttgtttttgtagcttttgcttgctagtttttatgatattgttttatctacattgtacctttgccataatggataaaaggagaaagagttgctcccacttgtatacctttctttttttaatattaataagtgtaagataatttaaacgtatttagtgaaattaaatattttctccctttttgttttcttccttcatttatcaataagaattttttacatagttttaatatcaatatggtaatcttataaagtcatagtacgtataattgaaaatacataaataaataaataatatattaataaaatatgataaattaaaacaataacttcaaaattttaaaatacaataacatacccgtgccatcgcacaggttataactactaaattaatagaataatttatttttttctcttataagaattaaaggaaatgaccgatatatattaattaattaggtgaaaaataaataagtaaaaagtgtgatgataaacctaatagttttaaggacaatgttaaaaaattaatactcctaatattaattagtactattaattaaatcaactaaattagttaaaaagtgttatatttaaagacggatgtagtaaaatttacattaaagaacaggagagatatatgttgggcaaattgttgaaatatttttcttttgttatgtgttgaaagaattgtgttaatagaacctaaaaatttcttggaaaagagtctctgctttcaaagcataaccaataaaaaaaagtaaatagttaaaactttatttgtggcaattgataagtgttagtttttaatcctaaaacatgtctaaatataaagctagctagcatgtccacacgaggtcagggaggagggagagagttctttggagatggagtctgaatttgtttggttggagtgtggaagtgaaaaatgaagcaagagaaaagggatataattgatgtaaaatatttttttatattggttataatttttattaatataaaattaatttttttacctcaattaaattacaaacaatataaaaactttagtgttcttttttgataagttataaaaatattattgttttattttcttgtctatcaataaaaatttgattgttctgtcaatataaaattatcatcatgttttttttacattcgattatttaacaaacaatgtaaaatcagaaattaacccgctgttaaatccctttttgcactggtgaatgaaatttctttcttattcatttttctttgattaattgaaaatatcacgtgcttattagtcagattttacgaaaaaaatccattcttactgtttagcgctatgttttttaaaggttgtttaatctaataaaaaccgtcaaatttaataaaacagtttttttttatgtatctaatttttcaatacacacttaccaaatttcacaagatataaaagaaagtatttccaaataaggtaaattattgatacttgtctattttgaaaaaaaaaatatagagccacataacaatttggatacaaattatacatttgaagtgggagagaaagaaagacaaaaagagggagaaagcaaaagagtaaagtaaagaagcattgcaaggagaaacacagtgtatgatttttctttttgaattttatgtattcatgtaattatcattgacttaagtgttactacttacttgctcaatcactgttaccttggaatgctattctaataatatatcatttttctatcaccttaattgtttttaggttatgaagatagtcttctaacatatttcttcccattagttgttttagttggagaacaaagcagtcactcatggtgaagaaaggtccatgttttcattacaaaattaattgtaagtcctctatctctttctgtggttgttgagaattttgttagattttattttatatcatattttaaaatattttctcaatcaaatcaagtgatgaatgggtaaatacattgtttctcttaaaaaaattgaaaataaaagggatttaaaaaaaatattaagttgaaaaaagttaa

SEQ ID NO: 66 - DNA, 2792 bp, Glycine max
  Soy_ogl_2944 Gm09:2142409..2600 Cluster 1
agagtgtttctttctttgatttatatgtcacctggcatctctaaattcattatattgtacgtacaaaaatattctattttagtattcaatctattctattaggctattgttaaatgtttgacttaaaaatattcttatttccttttttaaatataaaatattaatataaacaataagaatgaaaaataattcagtttcatttcgtctaatattattcattaattatgttgttaaaaatattttattttcatattcaatctattctatgaggccattgttaaacgtttggcatacaaatattcctattatcatttttaaagatataaaatatccatataaataataaaagtgacaaataattcataataataaacatgatcctaatcaataatattagttaattcaaaattaaaaaataactcagaataaaaattaataattattagattttctgattaataggtgactattttttaaaaattatcactccgcataagataaatatatatattttccataaatataaatttagtttattttattttatattatcaatctatttgcatacgattttctctttgtttgtagctgatatattttagatcctttaagatttgataaaaaaacactttcattcttacgttttaaaacaataattttaatttggataaaaaaattaattgattgatcgccattataattattttcattgttaaatatataaactattattgtttatataacagaaatataagagaatcatcatatcacgtaaaaattaatgtatcatgcaaattatttatcaaatattgataaataattatatttctacgttagaaatttttttatacatgcgttagaaaaaatatatcaaattagaaaatttagtatacgggaataattatatacctatgttagaaaatatgtatcaattttttaaataataatatagaattttataacattaaatactgatagactgattatattaaatattgataaatagtagaatatatacggaaaaccgtaaaatatcacaaaaaaattgtatcttacaaaaaaaatgtataatgagtaaattaattatacatgtaaattatagaaaatcatgataattaataaaaaaattatcataactataatacattaaataaattgattatcatataatataaatttttacaatcaaggtaataaatcaattcaatcttgaattattatttatttattaatttttcttttaatacataattcaaattataattatttttaaatagaagatgtctcaactaataattaataaaataggaattattacaatgaatagatgaattgaataatactatttagtaattttgaaaaaaataatatgagatcatcagctagtatcacccatagaatcaaactttattttatatatatatatagatagtagtgtattttaaacatcatactaaaaaatcaccaagttcagtacttcaactcaaatgaaatttaatcaaataaattccaattcaacaagacatattaaattaatcagagcatgtttagatgaagtatttaacactaaaacaattcagtaattcctttattcaaacataaccaaattaataattttgataatatatccaaatatactccgctttgtcggaaagaagttcctatggtcccaactaaaacaagcatagaaaaccatataggattcattaggatataaacaagcagtttttttagtgccaaaatagttaatataaaaaaaagacaagttatgtttttgaccttttgattaatgtaatttgatatatcttcccccataaaaacaagtcatttcattatttttcattctcaataaagctaagaaaaaaaatttcattttttaatttctgttttacttctttcttccccataaagatactgaatagaaattttaaaaataaaaaatttcaatttaaacattcttagaatttaatttttttaatcacatatcatgaaataaattccatgatagaaaagctagcaaaaccctgatactaatttatccaaagaattaaatttcttaaaatatatcaaataatttaaattccttaaatgagaaaaattagatcgttaaaataggtgtttctttttgcaccttatataaatcaacaacaacaacatccttgagtggatctagagtttgttacaccaacttctatagcgtacccagaactcaccgcgtgttgttcttcaatccctttactcaggagattatcaaactaccaaatagttgccttctcttgtgctccaacgtcatctgactgtgttgtgtttactgttaagcatgttagtcctaccgttatggccatcagcacatgttaccccggggcaacagaatggaccactgctagtttcttgtcttctcatgcaaggactgacctccatatatggaataatgagaaacagtgtcttcttctctaattaaagttcgtttttatggaaagcgttgcatatcattctctcttggtggctatagatactatcctcctaagcagtggcatgactggggagaacaagacccttttgaaaacatatggattgaaccgccaaaagatttctctgggttcacatgaagaattttagtgaaacaagtaagcattcccaaatcactatttgttatgacttattttttaactcttattataactgctggatatatgctttcgttgccaaataacaaggcatagtaagcttgttgctcttctttattaagtaattctgtatagttgaatttttcatcaatgctattgatgttt

SEQ ID NO: 67 - DNA, 2129 bp, Glycine max
  Soy_ogl_3211 Gm09:39882772..39884900 Cluster 1
tcaaaaccaaattattataattttattaattaattaaatttttgaaaaaaaaaatattcataacataaattatcagtgaatttatatataatgatgtacaaattaattcagcaaaaaaaatctacaaatcattaattttgtggtaatattatattgaacagatcacctaacaatcagatatttgaattgaaataaatgaccattaattcaaaaaaatgaaatatattctatttgcagtttttcaattcatatttattttaaatgaatttgttgtatagagcttacgagcaagccatgtgtaaatttcattttaagattatttttatatgaatataatatagatagataaattgatactgtgacatcatttttagtgaaagtgttataaattatttaaaaaagtagacaattattaaaaatatgatttctatcaatcaattattaagaatcgttataattatatttatagattatgaatttttttataggttgtacaatttataataataatcatgacaaaattacaatagaaatagaaatataatacaattataaatgtttaaggtaatatatttttatgaattaaaaaaataaaaaatattatcaatagaggtgttattatttcaaaaccaaattactataatttcacaattattccatcaataaaaaagaaataaaacatattatatgtgtagttttccatatttaatttaatttaaattaaatgaatttattgtgtaaggcttatgaggaagccacatgaaaaattcctttttaagattatttttgtatgtatatagtataaatatattttatatagagaaagatgtctatgcaccgtatgtaaaaggctttacacaagtaattaattaatcacattaaccacagtttgttacattacaataattctttaattaaatcaaacaataaataattttaaaaaggaaacaaagcaagaataagaaaacaatcaaaataatcacacattttttttcgcattcacgaagactcactctctacataaccatcacacccacatttctattctcaacatgtcttatcttcatgattctctcaccttggtgttgttgcagcacccacaattttgttcaagcaccctcttgttttcatgactcactcattgtggtgttgttgcagcatcgcaccgacggtcatttacatgcactttccattgttgttcggccttgcacaccaatattgcattcattatagatttgaacaataatttcatctcgtactttgtcaattgcttctttattcttttattttctttgttgttggtgtacattctcttttatatgatttctataataatgcaatggggggatttttagagctatgtgtgattattttaattgtttcttgattcttgttttgttttctttttaaaattatttattatttgatttaattaaagaactattgtatgatatggcaaattgtgattggttgtttgtgtaaagccttttacaccaatggtgcgcaaacatctttctcttttatatattccattttgaaaaatatttggttttaattttttgtgtggagcacaaatatccttcataaaaaataattttggttatgtataatactccgacagctttctaagtttctaatttcgttttctggcgctgctcctcaattttcataatttcacaagacagcaagtgttgccctgaacgttggactcataaggtctatgtgaagggtatagttgtctttcaagagaggattatgaggatgaattttccaaaagcttgtatcatttgaaagacaggctttaaaagaattaatgagtacttaggaagggtatacaagattcttacttaggagtaacactgaatttagcattttgaaagaattaagagtacttcggtatattgtactggaatatatatatatatatattaatttaaacaaaactttaaaagcagtctttaattgaatttgtgtattttaaatatatgaattaaatttatttggaacaaaatcttctcatgtgacacttctctcatgtgaaatctcagcctttaattaataagagataaattttaaatattaaaaaaagacacaagattttaatggtaatgagaacatctaagtaagaa

SEQ ID NO: 68 - DNA, 1833 bp, Glycine max
  Soy_ogl_3219 Gm09:40188742..40190574 Cluster 1
ttttatattaatttttaaagaaattatcttatataagaacaatatctattcttttatgagaaaaaaaaattgacatagacaaataaaaaaaaatgatgtagaggcgattgtgtctatactctaataggtggattcaccggtgctcatgagctaacacgattcattttggtttacaagcgaaatggattccaaaaaagaaaaattacgttttctgagttaatttaactctattcactcgatttgtggattaagactagtcatttaagtgagtcaaattgatccatattaatatgttttttttattttttaaagtatattttttctcttttatttagcttttaaactttattgataatgttatgaatgaaatgagaaggaagaaaatgaaaagaggaatgaaaattaaagttatttggttgagataaaagaggatgtaaaaaatatgaaatggtttaattaaagtagctagatgataggaaagagaaaattgaattgtgtaataaataattgaattaatatcttttaaatattttatttgttactagtcattcaaaaatattaaaaaaaaaagatactaaagatgttattggcaatcttaaattgcaaaaaaaaaaatacatattttttagcgagtttaataaactatcacaaaatgatattttgaatagttagaaaataataaaaatatctttatcacacattttctaactgtttaaaccgctacaaaaataattgccacaaaatgtcatttccaccccacaatttcagttcaatttttctattttatgatgaaagttaacattgtgggttatatcaccttttctcttggtttcaacctctttcatcacaaacaaacaatcttactttttcattctccacatgtttcatccatctctctttcataataccataccaagtcttaatttctctttaaaaaaaatatatgttgcactgaactactggtcaaaattatagtttgacctgatatttgatgataaaaaaatagacccttgtcaataaaatcttttaaaatagacccactcattttgaaaattaatttataaaagatgctcaaatgggttaattagtccatttttacagtcttccatgcaactttgagttgaaattaacaatgtcattatttctttgcacttcttcatatatttttctgctaccaaactatgcatgaacttcaatatccatccgcttcattgctcttccacccttcccccgtacacttcaatgcaaccatacaaacgaaaagtaaagggaaaaaaatcctttcattcagacatacttttataagaaaaaggtaaatattaagacattaattaaaaaattaaaatataaatatttttattagaaataaaatattctccattgacttaaataaaaatgattttttcttttgattcttaaatcaatattcttaatatactgattaacaagatcttaagaaaaaaaataaatcacttattttattattttctaataattccacgctgtttcttccaatccaaataaatgtttagtgttctagagtgtcttaaatatgttccattgtcttttaaaaatgatatttatgatgaacaataatttttttatctcaccttctttcaaacaaaataaggtaaaaaataattttatttgtttaaggatatgtttgaatacaagttaatttttttgagaattttttttataaaaaatagagtttttctcatagagaaaatttcaagatttcttttagtttgtatccatacatgttccaaataataaacatatttttttattttaatttaattttttaaatttactttgtctatgcagcatggt

SEQ ID NO: 69 - DNA, 3949 bp, Glycine max
  Soy_ogl_3240 Gm09:40616433..40620381 Cluster 1
taatttacacagatcatgggcttcacggattgatctgtgagctcaaacccatataccctcttcatttgtcatgtcaacaagttaatcccatgttatcacttagatgctaagttagtaattttcattataaaattggccacaaataatggtggatcaaaattgctaaaatttaaaaaatgtaatgtatcaaatgtgtaataaaaattttagggactaaaattgtataatcataaaactataggaatcaaaaataaatttaatcttatctaaaaaaagaagttgagaggtaagaaatttatttatttttatctaaataaatatatttaaaatgaatatgaaatttagttgaaataaatacattttcatatattttaaatttctttaaatttgaaaataccttagcctgaaatgaattaatcatattaaaagatttatagcctataaaaaaagagaacttgaccaagcctttcttttggtcttaccaacctagatcttcatccaactatcaaagacaattatagtgacattaaacgatcttgtgtgagtcacaagtcccttaaaatatgattttggtttcagagaatactttttctttatttgtactttatctttatatttatttatttttttgaactttggctagcatttgctataaaaaatagtaacgtgtaagattgtatagtctcctttgggctgatgccatccatccattggtacacttttatttattgtctgtttttccccttcaaccaagaaaacggtaaatcaattaggtatgataataataagggtgaatttatacgctgcagaatgtatagtaccccatacaccagctaggtgttagtacatcaagtattgtcaatttttttgtgtttccctgtacatatgggaaaatgctctttaattcctttggttttggattcaatgaagagagcgtctttcctttatgttagggtctacattggttggttaatatgggcttatgtatttgactggttatgcaacatttaccagaatctttcaggtcttgaagagaaagagagtggaaatggaaagaaatgaacaataaattaacgtgtgattcttatttttacattttaattcaaatttttcatcttaattcactttcttttcatttctttccacactactgaatgaatccttaaatgcataataagctgtcggcggggatactttttgatcttgttgttctcgtgttcttctagtaccccattaatacaatttgtgtttcgctgataaaaaaaaatcaagtattgtctgatgcaggattttaacgtgtaggattgcatagtctcctttagactgatgcgatccatatgcttatacacttttatttattttttccctgtaaccaagaaaaagtacatcaattaggtatgataataataagggtgaataaattttgaatttatacgctgcagcatgtacagtaccacgtacatcagttaggtttgacaataacgaaggtgtaatatgggggtgaagcgggagtggctttgtacttattgttcaaaccacatcaattaaaatggctgcattgtatttgtatattcatgtaaagatagctcaatgtaaattaaacataataacagatgactttgggctccaacatagtcaactttgtgcatgtttggattgaagtcagaaatattgtgtgcatgtttcaacttaaatctagcatgtaaaaataagaatcttgatcctttaataaaattatttttgcctcaaaaatatttttccatctgatttttaaacatgcacttcttagagccaacaaacataaatgacacacagcaactaaaagtgaaaggacgtttatccgtgtaatctatgaaaatccgattctctgatccgtgcatattcacttgtgagtaatgcatgaggtactgccttctgcattcttatctgtcattcaatttggacttagaaattttaatgtgtttggtagagtagactgtagagagtaaaactccgcctgtgtcttttcaattcttatctttgcatattcacatgtgagtaatgcatgatgcactgcctttgaataagagtccttatagaagttgtttatgatctttggagagtattcaaactcagtcacagtgtacatgagtttgtctcattcatacaactgtacattaagcttttctctattaaatttgaacttgtgacagtcggtgttagttggttccttaatgattcaccttatggtggcttttaaatcttgtcataggtgttgtttctaaagacggataattgtaggatgcttcttgtaatagcttctgaagactttgcttagcagttctatgcttttagttggacctgttgggttacaagtgtgaaataaaatctcacatcgagtacaagtaaaaaggttaaacattattaaatttcctacaacaaataaagacataattaacattttctttttgttctgccaaatgtgaagacataacattatattggttgtttcgaacaattagctaattaagacctcctattgactttgattgtcacctgtatatctcgacttttgactcagaaacatccgtattggactagtccaattttagtgtttacatcattattacgattaggtgaatataaattataagatcaatttgtaaagaatagatatgagcggggcttttcctatatataaaaaaaggtatgagcgggacacacctgcatgagttgaaatggtaaaaaaaaaatggagaaaatgaaaaaaataattaaaatgttaacttgattgtaaaataagtttaattttatatattttctcatttcccttgcttttaacttttaaggtatgacttttttataactactttaaaaatcatccttaatatactttttaaaatagttattataaaatttgataaatatattatataaatttaaatatgttttttatatctctaaaatatgtagtttttagattattacctttttttttcttttaactttctaataggaaccttactaagaaatctatccaaatttaatgaaaaagcaagattgataatgttttgaaaagatattcctgtctgacataaattaagatgccacctagctcactgttgatagccaatttcttagattcaacagttcagcaaacttaatgaaaaagcaagattgataatgttttgaaaagatattcctgtctgacataaattaagatgccacctagctcactgttgatagccaatttcttagattcaacagttcagcatttaaattcagcatataaactcaaggccaaattccaactctggtctatcagcagcagcaattagtcttatgcattgtaattataaatggatatttccttatgcattgtaattagtcttactaatattgtgtacggattgagcccaccccaagaactgctgaaacacatccctagaagactgagctgcagtaagaccacaaaatcagtgtattaaatatcctagtcctagttaatttaatctttgttgaaagctaccaatatcactgaaatggatcaactaataataataataagaagaagaagaagaagagagagagaacaaactgatggtggcaaatatagttcctggttgtctctactctttagcaatggtctgtattctctataagcgttaaattgcttaaagaaattcaaactttgttggccatttagtatgaccagagatgataaaaaagggatgatgaactaatgttaattaaaggaatgaagacagtgaaaatacaacaccaagaaaccaacctagcagcttagtgacttaattgtttacctgaaatttactttgagtttctcggccgtctccactactattcatagaaattggtactagtcttctgtctttgtccaatgataaaacttgcatcctttgaggccaatctgaatttaatcttggtgcaaaatcttccaattcattacaag

SEQ ID NO: 70 - DNA, 2462 bp, Glycine max
  Soy_ogl_3319 Gm10:2356639..2359100 Cluster 1
taatattttatgattatttttaattagacactgctagagtatagggaaagttctgtcacatgaatatggcttacagaattctcattgagtgcaggaaaaaagtaaagagaataaaattattttataagaaaaatttaaatcttctaccaattacgatcttagaagtacagattttaattaagggaattaaactatgtttgacaacaaatttaattaccccacgcaaagtcacgaactattttttttctgccaccaagataagatggaccatggccgtgggacagattttgccacgaataacaaataaattatagaaaacgtagaatacggtcctaactcctaatgagagactttttatatgtaagaataacttattaaaaaacgttaaaataattatatttactaaaaagattcgccatgtaagtgatgtaactttatatgaaataaataagtattctgccgttcgagttaattaattaatatatatacatctttataaacaacgtggctgagcttttaagaagacaaaaaaaaatccttttatttacattcaagttcttatgagaatttttttatgcatataaggtttaaaaattcaatataaatgttagatgatgttagaggcagatatactcctataagtaacttacaaatataagcgcgctttaaaaaataattcttaataggaaggcatttgaggaattgtttgtaattttacaaaattttaaaatatcagggaaataataaaataaaaaattattatttttaacaaaatttctgaaactatactattattattgttattaaattaaaatcatagtaataataaaaaatggtaaatcaacatgttccaattgtttaaaaacatctttcaacctaaagtagatggcgttttgaagattgcatcatctttcaacttcatatgcttatgaagtatgaaccaaaactgttcaattaatagttaaggacttgttttttcaagacaaaaaaattattgaaatatatccagtttgagcagaactatctttgcgtaatagatacttaaggtatattaaaaaacaactccttctttgagtacaagagtgtgagtgttcactctagattagtcgtgtaatactttgcattttattgttttcattaaataacttacttgcataattgattaaacgaaaacaataaggaaaattataatacattagttaaatgattttaatgttattttctagttgagtttgagttgtttaattaattgttgtcaatttattaaatgaaaacaataaggaaaattatactcattaaaccttgtggcaaaagggatatcttccatttgaaattttcgtgatactatttggggaggaaaaatgttcacgagactttattagagtgataaaaaaagattaaatatattaatgctacaagataaataaaacaagagggaaaatatgacttaaaacttaaaagccttatagaaattttatttgagttaaaataagggggcatagttttttgtgtaactctaaatacagaggaaataaacatcttaaaaattatccatctcatttatttaaaatgttgaactcacccttcttaccaagcaatttgaaccactttctcaagtataaaatagttcgttaaacagaaaattaggccacatcaaactctttgagcctatggaaagttaatgttaatgacttctaccatcaaccacgttaaaaagtggtccatcactagaccgttgatgtagtttattatcctatgtttattaatatgtaaaccttgcatttattacaaattttactttgtttatattaacttattattccctttgttaagaggataataagaaaaaaattaataaagtataaaaatattaaaaagatatttcgtatgaaaaaatagtttttaggaattttaataaaccacttacatttatagcccataagagaaaaataatgtgaatagtaatagtgatacagaaggttgttatgagcaacctagagagggtcattgttattaaaagctttgacatcaaatgaaaatgaatgtggaagatttggaacacaaagttaaagtatgctaaagctctatttgaataaacaacttacttaataacttatttacacaagtacttatgtataagttgttttagagttaaaaattgtttttatataaattctaaattgtttttataaactattgtggaaaacttattgaaataaactgaaaacagtttatggacataacataaattgttttcataaattccctcacatactcacacaagtatttataatatgagatattccaaatgacccataatttgttagcatggaagtgggacatgctcaaacgaaagtggaatagttatcctttttattattattgtaataaatatattatattgtggtgattcttttgtagaataaagtttatttctttaacaaatagcaaggacaattatt

SEQ ID NO: 71 - DNA, 2800 bp, Glycine max
  Soy_ogl_3690 Gm11:2347401..2350200 Cluster 1
gagaatctcactaattttataaaaaagaagaagagataaataaaatttaaaggtcattatctcaacaactagattcctaaatataaataatgatcccgatattaaaatatcataatattaatgtattagttcttcataaaaaaaagataacattaaaaaatttaaaataacaaaaaagttacggggcaagaccccaattgcatatactgatccattcttacacagttttgcctcttaagtacatagtaagaggtttattctccttatatgcatgaaaaaatatatgtggagataagcgaatctcttaattaaatttgaatatactgatatattactataaaaactcacaatttaaataccatgttaaacaaaatgtttatcatgaatggactaacgctggaaaaaaacatgtcaaagattcaaagaagctgtcaaagtcaatctcgatcaataatttagatgtaatgtatatattaaccaaacaatgtacactaattagtcaaaatttcttctctctgtctactttttctttgatagcacgtctgtgatttcgattttgttaggctataaggaaaatgatagatagttatcattatctagtagacatctaaagatataaagatagagaaatctaaatataattaatgagatatgatgtaataagataaattaaaaaatataaatattaatgaaatgtttggagaaataagatatttttgcatcattacttgggctataaataaataaataacttgaaaacaaaaatttacaacgggtaaagcttcatgcatgatttttttgggaacaagttagacatacaatatttattgaatttaatggctatgtactaatagactaatggtgtatactttcaattaattagaaactatgtttaatgcgagttttagaataattattatcaaagtaaatatttattatacattgaaaatccatatcctattttttcatatttattttataattctctcatttctattatcaattctattgttttggttggttcatattttttatatttagttaacagttttaaaaaatactgagcaacagtgaaaattctattatatttataatatattaaaaattacagttacagtttaagaatatagtgaatgtttaaaagaaattaaaagtaaaataataatatttataatctcgttcttatatatatatataataataattaagttaaaataattataatattgtaaaatgagaaagttaattgtgttcaagtgataaattttaacatataacatctaatactaaactaatttacattatcatttaattacagatcaaaatatataataaatttattaatttttataataattatattaaaagtcttatcaaagataatttataatttagataacagtcatgtaaaatttacgctgtaaatgtatgactatagactttagagataatacaaaatttacctttatcattttccgatttaaacaactagtttctatttctgaggtttattcaataaataacaaactattagatgatattcaataattttagatacccgttttcctctcttcatctttcttgttttttattcggattatcttatcttcgtgacttttcttcatttcttgggttcttctcctttctgtgcactaacaatttatcaaaattagacactttaaatttattacaaaaattatttgactgtacatgtataaacaggctaaaagcatgatttgttaacaataatctctcaattgtataaacgaatactccccatgacgaagaaaatggaaagccaaataaaatagtaaaccaaaagtataagtaacaaatcacgaagttcatcatcattcacaacaatttatttatataactaagaagcattagttatgcacactctttcagatgctgtaagataagataacccttctcactagccaaggtgtggcaaataatggctgttaaaattgcaacccgtgtcctaccagctcaagtcactttcatgctattagtggatgatagctatttgggtcggtctcaccaattatttgtctctctaaacatgcaaaataatatagtttcccttagctgaaattcctcatgtcttggttccactaatgtttaggtgaacattaatatagataatttgcattctttgtggttgtatttggtagacacattaaggaaaagcacttgttatctttattttgtgatcattaatagggtcatcaaagtaacataagattggctgcttcggaaaaaacaaagtcatgtagtattgagtattgacgctagctccacctaatggatggtagaccagtcctaagaagtagcattaataggaagatgaggaccttgtgaattataaattataatgcttccatgcgtagtaggcgaagaccaaaaaggaaacacagaaattcggcaatgttggtgaatatatggacaagtcagaagctatatattaagaattcattaatatgtaggccaatcccggaaaatccaactcatcatctacttattattaatttgtactaatattttaagtaatactaaaattaaatatatagccgaaacctttttgccttgctggtttcattctttcgttaactgatactagtaataacatatactactatgctcgaatgagaattgttttaactacaaattttctggttgaggattatctttattcttgattctccgcaaccacataatttaataacttgtgtacttttcttaaagtgattctacaatttctattttacagctgttggcatacccgtttattttggga

SEQ ID NO: 72 - DNA, 2570 bp, Glycine max
  Soy_ogl_3960 Gm12:728401..730970 Cluster 1
tggtgtggtgactcatttggtatagaacctataccatcaactttccagaccaaaagttggaccaatgataatatcacggttaattttccatctaccaattgaaattacttattttatcttataaataatttactcactttagaaagatctcaactcacattattaatttaagcctttactttaaataagaatatttataaggattttttttttttcgtgcaactttttatttatatattttcttttaaaaaaatattatttgcatcaataaagttactatttaaaattaaaaaaaaactactctacagtcttacactaccaaaatatattatttcaaaatttgaattatatctaccatgtttagaatacaattttttttcttttttattcttacttttcctttttaatatatgttgttaaatgcttgtatataattcaactctaactaagaatattagaataaaaacagaaagaatatacaaaaaatgttttagctgatagtatgatttattgattttattagttgtaataattttattgattatacctaaaaatgatgtgttaggtttgtgtttatttaagagtttttttttaaaaaaagttttaacttattaaatctttctagttgaaaacaataatataagcaggacataacttgacaatataatgctattattttccctcttttctctgtcgtcgggaaacttttatcaaattacatttagggggatattattattttctattttaataatactaaaaccaatcaagttaattttcaagtagacagctgtgtgaattttttccatctcatacaaataaaatttgactttttaaaatgatatttaaacagaaaagtatggacttgtaattgttaattataaagttaacagaatcaaatttaacaactcatgattaacatatacacggtgttttattttaggataaattttattttagtctttgtttaaatcaattaatttggtccatatatcttttttttaaaatgtatctttttgcacattgatgacataggaactaaattcacttatttgatgtatctagttgaaattttatggattaaaattaagtttgacaaaaaaatataaaaataacaagtatattttaccttttattttaaccccagctattaattttaaattaatgtttataactttacactttttaaagtatatttctttttcttttttaaactagtaattggactataaattttgagtgcaaattaaatgaagatttttagttcaatccaacaaagtttgtgtcatatttaggattatgtcgagtcacctatgttgggtttggactatctatttatttctaaaccttgttgagagaaaatgagaccaagagaagttcaagagactaaaattagttactaattgtctcaaacttccatttgtttaacaaagggtttgatatttattttgacaataaatacttataaaaattattgtacatgattccagattatactacctctgtctttaaatataaagttgcttttaaccaattcaaaccctttaaaaatctgattattttaattaggaatattaaatttgttagtaatttgtattatttttttaatattactcttaaaactattggtcttttcagttatttattttatatctaattaattgatgtgtgctagtcatctcctttaaacttataattattcgatttatctcattaatttatattatttattataaagtaattaagaatattttggtaaaaaaaatattgatgcaaaaaataatcttataaaaagaaacgaataaatttaaaaataaatcttaccataaaggtagtattttttagttgcatgtatttaagatgttaggagaattttgaaactttaatttgtttgacataaactactcaccattacaatacatgtattacattttataatttttttttacaaaacattttttactttttcaactacatatatttgtaatgctattggacatttgtaacattaacaactcattcgataaagaattaaatatataactattgttattgtaaattttataaaattataaacgagattatcttataatatataaacatttttttgtatttaaaacaattataatgattgtcatagtacatatcacctttaaaatataatttctatcattttatttattgcactaaaataaacatataaataaaaataactatcattatcacagtgtatttcaatatcaaattttgaataaaagtttttttaacaaaaaggtgatttaactaaaaaatatcaaaacccgcataagttggatatggatatcaaattagaaaactgaatgaaattcaatttattatggcccaaccattataacctgtaacccgtgataaattggataattcattttgacatttctattacatattgtgacactttacttaatctttatgtttaatcacttcacgagcaatattttgttagaaacaataaaataactaactttgatagatcataattgaaatggactaaacatatcacatttgagataactttataatatgaaacaatc

SEQ ID NO: 73 - DNA, 1952 bp, Glycine max
  Soy_ogl_4473 Gm13:36080901..36082852 Cluster 1
aacagaaaatgggaataatatttttggggttttcatcatggttgtagaaactattaatttaagtatcgaaaaaaaagaaacttttaatttaagtgttttgggtatcttttttgtggacgaaggctacgtacggtgagaaagtgtttaggtctttcatcgtggggaaaaccaatcctttaccgttgctataatagaaccgtagagaccaatcacaaagaatcctttcagtgtgatcactggaagcaaaagaacatagtgaatacacttttgtgcgagaaacaaatgaaagatctcaactaaaataaaatgagttacatcaataatcattaaacatctcatagaaacaaatagtcaagaatagtaaaagatgattagaaatgtgaaggggtagtgagggaaaaatggttcgactacaaaattgaaaaatataattaatgagtgtagtggcaacaactgtgtgttaatgtctttgattgctacaaattctcataacggatatgaaaactattatgggcaatcaattgaattacgctaaatattaatacataattaaaaaatttaaacatttttttacataaaaactcctacgagaaattgttgcaaatgactaaatagtattttcttactctgtggtccttattataacttaatttagaaataattgatgatattttttataaaatattttagaatttttatgaagtgtttaatcttttttttattagttgtccttattaaatattttaagtatttgacttttttttattgataatggtatataatatacttgaattttaatgttttcacatcaccttaataattattaataaggtcataattagtacattagtaacattttattaaaatttaataaaatcaattaaagtaattatttttattgatatttgtttgatattcaaagtatcttataacaaggacaaaagaaaatatatgttaagattaagatactttttcgtgcacaagtgtctagataacactttataagtgctattaaatgttatctggaacagaataaaatgatgatgctttttaaaattaagaggctaaaataagataaaaaaaataggaaaactaaaactgaattaaaaaattttagagacattaaaaatatatattacctcttttaaactcgcatggtgcctttcttttaactttactataaaatgttgcaatcgacccaatttgtttctaagtttcaaataaatttgatatataagacctatttgagtaaatttatctagaaacacttatagaaaaatatgattttttttcataaactaaaattaacttatgtataaattaaaaattatctttttgatatgctaatatatatgggaaagcttctataagtcataacattatcgactttattgagtattcatcaattgatactatagttaggcctaattgaattttgttcaaccattagtatcataatttgaccataatcaattatctatgttactctttgatctaattggacatatctcaatcattattacagtttgaccttattgagaattgattaattaataatattacaataactcattattggatagtgttcaatcattaatgtaatgtttgaattttattaggccttagataatcatccttgttacacttaaccttattgcaccttaaacatttgaacattatgaaccttagaccttatttatatttctactgttatattcccttttttccaacagatataaatatcttttttacattactaactttatagaattgttatatatatatataaaatatttattatataattaatattgatacttttgatttatattattgttattagacacctacatgttaagtttctttattttaaaataaaaactaaactctattgtaaacctctttataatatgttttctttttcgataaaaatgtaaaaagttataatatgg

SEQ ID NO: 74 - DNA, 2200 bp, Glycine max
  Soy_ogl_4487 Gm13:36493501..36495700 Cluster 1
tctaactatttctaaaataataggttaaaagttctaactcttcatccttttacattattttatgagataattaatgaaactatctagctataagaactaagaagcaatgtaattacaatactaataaaaatgcataaagcctttaattggtttaaatatagaaagatcaaatcttatgagtaccttaaagaataaattatactattttttcttatttttttaatcattataataatcttccttataggagatgttaatgtaacacataaagaaatatcaatataatattcaagggatgctaatataacatacaagaggtatcattataatgtttccaaacatacagagatcattgtatgaacaaaaaatatattatataattcgaaaaaagtttaggagtgagtgcagtatgctcttaagttaaataagcaaattcagctctttataattttttatttgtttatttaattaatatagaaataaactaattgctaaataaattatctatttattaagaaaaatatgtaacataattagaataaagataaaattaaaaaaattagataaaatcgtgctatttaaaaatattttatgcatcaataatatatttgaaaacaataaatatttgatctaatgtaagttactttgaattgaaataaattaaatatctattcaaataatcaaattaaattgcagtttaatttaatacttcgatttatatcaataaaatatacctcgatattataaattataacactcaacttagaaagtgagacttccactctttgtactatctcgattagatcatgttagggataatttataatctaaaatttcagctgattatttagaaaataagcttgatgtttggaatcttaacgtaaatttagaaaaaaagttgttttttatgaaactgaaaatttgtaacttatgattattttctaagagcctattttttgtttcagctgtttttatactattttattatgtaaaaaatgattttttgttgcatccaaaaaaaattatttattttcaaacacttttcaacaaaattttccaaacaaaaatttgttataattataattgattataagaataatcgattattaaaatagtataattttcacaattgttctaaacataccttaatattttatctctccctttcttttcttttgatgtgtatttcacatattactcatagaactggcaaaaaaaaaaaaatctcttaataccatctcaaactacttatcttttttatctttgtaagagtacttaattatcttttcaacttaaatgaggaccatagtttcgaaacacctcaatcatcaagttgatacttttttttatcaagcaacattaagtgaaattctattactaaaaaggaaactagcaatgtattgatcagtccttactattgctttcttattttgatggtgttgaaatgagagccaatgagccatatcatgacaaattctgtataatgctataacacttagtgcattcgtataatattttatatagatataatacattttcatcactttttacatggaaaatgcatcattttaactaaaaaccctaattccaacatgttttaaaccataaactaattaattatttaagtaaaaaacacaattaattatttatattaaacattaccaatttcccttaataaaaataaatgcgttgaaaaatcatgttctaaattaaagctaatttctatcttaaaaaatgagtatttagataaatatttggatagaaaataattttttatgattatttatttacttttccctaagtaaacacatataatttttattgcctcttatttttttaaataaaaacatcacttgattaaaaaataaatttaaaaaagactatctcagttctaaaatggtgctatagcacactatgacttacaatgaaatgctttattctataatttatattcaatataaatcagttttttttatttcttacttattgcttaatttaatatattatttttaaatgtatattttcatctttatattttattccttccaaagaaaaaggctagctttacccctttgcacacacgtgctaggatgaggtcaagaacaactttagaattcaatttatatttggttaaaattttaaaagtaaaaaaattaagaaatcaaaatgaaaattttcagttttttgtttttcttttgtt

SEQ ID NO: 75 - DNA, 4982 bp, Glycine max
  Soy_ogl_4619 Gm14:3588319..3593300 Cluster 1
aattcatcactacaataaaaagtcgtcttaaaaaaattattttataatattgaattaacttggccatgtttcatatccttccttcttttgcataatgttgtcattaatattcttttttatttctcacgatgctatggcattgtgttggataaggatcagtttgtatccttccccccttcagaccacacagagacataccaagaagaaggctgtttacaagttgagtacatagatgcttaagggcttaaggcttagtggcttaccgtatttaatgtatttggttgatcaggattttctttcaatgagtaggtgtggcgtctagattaatctgtgatgcttaattgtattaactctttgtttagttgtttcattgacaaggggcaacttttagttgacgccttatgatgtatagcaatagcaacccatgctgtgtagtgttacttcttctctaccatgaacatttgtcctttcctaagttgttgcttaattgccttgcttttaattcgtctatatacttcttgcggccttaaggaggtaaaatatattttattacagaaaaaaaaaggaaaatacaagtctgagtaggataaaattaaaatcttctaatgtagaaacaaatataaaaaaagaagaagaaaaaactcaaattgcatcaaagctgccaggtttgtttgcatattggagatagaaaatcctctcaattttgatgttttggggtggtttgatcaaataaagacaatacattttttgtggtttgttaaattgggtatgaacttaggatttaaatcttctgtcttaaaatgtataatgtaagaagtttaactcaacttcaaaaattagttcaagggataaaggttgttcttcacttatatattttaatatgggattaaattgaaatctaacattctgcaaccttgaattttcacattccaaagttaacaatcaatgacatgaagtatgcaaccacatttgctgcatcatcaactgccttcctcctcacttgagttaaatagcctttctaatagcttatttcaggtatatgcaaaattgtttctccaaattgccgcctcttatctagctgcttttgtcttaataaaagaaaaaagattttaaagtttgaaacaaatgtacaacctctttgactatctaaatggaatgaaaggatataataaccttatcaatgagaggcaggtaaaataatatctatgttgcctctcaatttgaaaacactgtctaacatcatgtgtattgcaattgcaacaagattttaacagaacaaggagaggatggagctttcaaatttgttgcacataaaacaacccatgctcccaccgaatgccttgttacaaaatgatgtggcagtttacaaggctgtacagcatccaggagagcatttatggaatagtgggtgactaggtgtctgttaaggtgatgatatctttaatacgatactgaatatatgttttgccataaataactttctttgtaagatacctttgttcttaattatagtttctgttgattttaatttattcaccctttttgaagatggtaactataggctatagctattgggagcaaattccacctgtctttggtagtctctcaaatattcattggctagtcttggccaataaccagtttgaatggccatccccatacctaatggaactaatactggtcttttgatatgatgcaccgttgcatcatacaaagcacttgtatgtgaaaataccaaaagttggcgtgttctgattatttcctctctacaataatttgttttatatctatcaaaatccatctaatatattccattatctacagttattggtaggtgtataacattttctaggtaaatagattttttttttcttccaaatctgcaaattccaaataaagatgctaatattaaacccacatcttatattttggagtcttagatcttaatgattattcgctattctttgttaatgacaactttttttttcctgtttctcagctgcttttgttagcagttcctttggttctgtttaattcaccatctgtttttgaataagacaatactatacgtagaaatagtaattgcataaggatgagtgtattctatgtaacactaatagtgaactaaaagtctggttatcgaattttagagactagttatattttcaaataatgaaaattattaaattaaacaattaagatgattaaaaaaaagatttaagtatttttgtggtttttggttttttaaaaaaaaagaaaagtaaactattgcaaaagagatatttaagtaatagtaaaagtaatcaaagattatgattcaccgaattttctccaaatcctaattctaatgaaattccttccatagttaattattgattctcaaagtcaatcaaagtatatgatcaaggtcaaatgatgctctttaccttaaatcaatactctaatgatcacatatatatcaatttaagttaaagtatataatcaatttcatggatgatcaattaaagattaactaatctatcagaaactacctaaacaatttaatcaatttgatgtaaaacattctttacttagatccattagacatacacaaatgatcaccatagtacatttgattaaatataagaatgatcggttcccaattaaacaataagaataagacaaagaattaattaatataaaatactgaaaaatttcattaagaacagataaaggaatataattagataattacatcataatcccgaactagggtgactagctactcatagtcaaaacaaaactagacagcctataagaaatgagcttagacatacaaaagtgctcatggtattgccttcaccttaccatcctcaaaatccccaaaagtgctttctaattcgaaaatatgataaaagatattgtttacaaactccaaccctcctatttatagctccctaaaaataataaatcatatgagatgcaccacggccgtgttgaaatccgccacggtagtggtcggagacaatgaccctaaagttctgggacattgtggtatgactacagctctcatggtgcgtccggaccaaatgaatgttttcttttttctcattttttttgtctttatataatgaactcaacttcatctcatttgtcaacgattgtggtgaactcattatggccatcgttggaaggctgaagctgtttagagaggattgtcatcatattgccatggtcatcatgctcaccacggttgtgttggatgtactatgaatgttgtcaagtgacaaagtttttaagtctttaggtaaaattgtaaattttcactctcttcacttaattgagcgtctatgcttttgcaaggcaaaattagcatccaaacaagttttgccaagaaaatacagcaaatgacacaataactcagacaaaatatcactgcaacgatggtttatcaattaccattagtggactccgtctttgccatcagtctttggttcaaaatggttactgtcgcaattcttgatgccaataacggactttagctgtattagggacattctatttatgatattcaaagagactacagagtgcaaaatttaatgaaacatatctagaaagttggggggaaatgcaaatgaatgattatgataaagtagctgatctatacttaattacttacatgtggcagacggagatacggggttttgaatattagagtgtttatactttggcaactgctcttaacttcatgaaatccacatgacaattaatgttggtatgaaaattcatttccattttctttttccacccttctattcatcagtggccaagttttagtgtaatttttatttatatattggaggaagtattcctattctatccagttcactagtctctataaaacttgtaagtaatatgttcctggattctttagcagctaggacaatctttaaatcagaacttaacatcatactcattctactcagtatccagtgctgagttttaggtttcaactattatggcccggttgcgtacgacacaaacaacatctgacgctgtattttctgagcttctgtcaagactatactgctaaaagttaatccataacaaatatcagaatgtgaaataagttcctgtccactggtaatttcttttttctactgcagcacttctggctgtgccacttttttcttggcctttttttcgcttcctttctatagtgactaatttgttccttaattaggattgcattgaatgtattttaaatattggtgttgcaagagagcaatcaatgttgtgcgtatatataattatatattggttctgatcctgacttctctgttagtgatcgttctgtggatggttttaaagggggtgaagaagatattataataatcttcaccgtgagatctaatgagagtggtaaagtaatgttttctttccaagagacacagcaaatgttgtatggactagggcaaggtaatgttactcacacatgtttaggtcattctttggtgttctttccaagatataaatacggatacttttgatctattcacccaattttatttactcaatccatttacagataaacttcatatttatctaatattgttgtctaaatagatttgacggtgactgcaaatgtttttgttgtctacttgtcttaaacaaccaacttttgtattagaatatatatcatatttttaaaagcaacgtacttaagccgttagtttattgtgaagacggtgctttcacatgtcactttggctatctaaaaaacccaaataataggatattctgttaaatatgcaatttgactgagtttgagattaatcatattttatataaaaggcttctagatatataatgtaattaattacttggttaaattaggtgcttacaatcagttactttgactgtgacagtgtcagtctcctccgaaacttggtcttcatgttgtatcagatttatattttcatccaactgtagacgcagtttca

SEQ ID NO: 76 - DNA, 3333 bp, Glycine max
  Soy_ogl_4625 Gm14:3816738..3820070 Cluster 1
aatttaaaatactatgatgacgaaattcgaaattgaaaaatcaagattatagaagtgttgatggtggttatttatgacaatcaaccaccatcatcaccaaataaattacaactacgatatgacaccattcttttaaccccacaacaatctcattatcaaaataatttctagtgtatgtccatctaaaataagtgatgaaaaatattaattttttttatcaataaatgttatattatcagttaaaaaaaattaaactcataatcttttttctattgtcttctttcttctccttctattaaagacaggcgtctccccatgtttgttttttttgactcattattcttcacactttgctgcttgcgcgtgataattgccttcacaagctcttgaaccatgtacaccttcttcgtccaaatctagggccacgtgtgacacgctgggaattaattgattgtacaagtcgataaccttttcccatttaccttccaatgtgtactcagccagatcatctgggactgtcaattcttcttcatctgatgaaacattggagtactgcaattccaggattcatggtcgatcaaagtgaaaattcaaataaccaggataaattaatgtttgaagtgttaattacaaataccagggtgtctgtaattctcctaataccttaatatttttgttgcatgtattttatacctaggaatttattgtggaggattttaacccggcatatttaattcatttataatcgtgtaaatctgttaatcatattaaattatcttatcgtttaatgaaattatcactaaaaatctaaaaaaaaaaatatttttcatattttacaaatattcaagtggacacgaagtataatttatcaggtaaacgttgatttatatttagtttatctcttatctctctttttaattacctcatttatccaggaaaataatatatagataacatgcgacgaatccaaaaaaaaattattgggagtaagaaattagtttataatattacaagcttttatatttttatattcatttaaaaaaatatatcaaaaatatatcttaggagagtaatacttatttttcatgggaaaaaattattaaacttattcaaataaaaaatcttatggcgccaattgccccataccttttatattaaacttattaacgttttttttatgtgtttaaaatttttagttgatagttgagtgttattaattatttaccataaaaaaaatttaaaaaaagtcaattacatgccattagatattaattgaaaccatcagcatatagtaatttagaactatctaacaatctcaggttaatgaaacgttcaatatataaaaatataatagtatctatatgtcgatcatcactctattctccatttttttattacatttattatgacttttttattttttaatttctcttttccatctctccaaaattgttgggatttgggagtaactgaataagttttcggattcggtagaaaaataaaacgttgcttcttgctggtttcaattcgctaaaagtacaatttcaattattttcttcctttcttttccatctgttgattcctaatcgtagctctaataaccttttttttttgttcttttgcctcttcactgtgactgaacaacattgttacatacattacaaataaataataaatgttgtaaattaagataaaatttttctctatcatgtgaagatcaactaagaaggctgcataaaaaaaatatattaattaagaaagtttaaaaagttcgataataaataccattttctctttttcatattaattaattaggtaaaaaaagtccgacatagaatcacgatcatttaaggataatttttttaaaaaaataatataaattattaacaaatttaatattcattaactaaatgatcatgaatctattttcttaatttttacgagttagttaacaaaattataaaaagaaaaagataaatacctatcataattttaacttatgaccaatacaatgacataagatcttactagattcatatataggagaatccacattagattctctccgtgtgaaattccttttaactcttaagcagagtcacacattgcaagtaatctttaacctcatgaattaggtgacacccataatctttgacatcaaactaaaaaataatataataattttgtctctcactacaagatgaaagaaatgtcaagccgaaacatatacgtgcaatttgtattatgcttatagacaaatgtcaatcacactatttaatatactcttttgaatatattttttatttttagttacaattaattgaaaattaaatatgatctttcttttgggtttaattttttttattcagcggaaaaattgcaaaagagctcaactcaaattatttttgattttataattttcaatcattttaatgaataataaaaatgtgcattagaagaaatattttaaagaggaaaatttgtaaaatggtcatttttataagagagtgaaatcagtaaatctaaatcatacggttattcataggtagttaattaagatttaaattatgagaccagttaaaaataaatcactttattataatttcacattacttaattactttaattcataataaaatctaatgatcaaaatttattcatttcactctcatatacaaaaataaatcaaattatacttacatcccttgacttttctcaaattaacataacagtactctttttttattattcttacactaaccttatatatttaaaaatattatactaacatgtttaaaaatattacaccaattctttttgtatgtcatctctgttatgactaaaaaagcatacctatataattacatgaaatctcatggataattaatgtaatttatcattaaaaaataccctctcttactagaaatgtcctccataaagagtgtattacaatttacatatcagaattttttggagtacagttttaattgttatagcgcaagatttgttttatagcgttttatgcttaactgtcgaagcctttacatatcgtcgtgtttcaagtggtatatatccatgtatccaagtgctttctaaaaaggcacgcttattacagctataatctttcttctttttgtctcctttttgtagcattgtacttgaagaaatcatcaaaagaaggaaagaattggtatatctatttagttcatattgacaaactgtttctttaaaaattgatctaaaagtaacatgaaatattattaactagtgcatgagtccttacgcttgactgatatattagccatttttatttgtcataagtataataattaa

SEQ ID NO: 77 - DNA, 4100 bp, Glycine max
  Soy_ogl_4862 Gm15:2057101..2061200 Cluster 1
actcttttggaagttagatttttggtttttataaatttatttttttaattctagtctatttaagtttgtgtttttttaattttagttttagtaaaatattttattcatttttagtctttatttttttaaaatttttattcatgtaagtatgaacttatgagaactataaataaaaaaaattataatcttataaggattaaaattgaataaatacatgtacttatatattaggattaaaaataagaaaaatatcttactagataaaaattaaaaaaatttaacttacaagaactaaaattttaaaaaaaataacttacgggactaaaaataaaaaaaaaatactatcttacaaaaaccaaaacatatttgagcccaaattctaatttcaatgtcatcattgggggaaaagaatgaaataagctcagaaatcatatataattttttctagatctctaaaataattgtgatatttttatacaaaagataaggaagttattgaatgttctctaaaaaaaatttaaagaaaaaggggacatactatcccatatcttaaattaagatatttgatatatcacattaaatattagtattgcaattttgtttatatttaatataataaatacttttttcttttttaataaaaacttcttacttttgtttctttaacaagtatcttaaggaaatttattagaattattgaacacatgaatcaattagtgccgaatatttcagaataaccatgacttgattttgagttttatgtaagcaacggcgtgaaatactcagaaaaaaaatttattacataaagccttgatttagccaaggaaaaaaaacttattagcatttaactttaaaatgtctttttttgccgaagaaaaatgtcttgtaataagtagtattttaagattattaaataagtagcattatatacacctgaggattagtaatgatacaatctttaacatattctttatttattaattaaatttttataaaataaaaaaaatcatgaatataactcattaaaaaaatacaactcgtaagttttttgaaatttctaatgaattttaatcaagaattaaaaattgtctttgaaaatatattagataatgtgttaccaatattttccttatacactttattgcaaaattctaattacttaaagaaaataagtaataaatgaaagcattggctaatgaattctctcttaacttcttaagatatttgttaaagatttaaaaataaaaaatattgaatagaaacaaatgctaaacaatgcattgggatgcgaagggggcaaaagatccggacaaaatctccatcaaatagatcaagtaaggacaacataatcgaattagatattatagagtataattcaaagctttaagatataagttatagatcactcttcatctacgactatttgaatgtaacactactcatactgtcattatctacacataaattttttttaaaaaaattgtcattatctgtaacaaaaagaaaaaacttataccgtcattatgttatcattaatgaaaatgaatgagacatgtcaccaaacctttacttcgctaacatagatactaccgttgggacatgggggaagtcaaataagtgatttatctccattaataggttaagtaagaatcatattatcccctctaatctaaattgatatttaagattttttatacaaattttaaaaaatttctatgagacaactttttagggggaaaattttatggaaatatatttactctctttcttaatttatatagatatgttaataaatattctaacataatataagagatgaaattgaaataaaaactttaatatttcaattctttaatgctaaaacattaattaatttatgtaaacatcaaaataactattgttttcggtgaagtgtaggaacaaatttagagtgggtaggaaagtattttcttgaaacttctcattcacatttatatacatatatatttttaatttaattaatgtatatattttctaagttaattaatgtaaaactaattatgtatgttgttatataaaactaaaatatgtttctcatttataattttaataatttttccatatttattttctaatattttaaaaaatttattttaagtctctatctattaaatcataacataatataaaattatgtaaaactagtagtgtttgatgttatgactactatggttaagcttattatcataatagttgaggatattgttatttaaaataaaaaattaatttcaattttatgtgtataaataatacatattttttaattttattatttattaaaatttagatatttaaacaattacaaaagaacgaaaaaaaatccatccactttaataaaaattttggatttgtcccacagcaataaaaatagggtgaaaaaattttggatttgtcccactgcaatgaaaatagggtgaaatcattcttaaaaacgatattatcgcatcacttttcacctattttcactcacctacttatattttttatatttcttcttatttttcttcaattgaacatttttaatttcttacatattttcattcatttttttttcattccccgtgtttcttttcactctttcagactgatccttaatgctatatactacttcatttggaacaaaattccaatttgagtaggataatttttttttgttgaattaaaaatttacactatggaaaacttaaatttaggataaattacttcctctaaaaatcaactttaaccagtcaattttgtaaatgcttgttcggacacactaattatgtaattatgttatctttttgttgcattgatattttttcattttacttaataaaaaatgataataatgagtgtcttttaaatatttaaagaattttaaaaataaaatttaatattaaatataaacacgacattttaagttctcgtcatatttaaaaaagaatattgatagtgacataatatttttttaaaataaaatatataaaatttactaaataatacatgtgtcattatttattacatagacataaatttatctaaaccgcaaaatatattaaaactgtgtgctatttacatacattaatttttttaacataaatgcaaatattgtatatgagaacaagaggggcttcataaattcaaatattttaagtatactattgttttaagaaaaaacaactttatactttatggtaagcccaaatcccgataagcaaaaagagaagaatatcatcggatcgttgtagctgtagacttgtagtaaaaaaagcacaggtggtgaaattccttattcaacatttcattccctctcccataatatttgttttttatattttaaatattttgtaatattaaaaaattattttttaatacatcacaatttatgaatatttaattaaacactataatgaattgacagctacatttatttttaaataagacttttaaaaaatataatgatgatttacataattaataatttccttaagaaatatatgttaattaaagaataaattatatgataatgagacaagactaataaattatatttttctttagaatattttattattaaaataaattttaaggactaacatacttattctcataaaacaaaaaggtgttcataaaattattaactcaattgcattctaaacattgacatcaaagatcaacaaatttcagctaatcattggtctccaaagctctaatcattagaattagcgtgcagagctagagtaatatagggtgtacaaatatgaattttattaatagggagatcaactttaattaacattttctttaaggatattgttaaagaaaaagcaatgataacgtatacttttttttttcggaaggccaaaaataaaatatactaataaacgtacgctttatatattgggtacatgaacgtaaagaagagagaaaaaaatggctgatatatatgataaatgatttgataagaaatgaagagagctaaaaaaaatagttaaaaataaaatgaaagagaaagtgattatatattaaataaaaatagtattgattctagaaaaaaagtattgattatttaaaatgtc

SEQ ID NO: 78 - DNA, 3100 bp, Glycine max
  Soy_ogl_4975 Gm15:10559801..10562900 Cluster 1
taaatttccttttagtttctcaacaatattttgattggatttactctctcgattactatttataaatgtttttaatttttctcgttaaacattatcaattaaataatgatatcataatcaaatataacatatcacataaattattagtatgatgtgaaagtcacatgataaattatgaaacacaagtaacaaatgtaatttataaattaaataagaatttacttgttaaaaaaaagttgtgtctcacaattttttatttaatttcaaattagttgtgaaaaataaataaaaaaagaatatgaaaaaaacccaactaagaaaaacatttgtgaaaatttctaaagctcaattttctaattcttcctaaccctttttcttaaacaaacaccaaatctttttcatttcaatctcgttgctcatataaatccttttgttccataagcaacaatgtgcatagagggcaaacaagtggtgaaaatggtagaaagagagtgaggtgacaatgacaggtttcaatgtcgcgatagagagatatgaaagtgtaataattattttctataaccagtgatcaagtgattgaaaataataaaagagaagaataaatttaaattttggtagaaaaaagtaaattgaaaatatgggttgttttctgcttgagtttgcatgaaaataccaaacatcaaattttacctaaattctcaaaagtaaaaaatagcatacaatataaactataaaaatattaaaattacaaataaactgatattagatggggccgtattggatgagttacaagaaaggccattgttaaacacacgctctttttttgctattaacacccttctgtgtttcgtttttttttatttatgaaaatacctctcttcaaaatgtgtttccattgatcactatatgcattggaaacacattttattttataataagaacttatacaatatcatcttttttacacatccaaattccatcaagatctaataatatcaaaatacatattcattttttctagttagaagcattaacacttgcttttatcaaattttgcttccatcgaattttgccacatagggtcactcggtactatggtattgccccaagcacttggcatatcttcgttaggaaaaaaaatatgtgccaacttccatccacgatgatgatgataaattttgaataaagttgggaaattactgattaaaattaaaatagaaatatgttttcattttgatatttgtttccgctttgattatttatcaataatcaaaacggaattatatttttgtaggatcatgttagaacggaaacatattatcattctatataagtttcatggaacatgtttgtgttttgagtgcaacaacgaaaaaaaagaagaagaaaacaaatttacctccaccaggtctctatatttggcgggatcttaagtaatgaatcacagcatttatcatagtttattttagaaatacattgataatattttcattattcgatttagttctatctaaatgggctagaaattgcaagttagctgttaagcccagaacaatagacgttaaattgacaacttcatgtaggccattgtttattggtgtccactttttttgctaatggcacttcccagcttttaaaaaagcaagaaagttaccattataatccaagtcaattccatttctcttttgctccaagctcttcctctcttggaggaaaatttgctctcttttgctcttatttggtttttttctttgttctacgcaaaaacggaaacatgttccatgggacctatataaaatggtagcgggtttcaattttcttttaaagtaatgagtaatgcatctcgtagtttaacatgatagataaagaaaggttcgaattttgatttactagtagaagtttttatatttaataactggctctctaatcttatataaaaaaaaactggctctctatcaaatttacctctaaaaaacttagtatcatatgtgaggaaataaaagaaaaagcataaaactcgcgtagaatctctcaaaataatttttttagatacaataataaaattaagaaaggagttgaaattctttcaataaaagagatacatacataaatatactcttatatttttattttatgtattttttttcaataaacatatgccataaattaaatactaattgtggatttcgaagtaaatttatcaaaacataataaatttcatttatggtcaaggtattctaaaaagaaaaattgactcacaaaatatttaatactaattatttttcatcataaaaaattaatatttaaatatttcaaacacgatattatcgatgaaaagcgtcttgatgtttgaataagttatatgttaatcttagattgtgttcgggtaaggttagagaaaaaaaaaggtttattttttaaataaccttttccttaaaactttcttttggaaactactcctttataatcttttaaaaaaaaatcacttttttagtttttcagcactatattagagattggtttgtggctgtgtacatcttgtagagattgttttgcttctaaataataaaaataaagaaaagcaggcagtatcaactatcaaggtagtcaaaacacacaaattaaaagaattacatgaaacttctccaaagaaacaagaaatcaccttgtgcaaataacaaaaggataacaaagaaacctagtttgataaaagaaaaaaaacttgtccatcatattttgtaattggttagtgacgatgtcttctgctttgaggatcagaattcgcaagcaaaagaaaaaaacaaagaacctaaggggcaaggagaagaagagaacaatgatttagtgagtctatacagaagagaaagcattcctttttataggtagacaaaaattattatattttttccagtagtaaatatgattgaccagaaataataagtaataaataggtatcataaatataatttaaaattttgtgtctagttttttcgtatataattatcatcataaacgtaaatttaatttttgttactatttttaattacataaataatatattaatacaatagacttaaataaaaaatattatgcttccttt

SEQ ID NO: 79 - DNA, 2800 bp, Glycine max
  Soy_ogl_5184 Gm15:50011601..50014400 Cluster 1
tgcacactaactaggttgaatattaacaattctttttaaattataattcaaataagataggaattaaattagaattgaataatgtaaaaattagaaataactttataataatgagatttgacagtaaaagagatttttttgctgttttttttttcttgagtgagcggtaaaagagataacacactagggcggtctacaacaaagtgaataaacaaattaggcgattaacaaaaagtgataaatcatttattcaatatttatattttttccttacaattttgaaagcgaataattgcacttgtaatagcctaaaactcaaacaaaaaagtaaacataaatgaaatggacatgggtagaaagtagaaagaaaaggcatcttggtcacctactgtgagaaggaaaattaattaaaccccttctgactaaatggcgattggaataattaactaaatgaaaagtaagaagaagaacaactaaagaaatgcatatgaaatgataagataaactaataattgtacctactatttttcaaaatggatacagacaaacgaaataatgcatggagtgtattccgagaaaagccaattttgctcacatgttaaacgggaaaagatgctagagtttcaaagatacatattttgaattggtgcttaatcagaagaagaaaaaatcccagatctctattagagattatcttaaagtatctcccatacatgacctctttttgaattcttaagcattacttccttttagccttttcaatttaagaatctcaataattcaacactaaatctcttcaatccaacaaagatattggtcatcaataaatgtcataagtaaagcttattgaaactctgcaatgtttcacaatgatccaaaaatttatcaaaaacaacacttctacaaaattaaccaggaaaatgctaaaaagtattctaaaacacttttaaaaaacttaaaatagaaagactttttattgaaatgcacaaaatttatattttttacgttctcctatatttttatattaaatatgttttccttttaattccttaacgaaagttcttaggacacaaaacaatacccaattaattaaatgagtttgattaataatttcacatctttatatttcatgtagtataatttatttattaagttataattattattattttggagaaagttgatactataaaatatcacaaccccgagtctggcgaaaaagaatgaatgatttgattaaggtatggtttgattgagtgtaagagaggagaatgatataaaattgagaagaagtatttgtattaattaaaatagaaaaaacaagtgtgagatccatattaaatagtaattttttcccctcaatttctcttcttttcctagcgacgaaaccatggataaggtgttcatccgttcaccgtggaatgcagatgaaaccttcgtgaagttatttttcttttcttttcttttggtagcattgaaagtgtctttttcaaataaaaaatttggtagcattgaaagtgtctttttcaaaaattgaaaagaaaagaaagataaataattgatctatgtagtgcgagtggagatttgaaccggggcgggagggtataggaccatgctgttttaaaagacttaagaccaaaatatgtatgattatatacatgagtcaatcattaaaaataaaaaataaaaagtcagaataatcaagttggtggcatattatttattttgatccaaaaaagtatgtgatgttaacatatttatttttgaaaaaaataataaaattaaattaaatttcaaaatacacaaaagtgtaacatatttatcctgtactattaaccaagcctagatgacacttatgatgatgatatgatagttgattattataatatgtgttatctatataattatcacatgcatgttatacatataatatcatgtgtttaaaaattaatttattaatttaatttatgaatttaatcacttaatcccttaatcccttaatcccttaatgatattttgattcttaaacataaccacgtactaatattttgattcttaaaatattttcaaattttgtattaagtctcacagtatgtaaattattaacatatatatagatatagacagaactcttatttgatacaccgttaagtacctatgagtaagtattagatacactccaaaatcattttttaaaaaacaaatagatacttattttgggttaatatgaaaactatttagtatccaatagctgaaacagactcaattcaaaaaaatgttcaatgtttaggatttatataccaatcttcttcttctctaattaaagtaacagcaaaacatgtaagatattggtagagatggacaagatctatttaaaggggttgttgttcttgaaattatatttagaggtgatatttttttctaataataataaaaaatgatgacattgaaattgataaaagtgtaatattacaattatgcttaaaaatttaagtattacagtttttatggtgagataatttttattatattaaagcttttaatattcttatatgttgtaaattatgttttatgcttttataaaaacaaataatcacgtatatcttgcccgatattggtttatacctatatgtaataaaagtcatacaatcatacacgtagtattttttgacctagcacttaataaaaatatttctaaaactttttgacgcatttaaaaaatattcccaaatataaataaatgtcattaatattttttcatattattttatcaaatattatatataatccatgtcactaa

SEQ ID NO: 80 - DNA, 2388 bp, Glycine max
  Soy_ogl_5254 Gm16:2371413..2373800 Cluster 1
catctaatttttctgttaattttaccttacttgagtgtatggaccatggaaattattaggaaaattaactgaaatagttaaatttttttcttctatgtgtatctcctttaacacttcgtaattataagtttcttctaagaaaaatatacctttatttcctttttcttcccagttagaagtttcttcgaagaaatcaactctttatgttaattgtaaatctaggattaattaggttttaattatcattataacaataatgctgaaaataacatccttttagcaaaattgatttttttttcagtttttctatataatttttttttcaattttttcatattaattggatttgaatgcagtagcatctagcctataaattgtgaattatttttatttgagttttaccttttttattatgatagtcttggtcaagtttagataccaacacacaaaaaatattagaacgaccattaatctaatgattcaagatcatccgattactaatagagtatagcatggctaataaataatttctttcaaaaaaagctaataaataattaagtattttaagcatatttattggagttcgattcataaaaatatatatagaaaataaattattgaaaaaggttgttatgtccaatccatatgatgacttatctagactcaagtacgaaattaatctaaaatcacaaatttattccgcatcatgttattatccaaattcttccattactatattgatcttagctagtggtttatagattttattatttaacttgatgtaaattaaagttgcttgaattttcattaatcgactcatcagattctttcagggttcagacctataatacgtcaaagcatttgcgtcttcagcaaaccaaataagttcataattctggtttagatttatattcacggttaaaagtatggtaattgttttaaatctattccaaaataaatatttatcttttaaaaaatacaggctgattattattaagtaatttacatgacactttgtcctagagtcactatatgacatcaaaggagaattaagttcacaattaaaaatattggaacatttcgtttaagacaaaataaaaattggaaggcataattatcccttacttattttgattaaccatatatacattatatatatcattttcgcaattaagaatatatataaatagaaaacgatattttttaagggaaaattagatagttttagttattaagaggccaactttgtcaatttcaactccctttaaaagaaaaaaaaaagtgtattttggatgtaattgattaggaataacaaatcaattagtattataaacttcagaattgcatggatgaagaaatgtaatgacaagctttcgctgtcttttttttctattttcgaaatcattttcattttcataatttacttggtgcaaagttttcgcaataatcgatatatatattgaccctaaaatgaaaaccaattgcggggcactttgtttctacttttcagtctgatcctattgtttgtatttggagttttgtaaaacacagatgataagtcccatggggttttcgggtacgtcatataccatttgttcatgcaattattcttttatataaaaaattcttcatgaaatttttatatatttcaatgcaaaataagattattgatttagttactatagataaaattcatattttataaaattgcgagtttgaattcggttgtcaaaagacttcgttattaggtaatccgtacgctttctaaactgtgaagttagttgataagttctcacataccaattcacctaatttttttaactaaaaaaattatatatactattcagtttcctaactgaagcaaataaatatatatgcaaatgtaattgatatgtcatacgtgtgatgcgtgtataggtctgtttttaattatgaaatatgagtattgctttcttccacgacaatgttgcttgtataggtgtctttctgtccattttggtgtttttccatagttacaaaagagaaattcataattttccattggtttacattttctgtgtttttgtttgtcttttattttctatcgggtctttaggaacattaaataaaggggcttatatgttctaattatatataaaaaaaaaatagatcaggctccgatatgtgcttagctaaaaaatattgatataaattatacttttatggaacttggacttcattttaaaaactcaaattgaattggatctttttggcctaactcactatagtttatcatccatattaagcttataactttcttgatgaaatgtcattaaattttaaattttgagcacgaattaaacttgaatctttttaatccaattcgatcataatttaatctcagttcta

SEQ ID NO: 81 - DNA, 3100 bp, Glycine max
  Soy_ogl_5290 Gm16:4363001..4366100 Cluster 1
gaaattgaaagaatcttataattaacaacagataaagtattaaaggccaaaattcaaagaattccaaaatgattactgtacaatgtacattacacaatacttatctttaagctcttgtttctcgaatgtcgagtgtaatgtaattacataactctctcctcttcgttatttttagtcattataatatttgttttaactactataatcaggacatctaactctatagtaaattttgaagtatttccacatgttactattgtttaggcaagttatgaggcaatcattataatatgattatcatctcctcaatttatcctaatattagtaatcttgattcatttgagattttttcaaccaaaaagtctaattcagttaagttgaataatatacattaactgttataaactctaccaattaaaaaaataagattttttttcttcgataacatacaattatgatatataagataaaattagaaaaggcagaagatgagaaagaaattcgaaggtgatttttatacatatagcacaataaattaattttttcaagataaaagaacttataaagactcgaagagaatatttattagaaatttcagtaatttttcttctgcaatttggcgttgatgaaaaaaagaataaaagatagttccatagggatttggaattggtattattttaggtttgtgtctgataatgggcacttttgtcgtcttcagtggcttgtagttgtgcgtgtccaaaggcatctttgtaattgtcccacatccgcaaaataagatggtccaagtctacgagttgttatataatattagcttgaacatgttagcatttcaaattttctactatttatattgaaggtgtaaacattggaaaatgaaattttcattattattgtcattcttcaaatgatttcttttatttatcatatactttcatctttgttattttattaggaaaaacattttaactcactatctctttttctttcctcctttcaaccaccaacaaaaggttataactcattcttacacagttacacccaatatttttacaaataccattttagatcatgtacaaaaaaaataccgttatatatatatatattatacatgtcacttttaaaaatttatgaagcattatatactttcttagaaaaatattgttagtcttttataaattttatatttaacaacttttaatcttccaatggatttttttaattactaattattttactttaacataatcgttttttaatacagataaatatacaaatagctagcgctcttttaaagagaggatgaaagaaataattaagacgaggaaaaaattaataaaaaaaattggaggaaagaactaaagtggtaaaagaaattaatgaatttgatattaaaatggtaaaataaattaatgtagttgatgaattttttaaaagagtaatttttaaaaattaaatgattttttaatgaattaaaattattaactaattttaacaaactttctactaagtttgaatcaattagaagtagcttacatacaagtacagaggggataaaaataaatcttactaatgaaatacatactttaaatgaatttattgaagaatatttaatactatttattaaaaaatatttatttaaaatattatttttagtttcttaaattttaaaagaagtttcatttattactttatattttgaattttttagtcaatttctattagccaaatcctatgcaaatttattcatgacgctaaatcattttttttattgttataaaaatatcatttttattaaatttgacaaatttaactaacggtttttttttcttagaatacatggatgggtgggaatcgaatctggcggagagagaggcaccttcaatagcaacgtcaatggccattactcaagaaattttttaaaaaaagtattcctcgacacaaatataaacatcaaatcaagtataaaaattagtaacaattttttgggtcggatgattttcgcttttgaatacattaatattgatacagtgattatgtattatattggtagatatttttctttatcactaaagtaaaattgacttgcctttacagttgggtaataaaattatgattttgatacataatcaattttactctaaaatttcatgtatcccctatttgaaagacaatgcgattccttttgcacgacgtggaactccaaaaacagagatgatcatcatgcctattataatctctaaaagtgtaaaggaagttcagttgatgagaaatgagaataataaaaacaaacaagacaaatataaatatggcttagctgtgctacacaattgctcaaatatataattctttgaatggttagtaattagctttaagctaacatgtttgttaacggttaacggaatttgctttaaatggctggtaattgacctcaacccaattaactttaaatgatagtgtgactattaattaattttttattttcaccgtccataattgcattatttttttttaatagttctcacgtgaatgataattattctcactatatatgtgcttattcacagtctctgtataattgcatgatttatctttgtagttcttgcgtgaatgacaaccacgctcactgtttttttttttttatgattaaagtttaggtaagctaaaccattaggatcagccggacgatgaaggattggataatataattgtatgtataagatcttaaattcttatgtcagtgtaattatcgtaaatcaaataaaaatttatgtgagttgatcctaaaaacttacaatgatcaactcaaatttcattattcaagaagagcttgtagaggtaattatataatttgaagtaaaatttcaattaggagtttgattatttgatttatttctaactaaatcaacctttattgacatatacatgtcttaattatttgaataattttttttcctataaatactttaaaaaattataacgaattaggagtttgtcgtaagatacagtcaacttatatacacttgaatttgtacactgagttatttaaaagctgaaatgattaagttgattttaattcaagagaaaatctcacttttat

SEQ ID NO: 82 - DNA, 2109 bp, Glycine max
  Soy_ogl_5488 Gm17:3606001..3608109 Cluster 1
cctcactatccctattccacacgcacagaactcagaagaatggccagaaagaattagtcaatcaataggccaacagcgacacgtttttcttcacgcacacaattattacctcgtaacttgatgaaacgaacagttaatcttttaattttactatatgattaaacgaattaattacattatccaaagagtgagatgcgaagaattttttcaatatcctgccatcagtggaaaatgtataagtgaactaaataagaaaactagagcttattagtagttcaatgaatgagtttgaagtttaatattatatgaacatgggctaattagtggctgatgcacatacaatgttatggggcaattgcccccataaggatttatgttttacttgaacatatttagcaatttttatctctgtgcccgtaaaggatttgtgttgtccccataaaacattttaaaaaatgaaaaaagatgaaaagaaaagagcataataaattgatactagttttttgtaatttgacagtattaagaacaaaagaaatcatataacagttttaaaatgtgaaaatatataaagtgcaattataattgtaaaaagcttaggtattttaaattttttaaaaaacattatttttttttataaaagattgtaatattttttatgaaaatattataaaatgatttttgtcccactggaaaaaaattctgaatccattgaagttagtataagcaaacaaattcatatattcaatgcattaggattttttatataatgatgttatgttgtcctttgttagctggttcaataatacacctcattctactttcaaaccccctctaatcagcatagagcgagatcacatctcagttgtcgaggaaaaaaaatggagttctccattgtataatttatttatttataactatgtgatagataaaattaaaagagatagcatacgatagatcgatgtgtaatgtgatgaagagagatagagtaaaaaaaatattgtaaatttttttgtataaatagtataataaaaaaatgaaattattcattgtttcggtacaaaaagtactttaattctgtgattctaatttctaggcttgcaatgatttctatctttgtttttcatattaccaatcaagatactttacagttttattggaaattaactaaatgggttgattttgaagaaaaaaaaaaaagagggtcataaccgtgagttacgatttctaaaatgaaattgtaactatatataattcatcacttattattatttttatataaaactatccttcttggaataaaaataataatataaatcaaaatctcaactgatttttttttttttactaatgtcgtgattcgtgaagatcaacaatcacgactttcttcttttttaaaaaaataaaaataaaaattcttcaatttttattaaaatttcagttttatatacattttttaattttttttattaaagtcgtgtatgacatcgatcactactttcttttcacaatttttttattgaatacgtggattcaatcactacaatttttttcttaattattttctttaaaatcgtgtgatgcatcacgatgtttttgtttttaaaaaaagttctatttatacacattcacattcacgtcttccgtaatgcaactctttttttttttgtttcaccaccgacggcttactccatttttattgtttattgaggggtactctattaaattttagccataagtttatcgtagttatattaaaaataagtactacataaacatctttctttccaaaaagaaaatctttggttcataaaatagcagggtattttttttatatagaaaggagtcatgaacgactttaataaaaataatttaaaaaaaattgtgattagatccataacgacattcacaaaaaaagaaaaagattcataatgttaatttttttttaaaaaaaattgtgctattatacacaattttaataaaataaataaaaaataagtataaaaaaatataaacaaaaatttgctttgcatatactcaagattttagtaaaacaaattaaaaaaatataataactaaattcgttatttaattacaacttctattctgtag

SEQ ID NO: 83 - DNA, 2000 bp, Glycine max
  Soy_ogl_5514 Gm17:4840201..4842200 Cluster 1
tcttcttttcttgagaatcacagttcaccaaattaagaatataataaattgacctaacgatcatagaaaagcttaacttttgttcattattaataagtcaaagacggattatttattatgatgttattattgataggacctaactttttaaatttatttattttttatatacgacttaatttatattatctcatattaattatttttaaattaaaaatatttttaattaaataagaaaatattacattaaaatgtattgaagagagaaaaatattaatgaaaatgatgttttttgaaaaatatgtaaatttaggataaatttattattattatagttatttttttaatcttaatgaattaaataattgaatcttataaataaaaatatatatagttttattaaataaagctaaattttggtatatttgtgatcaaaataataatgcaacgacgtaataggacaatagtttttttttttttttatgttagtaatcgaacaatagttaaacttagactaattgaattttcttgaaaaattagctttgaatagattatttgaagattgaggcgttttgctagaatatataggtttattgttttacaagaatcagaaggtaattttgcttcaactaagtaaaattgttataagtagtaaaaaatataaaaaaatagcgaaagtaattttcgttattttcattatttcttagataaacttttaaaacaagtaataaaataaaaataagttgctatagtataattaaaaaatatttatcgaaataaactatttatattctcacgagttatcggacactaatgaaattaaaaaactaaaaaaataaaattgagaatagttgcatcaatcagatggcttgcagattgaaccaagtcttgggcaagtagagcaagccgccgttagtggcaaattgacaaataataagttaacatctttgttttgttagtctttttcaattaagccatgatgatgtggtctaatcaggaaaaaaaaacaaacatcgactttgaaatgcattaatgacaataatattttttataattcggtcaatatcccaaaattattttgtatttatactataatcaaagcatgtaatccttaggattaaaacaaacaaaattagagaatttattaaagatcttcatttttttttggtagattatttttttagagtccttcatataataataataataataaatactaacatacaataacattattattataacggttttctaaaacgtgtgtaaccttgcacaaaataagagtaattgataatttaatcttaccttatttagattaatacttattattaattattcttctaaattaatccttatttagattaatatattcactttcaataaaaataataaatatatatttctcatttataaaatagattcattttctataatatatttccctccaaaaaaataatatctctttctaaaaaaatcaaaatagtatttaaacaccataattatttttcagtttttcatttctttcatctcttcctaaagttatagattaaatttttggagatatgtcttgaaattatatatttactattttaattataaggcttatattgttttttccccttcttttaaccattttgaatgactggtaaataattattcattatatttttctgcagggttattaatttgcgagttattaactttttgtgtttaattaaatatctacagtgtaataggtacaagacgtccaatggatttattaaggatctgattcgtagaatcaaaacattgtttgttttgataggttcattatatatattattgttttttttagggagagatattatataaattgtacttatttgataaataaaaaataaatattattctcttattataatatttttatctagtaatatttatttcttatttattgagaaaaagataaattagtgagatattatttacttcttatttatcaaaatatctcactgattttg

SEQ ID NO: 84 - DNA, 1632 bp, Glycine max
  Soy_ogl_5528 Gm17:5510601..52432 Cluster 1
tgaaatttatttaaattagaacgacggattgaactcttattaatgtttatagaattctctggatagttaatttaatgtaggttcaagtcaagcagtcaagtcgtcgcccgtcatttggtgcagttaaacttaacaacttagcgcaataaatttataaacacgtgaggttcttatatattgcaatcgcaatatcatttattgctacaacgaccgccaagcacattataaatcaacattgggattttttaggaattcgattaagtaaatgtccaatactatatatattcagtgatttttagaggaacacccaccttgaaggtgccattttcaataacatacataaagcttattttgataaaaataaataaataataaattaaacccttctaataaaaaaataaaaataaaaattaattcatacataaattgaaaaacagattttgaagaagctaatacgataaagtctttacaaattatataaaaaaaaggtttttttcttcttctaggattacttataaaaaagtttacacaaagtagtttatattccttttattaatttttctttattaggttaaaccataagttaagaaatggaattaatatttttatcatattattattttgtaatttctaaaattccttaattgatttttatcaatcttttatttatatgtttctctccttttaatctgattaatcaaatgtcaaattattataaatatgatcctacagttgttttgcttgtatcaagtgctaaattttttatcaataaattgtttatttgaatgatatttaactttatctcattaattaaattcttaatttcaagtcttgtgaattatttcctattaaatataatcaattaatttttataatagatctttgttatggataaatttaataaatatttcacatcaatattacacagtagtctgacaaataaaaaaaaattaggcactcaagatgacattttagacctctcacacatgttaggtttaacattttagtgtatcctaaaaacacattaaaaatcattaaatggaaattatatttgatatgttaaaattttaaaaatatttaatatttttaaatgatttaaataaataataaatgcttttttaatttattgattgtatctataagaaaaatattaacaaatatcatattttattttatggattataattctttttttagttattattattaagtattctatgcattcttcaactatttaccaatttattattaatacaaattcagaccacaatttaaattgttctttataaagttaagataaaatttacataatgtaaaaatatatatttatcttattcaaaacgtagactaaatactgtgtaatcatttttcaaacatttacatacaacaatttgtttccaatacttatatttatgaataaatactatacaacttgatgataaatgtacagatttttcatatttttattcaatcacatagtgttagtgttagtttattaacttttataatattttataaaaaattcaaactaagaaatttataacctattaataatgtaaaacatttacataaaaatagttttaattatatttttagtttctaaaatttagattcgatatctcaaatttcaat

SEQ ID NO: 85 - DNA, 2000 bp, Glycine max
  Soy_ogl_5779 Gm17:39392801..39394800 Cluster 1
ccaaaagctctagatatgtgttatgaagctaattaataaggctacaactactgtaaattacaaaggtatatactacgaagaaaataaaattgctagctattagaatactactttcattcctgtatataagaaataaatgaaaacactcccctctaaaattctgagtttggtgttatagtctctaagtgtagaaatcttctgaggatcaaggctaatataagtgtaggctttgtaaggaaacgggcaaattcggtgctcatagattgactagggcaactgaattttaagttggtccctgctgttttaacaatatgccttcttgttttgttgaacagatcttggcaaaaataataaaagtttgttattctaaaaaataaaagaaacatattattacttttaaatatattaattattaattttcttctatatactattatttattataaagactcaagtactaatgagataagtcgtatttattggtgaaaaattatttcttaaaaaataagtagtgttattaaatataatatttaaatcatttaatttaatggatacttttgaaaaaaaatatgatattgttaattaaattattaaatattatttttattggtcttagatgaattatgtatataaaaacaaaggtagtaattcatttctttcattaatgcttagcaacttattcactaatcaattaagttgttaattggggcttggagtttagatacaagcctaaaacaaaggtaaaattttaatttatatatttattcataatatacacattaaatttctacgcgtgaaagaaaatacggtggatagagaatttgttaagtatatgaagtctataaggatttttttaaaatataattaaaattatattgaaatatcattttataaagtaaaagaagtattcaatagcaatcataattttcgttcatttattaaaagaattcaattaacatgtcaaaataaataaaatagtttttatttaaactatgtatgtaaaattgaaaaataaatctaaatataattagcaatatataattgttaaattttatatgacacggtttttattatactttatgagatcataaagatacgattaacatttttaaacaaatatatcttcaaaatactaagtataaaattccctccaaaaaaataaatgaatttaaatatacactaattatttttatccaataaaaatttcataatcatttttttactgataaaaatttcataatcattaaagtacgaaacattgtacaactataattgcagctcctttttttttgtctattgtttaatgttataacagatagacaaagaaaagtaattattttttttataattatttatatataatttctaacatataatatatcttgtttattttttttggcatttcatatattactatttttccatttttaatggtatagtttaaaaataatatagttaatggtatttaaaaattttaaaatactttttaacaacttaactattctacttttattaaaggacttgtagccttaggttatgttttacaaaatatttcagctaacttcttattttttttattatataaaaaatttatttgaatgtttggaaaataagtttttttggtattttcgtaaaagttttaatttctaatttttttatgtttttttcttaatatatttattaatttttttacttattttttaaaataaatcataattttattattttttaactctttaagtgtcagtttgattaaatacttgtaatttaataaattaatttttttagttagttttatcaaatatagcgttaattatatcttacatctttcttatttatattatttttccacattgcatatattatgattttatttttttaatgttatagtttaaaaattatatataattataataataactataagcatagcattaatgttcaccataaatttcatatatatgccgtcattgattgttggcactcgtggaaggtagaaa

SEQ ID NO: 86 - DNA, 1900 bp, Glycine max
  Soy_ogl_5788 Gm17:39612101..39614000 Cluster 1
atatgcttacataataaaactttctttgttttcacacaaacacactctacatagtactctcgcatgtatctgtgggtaatattggttggtgtgtcatgtgtgtgtgggttgattcacttcaatattgatttattcccttgagttaggatattcctgtgactgaaggaaaaattgtttttttaaaaggcaaaacgaaacaaatcttattaatgaatccaaaaaaaaaaaaaaatcttgttagccttgcaaggcacaagatacaagatatgacccaaacaaaattataagcatagtccgaagttaaaatatgtagtattccatttataatatccccttctctattttttatttaattaatttcaactataaacttaaagttgattgaatgaaggaaaaaatatttctcaatattacttatttaaattatctttgttccagcttttttatttcttgaaaattattttaaggttcaaattcaaaatatgaactttaataaaaaggaaatatatttgatcattttggtttaaaaatttattttaaaccaaaagaaataacttatttttaaaacttactcgtattagctttcataagaaaaaaaaaggctagagtatatagtttaatgaatattcatcattaaaaaaagtctgtagatagtttcactaataacataatcataaaaattatattaatatatactgactttttttatataaaattagttatagaaagttaattttataaaaaaattgtactttttattaaaaaaaataagtttcattggtttaatttctcgatttaaagagaaaagggttaaaaaaatgttgggacaaaaactatcttaaatatatattttttataatgttttttatttctttctttattagtttttcgtcaaaaaaaatatgagggaataccctgtccctaaattttgaagaaatgttccacttgtacgtggcaaaaggaaaattacgaggaggtgtaattgcaataatctgcgtgagcacgaattatgacattgactatgagtcttgcatgttttgtgggggcaaaaatgataggaaaaaaaaaactcaacttgtatgtaacctttaaaatgttatcatccacaaaagagaaaaaaaaataataatcttaaagtgttgtataattttaaataaaaaaaaaaaaaatctgtagtatatcttttttcaacgcgaaacagctgtctgcaacttccactcacggtctcacaccttttcgtgcttaatttcacacgtgccacaaaccgattcattttttaaaaacaaaaataaataaataaaataatacgtcatacatagaacttggatttggatgtgcgtgcgtacgtcctttgcccgtactatttttgtgccaattaactaatcctattcctatcgtcccgtttatcggacttcaaacacatcgtgcttatcacgtgattctgacatatctacttgtatagtacagtataaattatcattataatttttaatttgaaaagtaaggatcttcttttctcaattaacagtatactttcttaacatattcttttgttataattataatttataagaaattgcaaataatgattgagattcggtaaataaaaaatactgtaacataaatctaaatttgtattagagaagtatattttttttatgatttttaataaatcatttaaaaaattatgttaaaaaaatgtattagcaaatataagtatgctaaataaatctaaatttgtaagtacttgtccgactccaacctattttagtagataataaaaaatttagactttgtttgattgatttgaaaaaaaattgaggtgtgaaaatgaaaagaaatgaaaaataaaaaaaaatatttgtttgttagaggagaaagtaagataaaatatttttaa

SEQ ID NO: 87 - DNA, 2807 bp, Glycine max
  Soy_ogl_5859 Gm18:1275894..1278700 Cluster 1
aaggaatttgacattatcatattttttcagttgaaaaaagtgcatataatcatgcctcctttgaccaagttgacaggtaaatgagtttggggatgtgcacagtagagaccatttttccttaaaatcatctggcaaagacgacacaacaatttgttttggcctttgaggcataatgtagcgcacaacgtgttctgggacttcctgttcattgcaaaaaacaatgactatgttagcaagtatcttagtgggatcaataagtagagaaataagatattttaagaaaaaaagtgataaaagtaagtaattaatttgtaattttgtagaaatttagtacatgcaccattgtatatgttttgtctggtaaatattcaggaatggttgcttgccataataattcttcagttggttcttctccctcatcatcggtatcggtcatctccaacactatctctactacgaaatagtcatcaaggtaggtaaacttcataagaaaaatgtcttcaatattataaaattgctttattgcagtgacccgtttattatccttccccattctccatcagtttgtgaatgataagtgaaaaactctccctctgcacatattaaaatgttaaatattgcaaacatataatagggacatcaagcaatattaatatataaaaagcaaagacaaatgatgaaaattaaatgaagaaaaaactagtcataactaaacatagaataccctatccacgtgaacaacggaactgaaatgcagataaagatccatggactaagctgttgatgagaagaagttcctggcatagaagttgatgatgtatgggtgaggatggtgtgcgtgattatttgttaccaatccgctgggttgtttttttttttttttgggtaatatattattataagtaaacaactattatttgtctaagtgtgttattattggtgagtgatgaatttgtaagttatttgaaaagtggtttaagtaatttgttataacaatcatattgttttcttattttggagaaaatcttttagtaatatattttattagtttccggaacaattggacaattgaaaaaataagtaattaattaaacaatttttacatattttgttttgaaaaaaatagttaattacctagacaacgctatgtagaataactcaaataagataaagacaaacttactacttcttgatcccaaaaaaacaagataaaaaaagtttacttctaaagtaaaaatgtattggggtgagagaggctcgaactctcgacctcaggataactcagaagctatgagacctacgcgctagccaactgcgccaccaccccatgattgtaaaatgctgttatcttttagattaaaatattaatactaaaactgatttggaccaaactaggtccactagcgacaaattattttgttgtgactgacccgttttgggcctcttggtccgtatagttgtattctgccccccttcaacttatttatttattattttatgtttaaatatatttatataaacaacagaaaaatatatatttattattgtgattgatattgagtaggatgaaataggttcttcattatctgttttttattttttccaaacttgttattgctcactattcgctaatattagagtatatcatcaaccgggacagcaaaacttttgcagtataaatgtataataatccagaattacaaatagttattcttttcccatagataaatattcattctttctgttttatagccattatgcttttctcctagatgttggacacagaaatattcaagaaagaaatttctttggtagatattcactagatatgttggacacagacaaattcaaggggtacatatatttggatttttgccagattatatggaattataattaagacgacttttcatgtgttaatcataccaaattttcagaataaaaaaatgatatcaaaatttaaaattaaagacatgtctggtattttttaaaaataagttaatttatcgtaaataaattagtcttactctatatacttaaagctataaactatggtcccacaaaagcgaatgggccattaatataagtctatttgttactttgttatgatgttatcaatatgggttcaagcattcaggagttaatattttgggaaggaatagaaaataaccgtaggccatatacgtggtccacacacaagtgacaagacccctttctttgttttaatctcaatcaatgtcaaagcctctgaagcattagattttttttcctattataattgagttcggagggaatagacctcaacacccacatatggtgtgtactaaagatatatattcttttagtcaatattttttaaaaacaaacaaacaagaaaagtgtattatttaagagaataaaattgtttattatttattttatttccaagactcttgaactcgtactaaataggaggtaatatccttttcacttgaagcatatatgaatcggtaactacatcaaggactttttttttatgagattacaagtatttttcataaaaggtaattatgcttgatctgatagagtcactgtgaggaaaaaatgatatttaatatacttacatattcaaaatttaaatcaacaatcattaattatattaaataaaaataattttatatcaattaatccatgcacttaataataataactatcaagaacttgctacaatatttgaaacttaattgtttttatcatttttgatagcttatctttacgcaacccatgactttcgagacttttttcattatattcaaaaattaatttat

SEQ ID NO: 88 - DNA, 1700 bp, Glycine max
  Soy_ogl_6220 Gm18:56956501..56958200 Cluster 1
ataatgaaataattttcaccatgaatcaatatgatttaatatttgatttatcaaaaaatataatttaatattttgaatatgggtgaagtaattagcacttcaatatatttattacactgtcttttttatcctattttataaacttatccttatttacgttttcttttaaacaaattaaaaataatttaagttaacctccttaattatatattatatataaagttaaaagataatgaaaagtaaaataaaatgaacaacataactgtattttatttatgtaaatatgtatgataaaaatattataattatgataacatattcaattaataaaaaaagttggaaatagtaaataatattgataattgatattttaagtaaaaaaaaaagttataattaataaatgttatatttggattggtggaaataggaagagaaaaaaagaaaggtgaaagataagatgagaatattaaattttattatttatttaagaaaagatactaaggatgaatgaattttgatcgaaaattttgttattttattttattttttcataaaaataaataatttctttgtaatataaaaattagaaattcactaacaattttatgttaagaaaaaatagagtaaaaacttcaatttttttaggttacgctaatttcaattagtataaaaaattcatataatttctttctctttttactttctttttcactcatctaagtgaagatttttttccaactcctttccattgtgtttgtatctatcaacacaactttaaagtctgatgttggcctaattttgaagtcgtgtattggcacttgtttggaggagcatccttagttacaacgacgccgtttggagtgttgagtgcttcttcttcttctgcaactacctctccttgttctcaggtgcatttgctaccattggagcttctttgtcctcggcttcaacgacgtcgttttcagggtttgcaaagccgtcaactcaagctgctaaaaaaatcataaaaaagttacaaaattaataaaaataattaatcaaagaaaaatgaaaaaaattataaaaaaaatgaaaatcataaaataattcacgatttcgttaaaaaaattaataaaaaaacaaaaacataagtacatagctaatcattcatgtgacttattctcatttgataaataattaaaaactaccttcatttcataaatttcaaaaaaaaaaaaagaattaggcccaagaattatattccggtaaagtgtgactaaaaaaaaaaaaaaaaactcaatccaaagccatgatatgatcatgaatgagcttaaccaaagaaaaatgaagatgataatgatcaaagtaatgatgaattaactgcaaagcaagctttgaatccgattcactggtgacggacttgaagaccgaaggccttgattgtgaaataaaataacttttttttctcctaaacttctgccttaagaagattggacaattatgaatggattggaaaaaaaaaatacaaaatacaatacccttcttaactcatcacgatttatagtttatgaattccgaaaatagttttgcattctttgtggttcaaatttcttaaccttgttgataaaataagtaatgtataaatttgtcatcaattactttataaatttatcaaaaagtctaattcaattattgtataaactttttgatcatatctttga

SEQ ID NO: 89 - DNA, 2352 bp, Glycine max
  Soy_ogl_6278 Gm18:59562660..59565011 Cluster 1
tattaaatgaagactattcacattaacatttatgtagttagaatttacttgccagaaggttcaactagttttgctagccctatttattctcagggacatgggtatatttattcaatatagtcacctgccttcatcattgtatacaagaaaaatggctaaagtaggtgggaaaagcattcgtgagtgtgacacgtgctattaaaaatcaagtgctactactagtactagtacgtgtcaccaacatttattatcaaggaattaaaaatagaaatatattgatttatcattcacctacttaaaaaaggatgaaagaatttataaaaaataattataatttctcatatttcttttaataagtttgttagcattttttttaatgaaatatcgtttataatttttttaaaaataaatttcatgattaaatttgtgacataatattttatatgatgataatttataaataaatatttaattaaaatgtttatttaaatgtatatccttgagatggatattatgtaaaagttaaaaaatactatttaaatttttaattaatatattaaatactttttgtaagttaatatttattttattctttctaaagagtctaaaattacttaacaaaatctcataaagaaaagaattccaaaacaatctcaaaaaaagaaaatgtaaattgttaaccttcttacaaaacatacaaaattattagtttatttttatttaatactatattaatatttggaggaatcatatgtaattttattattacttactgatcatgtgggaattctagaagctgaattttttttctaaaatatacaatacataatatttttatagtgtggaaactttgatagtcaatggcgttgtaaaattgtttctaaaacttagaactggcggcacgtggcaataagttgtttaagactttaaatgttaacagttcttctataaaaaaaaaagagtgttaacagctctcttgtcaaccattgtaaaatcattttgaaaatagtttatgcagcaattagtttcatactttgaccattctcatgtatcaacagttgtaaaattatgctcaaaacatagaataaataatacatatttaattattagcaatttccttgtttctaaaaaatagcataacattttttaatgtccgtttctttcttaactattgataatatttttaatctcttaagaaaaatatattacaaatcaatcataagagactttaactttaattaaatgatttaaaatgttatgataatataaattgttataataaataaaaccaagacttagagacagaatcattttcgtctctaaagtataagaatttaagaaaaaaaattttaaatttttttttaaataataagcgactgaaaagtatatatattttgttagtataataatatcaattaatttctttaaatcatttttaattatataatcttatatctagatacatgcttctaaattcttttcattttgatttgattccatcgaagtagtataattttcaccacctaaatttgtgttgggcaataactagacaattaaaaaaataattcttgagacaaaataaaacaccgacaaattatttcatctctaaatatgatctttgaaataaatttatttcagtctcaaaatatgatgttatttcattcttattttttttttattttggtagttgtgacttttgtgaattaattaaaattaacttatactactatataaaatagagggagtatcatacattaatttatccttcaatcatgatctatagttttataacatttattaattttcttaaacttggaaaataaaattaaggatactcacttttctattttactgcagacaattatctatattttttcattttaaagtagtgatgcacttttatcttcttataattattttttaaaattatttttataaaaatagatatattcaaaaatgttaacttttgtaggaagacgtaaattcattccacattttatatgatattgaacttatattattatagtctagaatttactcagccacaatctaatacccttatttatgatttgggatttccttaatcaccatttaatactcttttgaccataatttaatatcgtttttgtcatgacttaggatctcttctgtcatgtcttggtactctcttaaccaccacaagaagattaaggaatttaatttatcttaatactatctccttcatatattttttaatgtttagagttattgcacataaattaaaaaatgtttaatggaattaaagattattatatttggattaaaataaccttatctaataattatatctttgatacttatgccactagtggg

SEQ ID NO: 90 - DNA, 1669 bp, Glycine max
  Soy_ogl_6433 Gm19:38699601..38701269 Cluster 1
tttaaccaacaaatttatttaagagtatacttgtgataatttaaaatcaagattgagagaaaagtaggtatattaggttttataaaaatcaattttaacttgatataaacattttttaaagtctaatatgacatttatgataacttacataaaacatattttgcaagaagacttatgaataagatataaaattatcttccaataaacttgactctttatataagttaatacatgcttaacatttaataagataaataaatgtatgattttaatacgttaaacaaatttaatatgtgatacatagtaacgttttaatataacaataatattaaaaataaatatttatttacataagttggattgttttttaatatttaactaaataaactatataaatccttagtctagtttctaagaaaaacgtaagatagaaccttatccagtgacttaatttatttttgcccttagtcacagtaaaagaaaaaaaaaacataagaacactagtaaatttaaaataacacaaatagaaaccagcaatattgacagaccgtcattgtaagtggtcctcttagaactattttgaatataggaccgtagtctcgttgatagccttaaatatatcattatgcaatttaataattcatataaagattagatataaaataaaaatgataaagataataataacatatttgttttatttttttaatttacttaattttatgcacaaaacttgtttataaattgttgttggttcgataatatttgtttaattttcttaaatgagatctgtacatttgaactaaacttttatgaaaacaatttcatttaaaaaaaaaactaattgtattaaattacaaatattgaattaaatttgaaatattttccactccatcatcgccataaaagatgcccacgaatatatataaaagaaaaagaaagacaaacttggtacatatttcttcattatttgatgggcatgacttttcttttcccctcattgatcaacatttattccaccggttcaatgagaaatattgctgtataaagttccaatttttcatatacaactaaaattgattatataataatattaaatattgtattttaaatgaatatattttcatgatacttgttaaattatcttattattgagcatcttaaaaataaatattgaataattatttatattttaatataattaatactttttaaatatttaaatttttattttctcaatcactgcaataagaacaaccattaaaatcccccctcgaaatcgcttttcctgatattaattaattaatatacacaacgacgttacttatacgtatagttagtatttgtatatatattttttatcactaaagatgtagaaattacatgacctcgcagttagtatgtgataatgctacatcataaaacatattaattctgagcgtactatcttgaacacaaacgttgaattagaacttggataggcataacaaagtcgataaaaatatggaataagaatttctatttgtatgattaatttgtgatttttcttttttctgacataaatttgtgatttttcttatcaaataaaggagataagaaaaaaaaaatggatagatcaggtactatgttaatttgttttaattaaaactaatatttaacctgaatgcac

SEQ ID NO: 91 - DNA, 3742 bp, Glycine max
  Soy_ogl_6502 Gm19:42267689..42271430 Cluster 1
gcaaccatcaatacctaataataaattttctaattaagacaaacaattaaatacacatattttatatatacctatatccactccagtataagttgtatccgttgtgcaccatctttcttttcctcaaaatcttccttctgctgaaaaaactgctaaaactgcaatctagtaacttcgaaactgtataaagtggccaaaaattagtacggcattgacaagtaaaggggaaaagacataggaggggggtttctatgcgcagaagatagggttacagacacaaaggggcaattagagagatgcgagtacgtgtccgatcggaagaattggtataatattattcaatgttaactgtgtctgtgagagttactggttagcataatatggttatttataagttacagtacaacttgacatgttggtttgttattttcaatgctactcatagctgttgtacggaaattcaagaagatctcaaattctcaaatctctatgatgaagtaagatcaacatggaagtaaagaaaaagtttagaacatattaatatttcatgaataaattacaaaaatgtaaccagtaatattaggggaacctataattgaaaaaacgaatacaattaattataaattaaaaatgattttaagtttttggttgaaatgacgagtaaaagtgaagaagccccacattatatatatgatgtggtagaaaagatttacacacttagagaatgtttggatacattagaatcacattgaatgaaaaaatcatattttctaaagaaaaaatgttaaagtaattctgttataacttttatttaaaaatttgttggtgttagattcaactatttcttaaacaaacatttaatgtatgtctaaattttaagttagatgtaagtaacaaatttgtttggattgtgatctccacaatattatactctcgtatttctcaatatcttcaagtaaattaattaattaaatgtgattagttatcaaatcttttacggcaacttgtatgatagtcaattttgcgtgagatatattctctcaatatttcctatatcgacctctccatcacttatttattttttatttttaataattagtgatacaatattttccaattttatcctttatatttctgaaaatgttgttatacataaataaactgaggaaaatcgtataatacaaccgtatgaatactttaggatctacaatttaatttggtttaaataagtaattgttaatccttaaaatatgtcatttttttgttttaatctctataaaaagtttattcagttttaaattgaaattaagattaaatcaaatctaatcaaaatcaagtagtggattcctatcctgttttctactcggaagaatttgggctgtatagacgcgtcacgtacgtattcaacatgtacaatagatatatagtactagtagcagaaagggtcaacgaggtggaagggaattttaggaaaacgttaaaattaatcatgggagctaaacaataaaccaaacaatgcaaaacaaaaatagacaagatgatgtgagaaactgaaacaaccaagaaaaaaaagccaaataaattaaatacttacatgcatgtatgccctgttcttagtgaagccactcctggttttagatacagagcatggtcaatattcactaactaagaaggcagagatggtagagactagagagtttgtagcatgatcgaggatctctcatatacttaattggtgcgtcaaagtgaattgattaaggtagctatagcagccttaattttgtgagttagctagagacagaacactatggtacgtttgtatgaatttgaaattggcaagagggagatggatgcatgaatgcatctagctattgagtgaaaagtgaacaaaatgcatggaatgatagagtggcactattgcaggacttttgtgtgtccaggtacattttttggctcatggttcggtacgccagcgctgacgtcttaagcaacttgctttctaaatttatatctatgagaaagaacaaaggaaaaagaaatcccaaattgagtaatgttaatgaaactttgtgattaaatcaaaatataatttttttttacattattatcgtataattagtaaatatttgtttttccaaaggggattggttcatatttgaacgtttatagactgttttttaattattattaattcaacccatttaaattactcaaaaaataaatttaaattaatatgtaaggccctaaattatttgataatttttttattaaattcctaaactattattttttcaattgaatcattgaatttgtatttatttttttaattgaatcatttcatctaattatctaatcaggtgtgtgaatatacatcaaagttgttttaggatgaaactttgaagaaaatttatagtaataaaatcttcaatggtttagatgagtataattatgaatatataattacattattattttagtttaatattttataatatttgtatatatcaataatgtttattataagtttttatgttaccatagataatttgttcttattatttatcattattaaaaatgttatatttgagtgaaaatttacaccatgtttatagaattaaacgtgcatagtatcatgggttcgaattaatattagtataagtcttcaaataaattaatcaagaaccgcattattgaatggggtatttcatattgttacttgttacaaatttaaaataatttattaaaattacagttttgttattgatgtaaaaaaatgtgtcgttgatgtattattaattttttaatatcattaaatgttagaacatttaactcattatattttattaagtctattaatatagttcaacggaaattagctttattttttattaaatgcattgatataataatatttattttatcagtatgaatggaagataatttcaaaaaaattataataatttatgtgtcttatttaaccaattaagttattgacatataaccatcgatgatgataacattttattagttttctttactattatagtattattgtatttcgattaaattttaaattttaaattaaatcctttgatattactactttcggtgtattcatgaatattgacgaccgaatagacaaataccgtaaagttgctccccgcgacttatcttaacgtaagtcttcgagcttgtggctcaataccgcaacctttccaggttttttattcgtgtcattttcttttattttttaataggcaaatgaaacttatatattaagatagcagcagaagaagtgcgaagatatcaggtacttagaatatcgcatatacatgctctgcaaatagacaaataaccccaacaaaatatgatccaaaaaaaatgttcaaaagcctagtataaaataaacaaactcctgtagcttactatacccaggaacaattgcatacattaagcttcagactttgctacccgacccacttccattttaaatttccaaatttatggaaccaaccccgaatttgtggatcatttggttgagtatattataaatttttatttctataagttgatattttttaaatttttgtctttacaagttttttattttttaaattttggttcaagttgtttttttaattctagtcctttcagattttaatttttttatttttaatcattgtaagttcacgctcacaaggatgaaaattttaaaaacataaatttagaggaccaaaattta

SEQ ID NO: 92 - DNA, 2200 bp, Glycine max
  Soy_ogl_6542 Gm19:43906501..43908700 Cluster 1
aaattttattagaccaatattatattaaaaaggacaattataatacatgatattcctttcttcatttggtgacttaagtctttgtggaagttagttaagaacttgcgatgaagaaattaaaaagctgagctttatggaaagctatggacggaaaataatggttagtggataatggattggaacaagactaaattaagaaagactttctctctttggttgagcgtgagacacatgcaatgtgcatcaactctaaagcttttttttttttttacaaaaagaaacttatatcattccaattataatattaaaatcaacataagacgataaatactcaaaaatttaatttgatgattaacataaaatctagacattattataaaagcaaattgattggcttatctcctgacaaaaccaacacattgttttcacatatagtaagaaaaattccataaactgtcacaatagaaccaataaactctaaagtttaaaatacatacttttgcattaaatggaaaattttgccttaaagatatagatcaacatggatcatggaagtggaaccaaacacatactacaataagtatctaaatattcatagaatactggaatctttttttaaaatttgagtaaaacttaaaagtaaattaaaaatatttaagagaaaaaatgaggattatcaaaatgcataactaatcaaaatatactttaaaaacataaatgataataaaaacttcaaagttataattgaaaagatatatgtaaataattaaaaatttaaaaaagtgtgttaacatgtttggtaatctaggactacattaatcactcattctttaaaatatctcccacgaaaaattgataaaaataagtaattattttaaaaaaaaaaaaactaaacacctttattcttcaaataagagtactctaattaaggatgatagttaaacaattaacaaataaaagttttttggtaatgcatttataatagtaaatatttgattttttgttgttgtacaatagcaacaacgtgatttagacatagaattttgtagaaactatccaaatctcaaagcttggggacaggttgatatttaaataacataccttttgatgattttttttttatttaaacctaggttttattattttatattttttgttaatcgtcttaatatactataaaataagtactaaataaacataaatatatttactatcgcaaaaataatattttcttcatttaaaaaaatataaaattgtaaaaatatcttaaaaaagatttaacttcatttttctatttgtttattccttgaacattatccttacaatagcaattagtaaaattaatttagaaaaatactaacaatatactttctaacacacttttagaattatctgcattgatatacttcacttttgttttattgtattaatcatttcaaaaaaaagttatcatatattaaggagataatggaattgattaaaagtttatttcttttatttatatgactttattattattataataattttatttataatgagtatgtaaagtatttaagagttaaacatgattaataatgatataattaaatataatacagtttaatttttgttaaacaaagagtacaatatttcgattgaatccttattaacaaacagtttaatttttgttaaacaaagagtacagtttaatacacttaacattttttttgtctatagtaaataattttttacatagtgatatttgttggattgaatacttattttaatatttcgattctttttataagaaataatttttaatctaaaatacactaaaatttaattcttaacaaaaaggccagaagtagtgctatttatttttatggagaataaaaaattataggtatatatcctaaaacaatatgttagaaattttgggatggacaacatatttgattattaagaatcaaaataaatatatgaatccatagctaataatcacattaattaatgatgaagacttgaaacaatcaaagtcataaacaaaagagttgatgattctttattagtttattcttcaatgacattttcggaacgtactcttcaatacggaaaaaaaatgatattaagtatgccatttgttatattataacaaggatttttcatttattgactccactaagatttatgccaaagtgagtcaatgaaaatatccact

SEQ ID NO: 93 - DNA, 2374 bp, Glycine max
  Soy_ogl_6613 Gm19:47377201..47379574 Cluster 1
acgaattgaatcaatttcgtaaattattagtgtaagatttcatagataataaaagtttaaacttctaacttttattaagagaatttccaatcctagttgcttagtaagttacctgtttttttttttatacatataagttacttatttaaaacaggttgtttaatatttttatagcatcgtaggagatcttctattatgttgagttatttaaaattaaactctaattatttttgtaagcacaacaagttgcttacgataagaaatattttttttgtcatttaagaattatcaaaaaggattatttaaagttttattgaaataaaatatatgaattgtttaattataatgtaacattacggaaatcaattatcaggaaataaaaaaaaactttaaataagttgtttaagttgtaaccaattagagatgctctaattaactcaaattaattccgattacacagacgcatgtacaccccctctctccatctataattcaactagtttcgatttataaatcagtattgaaccaaaatgactgaatttaattataaatattccatgttaatcctccattgtataataaaagatcgtaattcttaaaagtaagataactttttattagattttttttttggaaaatacgacataatcataatcattaaagtacatttttatcttttgtaatagaaacaacacattaacttgttcggtttttatgttaaaaaattatcttttcgctaaaatctaactgtttaagtatattatttttatctttaatgttaaaatttgtattttttcttagtcttaattatttttaatctaaaactaatgtttatatataactattataaaattaactattttaagaataaactaatctgttagtatattattttaattcctaaaaagttatgcactattctgtttttttttactagtttagttttaaaaaaacagttatacatattatttatgtaattttaaatatttatagtatacttttatattctatccgaatctaaaaatcatgatattatattttctctcttcaaaacctggcaactcataagtttacattaatgttttaagttcatttttatatattaaattaaactacgctattttaagaataaattaatctcctggcatgtcattttctaaaaaatgtacattatttttatttatttaaattttgtggttttcaataagtcgtgtgtattacgtatatatacttttaaatattaaaaaatactttctaaattacaatgtttggtatttaatctaaattataaaataattataaaatatactgttattaattaatttcaacaaaactttctagtcaattttgtcacttgaaaaatatgcaaagcaaaaggtttacatggttgcaacttgaagactttttttctgaagactttgttttcaccttatatgtgagacaaaatgtagtcccaaacattggggctttacaattaatgacgaacactcataggggtaaagaatttaaaaggaaattgagcatttgacgaaatattcaaataaaggaaagaaatataagtaatgagagattattattattattatttaatttgttgcaatggcagatcctgaaacagaaagcaacttatgtgacaaatgcattctcaacattttccctctttctcaattatatgaagccacaagtcaaagaaatagaaaaataagagtatgattacattttcttttcaaagctcttcggattgattggttgatgtccgtaattcgggagctattatcgtactctgtcaaagattgaaaaataccactcatattgaattatacttacgacacctcaaatcatacaccaaagatcattggttaaataatttttgtgactagtgaattaaagatataaaatttattttaaatataatgtaaatgaaaaaatatttacatttctttgatacgatattttcaagtaaaaaacatcactaaaattactcaatgaatcgtctataaaaaaattgataatttaaaaattcgaataatgtatttaaattaaaaatttacaatagagtaccttacatttgttggttgataatatttaacatattttattaaatattcataattgtttaataaataaataaactattttttttttactttcaattcacttttctgtacttttgagttttgaaaaaataattaacaaatttattaaaattaagctcggtaatataattacttgcaatagacattgtatttaagttgtcttataaagtatgcttatgttattgaattatcataaacccctactaattttttgaagtgagaaaatatcaaatataaatatttttatttgacttttttagttaatatttaaagtcatc

SEQ ID NO: 94 - DNA, 3700 bp, Glycine max
  Soy_ogl_6634 Gm19:49969901..49973600 Cluster 1
agaattttttatgctgctagaacggcccccattcaagagcgaagacaaaacggattacgagcagaacggagaaaaactgtatttctcattgcgatgaaatggagacattcctacttcataataacttctttttttaaacataatattgtgaaatatttattgacgattttttgtcagatactacttttaatttttttaggcattatatactatttttaatgaactttttttttttctagtcaattttttttttctttcaaaagattaactttacttaatgaaactgaattcaattttattcaaatcaaagacttactgtctacttaatactatcttttaaaagcaagtgttgataattggattggattaattaatattagttcaacaatgttttcattaaaagtattattactttactttcatgatgagcttcaatacatcgatcattgatgtaattttaataaaaatgataattttttaacgttttaattgcactattagaatattagagcttgtttgagtaaatttatccaaaaggactttaagaaaaataaaataaaatagaatctttcagcttttaaaaaaattatatgagataacttgtacctattatcttatatataagctaattttaacttataaaaaatattatcatttttattttccttttctaaaagtttttctaaatatacttatccaaactaacccaactcaaatttgttttacatgttactttttagttttggtcttgcacagaaacaaatgtaaatagacatgtacttaattattagaaataccaaaaaataatgcgatagactcattggaagcgaagggcaggacgcaagagcagcaaatggatggtgacaagacaagctcagagtaaatagttttgtttggtactactacgaacaaaccctttggatgctcattttagcaccacaaaattctaaaccagagtcaaacttcccaggtctataatatgtataaatgtaactatgtaaccaagggattcatatcattgtttttaattggggcacgtgattgagtcactaccctatggacgttgttgttttgatgggcgatggttccttatatacgtcaccattcactcatcgtgacctcaaatataaaaattggtgttatttatttttcctgaaaaaatgatgcaaattggatcgataacaagtttcaatttatccaaggtatcatcctctagaataaaaacacatctagtaaatattttcatagtatgctgtaaaggtgtatctatttaatacattttcttaatactcttttaatatttaataaaacaaattaatcagagttaatgtatattaacattcatgtcctatttgatagagaggagaaaaattaaattattgaaaaagaaaagtatttggttgaagataaatagaaaaaatatcagaaaaataattagagagttaagtaaaaacaagtgaaacatgatacaataagtcttaccaattttaaaattatttctctacaaactcttacctatcaagtatcagcacttattttcatattgaatttgaactaaccaaaataacatttcgtggtttattttggatcaatttttcaaccttttggatttattttatatagttttaaaataatttttaatgtgacaattaataaaattaatttgatacattgcaaaatttgataaccagttaagtttcgacaaaagtttttttaacatgacatttactaaaggtgttgtttaagctttggaatcaattattttatatatggagatataataggaaaaatgatataaatatattaaaaatgtattttagtttaattcatcttcaactataaggatgatgtggtagtgggagaatgatttggtgttctcattcctttctgacaaaaataaaataaaatttgctgcctctatagcaaagaaagtaacttaatttttatggtgccggtaaaaaatgcatgaaaaacatatatttatgagagagaggctacagatcagttttactgcggaggatccggatgccatatttcttttgagaagcaaatcaagtggtaattttattagctaaatataggattctcattatagttcttaattttattgctatttctatgcttgtggatgtttgttccattattttgatattttctgttgtgggttctagcttcttaattttatttattaagaaaaaagcagtgttaacttctaatcacgcttgcgtgcatgtttttctaaatgaaaaatagtaccttctttcccacaagactagctttatacacaggtcacaggtgataaggcatagcctatgcccgtaaatatacttttgtgtgtcccaaaaatagaatgtagtaaaatatatgtatatacaattatacacatatttcttataagagttatttgttaaaattaatgatattaagttacgagtattttataaaaatatactattaagttttaaaaaaacaaaattttaaaatgatagataacttccaataacaattgactattatttagtgaatattgtgtttcaaacaaaaacagagaaactttattagtaataattatagttattactaatcaattgactattattatagttagttgttacaattatttagtaataatttttcattttctaccatcttgtttatcatatttttgtcatctcatgtcttctgcaaactactacttacctctgtttttcttttctatgaataccaaattactagtctcttcttcccgaatatcttgattaagtgccaaaaaatttgcaattgttattaagggtaattggtggacaaaaagaaaaacatattgaaatcttacataataaaaataatatcaaaataaattacataaataaaaaataattttcattttataaatcaattttataaggtgaaattagactcataaaactttaactatgggaaacttaggatcagagttattacaggaatgctaattgtgggctagaatgtaattttcttcaatccgtactttgaaagaaaattgagatttttatatgcccctcgaacggtccgaattcaatagaaagtacggaacaaaaaaaaaccatttctcctttctcgtaaaagaaatggggacgttctacagtacattttaaaggcaatcattaataattagattaaaatattggtgaaaaatgttattaatttactctgcatttttttatatcaataagattcaaatttgagattttacttaaaaattctaaacccaatttctttaacaaagtaatgctggttttcatgatgatttttgatatatcattaacgtaattttagtataaaaaataattattaatcttttcaaagaaaaatgcaatagacttattgtccgagttttgaccaggcaggacggtgacaagacaggcactcgtaaatactagttttgtttgaattgctattaggaacggaccctttcgttgctcatttcagcaccacaaaattcttaatcaaagtcaaacttcccaggtgtgtataaaactgtgcaacgaagggattagtattggtatcggtatcaaatgtatcattcttattaattgggtttaaaccatgcacgtgattgagtcactaccctatagacgctgttttgaagggcgatggtcccttatatacgtcatcattcactcatcgtgacttaaaaaatgtttcggataatcgttaagaa

SEQ ID NO: 95 - DNA, 3900 bp, Glycine max
  Soy_ogl_6785 Gm20:36264001..36267900 Cluster 1
tccaattatctagagttaaatggtagacaaatcaaaagtcaattaaaaaaaaacaaagagttctattatttcaagctattgaagtcaaacatcatatttagatcaaaattaatataatttctgccttcattgacttgcatgcatggccttcggcaaggaggtttttcttggttgatattatgcaccattcactctcaaccccaacaaaagatcaaatcaaaggaagtgtttgttcattcaaattgcattgggattggttttcacttgtagttgggtaatatgaacatactttacaattttgaaaaacaagggcgccaatgtgtaatattagggcaagtatatcagtaaaaaggaaaccgcctccagcaaaagaaaagaaaaaaaagaagctatggtaggataggaggtggaaaccgagaaatttattaatatttctctcccaaaattaattggataaaaaatcttagaaaatatttattttaacttaatgtttatccctcgtttgtcattttgttatataatccaatggacaaactagcctattatacattaactaataaaatttggaatagttgctaaggatgtgtttggataagtgttagaatccgttcaatgcaaaagcttcaattttatacagtcacggttagtgtttggaaatgtgtgaaatttttcaataaaatttatattcacacgtgattctcgtctccgtacaattacaaattacattattctagtagttgcttaaataataaaatgggtgtatcatctgtcaaaaaaaaaaaaaatgggtgtatcaagtaataatttagtggtctagtctcttcgagattatcgtttggagaaaccacgacttagcagtggacagcacgttcccatatttatccatgtttccacgcgctttctttcaatgctaaactaatttaggttggggtttattaccaagtatataattttactatatatatacatttaataaactatatacatttgataaatattatatttaatttaataaatataaatagaaaatttcaagttaattacatcgtaaatttaatagatacaacatttaatattattatagtaatcaattttcatttaataatgatagtataaataaatgctcctatgttacacgggtttatttacatttcatattataagactaatttgtggcaaaatatgtgaaatttattatattttaaatatgtgaagaatatgataggaaatgtttttttaattaatttatagttattaaatatttatatagacaaatttttagtgtaatataaatattttttgttgtactaaaaaaatataaattttcaattcttttgatgattttatcgttgaaaataaaatatttcaaagtaattatgtgtataatattttttttgaaagaattatgtctagaaagttgattaaatatcttaaattgcatatatttagacaagagttgtaagtagtttcttagtggttattgttgttattcactatttaaaattgacattttacttcagcaatttatattgtcctttaatacaaacttttgttattcacaggctattgaagtaaaactttaaatctaaatgaaaataccactaaaaatacttaaagaactacatttaaattttgcttgtatattttcagtctagtcattatgtttctctttatttagaaataagaatttttaacttgtaatattgtttgacattactcttgattttttattgtctaggacattatcctccgatcaaccttagagactaatctttcaaaagtatgaaaatttcttttaaaaaataaaattttaatatattttttatatatacatatcatgaattaaacctttattatatagacacatatttatttatcaattatgtcacactattaataatgtaacatatacatgtaaaaaatttatatgttttgaaaattataaaccactgtccgtaacttttagaagaacctattgtactagacaaaccaacttatttatatataatattattttaataaaagtattaatatttaatattatattattattttaacaattagaatattattttgtgacttagaattattttaatggttaacaaatggaatttattttatgattttaacaatttttagtgtgatagtctcttatcttagtctttaagtttattggcttttctttttttaattcatgaaatcaaagatagtgttaaaaatatgtaataactcatgtatcttattcgattgaagtaaatttctttaaccatttgacttgtttgttagctcataaatctattatctattagtccttttttataaacgcattagcccgtaagcccaggcttgtttggataggttcattaattcatctatttaaattcttaatatgaaataagcttttacaccgaatgacggctcaaatcagacttgtataaagtactagtctgtaagtttatgatgttaaatgtaaagaaaaattctataacacgttaacaaatcagacattaacgagagataataaatcaagtctaacttcacttgtactattttcagccctaatgataattcaaatatgatttaatttaaacaaaaatatgactacccagtaccccgtaaacaaactttcatttgtttagttgttagaaaattgatccttaattttgttaataaaagcacgtgttcaaatataaatatacgattggaattgaattaacttaaacatataattttttgtagataatttttattttattttatttattaatttaaacatatatgccaataacattatgtaaaaaaaaattcaatgattcaacattaattattccctacttaaaaatataaatctaataaccatacactttttatgtaaaaacttacattgtcaatcaattaaattattattattataaaagtaaaattactttattgttgggaggatatccctttcattttctttgtttcacccaaaaattaccgatcataacatatatttgcattttaattctaatattattttttttagaaggaacaggacacataataaagagaaactagtagtggtcagaaataggtgaataagtaaccaaatgccagctgtttcataatatcaatctggcaacaaataaatacacatacacgcgcacaaatgccttttaattaaagtcgtgcctgctggtttataaaatttatatatgtagtcccaaatgatcaattatacaggcgaatacacattattattttttttctcgatctaaaatgcagacgcatgcaatgccagaaacagaatctcattttttaaggccatccatgtatataaataaataaaaccagaagaaattcacaatgataagttatttatattttatttcaatacacttctcaattagaacacagaatatacaaaaaatcaatcattttttttgtaagtttttttactgtaattttttatttagttaaaatcaatttttatacttcatttttttttatataagtttctggtttaacttctcctaaaaccaagatatattacttgattttaactttagaaacggttataagaaggtgtcctggagtggcaagattttattcctttctttgaggtcgtacttctgcacggagtgtgtattgtctaatactctaatattccaacggccgagtctaaatacaataatgaatagacacatatacccatttctattatcatttgttgagaacaaccttgtcaaccagattattagtaggaaaatagtatgaatttgaatagaaaagtattaatttattcttcaaccgattcaaagataattttaatgatacaggaagaataatatcttcgtttgggaaacaacattattggagtattgagtgagtcaaaaataatattatcatgccaaaaaa

SEQ ID NO: 96 - DNA, 2731 bp, Glycine max
  Soy_ogl_6937 Gm20:42534001..42536731 Cluster 1
atttttcataataatacgtggagaatcaaatacattttgtaatattttcttatgttccatgtttgaggtgcgatttttccttccaatgtctctagttgatatatttatacatgctcatttttagtagcttgaattattttttataggagccttcccaatacaaagccaacttcccatgggctgtgaataaccgttttcccatcgttaacactttgtttggtgggtgagaaattacgcccaagggtggataaaaataaggtggtatatatgtttaaaagaagaaaaataagatataaataatttttaaaataattagattcattgtattatttttgcttaactctttgtctttcttcttatttattctctatgtcttttcgatcaagcatttttaatttatttttcacttatttttttcatccattttatttctattaactctatctctttcgtctctacaaaataacaaataggacttgaaagtggaaaagtaaaggacacttccaattatgtctgtactagaattgatttttcttctcggcatatatatagagttcacatagtcttgaactttatatatttctatatatatcctacaaaatataacaacggtcaagatctttcttactttcttcctttagaaagagaaaaagattgaaggctaagccaaacaagcatactacgtgcattcaaaacgtcacgaagaccctatctgatagatggaaaagaaaatgtagaagaaaaaaaaatgatctttgaattaaaatttttgaaattgcttattaaaagtcagtttttcctttcttcttttgttctatttatttttcaaccaaactaaaaagaaatcatattcatatttttttaatctctaatttctttcctttcgttcaagcaccaaaaaaaaaaagtgagcttagaactaaaattattttgtaagatcggttcaaataaaaatacatcttcacagcatctagggcaaggcttgtcttgaaaagttttcacaagatcataattctctcctgtatccacttttcatgtcacacttcttgctccaaaaaaacattttttttaaaattaaatgaccgttgtccttaaattttttttcctgcagacgagtatcataaagatacaaaaaaataaacaaatatttttataaaaaattacagtgaaattactctaaaaataagttattggcaatacctttttatgaaaaaattagcaatatctcaatattgtaagtatttattgacccttttatgcttaaaggaatattttattttattattatatataaaatatttattaatttgaatgataattaatttctgtgaaaaatatcattcataatcttttatgtttaaaaggatattgtaattttacacaaggtattcgatgtacgatgattattaattacattatgaacagggtcctccattgagatacccgatgtgtcattccccatagagtcaaaggaggaataatgatatgggagtttgtttcattgtcaagtgtcttcccttgggtgaacaaatcatgaatgcccatttgaatttgcatgtagggaataatctttccacgcattttattttttgcaaaaggagcaaagagatttcattggaaattgcagatccctgagttacggccagtaccatcttcacagatccaccacccaccactacaaaaacaacagcaacaaccattattccaatcacaatgtctcgatgctggtggagtgtgaaccagatttcctaaggatagggagaagaagcactcgattagaatcatgcatttaaattgattttttatttttttatctgagtgttagcatcgtaaataattagaatgctatttatattcaattaatctctaacatgaacaatccataggtgttttttttttttatatatatattcaaagttaactttgatctttttttggtttaatgataaaatattttattaattattaaaaatataaatagtataactgttaaagcaaacaattaatgtagtattaaaagagatggcaaatgatgaattttatagaaatgctgggaataaaaataaaaaaataaattgtaataagatactataagtttgaatgtcgcatcaaatagcataaaaaatgcaataagttagagaattttgtttaccaaccacctttattttagtcatataaacttataaggtaatgcgtgacatgagttactataagttagataaaaagacttatcttccacacgtgtgtgcatgacaagtagacctaaagtaagctttgaaatgttttttttaactaataaaaatactaatttactatgaaaggtgtgaaaagcaatggtttattatatgttaatgcttaaaatgtcactatatgatagaaaatacatagtttactgaagattagtaaatacaaaaactcaattaaaacaataactaaagtaattagtaattaataaacagataataagatgacagttgttttttttagaataaacaaataaaaatattttataaaaaaaagacgtataaaaatattacataaataatataatcttcaaataactgaagaaatatttgataaataaaatttgacatacaagataaataaatacataactcgaatctcataacgagacccttttaattagtgatagtagttcgcattcctacttctttcactcagtggagaacttttcgtttgttttggcttgattctattcaacttttcattc

SEQ ID NO: 97 - DNA, 2900 bp, Glycine max
  Soy_ogl_41 Gm01:1953101..1956000 Cluster 1
tttgtaattgaggcttattatcttaatcaatctcacaaaatatcaaacatttaaacgtggaaggttagttttgttccatatattagcagcagtacgaattagtgttagaggaaggaagatttctgttgggtttccatgcgcaagatatcatgtcacggaggctaattaagtagctgttgcagtgttgttgcctgttgaggatggaagctctgccagcttaaacgtcagagctcgtacgttagctattgtatcttagtttctcagatgaatagtggggtatcaaaaactgatatcatatatggtcatggttgttgcaattgccaattggtgagagtgagatcgacactcttatgatgggtcctatccctaccctctccttcaccacatgagaacgagaccaatcctagcaatatgagcagtgtcacttccaaataatgagggcaaaaagtgccataaaaagacgagaattttaactaacattgcagtagctagggaacacccctgctccttcagggtgatcgtgatcatcccctcatcaccttcattcctgttcactttcaaacattaattttttggtccaaatcatcaaccccattttatttcttttattttttcaccaataaggtttttaatttgtttgatttagttgaacaaatcagttatgtacgtatctgtatttaatttttaaaggacatgatgtaattgaaagtagcttcaagtttcatcatatattcctagacatgcaatattaattaattaattgccttctcttgatatcctttctttgatatgaggtaaaataacagtgctagctcaagacatggaatgggaaacagaataggagtactacttgataataacaataataaaaaaaaaaaaatccgagatatgcaatgcagcataataaaaacatttgtggtcaataatggttggttgtgtagtctataattcgatatactaacaacaaacagatgtggacaagtattgtctattcaattttgcttagcagaatttgcggactgggcaaagttacgaggtcttgcctggtcggtctgcaactataatacatctatgagagtatgtatggtcggtaaagtatcccctcattgtgtctaaaaacgaagtattcaatttatagttttagagaaattattatacttgatgacatttttcacaacaaaaagaaaacaaaaagttatgaaataattaatgtgatggagacatgcatagaagaagtatcattataaatatccaataaaaaattaataataatattgtgaaaaatattatataatccttatagtcagcttaatgacaaaggatttgagtagttatacaaaatttcatattcaaactttattgtcactgttttgtattaatttaacataataggatataagatatacaattaaacaaatataacttaattaattgattagtatgtatgcatgagtattgaaaaattctactattgtgttgtattcttataaataaaaaaattatataaatagtttaacttataattttgtacagtacaagtagtaaaacctgaagaattaacttcgttcgaagcaaggttagaatggattccagttctaaaattatattaaagttttgttttctaattatggggtttgagatccatgcattacaattacaaactgcgttcgaaacaaggttagaatggattcctgttctaaaattatattaaagttttgttttctaagtatggggtttgagatacatgcattacaattacaaactatgtctcgaacaaaattgactaaaaaaagtacatgtaaataaaattatataaactcttctaaaatcattcactttaatgaaaacaaaattgtcatcatgatttttttgctatggttccagcatcatacacaacgcttttgtccctacagtcaatcatgacactttaatttggaagaagaaatcataacttttaatgtagttctaaagtcgataaaaaaaagtagtgttatatttcatattcaattatcttattaaaataaataataggatgatgaaaattaacttcggtgatgattttgaaagatggagataaagggcgaattgtccctagaatgtttgttcacagttgctcattattaataagagatatgtttatactaaaaataaaaaaaagtatagcacatttcattttttatgggtggaaagtacagtttctaaaattcgaaaatataatataaccgtttcttagagggagaaaagtgtattttattttattttaaaattttattacttaattattcatctaaattaatacattctaaattttagaaggccatcagcccatatattaatgacttaaaagggccggaaattttaaaaatgttaagaatcaaatgtaaggaaattacttttggagaattaaaattaatatgattcaatatttaaagtactaaaattatatttaaaactttcaaataatctaaatattttaaaaaattatttaatgcatttactctatatagtcatcaatctatggatacacaatagtaaataggtaaatttaatagtagtaccttaaacagatttgttaagcaagttaaaattgaaaaaaaatatattaaaagttacagtattaatgtatttctgttatgatttctaatacacatttaacgcaatttattattttgtttttttattttcttaattaatgtcttaactcttaaagaacatttatcaacactctccttctgattttgcaaaggtttagttgaaaagattttgaaacttttgtttcatggattatttagtcatcattggaaatacaggatcacaaaaaattatttcacatttgttacgagataataaaaatcaatcctaagtatattttatttttagaaaatatataatctcacgtt

SEQ ID NO: 98 - DNA, 2000 bp, Glycine max
  Soy_ogl_656 Gm02:44754701..44756700 Cluster 1
aagatgtaagagcatcgcacaaacattgtcctcacaaaaaaattgaacaaatttaatacgacagaagaattgcatgagtcttataatctcttggatcatactccatccatttgagcaacagctaaagaatgtatttgcacaattcagctatataagaagtagttttaccaattttcttagcaaaatcttaaatccaatcacctcttagaggtccaccacaactagtctctcccccgaaccatcagtattaacagccaacccttccatgctttggaggctaagacacataatttcaataatcttaaaatttaaactattataatataatatagtatatcaaaatttaaaaatttaaatcaaataaaaaataaaatcaattaaattaaagtaatagtgtttgaaagtgggtattttagtctttgagcattttgtatctagaaaaaaagttgagataattttgtgtcgtccatttcacttgtatcgtcccattattattttttaaaaatcaaacatgaaataattccatttgtcctattcattaccatgaaatagcaaatcaaatagacactaaattataaaaatagaacacacaaaaaataagttaaattgtgttttataactttttagtctattttctaacaaatcaaaacttttgtagaaaaccttccatattaaagatgaaagttaaaaaagttttcactatattatctcatggagtaagatgatgcaaaaacaattttgttaaaaaattattttctttttcttaaaaaaaaaaacttttttataaccgtagtataagaattccaaggaggttttaaggatgcacaaatagattaaaacagatattggaggttcaaatcaaactaaaaaaacaattccaaacaaacactcaaatactaaggggttaacttagtcaaataaccaatgccgatgaatagttataaatactttagtatttaactttaatttttacagataaaaaaatactcaaatgttcaaccaagtaaaggtatgatcaaagttaaccttgatcatacattcacgttttctattttaattcaactcaatataataaaataagtataaataaatcattgattctaatgatactgaatttaattttcttaaataaagtcttgataacaaaaaagtacatatgataaaataagtgtgattttttttgttagtaaaatacactttattagttaaaattcccaattaaaacttaggtaaattttggttatatttattttaattacgctaaccttccattaagtttaaaaaattaaatattctcttcaattttttaattgcatgtaaggttgtcatataattggataactattaataatcaattcttgaagattagcatcaaatgtcaacttggttgccagtactcatcaaatttggtgtgtatatatatatggacaactactacacatgtaaattcttgagatgtaaaatcttctaaaaattaattaagaaaaaaagttaacttctgattattggaaaaccaaagggattcaagtcacttggactattttaaatagttcacatttgaagaagtagcaacactaattaagagaactacatacaatacctgtacgtatttataatctattcatcttaattaatagtttcaacctccagatccggtataaaaatcaatgttagattttctacggtcttgaaatatagtatctgaccaacctcatcagtcatcattgcataattcatcaatgaattgagattgagaagaacaaagcagaagcatataggttgagtgaagttcaaaggaaaatgcatgataacttcacttcgttgcagctcatgtctaattccaaccttaacccttcagccttggcagggttggatcgatgaaactgagattatgtaatgtcttttgttaatttgtttaagaaattttagaacctaaaagttaaaacagttaaggtcttagaaattgatcttatagagtaatgaggatggattgttgacat

SEQ ID NO: 99 - DNA, 2000 bp, Glycine max
  Soy_ogl_679 Gm02:45618201..45620200 Cluster 1
ccgtggcagggtactattctaccactagaccactggtgcttttttatcagaattctacacaaaataatatttattaagtaattatgttttcaacttcattttgtttaatctatagtaatatgaacaggtgtgtttcatccaaaatttactttggtttcttgcgcctctgacttgacatgattaaaatatgctgattagactcttgaatttgatttcaccaagtagaaataaaagttcaagtcaaagggaattaatttatatgagataactagaacttcatttgcatcaaagtttaaagacaccagagtccacacttcctaaacattttacaatttatatttttctattacgagtataatttatgattctacccgctgtgttttgtagaagcttcaatctgtaaaatcaaatgcaatagaatcaaacttgggttatcataattaatctctcaataattggtatgagtaaattatactctattatctcgaggttaaatgtaatattcaataaaatccaaattaactatatatttcactgtactttatcttgaaaccttttattaaaggatttatttgtaactttatggttgacttaatgtcgataatgtatactttatattttatgatttttttttgttaaaatagaattttgctaacttatcttcttttttttcaaattagtcttaaatttaaaaagcttcagtttaatctcttaaagtgtttcaattaatggtgggaggcaagggattttatttttaagtttagggggaagtatgttaaggaggataatttgtggggaaattgagaaggataggtgtaaaaaaggaaatgcaaatagcaattcccttttcattttattagtccacgtctacctcatagcccgggtaaaatggcttgacttgcatatcaagaataaaaaaatattttttttaaaaaaaaaccgactagtaaaccaaaataaactaaaaatgtctaaaaaaatttaaaattttattttatattttattttttaattaatacttgttaataattgattaaatttttcataataaatatatatactcatacataaataacaaatagaaagtcccagccaaaggctaaatatatatagtatttattgaaaacaaaccaaatattcgagcacatcaactaatatatattcaagtaaattaccaaataaattaaaatcaacctatttaagcactaacaaagaaaaacaacgttttgtccgttaaaccaacatgttacatggagtggctacacaagattgaaaatcgtatcttaaaattgaaaataatcattgttagttagataaagaattattttataacttttaatgaattagggaccaaattataacttaaaataaaattaagaaatcacattagtaataaattagtaacttttacttccttgttagtttcctttaattttattacaaattgattgcataggccacttgcatttgaggctaagtgatgcaaacttctcaacaaattcctcttttttatctcaccaaagtactaaagatatgtttgtctcattggatttgccaaacataaattcacgtaattttagcaactaatattagtcaaatcaaataaactaattactgaaacaatcaattgatttaaaacattgtaattctcaagtagcgatttgagaaagagactttattattcaattataagatctttaacttcaaacctaattcctatgacttgttcattttaaagattagattggacttttttcacgtttagattaaattaagcttgaagctagctgataacttcaggatttagtcaagcttgaccggaatatatatgtttgatatagagttgcttcaatcataaatgtcataatatttttttttgaaaggaataaatgtcataattaacaagtggataattgagcatgtattgtttcaaatatatattcatcaacttgaagcggactacctcgtttcaaacatttaaaaaatttatgaaaattgaa

SEQ ID NO: 100 - DNA, 2386 bp, Glycine max
  Soy_ogl_801 Gm03:1938301..1940686 Cluster 1
agagctgtagttatttctattgcgcggcattttggcagcatttttttcaaatatcataatctccttaattacgttacaagtatagttggtttcactttaagaacgtattcttgcaatatttggccacaaatttgattcttggctttcatgatttcaagagatcaacatccaccatgtttggtagatcctcaaatcaattttcgcacaaatatgaaatatctaggattaggaatgattccttcgtattcaaaattgtaacattttgtcgctttttaaagaagtggaatggaacataaatgtttgatactatcattattattttaaaatgtaaaatcttatcactgttaattttaagtgacaaagaatttaatttccttaaataaaatcacagagttaaagtcttacaaatgaaaaaaaaaatattaaaagaattttatattcttaaattggtttcaatttaaattattcaaaatacaataaggcttttgatcgaatattgaaagtttaattacgaaaaaaatgaaactttgtaaaattaattcagcaatatttaataattaagaaagagcgtctatacttacattttagaatgtttatgggtcaatttgttacatattttaaaaattgattttaatgtaacataatttaattattagtttttggaattttttaaaaatcagaagctaatttatatttatttttaatcataagaataatttattaaagaagcaactgattttatgaaaacgattaagaataacatctaatattaataagattttatattcttttatgcttctgaattttctgaaaatattaaataaattctataaatatttaataatttagaaggactctatacttgcattttaaaaattatggttcaatttgctacatattaaataaaaaaataatatcttattgattatttttagaaatttttataaaacagaagctaatttatatttgtttacaatcataaaagtaattttttttaaagaagcaccttattttatgaaaaaatattcataatattttttattcaataaaatttatatatttttaacttctaagtattttggaaagctgaagcaaatgcatgaaaaaattttaaaagtattttttatataaaaaataagtatttcttttacgaaataaattgtaacaaacaggctttatattgttatacaaccgaaatagtttttaaattttatagataatcaattttacaaggaaaaaaaaatcttgatgataatccatatatgtacttggtaattttagtttctagctaaaggtttgaatttggtttaaacacatttttaaggtttcgccaatcaccatcctagtcagactcgagcttgatgcatgtaaacatttgattacttaggtaaacaatataattaagtatcgtttaattcgtgtgacagctatgtctttttttttttctttcccttttataaagcttaagttaacgtaatttattttactcctatggaatgtttgatttagtggatgagggaagaatgatcaaggagagacggaaaggaaataaggaatagcctgctaaaggaatgaacgaaagctttaagcttacatatatttgtgggctcatattttaatattatgtttcatcaataattttggatatgatggaaagagaaagaaacgtatattaaaataggattccacatatatgcaagctttcacacttaaagaagtcttaaagtcataaagagacttaaaaagctctattaatagacttacattattactataaaagtttacacatcaaccaagttagttagaaattatttttttataaaaattaataaatttagtatatgtattgttggatccattaaatattgactcattttgattttatttttagtcctctaaaaagtaatttcattgtattctgtctttgaaaatttcaaaattttccttttaagttctttattcagtttcgttaattttttcagttaaaaatttatagttgtagttattccggcattaacattttcatttttgacattaacagtcagtgtgccctccaagaaaaacaaattacagttctgttattcttatacacatcaatatatatataaacaaggttgcaatgaagtggtttctttggcctttcttttcttttttcattaaatttatatacataaatttattaaacatgaatttatcaaccatcatatagtctaacatattgcatctcatacaattaagatcacatatatttaactatgctctccactaacaaatagcacatcaattcaaaacatctatattttttttaaattattaacacaaatatcatatgaaaattaaatttagggggaaaaccatgccaaaaaagctattgacttgaaatcga

SEQ ID NO: 101 - DNA, 3100 bp, Glycine max
  Soy_ogl_1022 Gm03:41668001..41671100 Cluster 1
acatagacccgtaacaaataatttattagaaggataaaaggtcttgaagagaaaaattattctcttccttaaatatagtacttatgagattatgtttattaataaaaagcatcacaaaatttactgttaacacttacaatatgattaagtgtaaaaagagtatgagatgaaacttagttatcaataataaaaagacttttctaatacattgtaaagagaaagaagatttttggggtgctgccacaccttatatgtgtactgatttatagtttatgcagataatttaatggtggccactaataaaagtactgctaaaaggttggggaaacctttcaaagcactgtttatattgatgcagcgaagagaagcttgtttgtactaagtatatttaaaatgtttttaaatatataaattatattatcaaaaaatatttatttagttttgtttttatatcaataaatatttatcttgcatattgcatttgttaaaatactagtttttttgtgttgaatttattttcaaaaaaaatttactttcacaacttgttttattatcacgactcccaaaatctgacaagtggactaacactccccattatgtggttggattaaatgcaacacaaatggtgttgaaagaggatcacaaggcatggcagtttgtgggggtccttccatgattacaggggtagcattcttggttgttttgcattatatatgtgcatatatgtttcctttcatgctgaactcacaacgatcatgctgattatgctccagtggtattgacaaaattttatgattattactttaaacatttaattttatttgtcacacatatgtagagaatgaaatggatgtgctgaaaagctaactagtgttgacatccactctcatggtttcatgtggtgggactatatccctaatttcatcaagcacatttcaaccaaaataggctttcccgagtcttaactatagaatctgtcgaagtgtcttgtccactgaattcctttgcatgggttttttctccccaatgtttttcatattatttttctctttttttttttttttaacaatacacgatagttgggatcttttgacaatattccacgctatggcacgttaaattttgcaaaatattttaaaattttagttttaataattaaaatttaaggatttattccacgcttacaaatagtttatatgattttttttaggaatttttttaatacctagttttttaattaatttgatctgtgtaatttacaaggaaaaatattaataaaatcatataacttaattaattgatttttttgtaactttttggataagttttgttaatttaattaaaacttaaactgtatcaaaaaacaaacatgaaaaagttacactgaataatgtgaacagacaaacaagtttatcagagaaactaatcataatcctttataaattttgaattgattattacactctaaaataaaataatattactcgctagtattttgtcaagtgttagatacatgctcgatacgcaacaaaggtacacttaagcacctaacactactctctacactcaataaattatcattttaccctttattgttttctgggtttaatgatggaagctatacattaaacattgttaatactgaacatgaaccactataggattgtatttttttttcttctaaaaataaggcatccagccagctagaaattgttagattaatcttcgaggaaggaaataaaatatgagtaaaggaataacttctctcccccacaaatgttctatttacataaccagaaatcaaactctataatatgcttaaaggactcaaattactaattatttgtgccacatcttatacactatatgattacactttacattaaactaatataaatgctaacaaatgttcttaggatattgattaaataattaaaaaatagtaatatttttttagatgtgtaaaattattttgttcataattttttttacatttttcgatgatctcaacagaaaatactttttcatttttatttcttaagtaataccctaaaacactggttaacaagacccctaaactaaaagttgacaccaacaaaaatcaactttaaatgcaaatttagcaccaatttggtctaaattagtaatttttggcatccactatttaagtaagtatcgtggacatagacagcacataattagaagttaagattacaaaaaagaagtatctatagtcaagcgtcattcaaaatataattagaagttaagactagcaaaaaaaaaagatctctagctctagttaagcgtcattcaaaatataaataagactagcaaaaaaaaacaaagaaagtatctctagttaagcatcatccatattatcctcctactcaaagtggggcctcaacctccgctcaaaatctgcaagccacagcatcacggcctccattagttgctcaatgatagcaatcctctgctcaacagccatatgctcagacttagcaattctctccttaaatgcatcaacacgacgaggatactgactcaataactctgcaacctgtccttcgctcttgccctcctgctcattgtcaagcttagcagcagatttaccaacaaaatggttagtatcataataatgtacaacacaagagatacctgtctaagcttctgaacgagaagatgccttctctcttctgccattcggcttctttcttgtgccaatcaatgtcctaacaacatatttgaaaacaatgttttaagccaaaacaatggcaattaatatagcctcatattccaggataataatcattcattaatcaaagcccggaagaaaagatagcctcaatggcatggcatcctatactaccttactttcaaaggcagcacatttggcctcaggtgaccgaattctctgccaacagcaaaaataagaagtaatcactaatcaggcaatcaaactactttcataaaaggtttctttgttttgatacataaaattgacccaattaaccttctgagattcttcatctacggcaattactgtttcctcacatctttcaacgaacattccattttacattgaggacactaggaagaaata

SEQ ID NO: 102 - DNA, 2372 bp, Glycine max
  Soy_ogl_1122 Gm03:47109701..47112072 Cluster 1
ctctccccttcaaaaagtattttaatatcatgtggaccaatgacccatatatcatatattaaactgataaaaacacataatatccttcatcttagccaaaagactgaaaaaggtataatttacaatatataaataagaataaattcctttataattttatttttaatttgtgtttattattttgttgaagaataaaatctcttaatctatttattatcatatgcttattacatgtttatatgtaatacaaatttgatgaatgcaacttaagaaaagaaataaatatcacaaaaatgtacttcataaaaaaaaaaaaaaatatgagcaatcacaaataaattatttataacaaccacaaatatattttcatttaacaattttttctcatgatttagaaataagacctatcaaaattaatgattttaaacaaatttcaaccaaagcataaagtaatttgctaaaaaaggtgtcattagcatttcttaatgttatattatactttatccatattattataattgttatataagaaaaaaatatctcaaaataattattattttaatttttcaaatgtaacattaattatatttttcactcgtctatcttataatgttaatgataaaatacagaaactataaataaattaatgatgacataaaattaattttgtaaaattaatatttttttgttgttatgggtaaaataaattaagatgatagttattttgagatgaaagaagaattatattataatagtaatattgttaattttatacattaggtcccacaaaaggaagagaggtataattattctctatacattaaggaattgctctccatcgaaaaaatttatatacttaaattgcttaatcagttaatcagaatagcacaagtcccatttagagttgctccgtatatatctggccctaaagattgaaggataaaaagtttggagacaacatctagttggttgacataataattctccatgtgggtgctatcataagacaaattatgtaccaatcatgtgctccctctcttcgtaacacttacccatagtggttgtagcattgtctttaattgcttagtatagtctttatcaacaaaggcgattacttgacagtgctgaaataaatgaagatagtattagtggaggtgacccatattgtgattcgccatttagataaacacgctaattaatcaaaatgatcaaaatgagagaagataaacatgcaaattttgcaatatgactgaccacgaatagagaatttaacgagcttaattttttacataaaaaaagttcaattcaaagttaattaactcagtcaaatataatccttgaatacaaaagtctttcttcaaaaaagtttgttcggattagatcacataaaatatttttatttttatttaaaaaaacattcttttaaataaaaattaaggatgaattgaaaaacgtacaagagaaacatttaaagagttagagttcaggttgaatttagttaagtttataatttattaacctaatatttaatttgaattaattggtttttattcttttttagtcgacccaacttgatttttaaactgcgaatcacgtaaataggatccaagagttggtttgggttcatgtccatacctactactgaagggtaattatatttatatccaaaatatataatgtaaattatggatgattgactggattatattatagtaatattaactggaatcattatgtaaatggcttattttattttgtcatatggcctgatatgattctcaagaaaaaatatcaaaattatccgataaacacaatgaataatcttgttactgtcaagaaaacataaacgattactcattccgtgacttctaatattaaaatattaatattaggtcggatatgaaaaattagaaataccgtaaacatgtgaatcaattaaccgtaaaattatttattaacaaatttttagtgagattaatctaggaactcacataaaaaagaaaagatatggatgagaattgagaaaactatgtaaaatcctactccaatgtaactatttataatatatggactgccatctcaaagaattaatatataaagtgtttatttatatattaataatacacaaatgtttctaaaatcacgtatataagatcaaatcaaagaataaggtaaagacttaaactaaatgactaaattaaaagaccaagtcaaataaaatatcttttattatttttattaaaatgactttataatagttattattatgagtatcattcaacttgtcatatatcatcatcgagaagaaattttaagaatataaaaaaaaaatttaccgtcatttttgtcatcacttccaactcatagcaagt

SEQ ID NO: 103 - DNA, 2548 bp, Glycine max
  Soy_ogl_1228 Gm04:5261753..5264300 Cluster 1
ttaagtgtgtaaataaggataaattaaaaaataatagtttaaactcctgtctaacatgtttaacgactcaactaattaggaaatggacagctaatggatctgtgagctaatttggcacaacaacagtatagaataaacttagaaatagtttcaccttatttgagtgaaattagaccagaatggattgattgttatgaaacgatggtgcgtaacagaacaaagattgccgaccgttttggatgttgccgtgccgtacatatgactggggtcgctggaaactacaatgtatccagactcagtttagcaagacaagacaaatcacgaaccatcttgctactggggaaaaaaaactatgaaaaatgaaaaggaaaaaagtagaaataagattgtttagtttacattaaagtaaataaaaaagaaatgaaacatttaaattaaagtgattaatttaaataagaaaagaaaaaaatattaaccattaacacaattcttatttgttgtgataagatgctactatgatggccggaaggatttcacagtgagatggttttgacttgtaagaactccaagtattaggtgaatacatgtaaaagagagagttacttgtgaaaatatacctttagatatatagacatcattgccaaaaaaaaaaatcgtcgctgttcattattttgctagaagcatgatgttgtcacatttttaaatatactttaagtctattatttagtcaacaacttataattgtgctcaaatttacttcttatatcatttaaagtattgtaggcaagatattttctgtaagagttgctctcaacttagtattacttggatggaagtaatattaacttaaagtttaagattgatgcattctggtaacaattaccaagtacatgagactaggatgcaagtaatattaacttaagaaggaaagagagatggtgaattcatattttttcactaataaaaaattaatcattaaactaatatttattgataaaataaaaatattttattttcgtaaaaaaggcaaaaaaaacttttattgccgtcaaaacagaaatattctaagaataaaataaaaacagaaatattcaaatgaaataaagaaaaaccctactacaacacaccctttgctttgtcacatatctacctagtattatgcataatgattgaaaatacgtaagggtaacgactgacaatagctatctatttatctcctctatattatgaataataatatatgtatattttattgaagataatttagttttgatcaaataaaattatcacgaatcacaaattttcttttaattatttcatgcaattgtatattaagaatattagtatattataaacacttatttaatagttttcatttttcatatatctttttctttatattatattttctttctttaatgatgataattagtatctttacctctttagtgaaattctgatatatttatacaagttttgattttttaatcaattataaaaccaactctcaatttaaaaattaatcacatttaaaattttttttttttttcttacaatatattatgcagaaattaaacctaaatcaattctcacaaatttaacgttagttgaggtacggccattgaaatgataaagttttctcccattctttctctcaagtaaaattaaacatttttatccgaatacaaattcagacatctccaagtaaatcacgtaagaacactcaaatcgtactttagcgtcgtcgtcgtgactcgtgacaatagctctgcaagtatactattacgaacacagagtcaaaaatggaaaaagcaatactggactcgctattaatcactgtaatttatcgtttggtacgtgtttttatgtttatttttttagataatctttgatcaaacatttattgattataatataagtttaatattcatgcactcgctcacagttacattgtcagtaaataaatatttttctcttataatattttaatagttctacttttaagtttaaacttttcttatcgaaaaatcaccattttcttatttttaatattttggattaattaagattctatttattcacaaaaaattacgattttagtttctaaatttttttaaaatttgtttttttttaagttttgaacaaaaatttaacttaacttctttttgttaaatttgttagtccataaacaaaaatttaatctatcgctaaactttcaagaaattttgttaatatgttttgaatctgtcattgaataaattttgttaattagtaactaaataaataaattattgttacgtaatataatatcactgccatattatttcctaacaaaagaaatctaatgatatagaataaaatatgtatttgatgaaaccgggagtcaaatatttttaataaaataatattttataaaattgaaaggtaaaagaaaaagaaaagagagaagggggaccataagattcatgttatagtaggaggacaaataggcgtgaacagcgaacaattttcccgaaaggtggggccgtatatgaaaaaataaaaaaag

SEQ ID NO: 104 - DNA, 2604 bp, Glycine max
  Soy_ogl_1348 Gm04:42428897..42431500 Cluster 1
aactttccggatagaattagggtctcacgaaagtaaaataatttattatactaaaatcacaaaaaatgttttttcaagcaattgaaagatcaaatattttaaaaataatagctttgttaaatcaaatgttagaattgatttttactattattaaaacaaaacttatgcgtattgcatttttagccaaaatataattgtaaaaattgtagaagttttatttttacttaaaatattaactataatattaaaaataatgtttgagaaattttctgcaactgtttagatttatgtgtaaattactaaaatacctatgacccttctaataagcttgagttcaattgtcatatagaagcatttattttatcatagtaaatataaatatagataaaacaagttttatcatactaatattgcattttatttgtttaactaatctcatgttctttttttttttattattgagagagaaaacgttgtccatgtccaatgaaacatcacaactagcaaaataagtagagcaggacaaggacaaccccaataacatcttctcaaagagataaaagaggatgataaattccatgtttggaatcataaattatttaaaatcaagtaaaaaatttagataaatgtttagtccacgataagaaaattgatagtgcactggttagccgttagcttcacgattggaatgagtcaaattcgctatctaattttgtcatttgcaagcaacttctagggagtaacctgcctcagtgtgtctgtagggatcacttgtcttacaagtgaagagttcagaagtaattttcaaatacatgcaagactccatatattgtagggtgaggttgcaccaaagtataccaaaccttgttaggttatgtcagaatcattgtgtctattagagcttattgaacatgtttctgaagacttttctattccaaagggtgatattttggacaaatgcttacattctcacagctggttgttcatcttcctccaagcctcatttgcttaaacacgattcttttcaatttccatgtgtttggaggcttggagcaggtgaaggatcgaggtcatgtgtgtcagagaaattacagcatcagacgtgaaaaagtcaacagtccatagtcaatattctaaagtaattttatattatcatttaattataattcatcatgataaatttattaaatttttttataattattttaaaaattatatcaataataatttattattaaataatattgtcaattaataactatttaacttattttttaggatacatgatcaaactttaaaaaccatatacattcttatagttaatattatgtcgatttttacataatcatattttcctatagtcatgtattcactccttattaatataaggataaaatgaaaataactaataatatatatatgagaaaataattttatacttttatctaaaagttttcacaatacataaacatttaaactcatactattatattatgataaatcgtatttaaaacttttgaattttttaaatttgagtcatttaatttttacgtagtatatatgtaatggttttaaaggaatcactcgccgcacactatcaatggtagattgttgaacatttaagttaaaagagaaaattaagatgtagttttttattctcttggtcctccttttattctatgtttaagacaatagagatattttaagaaaataattaactatactaattttcataacaaaaataataataatatttgactattatactagtagtgcatttagtttttgagtgtattatttgaaaaaagtaattaatgtttttttatgttttataagagacaaataattttaaatagaaaaatatttcaaaagttgcaattacattgacaaggttgaagtattgttctttgatcaaaaatagagtttttatcttaataatattttctttaagactagattaactaattcacaagaattaaagaaaatatttaatttaattaataataatacatttgtcctaaacttttttccctaatttatctctaacataaaagagacacatcttattctttaattttttttcaaatgttttatagttttaattttttttaatctcttccattatatcagcattatatttagagagtttctagggtacccatgctaatttgagggaattgatactattgttttttgggccaataagaattaagttgtattattatattttttattttaaaatttaataatgattttttatatattacaatttaatcctgcataataaaaaaaatttaaaaagaaattgaactttttaatttcacaaaatcaagcattgttcaaactaaaaaaatctttgcaaacatacggagttgatttttatttttcttttttttagtcacttacccgaattatcatcttcccttccaatgttcagccatgcacgcgtgcttccaaaatttataatttgttccgaaaaattgacttgaatactatgatgaagatattcacaatgccgatttgattaaatttttttaagacaaaaccatatgaaacataaaaaatgaacgtaatgtttggttttgatcaggggttttgtttttt

SEQ ID NO: 105 - DNA, 2710 bp, Glycine max
  Soy_ogl_1376 Gm04:43879391..43882100 Cluster 1
ctcatcagtttcagtttaacatgaacatattaatatccaaaataaaaatgagtttttttttttaagaaaaaacagttcgcacggttacacacttgcacaattatgggaccatcataatacgtcaatatgggtagttttaaaatcatttgcagttgtaaaatttaacattaacaaaccaaaatgagttttaaaatttataaaaaagaaatggacagttttaaaatcattttcaatttttaaattaacaacttttacatataaaactgaaatgagtttttaaatcacacgaatgaccatttattatgcttcagccaattatttgggtttcggatcccttaatttgtttttttagcatatatatatatagtgggtagtagttccctccatttgcttcagatatctcattctctggctaccaatccctacctctgtttgttccagacaccaatccccttcagaacccttaatttgttagcaaatgcataaactaaaattccaatttattcataatattttaaaattatgttgttttcctctttcctttaacattatttttttttaaaaaaatgagtgtttcatttcttctcattattattgatccaaaattagtccataattaattttttttaaaaatgaaacacaaataagcatacacgtacctgaaccgctttgttcatttgttgtaatgcgaattaagaagcctgagtatctttgaaatacttgttgaattaaaaaaaaaaaaaagctttacatgattagaatacgactctcatcaatgcacaaacatatattaaattatcatagtaccataaatagttgagacaaaagaagtaaaaaaattacatatacatgtatttggaaaaaatagtaaactaaaactaatatatacatcaatacataataacataaatttacaatatattaaatttgacgaaatagaaatatgaacacataggtacaacaaagcctgtattttcactagtatttaaataataagaaaaaattagaatgcaaaatcttattaaacactattgcttagtaatcaaacacaataaagtattattgaaagtaagagaataaattgcactgaaatcctatcagatttcttgaaattacaaacttatgtttttttacatttacaacaatctcacttatacagggcatatatagtataatatttttcaaacaattaaagaggttaatataggtgttaaaaaagggatattaagagaaattaatttaacaaaacttcacgtttgtgtaatttaatcagtaaaaacaatcttaactttctagcaatggtctaactacgggtttaactttagtaaaattaatattaatagaattaatttttttatccgtaagaataaaaaataaatataaaaaatttacaataactcatatacatgttaaaccatttaaagtatatctctgttgatagaattactagagtgttgagtataaataagatatttaccaaaaaataattaaagcatatttataatgctataatatgtatttttcatggtataaaaattaatcttttaacttcggggaaaaatggaaattaagggtgtaagattgatccaaaggcaaaataaccaaagcttaccttttaggcctaccggaaaaaaatatctgttagcaaaatgatccatacaatgataaaagaaaagcaacgtatgttaataaaaaaaaatccaattgtatttaaagaaaaaatttcttttaaatttttttataagggtatgtttagttttaaatgatgaaaataaaggagaaaattttaaattaaagtataaaaagtgagtcctacaaaaaaatataaaatttctctctaatattattttcatcttcaaaaacaaaagcagcctagctaattctccaaagctgatgaggaaattgaaaaaggcatgcatctgaaaagcttttgggtaggaactaggaaattccctgcagtgcaaatgatctttaagaaggaactgctggtagtagtgttcactgttcagcgttagcgcgaatgtcaataaataaagagtgaaagacccatggttagattaacaagcattcgattgtaatcaattgtgtttgagaaagcatattcacggtgccatttctcttgattgcatgtgcatgtggagtgagcgaacttgggacccggggattccaattgaggttcactatgtcactccaattggaaacactacattgtggaagtcactttcatgtctgttaggtttcaaactctaagcaagagccatgaatatatatgtgattttttcatatacaatactttcatgttctaattttcaaatttctttaatgctatatgcattaattttatcgaaaacgatgcacttatgcctttagacaccacagtacatagggggagccatagatagtagagaggaagaaaaaaaagttgtcaatgtgtaaggttgctagacagcataaagaacaattaatagagttttaatttatggtattatttaaattagatggacgatgttattggagtatgcaagaacatttcgtacgtagtcgtgttatgtgatggaccatgaacgtaaagattatattttaggatataagacggtgttttaaacgagtgttttgagaaaacggtaaacagagtgtactttggcaggcattaaaagaggcatgcatgcataatactgagtagaattattgggagaggaatatgaggaat

SEQ ID NO: 106 - DNA, 1666 bp, Glycine max
  Soy_ogl_1429 Gm04:46043435..46045100 Cluster 1
gtgcaattcgctattatatattctatcacaactacaatgtgtatgttctattattaattaaaaagttttaaaataaaaattacataagatattatttatttttttgaaatttatatattacttataggataatgttaacaatttcatgtaacaatggttacttcagttaaatcagtttattaaatcttaaattggtaaaattatgttaacatcaacaatgtctaaaaaataaataatgagtcaactttattatcaattaaaaataaaatatggataaatgtttgttagacaaccttaaataatctataagttgagagaagaaaaaaaaagaagataaaaataaatgactgatttaatttataatataatgtgataagaaaattaaaaaaattattaattaaatatttaaaaaattttattatcaaaatataatcactcgtttttgtttgaaatttttgtctgaaatattactacactccaaattatttgttttttttttactggcactccaaattgtttataaaaacttcatctgtgaatttgttttagaatttagtaaccgttagatcaatcctatcatgatgacatgttcattattatccaagctggacctacattatccaatatggaacacatgctctcacttaattataactttttaaatattgttataatattaattgtcatttgcgtcttattatttttatttgtgctcccacaaattaaaatattttcatataaagccagaaatattaatattttatctttcttgcttgaaatttaagtctattactatcttaatgataaaatttatatttattttcgttaagaaaagaatctgttttttatttgtatgataggccattgtcatgaatttatgtattaaattttaattaatattaaaaatagattattgaaacaaattataaataaaagagtgataaattttgaaaataattgaaaattaaaaaagtaaagaatttagagagaaataaaaaatgaaattaaaataatggttgataagattctcgtcatctatcacttcctaagcgtaacttggacttattattataatagtatgaattactatttataaacaaagttttctaattactcataactcttcttattaacttttaataatttttaccgtcgattatttttgtgtttgattttcatttttaattttcactgttgatatatttatacggtcttaatgcttttcaatcttcatttcttttctcatcctataattaatcaaaaaactatattttaatattttttccaaaatagtctattaaaagattatctgttaatacataattcaccactattttttgacaaccaaaaaatggtaatgataccacactgattattaacaaaaaaaatttattgatgacttgagtagttgagttgcaactatttagtgagagaaacaaatgatgatttgcttgttgcttcgtactcgagttgaaaacaatatttaattgttaatcttaagtcagagaaaaactcatgacgactcttaatcatattcacttatggtttacagcatcagtattttaaaaaaaatagtgattaattatacaaatttattggagaaaaatttatgtaagaaggggtattaataggaaaaaaatatttaaatagatcaacagaatataac

SEQ ID NO: 107 - DNA, 2745 bp, Glycine max
  Soy_ogl_1996 Gm06:16919821..16922565 Cluster 1
ctaaactatattcgtactatgcacgagtttaaaatctagtgtttattttttagaaaaaatgaactttgacaaatcccatagtgtagtttcgccgtaaactttgattttctattcagattcttgtcttactatacttattcaattggacatgaaaaacacgcggtgataaaaaataaatgagtaagacaatttgtggagttagcccataggaaagcattttataaactttaaagacattcaggcgaaatagtaaattaactttacagtaaaaagctaattcaattcttatcttattttcaagttgtttatttttttgacaaaatctcatgatatagtgactttttttactgcaactagagggggttttttattattattattaaatctcgtctaatgcaatttttttagtaggtacgtaatcaacaaattgatgaggaactgaatttggattgacataggattttaggctggacaagttaaagttgggttacatatcccaaataaaacaggggccaattataacttctttttattagacagaaagaattataacttcttcttttttcatagaaaagaattataactttttaaaacgttataaaaagagcaaataatacattttttttatcagtatgttactaatgttataataagtaacatactgaaaggtgcgaattaaacagtagttgatataattatccttttttttttttactttagcagtcattttcaatgtaaatttaaaatatttccaaactttaactgctttatggtgacattattagttatatttattttatcaacatgtcatttttcaagtgaaactaaactttaatcctccaaagtgaagtctcaatttccttaaaaaaagtgagtttaattccgagtattataaagaaaaaaatatgattaagagaattttttttaataaagttgattagtcaagatttttaagagagataatctttgaaaaaattgataaatattttacaccaataataaaattacacaaaaaggttttttttagaagtaaatatattggaggatttattcagaatcaaaatctaaattctgtaaatcaaacaatatataagagtctatctgctgatgaggataatctccatccaatcagcattcactaatctgaaatagaatattcattacaacgttctaagattttttttgttgaccattagacaaaacactaaaacaaaggggtaggcagtttctgatttttagccaaaactgccccaccaaacctaacatggccaacaagtttcgacggcacgacgctagctggtgatctggaattgtacacataaacctaacagtgataacttaaagtaatgcatatgaaatcacatcacatgattaaaaaaaataaaataaaaaatcttggctcactattgttttagttctatattaataatttacagtttgatctagttgtcactggtcttcaaatttaagcttttaacgcataattttgtcggtaaattcctttatatgtatggcctacacatttttttacttggaaaatatgttgataagatatgcatgttattttgtagaatttataatgtgattagaagagaaaaaaaatgagatgtttcagatgtttaaaataatttttgtatcattactttttatcttttcaaataattttgttgtgattaagaaatttagttgatactttttcgatttttttcctatcatatggttagtataaaatatttttcgactttattaattattagtaaatatctatctagttttttttttttctcatcatattatctatctcgtttaatcttttatgtagcttactttattttcttcaaatgacaccaccctgcatagttgcacgtgaaatgattagaatatactttttttttgtcttttatcttgattttttagtttagttttctatatttgaaaacttttgctttttttttttctgttggactaagttgatttcttttttaaatttatcatattattttgattaacttaatgatacatatgacagaatagactgtgaaaaataccttatcatatataatagacctttttattacgtgagtataacataagactattgatacaaataattcaaggaatgactaatttaatttaatttaacaaaaaaactttaagaagggagaggtttggattcattatttgatggattatttttttgtcctaatttgtctaatacagtacgtggaggacacctacatattccattcagggaaatgaacagctgtgtgaagagttcatgctcatgcaagcaacgtgtactggtaggcttggattcattatttgatggattctttttttgtctattactaatttctctaatacagtacgtggaagacaccttcacattccatgcagggaaatgaacagctgtgtgaagagttcatgctcatgcaagcaacgtgtactggtagcagttatattatatagcataatagaggtaatcatttaatgtaggggctttaataagttgtagggctcttattatgtttcttaatgattgctttgaagggatattaattttgtaacggcagggcttttgttttcattcctggaacattaattgttgttttgtaatttttgctaggtggttggtactgctggtacatgttagttgaatattctttttttgtctgacaaaaaagaaactttaaatgattaaaagtgaaaattttaaaactaaaaaagctaaagttaaacaagcaa

SEQ ID NO: 108 - DNA, 3246 bp, Glycine max
  Soy_ogl_2086 Gm06:46219901..203146 Cluster 1
aaagaaaaacttgatgagatgatgaagataatatgttgagttaatatattaaggtgatgtacaaatggctgaataaaagctgaatgggcatgcagaagcataatatattacgtccatccaccatctttttttttaattaaaaaaaaagtgaaaagtgatgcatttggaatcaatttagcctagtaagtaaccaaaccaatgaaatttaaaatttaaaggataacttatcattgcgtttggcaataagaagacatagagatatgtgctcattcataattaaaaataaatattccaaaattataattcttaatatattttattttgacatgcatgggtaaactcattacatttattcataatattaattaaaacaaatacaagagggaatgtaatcaaaatcatgaatgttagcattaaaccttgacgcatgcaagattatgagcaaacaactcttagtatttgatccgtatgtatagtataataatatattaaatataaatattatacgatacgtatgaaatatgcatgtatcttattaaaataaattgcatgtacaaaaaaaattgtccttattcggcttccgcatgtttcacgcaatctagttgcccacagctttcctttttttttttttaataatgttttttccgttcatttgttcaattatgtataggacacgaatagatacataatgttacgtacggttgataccaattgatatcgataattgaaaatttagttaaatctgatttaaaatgttttagaatttacttctcatgtaatttaaaatagaaaactttaagtctgatttacatagttacaaaattatgtataaatatttatttataatattattttttaatcattattactcttgaaatatattctaaatattaaattaaaaaatagacgtaatatatttcttaatttctatccttaattaataattaaaataaaatataagaaattattttaaataaaattaaggagatcaattaaatccttcataattattaaatatgataaaatttaattaatgatgatggttaattttagctttcaatcaatggttgatgttagttcaagtaattttttttatatttatatatagagaaagttagatatgtatgcattaatagtgtaaaataatttttttttgttgatattctaaatttttttcgatatatttgtttaagactttttacaaaagattcattaatagaaacttacgattttaaaattataccaggatgaaacagttaactctgaacttatcagaaagtacagcacatgtctcttggctgaccgaatccatcaacaatatattaaattaaagattgcattgcaagatgaaagagccaacagcaaatagtaaattctacgattattatttcgtaaaaaaaaagaaatatattataattataccattataattaattttattactaatgaatataaaattacatgataataacattttagcctaattttccttttcataaaagatccccattccaaattccataaataaaataataatgatgctatactatatagttttacagtaaattatgaggttatcaaagagttttgatttatttacatccatatagcatatatcagatagttgataatcttttttttttcttcatcatatttatatttttctctctctcttaagatataagtagcataaagatgtctatattattataaacttataatagttttttttatcatgaaatgatagcaacatctccttattctaaaaaactatttatttaataggtataagacaacacatactaagtttatgaaaaatgatctgattttgattctcacattagaggagaatattgaattccaaatattaatacaaagtctcacattatatataaatgagaaagtaaaacaatatataagaagaaagatttacaaatttgatgttttaagattttaaattaaagtatgatttagtttaattttgtgaaatattgatagttttaatctcataattgacttaaaaaaatgaaacttatgagaatattttggattttatgaaaagtcaaaaactttaattacgattttttaaaaaaaaactatttaactttagatttttttcatatatctcaatttttttttagataaagaaaccgaagagttaaaaactagagatggtaaaatgaatgaaattctcagtcgtatgactcgagtgcagatctagtcaacaaaaaccaaaatttaattaacaaaataggttttgttagagtaaaatttaagacatttggaatataactcttggtttagaaacaatttaaaatctactttaattaatagacaaacatttttttgacattgatatttaaatatctcattaatgttgatgaaatttttttggaaggaaagtaatttttttaaaactaaaataattaataaaaaagaaaaaaataatttaatattaatgttcaaaaggacatgtatgatgataaaaaaaaggacatgttctgtataaaaaaaaggacatcccatcactaaataaataagacgcgtcattatgtacgaaaaaaatatttatgaaggttatctgacttttggaataatgatttaactttaatgtattataaaagaataatttaggataattccttaatgggatatggttcgatgtaaagttaggtctgtatgctaacacgaaatctaatagaatattctatttagcacacatccattaaaatattcaatattttttaaatattaaaatataatttacaaatgggcaagtcttttgatttatttatggtatattgcgtcttccttttcttaagagacactcaaattgttcttattttttccttccattatttaaaaaaaatcaacttttcttttcttaaaaaggttaattacatgtttgaagatgtttattttttaaaaaagtaactacttatttcttaaaactttcttaaaaaatgacatatattttgattatttatccaaatcaaactgaactgaaaacatacttatacgtattacacctaattaattttaatgtaaatgaatatcctattactagtaaggtattatgcacaatacaagtttacacacatgaccagtacaacgatgaatgacttaaaaagtaaaatttaacagaaatatcttactatgtaatagttatataataagtttttttttactaacatagataaatttcttgttaacatatgagatttctttatttaataaaaattaata

SEQ ID NO: 109 - DNA, 2400 bp, Glycine max
  Soy_ogl_2180 Gm07:4295801..4298200 Cluster 1
gaaaaaaaaatagactaaacactacctaaatatccagattcaaataatttacaattcacgtatgctttattccttaatagaaagttaaaatgattttaaactacttttttattctataacgtttatattttttatcatactaaaatagtacaaattgttagatatagttaacttccacaggttaataggcatttatatgtttgttggtattaatgcttattaacccttttgctttcacttggacactctgttctcttgtaatgttttttttttcgggtatctctagtaccagttcaatgaacgtgtttcgctgatttaagaaacggaccagcaaggtggtggtggtggtgagaaattcatgatatttttgtgccttaagtatctttatccttaataaatatttaatttttatgtttatttttttaagaaatttttattttatgttaaatctttaacaaaacaataattttatattttattcttaaaacttatttctaattcttgataaattaacaaattttatatttatttttttataatttttttataagtggaggctaaaacaaaatttattaatttattaagaaataaatataaaattcagtaatttattatagactaaaacaaaatattaaacatcaaaaataaaaaatattgttttattaaaaattcaacgtaaaataaaaattcattaaaaagaaaatataaaaatatttattaaggataaaatcatgtctaagtcaatttttataaacagcaaacacgactcaccatgatataaacccaaatatttttgatcaacttcaagcttataataattactatacgcgttatagcagagtaaacagagatgaaaacaacagggtccatgcgtgttatatctattgatttatttggtgaagtcacttaacgacgaagacgaagtcgtttcaacttgaaaacttccgaagaataatgagaagggtataaggaattaatttccggaattgaaggccatgccaccaaccacactagaaggggctttacgttcgtttattcgtcgaattctttgataacaacccaatcatcatcccagctacccctaatctctgtccccctataccatacaagattacaagtctctaacttctgatgattgcttattgcttttataaaattaaaacaaaataatatactttttaatgtcattaaataagataatgtttactttaaatctataagaaaattatctcattttgactttttatgtataataaaaatgtgtcatgtgtggtccttgttttcatgaatgagagattaaaagtgatatttattatataaaaaaaaaaatacaacatcagccactaaaatgagacaatttattttttaggaattaaaaacaaatattatcctatttacaggattaaaaaatatataatgagagaataagtttaaacgatatcatgcattttaagtcttcatcgacaaatattacaatttttacggaaaaatgttcaagagttctaaataatttcatcaggtcattttataagaaataaatgaatacataacttttgtcttaattataaaaacatagactcacttttagattattaattctgaatgttaattcacttttatactcttaatttattgtaaaatttattaataagatgtacactcatatttttattagtctattacaatataagttgcattgactggtgaaaaagaaattattcatttattatgtatagtgttattaaatatttctattatttaaaccatttaattctatgataattttggaataaaaattaaatttctaacattattaattaaagctaactaacttacctatttttgttgatcctatgaattagttatttatttatttatataaaggactgaaaggcgaatcataatttaaatattccttgcaattaatagaaaaaatatatattgctatcactcttgttataaaagctttatgagattattccctctttagcatttcaatatgacaagtatactttctcttagtatctcattttaaagaatacacacacatcagatctttttttagtcatataatttcttctctcttataagtctcttagtacaaatgtccctgtaacttttaaagaaaatgagaattttacataaataattctttaaataattctttttttaatgtgctacaagtaaattatataagcaaatttgacattaaattaaacccaaacccatctattaaaagtgtaacttttaaagaaaatgagaattttacataaagaattctttaaataattatgtgttttattttaatgcgtcaccaattaactacataaataaatatgacgtgaaattcaatctaaaatcttaagttctagtttttaaattttagttttagtttttttt

SEQ ID NO: 110 - DNA, 1923 bp, Glycine max
  Soy_ogl_2224 Gm07:6000701..6002623 Cluster 1
ggtattcactagacaaatattacttaccatcatgggcggatccaaaaatcaccggggcgaattttctttttcttccttgtgtttaaatatctgagttttaataaatgataattttaaaaaatattaatcatttttacacataaaattaaaactaatttttattttaaatgataataatcttaactataaccataataacaaaaaacacataattaattttacacaattttacattaattatcactttaatcattacaataataacaacaaatataattaactttacacattatataccatctaaccataaccattattataataataataatatacacaattcattaaacacaatcatatactaactaattaacttaaaaatatatatatttatatacatgaaaaatccaaagaaaggaaagctaggacccctgaacgtctccttctaaatctgtccctgtatactactataagtttaacctttttaaataggacatttgactgttgatcattgaaaaaaggaaaagaaaattgcatacaaccaaagaaggaaaaaaaagtaagaggatagcaacaagtcgaatgtaaaaatatttgactgtttatggcatttatatttaatttaaaaataaaataataatattatcaagttgaatgtatggtccgatccgcacatcacacaactttcatattagtattcaaatttaacttaaaggaaaaaaatgtataaagtgaaaaatttaagatatatccaaagtcaatttaatcaatttatatttaaaaccactttaattcaatctaataaaatataaagtcttttttttttagttttacttatctcttcactttatataaatattttaaaagttattaataatttatttactattatctttaagtaaaaaataaaaattattttttgaccaaaaagttatgtttagtattttaccaatacatctttattatcatttcagaaaatattttttttaatttttttatcaaatatatatattaaaaaagtttactaaaaaagcatcaaattaatgcactcatttaaaagtcaagattttaaattcttttgaaaaaaatttataatctaaattttattgtttaacatgagcaattgaaatttctttattattgtaattaacatattttatttttaataattatttaatatgattgccaaatgggaggttttttcacaatccattttattaaatgattcattgaaattatttattattgtattaattaatatattttatattcaacattaaattagttaacactaatgaattcgactattccaatcattaaaaagtgttgaaaaatttatatttaatcttttacaaaaagtgcatgaccttgattactgtcaaatccaaaatattataatactaaaaaaatatttacacttatattttaaatatattcttgtaacatattactccttttgttcccataataaatgttatgttagaaagaaaaatatatttttttaattttttaatgtgatattaattatttattttttactgttgtctcttataagtgacattttattttttcaatgtaatattaatagggggtaatttaaaaaattcattactcctttttattaatttgatttatatgtttaaataaacataggatgacacttatcattggaaggagggagaatgtaatattacaaatgtgcaatatttttaatattatatattgcaacgtaatatttttaaattatttatgtttttgcttaaaaaattatttatccttcactttttgtttttacatattataatatattagatagacatttgaaattagttattggaaaaatggaaagttaattttgcatacaaccaaagaagcaaagcttaaatggatagtcattaaaaaaagtaaactaattttctcacc

SEQ ID NO: 111 - DNA, 1942 bp, Glycine max
  Soy_ogl_2404 Gm07:37986294..37988235 Cluster 1
aaagcttttacttcttcaatctacatttccgctaacaaaattatttttcatggaatttgattcttctaagtaaatgcctcatttttcaagtcctctcagtaaatgcctcatttttcaagtcctctcttgcgtcaaatgaacaaaaatttaatttctactagtttcaaaatttatctcataatttatgtcattctatctcacacaatttttttagtaccaaagtttatgaccttaaatctcacatgtaaactacattttttgaattctttcaaacctcaaattttatggttcatgtactcaaatcccttcaacccctcttctcaatctcttttttttttccttttaatttctcttctcattgcatgtccttctcaattatgaaaaaggcattatagaagcttactatgaaaaggaaaggattggtgtgccaatttagataacaatattaataataaaaacattaaaagattatcaaacttttataatttttaaattaatgaataactgattaaattaatttttagtatattgaattataaattaattataaacgtatgttttcaatttaattgctattaaatgtgcattatataaaaaaatgtgcatcacaaggataacccaattagttattttataagatactaactcttttcattttttttaaaaaaaaattggtgtgcactaactctttctatttttttatggtacactaactctttctatcagactaagctccgttgacaacttaactaaatctttgatttttgggatagttatattgacttcctttgaggttacctgtaattacatttagaccctatttgttttttaaattacacataactctcttacattacatgttccttactttccttaaataggtactatactactatgcatatgattcgaacatgaaagtaataaaattatattatttttttttttacagaactattgtctttttttttaaaagaatgttaaagcgtaatattaaaaaaaaactaattaatgtctaaatcatcaagcaaaatgtaattttaaggaaagtcaatgtgattattcattgatttattataattaatgtttaatttcaattttctataatttttgtagcagtttaatctcttaatttttatttcaaaattttaatcttcccaccaatatatcatcaagttattaacataaattaataacgtcagcaacaatttatatataacactctatacccagctgagtgagaaaaatgtttgaactttgaatagaatccatgagataatgagacatgacacatcagagggaaacgaaaaaaagggaaaaagctataatgcaacttgagagctttgagaatttgttgtttttgtgcaataatgaaaggggatgaacaaaagccaaagttggccactgtaggaaaagccagacattttgcgcgccaagaacaaaaatttctttttcttttctctgaaaaaaaaaatgatagaatagaaaggcatttccaatactatgttagactgcaactcacctaaaggattactgcataggaaaattttaggttcaagaggatcttccgaggatgattgtccatcaagtgatgttaggaaaatttaaatcacactatagaaaaggtaaaaagttcattctgaattcttaatcatttatctaatccacattgatctgccaagaacaaacatagaagaaagagaggtgatgatgtggatcaggttgatttgaattatttaaatttaatatcaaatgtcattaagattataattataaaacttcaactgaatgattcaaattaacttaattttttttcttcgttttcaaattagagaggttattgggtcgatcccaaccctctaaagaaaagtaggatttttttttaagaaatgaagactcaaaatttgctctatatatataaaaaaaactcaagtttcaatgtttt

SEQ ID NO: 112 - DNA, 1964 bp, Glycine max
  Soy_ogl_2418 Gm07:38312131..38314094 Cluster 1
tatattttacatttataataaataattcaaattgtgacctaaagttattgttaatcgtttatagattctttaaaaaaataatgaaatttaatttttctattttgaattagaaagtatgagtatctttcaattcattgaataagagattaattatacttgtagtgcatggttgtagtcaatctaagagaattttgtatactatagaaaatcaaacataaattctcctgtagatcgttcatgatcaaagataaaaataagaggataagttgaaaatatagacagtcataataagattaaatataaaataaaagagtaatatttgagatattgagaaaattgttttggactaaaagtgatttccacacataagtaactatatctttggtaaaattatttttaaaataaaaaataaaaatgactttgatttttttctttttaacgacttcaattttttttaataaaaataatatgaagttgcaaaattttttacagcttcaaataaataattttaaaaataaaataactttgaagtcataaaaaatttaacgacttcatataattttttttaaaaaaattaaagtgaaaaaatatcaaaatcctgaattttttatgacttcatcacagaaaattaaaaaaaaaatcttacaacttatctgtattttagtaataatttaaaatttattcctattttataaatttcaaaaagaattgtctgttttggtggttcgtcctctcctatgttaggagcttctctagatatataagatctcattggatcatttggacccaaagatgcttaagctgaaaataaaaatatgtagtagaaatagtagggtttaattggtttttcgtataaaatcttaatattgtggtttaagcaaaaattaacaaaatttaatttaaattataatttttaaacgaaaagtaaacatacatttagtatattatattgcatggatagttctaggttcattttatttttttaaaaaaataaataagattaggtatttaatattaattaggttaaaaaaattaaattaggatttagaaattaagacactgtcatttaaaaaaggagaatatgaaattaaaatatgtataagtaaaaatacattaattttaatttaatagttttttttttactttgaaatgacatatatcaccaaaaaagtatttgttttgaattagatatgactattataaataacaaagttttcgttctcaatacttaatgtatacaaaaatcaaactcaaacgattgatatagctaaatcaataaataataataaatgtttgctcgttttgttttcaagatatagaagtcgttatccggtcaattcaattgaaaatcataatttcatcatatgacaatcatacataaattatggacatttgtttgaacatcaactacgtcatattaaaaataagtacttgtttctataatttaattttgatatattactacaagtgtaattttttatataccattaactaaatagaaattgaaattaattaaattatattaataatatagtttttgttactatcatttaattagaattttggtgtgataagattatcaacttttatcataattaatttaaatttatatataaaattatttataacaacaagttgttagtctgagttatactcaatctagttctcttaagtaaggtctcaaattcaagtcttgtggatgaaaaaaattataactgaaagaaaaaaatcatactaaaagtaatcagttaggattctcaataaagattagttatcaacaaagtcaaatgatattttatatcaacaacatgattaaaaaaaatataaaattatttctaatcggtttagataatgaatcaaaataaaactcttttataaattttcttaagtaaaacatgtaaattaattattacaaaaatgaataattttcaattatctatcaattatttattagatgacaacac

SEQ ID NO: 113 - DNA, 1844 bp, Glycine max
  Soy_ogl_2428 Gm07:38557307..38559150 Cluster 1
agtgcattccaacaatggaaacttgaggcattttgttacaaacgccgctaggaaaaacattttatacgacaatgattgaccaagagccgtcttagtatgtaagacattgacaattttataaataagggagttttttaattgggcccttctatcttattgtcgttataaaaattaattgtttgagccaattgtgtaagtttatatcaaggttattgtagaatgaagcctcaaaatatttgtaaaagaatacttaggttaggttgagtaaacttataaatgtgagaatactagttgaccaacttggtttataatattggattcatataatctacaaaggtaaaaattctagcctggataccaacttgaagaagtgataatacttagtgcagacttatagagttgacaatactagatgcaaagactaattagatcctggtggttaatttttcaaataacaattagataataggatccaattaaaaacaaatacaagtttaaacacccaaatgaaaaaaaaattaggatctaattaaaaattatcaattagctcagcaatctgcatagtaatttaaccaaagaaaatattaattccaaaggtaccatagttataatttttttattaattatgtgttatacttattaatactctcacactttaccttaacaatttatatttatctgtaaataaatagttttctccttatagctagttatatttttatcttatgttttatcagttttctttgtaataatatattttctgctaaattttaaaattattttaatttaatgtattacatatatatacttattttaatttaatattaaaatttatggatgatattaagacaaaactataatcttaactcgagagagaggatatgaattagaaaaaagattaaaatataatttcggccctctatttaattcaattttctatttcgatcctctttacatttgatcatcctattttttaaatcaagaattttgaagcaacaatcaattttcaggtattaatagttattaaaaaatcgttgtttgctaaatcacttacatggcacaataatatatattgggcattataagtgaagaggccatgggttaggatttgaaggtgtacacggttcaagtgatttaaattcttattaaattaatcattctactaagagaaaaagatcatgggttaagatttgtaggtgtacacggttaaattcttattaaaatttgatttttttagtgttttaaatttgtaaaatgtttttttaattcattataggcctaaaattatcataaattatgcatttaaacagtaaaaaattaatcaaaagagaacaggaaaacatttttcaaattcgagaaattaaaaaatgcaaattttaatttggagactaaaaaaataagctccaaattttaataactaaaaacatatttaattatattatattttataaaatatctttaaatgagattttaatttagtcattatcttgtctttaatttatattatttttttatattaattaaagtgcgagaacgtgtatatgtataaaaatttaggtacccaattaagaaagacactagtattacttactgtccacgcaaatatcagaaataagtacggaaattttgttagaatgcaggtatagaaaaccttatcttaaccctacccgttaatgtatacaaaaaaatcctacccgttaacattaccttcccctgaatcttgataagtgatgatagatatactaattgttttaaaaaaataaaatctgtattagacgtgctaatctaaatcctgtgaaaggtttgacaagtgacatcttggttagacacacacacacacacac

SEQ ID NO: 114 - DNA, 2188 bp, Glycine max
  Soy_ogl_3914 Gm11:35944921..35947108 Cluster 1
caatccaatccagtttgaattgtattagattattcgatttctacctatacatgcttactgatatttaacttcctacttttacttatgcccttagctccaaatcttgaattatatacgcctttaccaacacatcatgaaaaatattcatccaatgccattaagttctaaagttcagaaaatgcacggaaaaggagaaatattcatagtaagaaacaagtaagcaataagcacttttataactttgagatatatgaagggcaatatttcatgagctcactaaaattacaccaaaacagcaacccaaatttcaaacttacccactgaagtagctgcaaatcaagcaatcaaaatagaacatatagctatagaagaaaagtacagaaacagagaaagaaaatgaatacggtaatttttttagaaaagaaaaaagaaacaaaaaaaactaccatctctcttaaatcataacgcaacatgtcttgcgagatcactaactcgtgataaaacacataaagttaagtaattcaggttacatacttacatgtgaaacacaaacataataacgtatgggtaacagatcatttataattttatatagatctgatcggtttgtatttgttactggtttgtaagggttgggtaaccgtgtaccctttatctttttttttcttcttttttaatgaaatattttttgctcataaaaaaatgtatgggtaacaaacatattagttaggttttggattggttcagttttataaacaccatacaaaaatcgaatcgaactgatcaattatgcaaaagatatatagtacaaaataatttggtttatcgatttgagtttttttaaattgggttggatttgaagattcctatttattagcatttcatcttaaacaaattcttaattacattctaacctttttagtaaagataaatctattaaaaaaatattttatcatagtaatttatatagctaacaattttattacgaaatatatattaccgtaaaagataaatatataatatgaaacgataatatatgttttcatgcaaaatgttgtttgaaataatgatattttaataaagtgataatattttattggtttaaaattaatctttttttgtcgctctaatttaaagaagaaaaaactgttttagtccccccaacccgaatgacgttagagacttctcttatgttgctagtgaattaggtgtcacgtaaaaacccattttgtttttgcactcttattatcaaacatcctattatgtgtttatttttctttcaatgtatttactttttccgcattttgactagctaaatattttgaaaaaatcttttagaattttgaaatatttttaatccaaaaggaaatttgttttgaaatcaccgattatatttaatgtgccaaacgactaaaatgatgtcattaactcttttgatttaataatttaaaaaatataatttattaaaaattatatgtgactaccttgtcaaatatcttaatgacttaacaagtcgataaattgttaacgttactattacttgattgcaacgctagctgaaacaaacaaaacatacaaagataaaataatttaaaattaaaatctttaaaaataactaaaatcaaaagctagcttcttaacttatagggaacataaaagaaatttagggaagggaacaaaaattatttaaacctcaaataattctcccaacaatatgaatgatacaaataaccgtttcctaaagcatttaaaacactcactttcaaatgaatttacccattggaaatcttcaaaccgactttaaaacttttctgagacggaacgaataataattataactatatttaacaaccagaacatttaattagaatattggaataactggctattgaaaagatgcttgaaccatgctcgtagttttaactagtcaacaagctaataagacaataattggaaagtcctactcctgccaaactcaatttaaatctgataagaagcattggtcgattgggccaattagagctagtctgtttataaacatgtgtgtgtcactttgtataataacgaaatgcccagttcaagagaacaacttagtagtgcatgtccctcaaaattatagtttcacatgcagaaaatgtactatagtcatcacatcccctgctcttgtgaatatttcccacacacacac

SEQ ID NO: 115 - DNA, 2496 bp, Glycine max
  Soy_ogl_4128 Gm12:37662905..37665400 Cluster 1
aggtgttataaataagaatgcaattaggtcttataagaattcaacgattaataaaatatttaaaataactatatatcttttataaaatgatgaacttatagaaaaattaactttgaaccaataaaaaaaacagtttcttttttagtaatattttattagatttataatttttatttttgttaatgatatatctatacttagttaacttttctaagtatttaccatgttttattcaatttaaccaagtatttctaagaatttttcatgtattactcaagtatttatttttgaaatatttgaataacttgttataatgaaaatttcttttcacttaacttaaatgattttttttttttactttcttctccttttggtatcaatcttcgtacgcttatatattagttgcattggtgtcaggcaaaccattcaaccctttgatgatcaagagagacgacttcagtagtcacaaatgaatcacactacttcaagtcattctcaccaacaaattaagaacaacgacttgtgtttgaaaattattaaatagggtctggtcagggaagtgtgcacgctgtgctactactcagaagctacacatatacttcatctcttcctcattataaaaactttctaactaatttatgttttttaagaaaaacaatcaatttagttaattacattaaatatatcaattaattgtattattttttttaaaattatcattttcttatctttctattcattaaattgattctcattaatgtttgaaagagaaaataaattaagtaaagatatgtaggaaaaaacataattaatacatctaaaaattaaaaaaaaaatcttataaaaaaatatatataagtttttaaaaatgatcttataatcaggataaaatataatataaacaataaatggaatttgtgaactgtaacgttatgtttaatgaaaaatgctagtaacatacttttagaaatattctttttaatacactttcttttattagttgaattttatcaaaaattacaaaaattattgatctcacatcttattaaataattatctttcatgattttataatttttaatgaatttcaatcaataataaaatgtattagaagaagtatattaaagagtatattattaaccctcctcatgtttgattaatctcgtaaactttgtcatcagccccagagacaaacaagaactagacctaaaatacttataagaaatggtttttgctgaaagtttttataatatttaaatacttttagagttttagtagtaggaaaatatgatttattcacatggtcaaaactttatcatcattttgttaattttctccggtcattttaaatagaaatatgaatagtgaaagataaagtaaaaaaagtggctttggttttttaaaatcgcaaataaaataaaatgatattatcctttaaaatgataatcttataacacagagaatgaacaatgattagggggaagaactaatcaatattattttcgggagtcaaatacaaagataaaaaagaaattaaagataatacattatacttaaccaatactttatataaatgtaaattaaaaaaaactgaaaatcttatataataatataagagttattttttttttgaaaatatagtaatttaagaaagttgctcacaacatttgattaactccatactaaaagaattattaatacctttctcaatgtaaataaattcatcagtctttctttttttaaatgatgatgaatagaaaatttgtaaaatgtgaaatttgaaagaatgctataggcaaaatggtaatgttttatttttcaaataaaaatgaacggcttattaaaaatgtatgtaaggtcatggtgacccaatgacctctatttagccattattttagcttaaacataatttttattaacgtcgatggtctttaaacttcatactagtccataaaacttagaaaatgtctttaagtcttcactttggttctcttctacaactgtttcaacagccaattgttcatgtgtccaatcttttaaaaagaattggcttataaaacttagtgatttatagggtttttaagcgttttagatgaatcaaaataaccccagataaaatcccaaacaaagtataacttaaaatacattcaaaacacacaaccatgcattattttcggcaatgtccaacacacagtttacaaatttcatgcaaggaatatggccataaatcaaacaaaaagacaactttatgttctagaacaaatatatcatcaaatatatgatatgtaacacataccaagaaaataatctttaatgacatgaaacaataagtacatgtttagaaggccgaccaaaaaaaagtacatgtttagagcagtaatacacatttccgtgaaagaaaaatgaaaatgaaagagcaaacttgaagctttacgcctacatatatatacacaaacacaaatgtggacagttaattatgaatatataaagccacat

SEQ ID NO: 116 - DNA, 3894 bp, Glycine max
  Soy_ogl_4319 Gm13:28089201..28093094 Cluster 1
aacatccaggtaaagtaccacgtggtttgtgtacatgtgcttccttcatttacaatcgaaaacatataaatagtcaaaaatattttgtttgagttgatatctaaagatatcatattatataatttttttttaacttaatcaatgagaaattatgtgaaatgcagtgatcgacaatatatgaaatgcagtagtgacaatatgtactaaattatatgaaattattatgatacataagaacaataaatatagactattaggaagaaagtttaataaatatctgtggaggtaattaaatgcatccgtaattttttttttacaaacccgtgattacttatttaaggttaatggtaaactgtaaacttatatacattgcatttttttatttgtagattattttttatgctgatacatagaaattgaagacacctaaaagagaatttacagcaaatcatacatttttctaaatcaactaaattagatatcttggtgcatttgaacacctaagacaatttccggaaaaaaaaatacacatcctaaaatcttgtagttattgtccagattaccaccctaaaatctcattttatgtattacggggaacaaaaaagttaaaccctagttgagacagatggtgtcatttggattttagtactaaaaaattgaaacctaaaatcatcacttttttttttcttcagaaatcagccaggctcgccagtgtatggcctttgggcttctgtttctcgtctttgggcgattagccttttgcttctgtgatgtaatgacccaaagcaataaaacttaaaaaattggcgtctttcaaaaataataaataaaaaaaagaaaatttgcaccagccgggaatcgaacccgggtctgtaccgtggcagggtactattctaccactagaccactggtgcttgttgccttattctttttatttattagataaataaacataagtccatgattagattggtttattcaccttacattaggatgtgtgtgaggacaataaaaataggaatgaaaaattgtactgcttccatctgtcgtgaaatttcagccataaattctcacattccataatttaccatgcaatatatatatactttggcagttgttgtgaaagcctgaaaccccttataacttattcatgtcatttatacaatttctaatctcatatttctaagaaaagtttaaagtcaaaacttttatcattttattttacttcgttttctattgttcattaattattttatttattggtcatacattatattcatccatcgagttagattcgctcaatacatataatatatttaaaagagtaaattatagtcacaatttttttgttttatgtgaaatgtgtctaacattacttctttttggggatttacagaaaaattcctaattatttggttttagtatttaacaagtcaggtcattttttaaaaaattaacatcaaatcaatctatgtaaataaattattgttgtattaatggtcttacacttaatattttgatattacatacttgttaatttatttaatacttaaattcattagtttacaaataagtttcatttatgtacttatttagaggtatgtttgtaagttataaataaatgaaccttattataaagttttttttttttgaaaggcaagcatccaacttatataaatgataacagccacaaaatatagcccaaagagaaaatacaataatcaagatccaagaaaagacagaaataaaaaagaatcaagaaatgattcaactagcaaaggataaaccacttgaacaaagccctttgtacttggaccaagtccaagacaaagtttggatatgccaaatcacattctctattaaacaagttttgtcaagcttttagaaaggttaggtcaaataaaaatcttcgtactaagtaaatagttcaatttaatttgaaaaacatgtcgactctatccttataaaatttaacttaatttttttctcccttaactgtattggcttagagaacatttttttaataaaaaacaaaaaaaatatgaaaccagatataattgaatattacatattacaattagtcataactcgtgaatataattacgtatcacaattaattatactatgtaattataattggcaatatataaattaacttcttgtcacctaggatgctagcaaaatactccctgtccatttgaaaggagtatatgttcttacaattaatttgccaacaactaattaactgatattgaatttaaacatttgaaatttgaatggaccatctccctttccatttttcttcttgggaactagatctggattctggaggagttaagcctcaaaagtaaaaatcatacaagaaaggaaactccaaaactaacatgcatgccaaagaaacttgaacaatatagaacaatagcaattcgtcagccaattccaactaccctatttaatttccttcgccatatgcacgaaaatacaacaaagacaagcttccttgatcaaagtttgttgcctatgaagcaatgcgttacagcagtgtataccatcattaactaattcgacagctaacctagcttgaatcaccaaccagttgcccaattaaagttatgatatgacttgccagatttacagatgtactataagaacaaaatagatattagttaaaaataataaacttaacttaatttcttaagattttttcagtttttagttttctaattttaatatttttaattattttaatttatagtattagattaggttggtctatgaacattttcttatttttttaaaaaaaatcctatgctaatctagtaattaatcagcgttctataaagtttagataaaagtatggatttgcttaaaaagttgtaaaccaagggctagaagaggccacaaaactatcggccacaagtcccaagtgtagaaggagaaatgcattttgtttatgtttttgttttttaacaaacaaaaaacattacaacttgatgaaggtcaataatgtcatgctaattcaacacagtcaaaaactattgaagtatatccccgtccttgtttttaaaatatcttcactaaatagacggatattatgttaatatgtttttatttagttgcatgttaatatttgtagggaaagattttatttaacagttagattttttattatattaattgtcaaaagaagaaagtatttgaaatattttttttaaacaccataaatatttttaacagaaacaattatgttctagccgtgaaagatcattatgggcaaatccttcctccacttttttacaagatttttttttttaatttgttaatacgagggtacaaatttgttaaaaaaatttcttaagataccagggtctagaagaatcgagggttctttcgagttggtattttgttatgttttttgcccattgcttttaggctcttaattgagtgttgttttgaagaggacgcaaggataatgaaaggtagtctgcttaaggaggcaatattaaagacaatagtttcaccaatttgacaaagagacagagataatgccaatgttccaaaaataaatatataaatatgatgcaccttgcacacacaaaaggtaagaaaagattatgcacttaacttgtaccaactatcactgcgactgttttggttcctagatcttgaaaatcatattagaaaatattctaacaactttgaaagaaaaccctaaaattaaagatttgaaaattgaaaaagaaaccacttctccattttaggataatattaaccaattactcaaccgcttcatctaagaattaggggtgttttgatgccaacgatcccaaaaattagtcatgccgtaattttattataattctaaattctaactagatactgttagaatttttt

SEQ ID NO: 117 - DNA, 2148 bp, Glycine max
  Soy_ogl_5266 Gm16:3179803..3181950 Cluster 1
tcactccaaaatatgttatgggatagttgcgtattaaagttttacatttgttatgaaatggctcaatggataaacgatatatagaagatttgctcatatacttactgttttaaagttttatatgaagctgtaaaataaaatatgtttttgtcatagtctgttaactctcatgagtgctcccctattctgccaagcgtttcatggaaatacacttatgaattatatcatcatttaattataaatcattttttatataatttttaagataattattataaaaattaataaacttattataaatgatgaattgtaattagatgataaaataatttattgttttacaatgtcattaaataacattttttttcctattctgcaaactcttgtttttagcacaagaaaattttcagttcatgttcttggcacacgaggtttttaattttctctataacgctataaagttttgtcttgtcatggcaggtacaaacattttgagatgattgtgcttaataagcagacagcatgtgcctaataaacagacaacatatgagaacgtcttaattttaggcttgtatctatcacgtttttctccggaaaataggcaatatttatttagagcatttataatgtataattatttaaataagttgtttattttaaatttatgagtcttataatataacataaatttaaaaaaattacataaaaattaattcaaatactaaaattattagaataaatatttaacttgagtcacactaaattttataattaaaaaatatttctttatatggtaagaatggattaaacaacgttatttctataaataactcacttaaataatataatatattatcaagttatttactccgaatgataaaaatttgttaaacaatattgtttaattttaaacaacttataaaataacccattaaaaattttcttagttggtttttcctcaagacagatatgacttatgagttacactgtaatttcatttttctcctttcaagtagaattcccaactcccataatcataggaaagtaaatgccaaaagaagttgctacctctaagcctagccatgaataaacacgtggcaagtgggggatactttaggtgaagagtgaggttaattgtaaaagtataaagaaattaaacaaaaaatacacgttgttgatgtgatgatgaactttgaacactgaagattgatacaatactggcttgaataggtagttatgtatagttagtcatttattcctctttcatggacaattccgattatgattaataaaacatttaattcggcagcacgttgttgatatgtgatttttttcatttttttagtagacgttgatatgtgattgaatgttgccactaattaatctttttataagccaaaacaagttaaagtttttggccaataaaaatattctctcttacatctctttttttttttcctaatccattatttttatggaatttttttttatcgacaccttaaatgctatttttacacctttgagaaagaaagaaaagtgaaagattatttattttttatttttttatggacgcatgctaccccttcaatccatccctgagtacaacatagattttattcccttttcaatccatccttgagtacaattacacaacatagattttatggccacattttaaatttgaagaaactcaaaaagtactctatttgaaagtgaaaatcctaataaatagttgagaaagaaaaaaatattttttaaaactttaaaatttattctataaatgttactattatgaacatagatcttatagtcacactcaaaatttaaagatgaaaaacttagatagacacgaactgaacacatcatttttagccacaattaataagaattttacaactaataaaataaaataaataaaaaattaaaatctcaagtaaaattaaatttgataatgtttgttttattttattatcttcttcctatttttttgctaaattgcattgaaattaaaatatataaaggattataattcgaatttataaaatataatttaaattttaaaataatatattttggtggtgtaaaattatagagtattttattttaaataataactttattaatgcaaataaaacactttgattttaa

SEQ ID NO: 118 - DNA, 2900 bp, Glycine max
  Soy_ogl_5428 Gm16:37030601..37033500 Cluster 1
tactgttaactatggccttcaatatagtatataatatgtgtattgtgtgcacatgtatatgaatacgtatgtatgagagtactactgcaccctttggctggtgattttaacagctattcttcaactacctcttttatgttgcagattaattaatgcatgttgatagattgtttccatacatacaactgtatgcatgagagaatcacattcagctcaaccaatcatgggctggtgtcgtactttgcaattgggtggaattaattttggaagattggtgtttgaaaacgatttgtgtttcggaattgaggttcaagggattcgttttgctctaataatatggtagattttatttttcagtataaacacgaatgtgtaattttataatctttacaaactaattcttccgatcctctatacttaattttttttggtgaggatatctatacttaattctactaaatgtaaaagggtttttttttcttctaattttcacagagaaaaaaaaaaagaaaagagtttcttcttttattgaaattaattaattttattcacatgattttatcttgagaagccaaggttttaagctaacaatgtgcaaaaaatgaggtacaaaacgtggtaaagcaaacatatgcatgttacagatatttaagacactgatttggtttcttaaaaaagataaatgatgcgaacatattgaagagggaagtttgataaattttatttattgtttttaataacacaaatgactaatctttttttatttctattcttataaaggttttactttttattactttttaaacagatatctttgtttaaaatacaatacaatatgaaaagtatgtatatcttttttttaaaaaaataaaaattatattatcgagtgcactaatctttgcctagttcaatcattaagtgtagtggttccattccgattctggtagcaaggccttcaaccggacaaaataatggccagatattaattattactggatttccaattcaactatgaatacaacatttggtaagtaaatcaaacaaaagaatttttggttcattttgtttttaatgactttttttattgataaatagaatattaattcgtttgaaaattgaatcgccgtaactttctatatcatatgtttttgactttgaaatggatggacttctctcctctttaatttttagttaaaaatatttactcccttaaatgaaatagtattttttcatttttttatattctaaaaatagtgtagttagttgctcatctaatgatttaaatatgaagaataaacttatcttattactcggtcatttatagatgtaaaaaaataaaaataataattgcaactctacaacaattcccacatattacttaattaattgagctaaatcctgagtgattaagattgtacttaaacacactagttatttcaaaattatgatttacttcttacatattttttactggcatgcccataatgatgatgattattcaaaaaaaaaaaaaaagaaatcttccccgattgtggtgaaacagaagacgtacgaatatcatcgattggcccaacgcagtataccaaaaaagagttgggctttgaaacgtgagtccaatgtatgttatctccgatgcacttagttaagcccattactttctttcgctacagtataatacgataaacaaatggttcgtgactcttttttttatagagaattttccttagaatttaatatggctaataataattacacgtgtttttatcttcacaaagccctcacgtagttttatcaagacttttaataccacaaaaacgttttaaactgattcagacgaatccaccttgaagtttaatgggggagcaaagatgaataaaatttgcccattttttcattatttcataaaatataataagtgaaaagagatttcactaaataatttatattttattatttattttaattttatgttctctagctaattgaatttaatatatgatgttaataatagtgataataaaatctagcctggaacaaaatgacgcggcagtggagtcaggactgcttaattagtttatggtggtcacacttcattcattattatttgatttgacagtaatataatcatattttttatttgaaaataaaaatatcaaatttacaaaaaaatccttaaattttaattgtaaaaacaaaaaattaaacttaatcatctgatataacaaaataagtcacatatgattaaattatacatgacatacattatgaattaaatcacatcaaaataataactttttttacataataaaaagtgatgaacaggaaaaaaaataaactaaataacaaaaaaattcttcatgtgacatttttattaattttaaatacgttcattaaaaaattcaaatgaaacaaatatataatttaccatattaatttttgaatgaagttatgaacttaatcaaaaagttcagaaaattttattttgaaaaggttagattatttgtattataaaataaaatattatattatttgaataaatattatttataaagttcaacaaacttttcagtgtcataaataataattgttaacataaaaagcttttagctctaaaattattacaataatcatttatcctgcattaaaatgaattccatatattaaggaggtctagtttaattagttaaataaaatacataagttattataaattttctgtctcacggaatataaaatttagttgtttagaaaatgaaatatgaaattcaagcgtatcatatatttttaagaggtacatcttgcactaatttaattattgtgcaaccacatatcatacagctaaaaatataagagaagagttgcatagaaaaagaaagccatattaattgaataagacgaca

SEQ ID NO: 119 - DNA, 2651 bp, Glycine max
  Soy_ogl_5974 Gm18:7113901..7116551 Cluster 1
ttaatagctcaaccaaatcaagaaataagaatacatgctagtgtatctatgtatttttcctagatggtacaaaaatttaaaagtcggctatatctttattagtaatgtactaatgtgttaagtgaataacatgtacgtttagtaggtttaacaaatattgatatataaaaacaataaaaaataaaacaaagcttaaatcatcccaattcatttatttttaccttcaattcataaccacgtgtttcactttcataaaaataaaaaatgaaatgaaagatactaaagtgaatcgtagaccccatcgataaccaaggctgaaacgttgaaaatgttaaaggagtaaacaactaaacataatccctatgtagcactccagacatgacgaattcacattattatcagtacaaagtattcatagataattaatcttgatcattaatttagttgatcattattaatagagtcttcacaagactcaaaaacacgagaaatctaaactaaatttcatttggttaatgacatgatgggttattaataattttgaacacatattttatattatttgttaatgtaagtaatttctttgttcaaacagttttttttttttttggtttatgacattattcagacagttcgagaataataataaaaatttaaaaaataaaataatgttgggtgtaagctaacaaagatcaatggacagtgataaactggtttaaataaataaaaaaaatagaaggaaacgaattttttttatatattagatcttcccttactttggggtccttcttttacgaaatgaacataaatattgctttttagttatgatatatgattcaaacataggcaaaaacacataagcatttccaatatgaaactctctatctcaacctgaagttttaaaagttttaaaagctctctatctcaaaaatcaaaattgttttcatttttcttctatttattttttccttaaaattttgaaaggaaaacagtgccggatgagaagaactgaagaagaatatacctgcgaaaacaagctaattaactgcaaaagtaaaaacaagtaattaagaaaaataaattagatagtgcttgatagaatatgtgcaagattttgggataaaaatctctacgaataatactaacggtttacttctttctttgaagtcaacaactaataatagtcttctagtttttcttttttttttagaataatagtgttttaggttctatatagattctaacgcaagaataatttattggaagtgacctcacgagatatataacgagttttctttatttgcttggcgtacgttgtggttaaattaaaaaagtttgaatataaagtttaaaccgacagtctctcttcgagcctaagaaaagtaaaaaaaataaaaattctaaaaataagttaaagataaacttattttactgtcgcttaattttttttataaatgttaaattttagtaatttaactgttgatttgagagtttatatgaaataaattaattctgtagttttttgtaattttaaaaaaatactgaatatttcattaatttactttattttaatctttgattaatatgtttttccaaatataagtaaatgttgattataaaataacacatctatcaatgttctaaaatttaatatacacaattattaaaataatgtcacatgattcaactgttggattcaaattcaatcatgaaaaattgttaagcaagggtgtaaatacttactcttaaagcacccccccttgagacatgaagtattatgtttggtaagtacctcccttgagacatgaagtattatatttggtaaatgttaagagtgtctttaagatattaattaaaaaatttaaaataatttttttattgagacacataaaattatattcataattttttatgaattttataataaatattttttattttaatttcttaactcattaaaaaaaaacacttgataaacaagactcattatatttcaatagatacctagtgtatgacatcaataaaaaggttgttacacattattttgtttttgcatgaaagggataattggcgttgccatgttaaaaaagtttaacatgtcggagtgagaaatattataaaaaaaaaactttgaaagttgaaacaatcagatattggcagctagcaagctatggctatagataacaatccataagctctccacttttatggccgagacttgtaaaaagcagaacttgactttacttacatggaccatttccaattaacattgcatgttccacaacttttttggcatgagaaatgctatcaaattaacactttttaatatatttttagcattttttttagtttaatgcttacatagtgatgtataagtattatatatgatgattgtataaaattttatatactatcagtacatgattattttttttttctaatttttttactgctacatataataacatttattagagataataaaattttatgagttcattttcttataaatcagtctcacttataattttaatgaaaataaataatatatgtactaacaatataaaaacatttttatattatgtatcatctaacaaaaaaattgtcacatacaataaaaaaaattacagtaactactttaaagttgtatc

SEQ ID NO: 120 - DNA, 2378 bp, Glycine max
  Soy_ogl_6304 Gm19:349524..351901 Cluster 1
cttgtcatatcttttgtttttctctacttttaattttcccagctccctgtcttttcaacttaatttacttttaactgtaaaaagttattaaataatctgaaaccattatatttttttactaattttaaactaatatatccggtaagaaaactaatatataattaaatattattaattattttaataatttaaaaaacttaaatacatgttagctaaaagttaatcaggatcgtagcaatttaatttctctttaataagagtggtcgacgattatcacttattttcagataaactaaagttatgaaaccacgttgtgggcattgcatagttatggtaaggggcattgtacatgtcctatacttttgttgggtttcaatctcacctcatttgtcagattgagttaatttcttatgggcatccataacctattcaatttgtgatcacagactatgggccaattaaaagaaccaaaaattaatgctcatagattggaacaaccgaagaatatagactagaaacatagaaattaaagccttcattgttacggatttgaagttttaagtaaagcaaatatcttcaacaaaatgttcatttaattagatgagaatgtctacgaattagactcaactaataatttatagatttttatgcctcgtgaatttacaatgatgatcgaatatgtttataaaatatctaagtttttttaatattattagttattcattaataaatagtattaactttattttagaataagaatttccctatcagcctaaaaaggcctattagtgattccactgttctcatattattacgtaatacatgtattttgtatatgtattatatacaattatgtatataaaacataatatattacttatttaaagtctatttttttaataatgcatttaaacttatgacacaaatttatctttcaatatatcttataattaagtttgactctttatgtaagacaacattcttaataattaagataggtaaataaatatatgattttaatctactataataaatttaattgaataatatacaatacttttcaaatggtttaaggtgattttaccttttcaatcaaataaaacttgatttggctaattgagtttgacgtaagctagatcatagatatctctaagatgacttgacctattttcacctttaacaatgagacttaatattttttttccttatataaagtagatttacaaactcaatctttcttcataaataatttcttgaaatttataataaaatttataaatttttaaatatgagaatgtgcaaatgcatcctttgtctttaataaattacaggtaaatatcttgaattttgtatttttccccttccatttttattatatttgaatccactgttcaagtttgtcattctctttatttctttattatttttatgagtatcttaatttaaaagtaaaattgtttctttaatatctctttatgtataatacattaaaatcttgacttgcatttttaatcacctaattatcatcattttgtaaattttatcaattatgtttttttctttaagttttatcactaagtttttaatttttcatattttatcatctaatttttttttcacaaattttaccacctaagttttaatttttatgaattttaccattatgttggtaacaaaatgatttcatttcaaaaaaaaaaattataactttttttaataactcatcattcataaaatatacaaaattaaaatcttgggtggtaaaatttgcaaaaaaaaacttgagttttaaaatttaaaaaataataaagttgggtggtaaaatatataattaagcttaaaatcttatgacttaaacatttataggttatgataataattgcaaattataaaagttgacaaatcttatgacttaaaatatgcataacctatcttaattttcatatttatgataatatttattaaaataaattgtcctcactaggtctcagattttccattgccggcctaaggaattcacatagataaaaaaaaaaaaagctggcattaatatggtacttttacttcttgaatttttttcaaattttaatttttgtttctaacttttaacactaataatatctttatgcctctctaatattttaggaaatatctctaaaactatcatttttcccacatatataaagatcaaagtttagatgtttcaaaaaaatataaagattaaaactaatactttaaaactccactacaaaatccaaaatttgaaaaactttgactaaaaaaactattaacccaaagaactggattaatcaatataattaaaatcaaagttgtaaggtagctaacaatttaaccgatttgatatgtataaccgaccc

SEQ ID NO: 121 - DNA, 1753 bp, Glycine max
  Soy_ogl_6447 Gm19:39201741..39203493 Cluster 1
tgttgcattgaatatgctctcacaaaattatatctaaatcctatcatgtaaaaaagtaagtagtacaagagtaacaaaagatgtatctgaaaaagagtaccatgccactaaatttttgtcgtagttaaatagatgcgtagggtagggtttctgatgaaaattgaaattggtgcaggtgtgtgggtgtggttatttaatggggtagtgaggtttggacatttctgttttgctggctctctttgggttccttctaccttggggtaatcaaaagcatgaagaatttagggaaagttgctttcttattgtaaaaggggcacttctttcgcatgaatcttccacttttcatttgtatttttttaacactttctttacactaaagttgattaggaagaaagaatttgaaaataaaaaaaaagatagataaaatacacttgataatatttttttatttgattgaagaaaagttgattctctaaaataattattctccttttatctttaattcatattttatttttattcaagctaagagataattatgttctgagaccgattattttaaagatattgactaataactaaataagtaagtattaatattcgcaataaaatatattagaaatcacggtaaaaattcaataatattttttttttatagaaaataatacttttaatttcgtattaaataatgacactccttttcttcttatctttattactgtgttagccttttatttaataagatcaaacatccttagtgtgtttatttattactttctctttttctttcttccaatacttaatttttcaaaaattaacttttaataaattataaaataatacgtacattattacatttatttataattagatatcaagagaatacaaatatgtgttggtctaattaccattaagtatcattttttaagtcattagtaaatattatcttctgtgccaaaaaaagagagcaaagtttatcttctatacatattgtttttataaggtctaatagtaacattcaaataatttatttaatttataaattaaatattttattgattatatttgtaattttacttacgacattaatatttagtatgagacgcgtctaaattttgtaaacatataagataaaacattaaaataaatattacatggtgacaccttttatcatttataaatttgaaaaaatgaactattttattaaatagaataaaaaattataatgaaataaatgcaaataaaaaataattgttaaaatttaattaactcaatatgcatcaaattttaaatttgcagctttccatacaatgttatttagaagtacaaacaatttaaataaattgtaaaatgggtttagtaataacaataattgtcaaatcagttgaaaatatgatcaatgaaatgaaattaagaaactcttaacaattaatattttataaaaacaattgactaaacacttacatttatcctctaatttgttttttttactaagaaatatatgtgtttttatttaacattcaattaactctcctcccatcacattggctcattcttgagaataaagtggttcattcaattgccctatatgccaaaaaaaaaaaaaaatcctttaatttggttcatttggattcaattggattaagttggtttgatttattccatctctcaaaacataaaaagatgttgagttgtgttattcttttattattatttgtttttgcaaaatattttcaaaaaacacgtcaaaagc

SEQ ID NO: 122 - DNA, 1500 bp, Glycine max
  Soy_ogl_6764 Gm20:35055901..35057400 Cluster 1
ttaaattttcaagagattacttttagtttttctttctttattatgtttatggtttcataatttatggtaatttttaattatcaaaatttattttttaaaaaatgatttatgatattttaaactatcaaaatatttaactcgtatgatttgactggttttttttttggtattctgagttttatagaataaaaaaatgtgaatgtagaattgtgataattttttaaatattatgatggttttaaattactataaattatttctgatagtgaaaaattatcacaaattatgatatcattaacgtaaaaaaataagaaaaattaaaagtaattttttaaaaatttgaaaaattaataaaaatattttttaatgattaaaaaaataattatccaattataaaagactaaaaacataaggcaaaagatagacttcgaatagtgtttcaactttagtcttagaaaaatatagtagacactttaggtaacgtgacatttatgaagtatttacatgataatttatgtcacataaataacgcataaccacaagactaataacatggtatatacatacacgtgacaaatgttacatatgtgttttaagaatattttttgtaattaccttttttactttaattttaattcctctaaaatgattaaatttgattttagctccacaaatttaaatttaaattgtatctattaattattatttttatcttacttggtcattttttaaatctctaatatcttcgtcatttttcacctagaattcactaacaacatcacatgatataatttaaaccactatttagaattaacatcgaaagtgaaagtagagtcgcatgacttaccctaacaacctacaagtgactcggatcttatgaatcgaacgtcaaaacctttaatatatgcatcttgacaccctttagtaactaatggagttccgatacctgaaaatataattaaacacgtcaacaaactttactaatatccgtaaaaaaaaactttactaatatcaaatttctttaatggtaatgtgtttcgaaatcgaaactgacttttttatttttactatcgcacaatgttgatactgtataaacatttcttagagacaaattaactactatttagtcatctctaaaaatttattcataataaattctttgaacaatcaatcatgacaagaccgataaatatgctcctcaatatatgtatgcggggttaggaagagaagattttcttgggtccatgtttatctgcctcgtgtggacaatgagatcatgcagctgcatgctgcatgaagccttgaatcgtaatatttttagttgtcccttcacacctaagtttgaaattaaatctcaaattttgattaagtaatcgaagtgttaaattacttctgttatcaacatttaatatcattatatttctttttaggagtacaaatccttgcatatattttactattttgaaaacaatgtcatgcggttcaggccaaaaaaaaaag

SEQ ID NO: 123 - DNA, 1800 bp, Glycine max
  Soy_ogl_6769 Gm20:35201701..35203500 Cluster 1
cttttctcatctattttttcacaatcaaactcacaaaaatcataagtgacttaataaaaataactaaataagtaaatttcatgactttgttaaagaaaagttacggtaatcaacggctggtccaaaaataatgttattaaaacttaggcaaatgttaactagggttaaaaaactgaaagatttttttatattgaaatgaataaatttatattgtttataatttttttatgttttcctattatatgtatagtaagttttttttttagttccttgagtactaattatcaataacctaaaacttacactccaccgataaaatttgttttagtatttgttatttttaatgttcgggtaaatgttataccgaaaatgtaattaaacttacaatacttactttcttgaaaataaatttcttgaaaacaaattagatatctgataaaaaaaatatttcaggatttgttgtattttgtaaatagttataaaaacaattttttagaaatatttatagaaagctatgaaataatattttttttcttttactattacttgtataaaatactaaaaataagaaaataattttttataataatagatggacatgaacataaaaaatagtttttaaaccaaatttgtttatataatgattagtgtgtgacatattcaaaattaaaaatcgggttagtaacaaaaatgggtaaaatttaaaaaaaatactataataaatatttttgaaaaaaaatatgaaaataagtaacaatactttaatatacaatttcacaatgaaaaaattgtatatcaaaatatgatttttacttttcatttgttaaaaaaaatcctctaagaactaaaatcgtatgctaaaatacaatttttaaaattaaaaaaatgttgaaatcatattttaacatatgatttcaaattttaataataaaaaaattttaaaaattgagatcatatatacatatataattttaatgtaacaattttatcaaaaataaaatcgtgcttttgagcatgattttttatagtaaaattgtacttcaaagcatctttttttttcattttttgtaatttttaaaaaatacatccattatggtcattttaaaaaaaattactccattatagtgcaagagccttaaaattcttatttaaaattttttaaggttgatctaaaataacaagatcatagaaaaagttattgaaaaatatttcttattttgcaaatatgaatacataatgaacattttattttttaaatataaaatttaatttttaattgcttaaaatcaattaatcgatgttgacaaaattaaaaaaaaaatccttaatttatttgaaattttaataaataaagggttctataagaatgtcaatgagaataatatgtaatttaattaaatttgtttattttttacatgaacagaatatgaaaatttaactttcatatgtatacttttgctcaaaatcaaagactcaaaaaaacatttgattaatattagtaaagcgggtcattaattaaagtctatgttgcattaccacaggcgttgtcttaatttaattgagatgatatgcagtaacctgaacttggcttggagtaattcataatgttgatattctatctgtcttaaaatgactgatcaaacattacaagagaattaatttatatttggagataattttattaaaatatttttgttctctcttttaatcttaatagatatattattaattcttttaaaataacattatatattgatcatagaataaaatttgaatggatgtttgaatatctcattaaaa

SEQ ID NO: 124 - DNA, 2066 bp, Glycine max
  Soy_ogl_6864 Gm20:39379135..39381200 Cluster 1
ctgtcaacattaaagctgtagaattcactttttggttttcttttaaattagtaatttacattatttcatattatagaatttactttttggctaaattgtataattcgcttagttactccctccatgtgttttaaatttgatgcatatcttttgagttctagctaaatagataaataaataatagggataacctatatgattcgaatccaatctggaaaatttttaatgtaatgctttttttggaaggaaaaaaaaacctggggttgaataaagtcagatttaacgtaactttaagtactaagccaacttgaatttgttctagctggatcgaattatcttatttattatttaaataatgaaagaaaataaaaaaatagaagaattataaattataaaaactgaaagaaaataattatcccaaaagttacaattattctatagagtatgtctactaaactacactaaatatgttttatttatttttttatatcgagtactacaataaatatcattttattttgtacataataggatagggtcaaaccgatattcattttttacataattataaattacataatagaatttttaaatataaaaataaagtttcttaaaccgatattcaacatgacttaattggatttatacaaattcaacctaaccaaacaagtgaagttaacctgatttttttatattgggactgaatcaaatagactcgagattagccataaacaaaggtatatcaaacgaagcgtgaaggggaaaaaaaaagatattgataggttttgaattaaaacacggtaaaaacagtatatacaaaattttgtttaagagatattttaacttttgcaaaaccgtatatacaaatcagtaaatcagcaaactttgcaaattggcaaaaatggtttaatgaggttaatgaaaaatacaataaaaatacatttagaaataagcatgtctcttttccgtaatatcgaataatattaaatcctcttattatatcctcctacaaatcttcatattattatcttttatgataagtattgaataaaaaataaaaatatttatcgtcttaaaaatataaaatatatttaaaacttatcataaaagataataagaggatttgttggaagattaaaaattattgttgaagaaacctgcgaactatgtactgaaaacagtttttggacagctacggaacactaaaaacaagaatggattacacacataagggatgaaacccgaggagaaaagtgatagagtaatgggtcatgtagagagtttgttgtgcttatcttttaagtatggacccaaaaaaatgatatgtttctccaagaagcccatgcagcagatgagttattggaatctgaagcccaatgaatggcatataccaattgagtctttgaatgctcttttctccaacctttttgggtcacctatagaaaagggtaggacaacccaaactaattttgtacttgcaataggaacttgggattggtcgccagatcagttgacttcatgatgatgccctatttcaacaaatttttattctcctctgcttgaccaagaacttctttcttcttctttctttaatgaatgcgtcaactcaattcaccttcaaatttgccaaaaaaaaaaaggtattagattgagttgaactcattttgttattggattgataatttcaactaaatctaatcctaattgatcaatcagattagtcgggttcaattatacaatacagtccaatacacttagatacattgaacaaattggcccattaggtttaatcggctctatcatttctagaacttttacttgtagtggtttaaatcttcatacaggatgttttagactcaaaactactaaaggtacgcttataattcgtaccataacacacaataatatataatgctaacatcataatatatatagaatctaaaatatatcacatctcagtaatatataaagttcaaatatcgtagagtttttttttttttatctgtatgtagagttgtttagttagttaccaatttattgaagaatggttgttgccaatatcatcc

SEQ ID NO: 125 - DNA, 2200 bp, Glycine max
  Soy_ogl_1098 Gm03:45486701..45488900 Cluster 1
caaatttaacaattttttttactaccaaatcaatcttattactcttactttatactataatatcctagaagtactcaaagaattgcttcatattatttttattgcaattactagctaaaactcaatatattggtgcctttgatacacaaaaaataattcactacaagacaaaatcaagttacaacacatttttctttatcttgtttagcgaacaataaaagaaaaagcaaggtactgtgaaatttattataaataaatgtagatataattttgagaaataattaagatgaagggtttttccatatgtttacatcagagatagataaaaggaaaggtattgctacatttattttactcagaatgggttgatcagatgggaagaaaattaattaaatgttaaataagaagttcaaatattttcctgttacacaaagtaaataaataaaacaaacgtaacaagcaaatagagagtggtgctgtcccttgatttagttggtcgaataagttacaaatgtataactaaagaaaagattccaataatacttaatttcaagctatttactcgaagatacgatttcggtattccttcggcaatctcgttatttctcttaattgttttaggcttggatgatgcaatcacgtaaagttttaggctttgttttgtgttatataggagttaacaacaaattttggatttgttttcttcaataaccatgatctcatcaaaatttaaggaagattaatttttttttccctatatcctctttatagatcatttatcatgaattaatgtgttaaatttttaatattcaattcaatctaacatatatgattacaaatataatccaacaaactaaaaatatatattaaataaaagatattatagaaagaagatgtcattgaactttactgatgaaaaattaaatgattaagaacattatactaatctcttaatcagaagtgtcacatatttaagacatgaacatgtttataagtaagttttaacccttattataacacacaagttttatatttataaaatataaatgataattacttttaactgttataaatttttattaaaccttcactgttaatgactttagtttttaattttcacttttcatatctgatctaatttttttataatcaaaatatggaaacatcaatgataaaaaaaaaaataaagatttaagaataatatacattatagacttttacttccgatcaaagttttgttctgacacaaaagagcataatcccgtattcgattctaattatgctgtgtattgtgtataatttaatttatcttaactagtgacggattcatttgtaacaaacatgaaaaggattcctttgttgattgctaaaatatacctgttctcatcacgctttggaattgcttggttggagttggagagcttcacatctgtcggacagtgcacattggcttcactaaaataatttcatcgaaattaatccatcaaaatcattaacattgtttggttttaatactaacccaacgattaacgtggaaggtttgattgctgacatcggaaaattaatccataaaaaaatcactaacattgattggtttgagtagaaagcaaggtctcatgactagaaaccttttgttcaatttttactgtcattttaatttggcaatataaatgaaatatatttttttctaatttatctttaaccattaacagggaagtgaaaaaacaagaaataaatatataaatgagtgaaaatataattaatatgaaaataagagatatgttaggaaatgaatactaatttttatgaaatcctaaatatttaattatatttctttttaatattcctatgcctaaatcttaataaacattgatacttgattataaaataaattatattatgagaaaaatactcatttattatgtgtttacatttctcaaaaaaataaaattaataaataattgtttcacagcaatatgcaaacatcttcttaatttaaacatattctactaatatcattcattagtcatatttttttttctttatttttctatcccattataaaatctatcatatttgtatatattttttttcttctctagccctctcaaagtatctcgtaacgtggaattagaaccttgtttgaagtgaggaaggcaaacagggtaataaatgggactggttcacccgtcccaacttg

SEQ ID NO: 126 - DNA, 2900 bp, Glycine max
  Soy_ogl_1923 Gm06:13569801..13572700 Cluster 1
tggcagctccattaatattggcccatgcgggtgtcacgatctagcgtgcaaattcaacggcgaggatggcatcggcgccacgtgaaccgttctagtttcctctcatgcccttgtcttcattattatgtaaccgttcgttcctctttcgctgtcacaacgaccaccttcaagccaaacccaaactaactagttaggacttaggagtatgtatatcatagagaaatataagtaacatgtttttaacatactttttcaaacatatttcttattattattcatttaaaatcacaaattttaatacatctaacttttcatttaatatttttctctccattcatttaaaaaatatgttacttagactcgtatgtcatatcatatgttcaagctgcatttacataacatatgcttctgcctagctcccgcacccaaccccaacccattctcttttttctgtggtcagcaaagtttcatatgccatgtggctttgtgtgaatgtgcgcaatgcaatgcaacccaaacattttgaattccatctatattttggctctatatatagtttttacgtgtgtctactttgcgcctaagctacgtggaatgggggaccaccaccaaacgttgttagaatttgcgacatatacacaaacacatcatttcggtatgcctaattcctaaggttctgcctaacttttttttttatatgcccagatatatatatgacataacaatatgttagaagatactataataattcaagggttttgttacaacaacacctttctctcttcttggaatgcctatagcaatggataatagatataaacataaatatagatagatagatgctcgtgttttatatatataaattgttgtgctctatgggtagaggggaataatctcgtagcactgtcaattagtacactatgtatcattttagaattaacttccagcaattagtacccctttgctagttgcatgcttcggtggctttcgtgattgctttgatcggataacttagaaaaacagagttgttcggcgcttctcaacttcatctaaaaatagatataaataaacggcgtcgaaggaacaccattgtcaatctcattaatcacgtcgtatatgttctttgccttttctttcaacttcttctgaaggtttcttcatgttcaggtccattattaatcaggttttctcatctacatggccgtacaatatttatgaaaaagaaaataaaaaacataggaaggaatgctaaacagaattactattaaacaaaatttatttatgtaaaagttaaaattacaagagggtgtaatgcactaattatttgaggagtactaaccacactttttaactcgttctttataacacatactttatattacttaaaatttataaaatcaagagaaactcataatataaactacaaattcaaccaacaattttgtcttcattcttgttcacaaggtgctatgtttattgaaaaaaggtttttctgacgtatttagatgttttagggtcatttgatttgttaaaatttatggcattgggcaggataaatatttttattttacatttgatttgaaaaaatttatgaaataatgcaaattaatcacatgagacaaaaattcaattttttgttattttgaaaatcggataactttttatatcagatgcaaagtatttaaaagacacgtatattcaaaacatattaagataattaatattaaaaatattttaataaattttatattattatgcttgtgttattcattattaatcaaacaatacatataataaaaaaattgtcctgtaatttgaatattttatcatgtgttgtacccagtaacaaacttaatcttatattataaccaactcacaatcataaaggataatgtcagattcatgtgtcatgttttactcatgttttgcattttttttgttagatttaggtatcattctattatatttttgtttaatttcttttgtttaggattttgtacaacattaggatatgtttttgttttaggaaagatagcttgtaaagtaaccaagtgttaaggaatcgctaagaagaaagcaataggaactaaaggtagtagaaatcctgaagacaagcaatcaagcaaactgaaggcctactctgcacccaagctagcaattttgccaattgggatataattgcaaaaaatttcaatattccatcaactttgatttatgtgttgaagcaaaacgtatttggcgatatgattcaccatcaaaagaacccaattatcacattgaaaggttcttggaaatctatgagaccttgaatcatgaacttgtgatgcattgcaacttcacttattctttctcactattagggataaggataaggcatggatgaaaatcattcccaactccaaagggcgtgaatactggacattgtgtgaacaaggtttaccggaatgagaaaacaagacacctatttcaactaagggggttgtgacaatccctatatgaagcatgtgagcaatataaaaaagaattggactgtgaaccaccgctcaaggtttacttagaagcatgatctcattgtgggcttgagcagtgggtcatataatctaattcttcttgaaagtgttgaactatcactaccaaagtatagtgactttagattctgcaattgggaggagctttcatgaacaagccaatggaagaaagcattatcatcctcgaggttgtgacttcaaaggaaaaatatagtccatgtggggagaatgagaaagtaaagtatgaggtcaataatgttgacctattaaaggcagaattagatgctctgagtctaaaatttaataaactggaaatttaaggctaaggttgattctatgggtactgttaatctttattgtaagctttgaagt

SEQ ID NO: 127 - DNA, 2132 bp, Glycine max
  Soy_ogl_2469 Gm08:2578569..2580700 Cluster 1
aaattatgatatttttttaattaaaaaatattgattctgttttaaaaatatttatttgttgtttttaaagtaaatctgtagtattttcttaaaaaatatataagctacacctcttacgtgctttccgtccaaatttatggagagagtgagtggaaatactatatagtggggtctacagatttttataacttctcttccctaatccctataaaaaaaaaacaatatctctgttgaatcctttctttctaaatcttcccttacccaaaacaaacataattttattgagatcaacctttaacattttagcagtaaaaaaaccctttaacattttagactaaagtttaatttaattattattctatctttttttttttagatttatcattctatcttgaatgtgttctaacttatgaatacattttttttaatatctacattactatgacatttatataattttattttgaagatgagattcatataattacttattatcttatagtggaaaaattagacctcttaaatagtgattgtattactggcttaaaggctttttccatctcatgaaatcttaattaataaattttttattcatatgtgtatattaattttctattttatacattaattgtatccgataagaaaacaaaaaagtaaaatagaaatttatatttagtatgttaattttaaaaaaattataatatttttgttttcttaaaatgatttaaaacatttaaaagagtgtgtttaatactttttaccttaattaaaattttgaatttaagcaatatgttctttttaaacattttgaaaatcataaacaaaccttgattacatcactaattcagtaattccaaaactattcatcacattacccctacaatacatatataatttgtcaatacacgtagcttaggaatttattcatgttttattaatttttctgttaaccacggcgccaatgaattcttaacataagagttgtgtaaagtgtaaactagtattgaatattaattctcaattacccatccaattctaataagttaaattatctctaattattttgcataatcttttttaacacctacttttgtatctgttgagaaaagtttattctctctttatttaattgtgtgataatatgatactttttaagaaatgaagaaaatattaaaaaataatataaaaggaattttgtttattttttattttttgtagttgatgacattctttctttgatatctggttagatatgagatccgatgagcccagcacagcctggatcaatcatttgcgcattgtcacctgtatgtgattcttaacttatttttcgagagtcaagtcaccccgtgattcttcattatcgacagaacatccatataaattaaagagttgacgcagccaattgaacaatggtattattaagatacaccaaccaagttccacatatatgtatatttttttttttcttttgtcaggagggtacgagaaaatgagtctaatcacatatttttcattttcattttaattagtttagaaatataaattttagaatatgataaatcttctgatattgtgcgaataaacaaatactcaaagtttaacaaaatataaacaagaaagatatatagcatcggcaaataaagaaatttgactaaaatatataaaagaaaaaatgtagaggaaactaaactactagctgaaatgaatgtcttaaattttggtgaaagaaacagaaagtgtaagtgcagccagagaagcaggtcttccttctttgcagtgacaacgggatgacaccctcaaccaagctgtttttgtccccaccccgcccacctttatttcttctcttacattcatcactttcttcttaatcttaccacaaaccaatccaccaattcagatcctgtatcttctattcattattattactttaaaataaattgcaggcaacctactttgctctttctcttttaatgaaatacaatatattttttttgtttgaaaactaaattctttactaatcgatctcctaaaataaatatctttactagtcaacaaaatttaaaataaaaattgtactctacctcagaccccaggtaatcagcctcagccaaccgatcagtatcatatgc

SEQ ID NO: 128 - DNA, 2513 bp, Glycine max
  Soy_ogl_3630 Gm10:48710889..48713401 Cluster 1
ataatatatggtcattaattttttttccaaaagaatataaatattagttaaaaagacctcacctcaaaaccactttagagctaaaaatatattaaactaaccctattctttggtttgagcccatcatattgaaaacttcagaattcaatacttataacgaattagaatagatcaattattttatagaaccaaatcaatctaagactttgaatctgactcgttaacatccttaatttatatatttcttttttttcctatttagcttttaatccaaattgtaattattcaaaggtatgattgtaatttttccttgatgtgttgaactttatctgtccgtacatttcattattttttgtcactcttgatcgtgtgttaaaatgaagtgaatacatgcaaaagacaatttgatacttaagacaagacaaatatcatttcaatacagtaaaaagaaaataataaatgaaaatgaataattattttacctcgaaagtcgcactctttgtatatacgcatgtatagactttaggattcatgggtcatattgttaatgtgatgttaatcctttattatatggtaatattatcttaattcaaggattatgcctctaacattgacattgtcaactgtaataagatcgaacaatcctctcatgagtattgttggattatatgattatctaagggttctagatccaagtgggataaaaaacaaaaacattacttctcatacaaatcttactaacattaattaaacaaggcattaaatatatttaatttcttaaaaatataaaacgtttttaatatttactttatttagtactactattaattaggagaattcgtaggaagagtaagcaggagaatataaaattattaaagaaaacactagtataatttatctggatgtgtctcatgatcacacgaccgacgttatttttagccatacagcaagggtatctccaagaacataagttgttatatttttcttggcttttgccgcgacatcctttatatttaaagtgcatcccaaacttttattactagaaaattacttgtcatatgatttataaattggttccatggcaacttcaatcgatatctggaccgaacatgttagtttagaattcgtaacgtataacaaaatagattgcgtgatccaatgacttcaaaaatatcaccattatcaattactccaaaccaagttcaggttactacatatcatctcaaataaacaccacgcttgaggtcgccaatcatgcaacgtagaatttaattaatggccagctttattaatattaatcaaatgttttctttttgctgaataataatattaatcaaatgttttaccacaagtaaaagtaaaagcaaaaaaatcattatttaatattaattattttttaaaaaataaaacaaatcctgagaatacttttttatttagacgtccaatatattttcaagaaaaacaatttttaagaaagtaagtattgtaagtttaattgcattttcggtataacatttacaccaacaataaataataaatatttttttattggtgctgtttaagttttaaattttaataaccttatttttggaccagcttcgataaccgtaactttcccttaacatttaacagtcattaaatttacttatttaattattgctattacatcaattatcatttttctttctttctttcttctttatactccaataggtagacctagaagtttattagaagtccaagataaaagcaagggacaaatagtgaaataggagagaaccttctaagttataagtagagttgtgttggtaacatcaatgatttgcttgccacttttatataataaggctatcattattctcatttgtgttaagttgcttcttgacgttgagtgattgtgtccacctagccttgataccatttgtaatatttcaatcatcacggcttaaccaaaaaaaaaaattgaagaaaattaatacaatcattactgatgcgaaacttgctactcgatgtccattcctcatgcgtcataattagccttcttttttctcagttacaacttaacaataattattaactacttttcctttttccttagttatcttttactttcctaaaaaaaaaaaaccaaaacttttaggctggcaaagtcagaggaatgacaaagtctcaaacttatagcaaattaactttataaaaaagttaacgggctgatgagaagatttaccgaaacattatagaacaaattgttgaatactaataattcaaaatattcatttattaatggggtatttaaaaactatcaaatgattaattttattcgtttgtttattataaaacatatgttaattaagtatcaaattgtgtaaatttatacattaaataattatttaaaaaatagactacattatacttttggcctctatataatatccaattgtagtttttggtcttctttttttaattcggcaattttaacggggacggaaccaaaagtgtgttaaagggagacc

SEQ ID NO: 129 - DNA, 1800 bp, Glycine max
  Soy_ogl_825 Gm03:3529801..3531600 Cluster 1
tatgttccatctgagttgaatttacactatattgcttccataggagacaaacttggaactgttgcatcttgtgtcccttccccatgttaggtgcggaacaccctggctttggttagttcctgccagagcgtaaaaaaaaatctattttatgtgttccgcatattaaaaaaagttcccaattttttttaaaaaaaaatctattttatgtgtagaaaggatcgagtttccaactagtacaataaaatattaaaatgggactaatctattttgaaatagaaagatatttcataacctcttttcgaattaactaatgaggcttgttttctaaatattataggacatgtatatttttatatgtgtaaaattatacttctatctaacaatgttatcatataacttagtttaatgagtttaatattaaacacattaaaatatatgaacaataatttaatgagcttatttttacatactagtcttttaaagatttttttagtctatattattttttttattttgctttagttttcactgttaagtaaagcgttgattaatttcataataacgatgatatcaataactcattaatttatcacatcattgaaaagtataatagattataatatgttaaaaaaattgtaaacaatatttttttaatatctcatcaactagtatgcgttaataattgtttttaacaaatgatggggaatttaaaagtacaattcactaaaaaaaattcgtttgactattatattaaacgccttgattgatgtggcaagtcaatcaactttcaagttgtgttacctgttaatgttgtcaattgtcacttgacaatgtacaaaaaaaaaaatccagaaactaaagaaattttttaaagtattaataaatgcaaaaataagatagtttatagggaccaaattgttatttaagtgtatttattttaatttgtttacacggttgatgatatagattaattataataaatgggtgatgatcgtgacactaagagtcgtagagagagaaaaataatcttaaaaagatattcatattaaaatagattaaattttaacacattgatttctaaaaagagtaaattgtaactatggacgcctttgtccaattgacctaaggaattaatgttagacttatttggatctcttgcaattcatggaggatgagtagttggagtttatagaaagtttattttatgaaatctcttagagatcaaaaacaatatgcatactttaatttatcaccaaccaagtagatgaatactacgtgatagtaataggaaattattctttggcacttagatattaaggaggaatagactgttccagttggatatcgtcaagaatttattacaattgcataggaacatgtttatttttgaagtatttttcccgtaacaatattttttctattttaaaatggaaggaaatacaatgtcattttttaaaaaatgaagcaaattacaatgcaatttaattgtctttaaaataattaatttttctaaatcttttattaaacattattttaaatataaaatagatagattagtccaaataaagtgctgtcgatttgagaatttcatggatatttccggatagttataaattcatggggcctctttcatgtacccccacttatctattttatagtttaggttcagttacttaccttttctatttgtttctttttccgtcaattaaggaaataagaaaagaaaaaagtcttttattgataacagattttattttaggattattatttagctaaagtatgttttttatttgtttaata

SEQ ID NO: 130 - DNA, 2459 bp, Glycine max
  Soy_ogl_211 Gm01:48854901..48857359 Cluster 1
tactacttgatgaggtctgttatttttccctacttcctctcttttatatttggcgagtttatgaatttggaccctatttgttttataaaccaaacttttgctatatatttgagtgtcagctgaaaaatacaaattatagtaagtacagatattttgtaaaaagaattaattcaataaacaatttaattagagcaaatgttattgaaaagattaagataaacttctttaacagtaactccacaaatctcactcataatcaaatgtttatattttgcaggattacaatgcaaaaatttcagattttggcttggccaaattaggcccttctggggaagattcacatgtgagtacgagtatcatgggaacatatggctatgctgctccagaatacattgcaacaggtgatcatcatcttatctacacatataaattgatgcttttcaaagatactgctcattgaaatttacctgaaacataagaaacagtttgatcttattgtttctaacatggctgaggaatgtgtcatgattcaacaggccacttgtatgtgaagagtgatgtttatggttttggtgtagtactgcttgaaagttgacagggttaagggcacttgacaaaaaccgcattatagagcagcagaatctaattgaatgggcaaagtcttctctctctgataaaagaaagttgaaaagcatcatggatgagaggatagagggtcagtattcaaccaaggcagcattgaaagcagcacgtcttactctaaaatgcctttaatgtgaccctaaaaaacgtcctcatatggaagatgttcttgacacattggaacgcatcgaagctatcaaggatacaacgaagtaatccaagaaacattgtacaaagttagcaactgtgcacaaattctaatagccaattcatattcatccttctgcacgtgtggaatatgacagagcatcaacatgtgtaggctgttgctacttgctagcatactagtcaaagttcaagttcagtgtaactactaactaactaggtttacagttaaagcctgtttggatacaaggctaaagtccttttgacagcttctctattggaattaaagagttttttcaaatagagaagctctcaaaagcacttataacttgtatccaaacaggtaattagtataggtagttagacctgttactgcatgagtgtttgttgctgtgttaatttgattagttgtacctggcctctctcattctagcttagttcccttgtctataaaaatgtgaagctcctacttgtagttgtatcgtcatcttttcatttaattcaataaaatgagttattcgaattcctctcttgttctttgagatatatggtctttggcatggggtgaggttacttgtattttttcaaagttatttcgttagttgtagggaaaatttgagaagtgggaaaacatcctgtattctaaattagatatttgcagaaagagttacccgaaatcatttataccactttacacaagctagggtaagactaggtaagactaggagtgagtatagacccgatcaatacgaactaaattggtttataaaaaaaatctcaactaaattgaaggagaaaatttgggaaactggatgatatcaatttgcatattaaatttgggaatatgaaatctagactaacacaaacatttactattttatagaagttttaaattttatgttctcgaattatataatttataaattttatgttgtacaatgttttaattttgactttggagactattcatcattttttttttcattttataatattttttttttgttttctcatattttttaatcattttattaatacaaccgatggcccagcttcacccaacatcaagtcaattcaaatcaattaacattgattggtaatggactacaaatttaaaagtagaaagttttgggctttgttttaccttgtgctttcaaccattaaataatttcatgttttttattatgtatatcaaattttatataatttaaacatttttttatctttttatctaagaaataacatttatttatacaataatgtattgttgtgaaaataaagttgtaagatgaaatattaactagatttttatttgcatgaaattttatcaatttaatttattttaaaaattttcattttgataattgaattggtttgtttcatattctaaacaaatttattgacacaaaaagttattaagtgatgggaatataaaaatttaatacatagtgtcaattgatcctattatatatacgtgcacgcatataaatacataataagtgaaagtgattgacgtaataatttatgtgatgagataatgagaaatgagaaaaaaaaaagaaattaggtgaaaaagagattaaaaaagtgagtgtatttttataattattgatattgagaatataagtacactatagcccacatacaggcag

SEQ ID NO: 131 - DNA, 2000 bp, Glycine max
  Soy_ogl_217 Gm01:48957301..48959300 Cluster 1
cattcaattactaattatgatggaatgatacacatggaaaccataacaataaagctaataaatataaaataaaacatggtaactagaggattaatgtaaattcaagaaaaacataaaaaaagtgtctcgtatttatgaggggacacatgtggtatttgaataaggtagaggggtaatctagttaatcaaataaggctaacatatgttttaggttatcataaattaaaaaattatgtttgttttttaataaatttttttcccaacattgaatttataataaaataataatttttatttttaatttttaatatttcttaatccataataaattaatgaattttatatttattttttaataaattttgttatttataattagtcgtgccaaatattaaaaataaaattattattttattagcaactcaatgaaaaaaaattattagctacatctataaaatgagagagttgcgatttctatctgtctaattgtgtgagattttaaatgaattaaagattttattgtttcatgaatatgtgtttgttcatgaaaaggtacatgtataaacagttgtcttcttcataaaaaatgggtctatcgttcgtatctgtatcatgaattttttgaaaggctatcgttaatttgcaaaaaattccagaattaccaattctgacgagatcatgaatctaatataaatagaatgaaactcataacatttgcattttccattttttgtgccgttatagtttgacttgacttctcaagtaccagctattatttaaatacaaatttgctttttctgcaccatcattatgtttttttaaaaaaatttggtatctttttaactgtttattccttttaattcaaagtttttttttatatttatctataaattaaatttcaattaattttttaaaaagattatatcaggagaattatggggagacaaaaatatttaataaaacatttaaaattatagatgacttgactaaaacattctgaccagatgcaaaaaatattactaatttacaagctataattaatatacaaaattgaccttaattaaaagaattatatctgaaaaattatggggagacaaattatttaataaaacctttaaagttataaatgacttgacctaaaacattctgaccagatgcaaaaatattaatttacaagctatagttaatatgcaaaaaattcataatagctaattttgacaagatgatacacatggaagccataaaaaaagtctaaacaaaaattatattataaatagataagtaattatatcaatctttttaaaaagataaataaccgcttaatttatcaaatattaaagtaacattattttttaacaaatttaaaaacatatatacattcatcattcaaaaacgaaaaagatatagagatcatcatattaattaatcatcttgatttcgatctttaatcagaaaagaaaattgttttcctatataaaggctttatctgtatgcagagtctgcacctagaattctaaggagaagatttttttctttctttcacaaacaaagaattagtcatgacttcaatctttgtacatgcagctaagctttacaagtatatatataagaagtatataagagaaaataaaagacaaagttgagtattatcttgttttatttatcatatttacggtattcttttgcatggcgtacgcagaacgaagtaaaccacaacgctactcctcagcgtgtcgagggttaagatgaatcaacacgccacgttgttgcctggtgatattttcaaattttccattagggttcatctcaatactgcacctgatccaacactcttgttatactctccctctcaaaccgtaccttaattgtcatagcttcttgcacgagggtaaactcttgcagacactgttatctcgcataaactttttcattgattctattgaagaaataacagaaggggtcatatcttgtgttcaagaactgtttcaagttgatggttt

SEQ ID NO: 132 - DNA, 2191 bp, Glycine max
  Soy_ogl_293 Gm01:52389101..52391291 Cluster 1
gttattacgaagtaacttgagtttattaatcgaacatcaaataagaaatggcatgagaacaatattaaatttaagtcatgatgaacatttatgtttatttctgtatatgtagcaacatatgaacatgaatcttcatgattttatgttataatattctggtaatgatgttgtcgtaactccaaaaggtgctgcagattaagttgattaacttgtttataatatccacaaaaaatatggttggaagtaatcataagtatatacgaaataataatatagtaatccatagttttaggaagattagtaaataaatgaaaattatttaaagaaaaaaatcgtatgattgttgatgttaggatttttttttttttttttgcgatttgttaacaaataatagtttgtgagtacttaagatttcatgctttaaattttgaccaagttggaagatatttagttctttaagtatggttaattgatgtgttaaatttttttatttgtgatgtgtgcagaaagaaaattgttaggacatataatactaattatttttataatatttctactttagtgatgtttgattaaggtagtgatagaaaatcaaaggtgaatgaaaataattaaaaattgaagtaaaagtaaatcactggatttacttttcaacgaaaaagtcatgtgtggattaaaaaaagaaaagagtattcaaataataaaaatatcattttactttgaaaaatgaatactctaatttattataggcaaatgttaatcatatacatgctatagttttctttagaaaaagaattgtttattgagtagaagatacaaaagtaattaatgcttctttttaaataattaaaagtatttaataataaagtatacttaatactgtatgtacatcggttactttttatttttgtgttggcctttaagccgttttgcttaaaaaagaaagatagaggatgaaagaaaatacttgttaacaaaatattttttatatatacaattatacattgaatttaaattttttaaacattaaaagtctttttagactgaatgacttagtaggatagaaggatcaccaacccctagtttattgtaccaatattgaacatatcaagtttaacttttatttggtttactgtttctttttagtaatcaaaagtagttgtaaatttaggggtgaacaaattaaattgtttaaaaattaaactgaattgtaaaaacagtttgaaagaagtggattgaatcacactactccgaattactgtgaattatttgaattgttctcaataagtatcttatttgaagagaatttttatattttttaatttcatagattaccgttcaaatttgttcaaccagttcaaaaaagctgaactatgaaacagtttcaagttcaattttttattcaaaacagttcattttttataatacagattagttcgataccagttgagttcaaaatttgtttaataaccctagccatgaaggcaaaatatttgcaaaacatactttaaagctcaaatcaacgtattttggtaaagtattaataatgattaaatatgaactgcacttgagtattgaacttatataatgtaaagcagtggatgaattattatagacatgtaaagaagttcaactgacccctcgctagtcaaacagactctcttaggcactaatggtgttgtactggaaattaaatttgggggaagtgacataggagttatgactttcaagaatcaagggtttatttagataaacttctttaagaaaaaaatgactgagaaagaaaaataaaatgatttttttataagttaaaattaatatatacataatttttttgcataaggtaatttgtataaaaaaattatgtaatttctctaaaatataattttaacctattcataagctcattttaatttataaaaaaaatatttttttcttaaaaatatttctggataaatttatccaaacgtacttagtcttttcaataaggctgatccacttgtacacgatgaaacccaactcaattgtacgtagccaataaaaaaatagtatttattatccaatgttgggaaagttcgaaataactgtggctgaaatgttcaaatttaggtcccatataattctgttcaaccgaagttgttagaacaataaaggatgtagaaaataaccaagtttcagtcaaagctgattc

SEQ ID NO: 133 - DNA, 3486 bp, Glycine max
  Soy_ogl_345 Gm02:3300001..3303486 Cluster 1
atataaattactatcctatagataaatgtgagttattttggtctaattagtcacttgaaatcacttttcaacaaatttatcaaacaaaaattatttcgattataatcaattatatatataattaattattgaaataatttattttttttaattatctcaaatatactgtgatctctgaattaaatcttaagtatataattatgttaaatatttaaatatttttattattatttatagtcgttttgattttatttgatttcaacatgattattttcataaaagatacatagtttaaacaaaataaataaataaattaaattgattgggttataaattaaaaagagttttaataacatattactgatactatttttttctttttgaagaaaataaaagaaaactatttggagttagaaaacaaagaaagaaaaagcatacttaaactaatgagttttttaaaacttcttaatatatatacaaaaatataaaataacttatatatatatatagtggtggacctatgttgttttgaggggtgcacttgcatcccctcattttttaaaattcatcaaattcgtaaataaaattttatatttttatattttattttatctatatttatataattgaacttactgattttattttttataatttactcctactaacttagcatcttaaatccgtcactatatatatatatatatacacacagcagtgcattaacacttaacaattattggatacaaaaatcaatactcctccacttgaagtgatttgtattaaggttatttaagtaatttaattattaattttaaaataaaaacaaaaaaccctattctctctcctgccccctctcagtctcacgtcacacttcacttgcgaacattgtcaatttattttctcttctgaatttctgaactgttggtgcatcttttttctgagttgcatttcacataatcgattattagttttcctttctctccttcgttagtgttggtgcatttcacataagttctccgtgacagttctttgttcagctccttttgctgctattcacgtatcattctcagtttcatcatatatgtaccaatgacattctcaaattcaagtaaataacatgtgttaattttttcttgaatttagatgattactaaatttgtcacgttctcaaattctcaattttctcggtgtaagtcctttttttttcattcacatatcattctctcgttgttcttgctgcctttctcgttagcatttttgattaagtgttgtttcaagagtcgaagcggatcttcaagcaatgtaattgtgtttagtctaagataatgagaatgtattttgcatcttctattattttaaccatgaaaaggtttggcacgatattgtcttgaatattttttcattttaatgtcagtatatttcctctctgacttattttcattgagtcaaaaataattttcattgaatgtctttttgattaatagtatttattgatgtaaggattggtcttggcttatttattaaggaaaaaatagatcaggaatttgtttcaccaattgttgcaaactacactatatatttgttgtcgacttcttcacttcggacaccctttctatcaatattctataacaatgatgtattaaagcttatagtccttgcaaggtagtgtacttgcatgtcttatgctctacactagctatatccaataaatcttttgttcataaaaatatacttgtaaaaaaaagtagcaataaattggtatcaacattatgccactaaagaatttgatgctaatgttaagctttttttaatagtcatgaacatgaataaatattattaaaataaaattgttttctattacaacaaacagtctaagatctctaggaagtaaaacttaaaatcaagagatatatttactaaactctaacattttatatatacttaagtacaaaagattggaatattgttacaaattttgacaataatagacaaaatcattaaaaaatcttataagatcgacaaacaaatagcctaaaagcacatatacatctatttgtgcacatggtagatgtttatatatatgtctccaactacaagtcactaaagcaaattccattgttttctattttctccaagagcctttattgtatcacctccttgagcacatgtcacaaccatacactattttgttagtgtggcaataaatgatcacattgggcaccaacttgacagcatcaaagggtactcctctttatagcaatcttacatgacatcactttggcaccgatatcaatattatgcttctctattgcatcaactacacaaatacaattgtatacttaacgaacatgttagaaggaaaaaagaaatcattcacaaaacacacacgaaaaagataaattaatgataaaactagtactagaatatattgacttccaaaaaatacaaacaaaaaattcagaaaactataaattaaaaattttgctcatgtaaaactaggagcaactaatagctattatggccaagaaagtgatgttgaatgtgcttattttttcagggaacgacaagtcgtgaatttttctcactagctagtttgtttggatcaaatcgctttgtttggattaatcgatggtttgcgaaggtctcgtctttgctagtttgtgaagtcgtgtgaccgtgctgcttcaattttgtgccactacgaagctcgtcgttgatccctctgtatctttaaataacttaattattcatgaatcaattattgggacatatcttcaaccctatgtcactttcaaaacttgattctttaaactcaataatcgattctttatattcaataattgggtttcacttttcgtaaaaaataaaaataaaaatgggtttcactaaatcaaatatatacttcctttattcccaattataattttttttcaaaaatttgattgtctatttttataaaattattttctaattttaaatacattaattattttttttctacttaccatcccttaattatttctttttcaaatattaatgtgaaacgagtaactggataaaaaaataaaaagataattttagaataatgatacaaataattaataaatttaatacgataattacttttttaaaagaacataaattagctgaaaaaatcttataattatcaataaaagaagggagtatattcaaattttaatcaattattcacaataactaatagattaacttgtgtaaaatccaagtgtctacattatagtcgattatttgtaatctataatcaatttaatcattatgtattcattttactcgattaaatatggtcatggcacacttatggtaagagtataacattagtttacaattttatttaattattaaattagaacacaaataaatttaatttcttaaacatatttttatttcattttatttgtcctcaaaattttttaagggaaaatagtagcataatcttttttagag

SEQ ID NO: 134 - DNA, 2000 bp, Glycine max
  Soy_ogl_962 Gm03:39150201..39152200 Cluster 1
cggagatgatggtttccaatcaatagcacacagtggtgagaagatgaaagggtaataattaactatttgtaagcactcagatcaagggagagtgagcaatataaggttttgagtattacttaattaggggcacattacatatggtccttcattagcgggaaatactgttagatgacataataatttatttatttttatccataagagttaaaaatcatatcaagaaacacattacttaacaatttgttattttgcaaaggactaacatgacaatctaggtcaacatatataaaagagtgactcttgcatgaaagaaagggtgttctagtcattctttagtgattccgtaatttttatgtgtaatcgaaatacttatatttgatgatgtcttataagatcataggaataacatgatgagttggtcctcacaattgatgacaatgtaaaaaaaaaaaaaatcaatattatcgtaaaacattttcataaaaaaatatatatttagtcataaattaaaaaacaaacattatattaataacaaagtgtagtcaacaaaatggttagatacttcatatttatagcatatcaacttaaaaaaatatcctacttataattttctctgtagttgcttaaaaaaatgattagttttgtgtctgtactcaatatgtccatatgtgatttaaaaattcacgttaaaactaaaaacttttaatataaatttatggaatttaatgagcaatgtactttagaaagaaaaacataaataatgatagctgacaaattaactcgtcgaatttctaactatttatttttatatatgaaaagaaattactgagaatttcaatttcaacaaattatagtatttaatttcgaatcaaatataattactcacagaaataaatgtagacttaaataacaaaataccgtaaaaaaaatttaaaaaatcaagcattctattaactatacttatgtatcaaattcctccatagctgtttataaaaaagtcttttagttttgtgaatatgtacctaattgataaggttcatacgtgatgcaaaaaattcaatgttaaactctataacttttactataaattaaatgatcggtgtaccttagaaagaaacaaataaaataataatagctgacaaattaacatttaataaatagaccaaactcaattttagtcttcatgttcaataaaagttttatttggttctaaatattttattctagagtaaattacaattttagtcttctttaatttttaatccttattttgatttctctattttttttctcatcatattattctatttattttaaaaaatttataatttttgttcaatactcaattttgcatatgtttattcttgttatgctagtccaactaaactttagacataacatattcacttgaggtgatataaaaactaattgaattaattaaatataaaaaatatgtaaaaataagaattgaactaaaattgtaaatcttataaaatagactaaattggtaggggaaaaaggtcacatattaaccattataaaaaaattaaaattaaaatttaccctttatttatttataccttgaagaatgctattgatatatatttttaaacaattttgtattattgttacagtaaaaaaaaattgtattattgaatacaattcatataaactctactaaataatgtaggtttcactttttcttgaatgatattcgcatagattttactcaatgtttgaaaatataatataaaggtatatgttgctaacatttttcttttatacatgtcatgttttttttataaaaaaagtcatcattaatcataattgaaatgaaatatgaattcaaatctatctaatttgggacaatgtagaaattttgaaaaattagtaaaaaaaaaagttttagtcttgaaaatattcagaattatacacacatctgtatttgcttcccaatatctttagaacactccaaagttatttctcaaaaattgaaa

SEQ ID NO: 135 - DNA, 2200 bp, Glycine max
  Soy_ogl_1146 Gm04:785801..788000 Cluster 1
ccaatttgtatgcttaatgggccaatttgtagacttagattcatatattcattcctaattatcaatttgataactttttcgtcatcgataaattgaggaggaagaacactataggaaagtaatttttctttttttacaagcaactacagagataagtaatttttctttcttttttacctataggtgagtaattagaatacagtactgttttaaaaaaatagaatataatacactaaacacctcatactacacttgcttcaacatcaaagtcctattgcaaatactcccatcgtacagagtaaatcaaccgaaggaggagatcaaacacaagaaagggagcagcgtagcaaagactatggtagaacatatgctctcagacaagataattctagtaagaacatatataatcatgttaaacatgcaagaaatattaaccaatacgtgcaatcaacgtacaagagccaaaaactaatagcaaagaaaaaaaaaagaaatgagaaaaattgtagctacacttctctcaaaaaataacaaaaaaaaaagagaataatatcctttatctcgcaaataaaattgaaaccttaacatacaagactaacagcaatgtccacaatctccctgttatcaaaatatatataatattttaaaatatcgatgaaatcttagacgacatgggagatttaacaactaatttaagaaatatcaaattaacatataaatatacttaatattttaaaagatataaaaagattatttacatctaaaattgtgttcgtcttttcttcagagtgaaaatcatcaattattatatctgcgatgcattttttagcaattttttaatgagtattttttatatataaaagtaataaaaaaaaaatgtgtgtaagggaagccggcagcaagccaaactgtgggcctatttgtgcattgggtcgtggtatttgcctgcttgggttgggccccaacggggcgatatcttggatacgttgctgtcgctgcataatctccaaactggccttatccaaagtttgcaagaagacaagaggaggatactcttattctttgttttctgtttttcttgatatgggaactaatgattgctgtttaatatggagtatcttctgcaaattatttatttattttatctggagaaagatagaccataatttcatttttgaaaatatttttattcgtattttttttttaaaaaagttaagatagtattcattattattattattttttcaattgtgtttatctttataatttttaatttactcaccagttaagaaaaatatttaacattattcaattttattaaatcgtctattttttaaaaattatccttcattcaaagatgaaaaatccagtataaataaattcttaaataaatgaaggatattatactgatgatattattaaatatgataaaaataattgcctaacaaaagtaaaaataacatttactaaaatttgcttatattttagtctatcattcatattttagagttatccttattcaccttttaaccatacaaagattgtgtgtggttttcaccttaaaaacaaaagtctacattttgagttaaaataaaacaaaattatttataagaaattctaaaacaaaaaattgctataatgtgtgcatgtacatatgtgtgtctttttcccacttgtgtgatggacaagctgatagtcacaggcaagttgattcattccatttcatggagttgttaattctccgagaatgaccatttcatggagttgattcattccattccatttatatgctgtaatatttggtatgttgtattacaacaaccaataatgatgatattgatgtatttatacccatcactaaaattattgattgttataattgacacaatacttgaccttaatctcaagagataattaatgagtatttttattttagacttatatttgtcttataatatatggtttatgttctttattttgataaatattgtactccacatttgtaaaattttctatttctaaattatttaattgtttttcattaacacaataaattattattattattatttaatcattttaacgtatacacaagttgagactcgtgaaacacggatcactttactagtttctagtgaaatgggtggatataagacctaggaatcagatcttgaacatgtgtgtactgtgtaccgaatgc

SEQ ID NO: 136 - DNA, 1898 bp, Glycine max
  Soy_ogl_1409 Gm04:45047603..45049500 Cluster 1
ccctttacagatgtaaatatatttatttttaaattttcattaaaaaaatttatgattaaaatatcttttacactattctaccttgagagacttaaatattacatttttcttttttttttcaagatatacacctttctcttttaatagattaaaatacaccacaatttcagtattatatttttctataaaaaaataataaaaatttgacattatttaacatatatgtgcatctttttttcaacaaatgcatgttattgaattatttgattttcataaaataattttggtcataattttttttgttgaatgtcatttctaacttttttatataatacttataacaagctttgttagacatttaaaatatttactttgtttattatcccttttgaagataaataatgttggagtgaataggaaacaaggttaggacatcgaatgatggaagaataacctgataaattaaaatatttgaaagaatattttttaagagtactgttaactaagttaaatatttacttaattatataactcatccttaactataattaaaagtttaattgagtccctaaattattaaaagttcaatcaggtgtttcaattatttaaaacatttgaattgggttcttcaattattacaaattgaattaggttcttcaattgtttaaaaacattacaatcatatcattttcgtcaactttgttagttttatcacagaaattatgtaaaaaaatatttctacattgattgtattaacaacaaatataaaaatatttatttacatcaacaataaatcttaacaagaacttcatttttgcatgggtatcattgataattgatgtaaaaaattcttattttaagttgattatattaatcttacttttatcaatcaaactaacggaattgatagaaaaaagtgtaattataatatttttaattaattagaggctataattaaacatttaataattaacgaactcaattaaactattttaaataattgaaaaacttggttgacttttttaataattaaaggatccaattaaatttttaattattataaaagatgaattgtataattaaaccttaaatatactaaataaaatattttcatatctaattggatgaaagtatagtttacttcactatttttgtgtgtataccagacttgaacccaattctttatggatgttgtcattagacaattatcataagaatcaaagttgtcgatctctttttcttaaagtgatagtccaagcatctaagctcaccaggccatgcatggtggattgtggttgcaacaacttgttatccatccattgttgggagaggaaggtgttcacttctctatgaaactaacctctcacgttgtgtcctccactctaggaaccaggagattcaactcttaacttgcaataacattaatttaaatgaactacgttatatatttcactataagaatgtaatatttatatctcttagaggagagaaacgtaatttgctcaatatttttaggctaaatcacccctaactcctaattataaataagtttaaaaaaatatgtgtgattcaaaacttattaaccccaattcttgagtatttaaaatgcgcacatcaatatatatttaattcttgtgtgcgtaaaagatataattatggatggtttagtgcgagtaaaaaattaaattactaaattttgaattgcagttttttttcttttaaatttaatagaaatataactaaatgaatgcccttatattcaagcccgcgctttctcaaatacttgagcaacctttctttccccagcataaaaaaaaaaataaaactacttaagaaacctttacaaaatggaattttaaaaaaattagatagtaatagtagcttttatcttttgcaaa

SEQ ID NO: 137 - DNA, 2168 bp, Glycine max
  Soy_ogl_1434 Gm04:46095801..46097968 Cluster 1
tagtgataaatttaagaaaaataaattataatataaatgtcaaatggattaacccacaccgagcttgattgtaaaaggaatgtgtgaaaagggttgtggaattcaacccattcctttgattggacatgagtgaagcaaatataagcgtccacgatccacagttttagaagaaaaataaaagtatattgttttattcatttacgttagaggccgagggattctacctgcggaatctcttcattcatattatataattaaatttattaatatatatacactgattcggatttattttccaatctaattacgttgaattaaattttataagcatttgagtttaatttattcaacctaattaaaatctaatcattaaagaattggataacaacatctattttttaaatatatctcaatctatatcatataattaaattaattattaaatacaaaacacattaatttttaactcatataatttattaaattattaaattaaatgaaaaatgatttttttaatttgttgtttttatgtctatcttgattttgtttatattttttcatgctaatataatatttatttttatctaaaattaaaatattatattagtattaaaatcaataattcttataatcaaatatctttggaatttaatttttttaagtgtaattaatcattatacatttacaaaattttatgcaaaaataacttatagttcattaaacaaaatttgcaaaataaaaaatatttattaaatattcaaactcgattaatccaatcaatttatgatgggattgatttggattgagtatgcaaaaaacttacacaaattcaatctaagccatcaaattttaatcgttggataacgaatttaaataactccttttatagataattatgtttgaattaattttatattaaagaatatgtgtcatgacagaaaaaaatgttcatgaacatttgtcaaaacaattaatcaggaattttcatggccaaaatatattattcctagctattacacttatattatatatgttatcacaatccaccaaaatgagtatatatatcttgcgcaagtgatgagatcaagatattaactatattattgtcatcataattgctgtcccaaaataagcatcgttggcaattcaatcgcaaagcaatgatgctattttatatgaactttcaagcttagtaaaagattcaggaaagatcgaaacgaatatgaacatgtaattctggttcacagccttcctcgtgcccttagcttttttctttaatttttctgaaaggacttgaccatcttcacctttcggtatgttaatttgaattagaatgcattagggtgaaataatattttaatgacattagcatgaccgaagaattaagcatatacgtcagggttagtggttgtttaatgaaaagccaaaatgtttgatactcatcagttaaattgtggtatttggctgcctggtaacttaaagtaaaaaaaagggcagagattgaagaatatatattatctatatattaaatcgttttttcaatgtgcatttttatggatatacgttaaagaagtcaaaataaaaaaaatatttgttatattaaatataggatatgttatactccttataaaatttaaatattaattttattctcataattttttttattaatttgattcctataaaaataaaatatatttttctggtcatcaatggtaattctattagataataatttgacgtttataagtgaaatttaattataaattaattaaaaagttataatttatgccggttaaaatctctcaaggtgaataaaaaaaaattcacagttaaaaactttcaaaacttataactttttgtcacttttttttatggttttcttgcgatgagattaggggaatagataaaataatagtgagttttaatatcttctatgtgtacttgaaaaaagtaaaaataaaaaataaaaataagtaaatatgttaataacgtcaaagaaacatataacagctcaggcacacatcctcttttatgaatgcattaacaatcaacaccataaattatggacggaaaaatcaacacgttttttttttttgcaatagtaaatttaatttaaaatatcaataatttattatttaatttaaataaatcatttctctctcctc

SEQ ID NO: 138 - DNA, 1866 bp, Glycine max
  Soy_ogl_1520 Gm05:1539444..1541309 Cluster 1
gagtttgatcacgaggtaaataacctctgatcaaaaattatttttgttaaatatcaaactcggatattatcaaaaagatgatttctttaaagtaagtaacaaaatttatatttaatttaaggggagtaacttttttactagaaataaaaattaaatataaaatataaaaataattttttaaaagcaagtaaacaaatttatacagggaggaagtttttaataaagataaaagttatatttaacatatgaaaaatgtttttttaaagcaaataagaatatcaatacttaatatatgaaaagaaactcttttttacaaaagataaaaattatatataaaatataaaatatgaaaatatttttttataaaaagtaagaaattttatactttgtggagagaaacttttttcataaaaatagtaattaaatataaaatatgaaaatgatttttttaaaggaggtaaaaaattttacttaatttatggagagaaacttttttagaatcacattaataattataatgcatatatataattagacatttcttttcatactcctttcttatatgcttttagttagacatttctttttcagtttaacaaataggttatgtcaaatttgtatttttaatctcttgaatatattttattgtatttttttataaataaaaatgcataggttaagaatatgtgcattatgcatgaaccaagggcaagcaacatacacgttcagcttcacccactaccacagagtctgccatggaagacccgcaccagaggtcccaacacattctcacagtcacgttgcttccttgttgcgtacgtgtagttttgttgcagttgtcattttctgtgcaaaatggaggttctctccaccttgttcatggtaacatgctagcctctagctgcaagacttctcgtatctgatttccttcttagtttcctgtggttaagttgtttattttgttttattgtgttatttcttgttcacgtaaatttaatatactgtaaccactttgttctatctttttctttaatctcactaatttgaatctgtcactatctacttttgtcacttacgccttacatttacgaaaatttgtttgacataaaaaatcaaattccataatgttatagaatcatgcatgtgtgctagtattttctgtctcaaaatgtttttggaattaattaaaaagaataaaaagtaattaatatataaaaaatcataacttaataaagcttaagtcgtgattactttggatgcatttctaatttaattagttactacaaaagctataaaggtctagtgatagttacttttgaatgtacttataatttgattttgaaaatcataaaaaaggatttaacagtaatcatctcggatatatgattatcacaaaagcccttttaaaatttaaaagatgaaaaatataataaagattttgcaatagccactttgaatatacttctgacttgatttattgcaaaagttatttaaggttaattataatcactttagacgtactttagacttaattatcatgcaaacttttaaactgaaaaataaaaaaaataaaaatgataaaaaatatcaatgcacaaatgttttctacaaaaaaaaattatgtaattttatttttttattgcacttgaaaataagtacaagtagggggtcactcctattgaactgaaaaaaaaatataaattgaaaagataagaaatacaaactaatcctctttttcataataataaatttctcttgttaaaaataacaataaataaaacatccaaaatttctcttttatattttgttttgaggggtaaaaaatttgataagttattcaaatatatacatttaactagagataat

SEQ ID NO: 139 - DNA, 2620 bp, Glycine max
  Soy_ogl_1763 Gm06:1355019..1357638 Cluster 1
taaagaaactaaaaaatagaaagatatgtaagaatgagttgggaggaaaacctgcaagaatacagaaggaccctgggagaagaggagcaggatttaagcataagagagatacaaaaaatgagaaaaagtcgtgcgtgacagtggttaaaaaattggtatccacacctatgtatatcattaaaccccatgtaacagaatgtgcagttactttaagtaacggataaattagaaaaaaatgtgtactccaaataaaataaaagttcaattcaagaactaattaactttctcataatatacaggagcaacttatgcaaaaaaaaaaaaaaaacaaattaaatagataaagcaatgcatttcagaaaatatatacaatggcagagataagggaaactacaaaattttagaaaaggcaatgcattcaacaccagataaggatggcacataaatagataaagcaatgcccgaatgttgaatcccctgtctcaattgaactatgtatgcacacacacacaaaaatatgcatatgtatatttatatttctgtctatctttccacacgacactactccactcaccaccacctcaaagcagagcatttggaaataaacctttgcattgtagaaattacacacacaaggaattgcactcaatatggagaatgaatgaatgagggaaaatcttattgatctcaacaccatttacaaaggtcttagttacttatataacaggtaactaacttgtacatctctaactgtcattcaaaatagttagtaactaactctagttaacttgaattacctaactaaccaacatgcattttctcaccatcaagttatacgtgcataagtgaagagagagaacaaattccagtgcagtttaaaatacgtatccaaacaagagaaaaggaaaaaataataaaagattcccaagggcatgtttaaagtcactaactttacctgatatgatgaaggaaccaatatatctgcatcaacctccaagtgaacctaaaatcaataaataaatcaaaaccaataaaaattcaccatcactcagacgtgcaaaagaaaatgagtcccaaaaaataaaagaaactaaaagaaataaactaaaaaaaattacacgtgcaaacttgctcactctctgagttttgccttcatgcgcagtatcattgcaggacaaaatcaaccttacaccaatgtacctggacgttccctcctttcaaactgctgccaccatcgtcaacatttggcaccttgctatgaagggggagctgaaaaaaaaaaagaggagaggagagaataaagaagtcatgaggttttatttatttatttcgtaccggtttgtggggtgaaaaaaccgtcaagcacaaagagaatgagcaatttaccttcacattctcatcagttaccttttgtgcacacaggttcttttttctcattttattctttaatttatacatgtattgattgcaaaatattccagggacataataataataataattatagttggggagtctaacgtcttacttatacggtagtaccaaatcaaaaaaataataaacctttttaaaattttctctttttttatcaaatatttttaattattttaattcataaataataaattctatgaattgattttttttttcatttatgatatttggagaattgaagaatttagttttaaaaattaatatgcctaattgcaaactttttcacctaacttttattatttgtgaattttatcacttaaattttcaattttgtgcattttggatttttaccatagttgacgtgttacctgaaaaaagttaaaggaaacacgatgaggatgtttaagaatatgataaaatttgtaatcaagccaaattaatactccactactactatttttctctgtccatagattaattatttttaaaaaaatattataaatacagacaaatttaatgttattaattattttttccaatgcatttattattttaatccctgaatacaagacacttctttaaaaatttcttgtcaaattttataagagttttttttaattgatatgaattaaaaaacaagagtttttaatcatcctttacgttaattattatttttataaaatactcttaattattttagttcttaaataataaatgttataaaaatgactatttttttcttctcttttacgagaattgaagagtttaattttaaaaattcatactccggtaatatttttctctgtccatagattaattattttaaggatgttcttataaaaatataataattaccaacaaatttaatgttattgactagagtaataagtttttttaataggtatgaattaattataaatgtcttatatatatttatggaaatattaattaattattaattattaattaccaattattattattaatgctttggatttttttcttagagcatttttcctcgtttcttagccagttgtttattttagacattattgtttattttatttttttcattggagatgtctatgtgctatataagtaacgattactaatgaataaaaaatatttttttgtcatttaaggattattttaaggggatagtttaaggttgcttaaaactatatta

SEQ ID NO: 140 - DNA, 1911 bp, Glycine max
  Soy_ogl_2142 Gm07:2948801..2950711 Cluster 1
ttcttctcaaatcttttttctttccattaacagctttccaatatgataaatttaggtcaaataactataaataaataatcaaaatttaaagtcatataatcacttaaaatagagttatgtgacttgatttagaaaaaaaaaagcacacataattatatatgtattttaatcttaattattcataatatccaatagtaaacatctatttttcttattcttttccacactatttcaagaatttatagaaaacagataaaagtaaaatgttaatttttttttattttttcataaataattacaaaaataagattatctttacaattattaataatggaataaaaaatatttcctgaaactaaacaaacgtgttgtttatcatcgatctctaccttaacctaacctccttcttgttcccctggaattatgcgatagattaatgttttcttcatttcaaaaaaatagatttaattaaagcttggttgtcggttatattatatagttttggaatgatgtgtaattgaaactcaacgcaggcaatatgtgagtaaaaagtgaagcaaacatttctggtaaaaagttatcaattaatgaaaatagaaatctgaaaagtaattaaataattttataactttagaatttagataggaggaaaaggagagatggaacaggtgcacgagtggccatggttgccgggtgccagcacgtggagaaactctgcctattgccactgtactttggcacatattataaagtaagatcactatgaatttttaataacgttaaaatcattaattttataaatttttaaagaaatattaaataattaataatttattaattaaaaaacacttttttgcttaacaaatataaatttattgcaagatactagtctattaatcttgcagttgcattccatcatatgattaattaatgatgtgttttgtttaacgaatacatattttataaaaagttagaatttataacttttgattaaataataatggtttgaaatctttcaacagaaaatcaaatacactaagttattttgtgtatgtttccaactcgtacataattgttttcctttaaaggaagtttataatctacatcgaaaaaagagaatcaagtcatttaaagaaatttaaatgaaatcatttttaaagaaggaatttgtaattttgataaaatggacaatcattttaattgtcataataacttggatgttaatcatctgctagattactaaagggaaaaaaaataatgctcagaagttcacaatttagaagagattgtacgtggttagtgtcattataaattctgttgataataaagttgagaatgatccagtaactctatagaacaaatcacgtgaaaggaagtaattgtacgtagcagctacaactcttcacaattttttttatgcagttcgcgaacatgacatgaaagcttttgattgcaatcaaaatagctatagagatcatgatatttaatgtaaattaaaataaaaaacaatgcattcgtattttcctaaaccatcattaatcattgctataatgttataatattgaccggacgatacacttataaagggtatttctaaaaagaaaagaaaatatttttagttcctatatacgttataaagttcttgttttagtttctgtatatcaccatccaatattttagtttctgaatttttaaaaataattatttttagtctcttggaaatcattgtcttctatatgataaagacaaaattaaaactaagaattttataaagtataaagattaaaaatattttttttcttctaaaaattattattatggtccaaatttaaaataaaaaaaaacatttttaaaaacaattaatttatagaaattttagctgtctacaaagtgatggtggtcgcagaattg

SEQ ID NO: 141 - DNA, 2100 bp, Glycine max
  Soy_ogl_2155 Gm07:3240301..3242400 Cluster 1
tgggcctattgctccaaacttcaaacaacaattattgaccaaaactcataaaagtgaagtatttaagagttaatgaccaactgaaaaacggattgatcctttcagccgaaacttaatttatggactcctagtgtgtggcacacatgccatattttaagaagaaaataataaaactataatttaaattgcaaaaaacaagtaaatataaaaataaaatttgagtgtgaatcctttcaaattcattttaaaaaaagagagaaacgttgttttgaacaattttgagtgtttttttagttgtattttattagtattattcttatttattcgtttattattatgctttactcaccattccgaacagcaactctaacttcttcttcttttttttttttttttgagaaagctctaactattttcttaaaaataaattgaagatgaaaaattacaaatgattaaatcgatgtaacaaagaaaaaaatgaatgattaaattgaccgtctcaaactgttatgtaacactttttctattaagtgttctttaatttccgcgtatatctatctgttgttttcctttttcgttacacatggatacgaagatctattttgtttatttatagtgaattcaacaatgctttatattatcatcatcgttgaagtcttgaagaaaattacaaggcagatgccagatggcccattcttatacattgatggttaaagtgttcagttcaaagaaacaataaagcctataaaaacaattgttcaaagaaaaaaaaatataaaaatatttaattaattaagtttttatcccataaaaagttgtgattttttcattgcgtgtcctactttttattttttttccaacaagtcgtttatataatatttttttaccaaacgatttttctgttaagagtagttcctttattccttatttaatttctctaaatactatcacaagtttctcatttagttcctccaaatattgtgattttcattatttgattcctctaaaatgagcaatacaacaaaatctcacaatatttagacagactaactgaaaaaacgaaaatataaactgaaaaaccatatggtgacgaaaaataatttaaggaggacccattcaaaagacattaaaacgggaaactaaataaaaataatcacaatttttaagagataaaaaaactactctaattatgtcgctttaagacttttttaatcagacgctttgagactttttccattcgtattaaaaatataagacgctaaaattagaaaaagccaattacgggtgttaggtttaatagaagaagttaatttcacacaaagtgacaatttaattatattgtatcaataagtggcatgattcgaatgatattagattcaatttttttgaataagtctcagatttaaattttaagaataaaagaatatgacttaaaagaaaattccaaaaaaaacaattagttaaatttcaagtaaaaattaattatcaataaaattagtgatacttcggataaccacaaaaaaaataatcaaattatttctaaaaataatattaattgcactgtttcagttctcattgagacatatacttatattaaatttaatagtacatgttaacaaatactctatttaataataccttttaacagaaaaatttaatttattttttaaaactagagtatttctcaattgaatcaaagattaatattcaactttgaggtcctcggattcatttgaaagctattttttctaatatatatttttccatacttgtagatctaaaaattgaatgcatgaagaacaagattatgaaaaaaaataggaacaagataatgatatttttataattctttaaaaaataaaatataataataaaaatatttttttcaaaacaaataggtttaaattaaattaaccctctcaaataacttgataatgctatacaagaatgaaaatagtttgagagggaaatatttcagtccattttcccccatcttttatctcttaactgtccatgaagtcatggataaaaatgtaatctgtgttcactctgccgacctcatatgtatagtgatggtgtaatcccgaaggaactgatata

SEQ ID NO: 142 - DNA, 1745 bp, Glycine max
  Soy_ogl_2192 Gm07:4664201..4665945 Cluster 1
aaaaaagtatcgagctcgtgttgttgaaaatatagacataatcagagtgtgtagtccacttgctgatgagatgcatttgtacttatttttgttttgttttaatatcttccaacgtgctaagtttcaaaattggtgatattttttttttctaacaaggcagtgggcgtaatatttcgcttaatttcaaagtgacgtacgtattcaaatatataattttggaatatgtattcttttacttaatttagtcaatttggaatatatatattatttgtttttatttattcttcttttgcacaacatgacacatactaatttgtatttgacttagttgggatgtaaccatcttttatttcaatgttatctttaattatttggcagataaaaaaacttaatttagttaattactttatatagattcgatcgtggcgaaattcaacaaccttcatcagttcttctatcattcttttgcatgcttttattttggctttttaacattatgtttcttttgcattcatgatttgttttataccatactatttatatgggatttgctataaaggagatatataaataaataatcgagaaagtttaactcctcaactcaagtatgttaatagaaatttattttttggttgtgtgcggaaaaaaattatcgatcgagaaaggttaaactttaataattacgtttttttttataacaaaaatagcttctaattttttatgaacaccgaaaaaaactttaatttaactcaacattaactgaatatttgtcattttaaagaaactaaatcatttcataggagttttataagtgatctgtggtctctcttaatttgagtgtctgtgcttttaaattgtttatttacaagcaaaatttatatgtaacgcaagaggaatttaatgcctatatatatcaaattgcaaaagctatttaaattacgtaacattatggttaattgaaactaatcagtacttaattaaaaatttaatcaataagtgatcttacaggacaaaggacagattgtcattgttaatagatatcgaccgcattgttgtttttttattttttagaaatagatcaacaacattgattctgattaaatattttttcgattccgatatatatatatatataaagtttaagcatttaaacctatgaataaaaaaatatttgttattagattttataaaaataaaaaagttacatatgttggaaaaaaattatcacatataattaacatatttttgtaataaaattaaaacaagtagaaatattaaatattcttttggtgtactttaaatgtatatttgatttgatttttacgagtattttgaatcataaaataaaaataagtgttatttttagttttaactgttataaattataatattatgtttttaatatgattttatacataaatttgattattcttattattattatattaatatcaaatcaacaacgttgaactattaaatgttatattagtgctttaatccactggataatcgattggattttcagaacattataataaacaacattagctgttgatgaaacacgcatgacgcatgtctttttgataaaaaaatttagaagaaatatttttattttataaaatctaccaaaatgttcacgagtgctatttcagtatttattcattattattattaccgatgccggggacagagatagagcagcctgacgccgccacagagagcagcctgatctgaagccgccacat

SEQ ID NO: 143 - DNA, 2949 bp, Glycine max
  Soy_ogl_2414 Gm07:38207201..38210149 Cluster 1
ggccaatgatctagtgagtatttaaatagtatttgtttggaaaaaaaattgtattgttttgtttgaaattttataatgtcaaactgctagcagaaaacaattgacataattcatcgttcgttatggatcacatattaatttttctcaaaacatatttgtattaacttgaccacttgcacatccatgaccagtccacaagattctcatagaaaaaacttgcacgagttcttttagcatagaaatatatcatgcataaattctctctcgttatttagccaattttacatacggtttcatagaatttgacccaaccatagcatacttatttatataagttatatacttctatgatttttagtgttttcataaataaaaaatatcagaaaattagctgtcaaacgtgcctttatcttcaactagccaggcaagttgtaactactgattatgacatttggtctgctaataaattcttatcttgtgatttagcgtagtttgaaacatttttttaatttgtataaaaaatactgtgtcaatcagcagtaactaaattcataatgagaaatatcaatacaccctccttttctttttgatacactcttttatactcggtgaaatatatattaatttctcatatggtggatattattcaaactagggaggcctacatgaatttcaacccacagaagaaaaaaaacgtagaaaaaatattgttacaaatcgttccgatacacccaaatggtttcatccttcggaattgagattaactaaaatagtttataaacactttccttccttaaaacaaaaatgaaatattcaaatagtagaacaagacaggttcacatgaacatattactaattagatgactatcacaaacaatcgcacattgtgagaaaattatggattgtgccttgtcattttgttcttgggcaacattgcatattacagattgggtcttatattaattaaatatcacgaaattcatcccctctcgattcctattgaccagaaataatatatcaaaagaaaccgtacttgcatcagtttaccaaaattgtttctggaggaatgattaaattagatagaattcttactaaacaagtgatttgcagccatgaaacgccaacaaaattgtttatatcaaacattttacaattttataattacgtgtgcaacgcataaatttttagatgactaatgcgggcattcgtacgtccaactaatttatatatactacgaaacaacattttttcgtataaaaaaaatgtagaccatttcctttgaactttggttcttacgtttacaagtatatatgtttacaaatttcatcaatgaaaacatttttttcataataaacacttaaatatttttttcttaagccattcaatcggattattagtgagggatttagatatttgcgtaagatcatatgttgaaacctcgcaaccagcattgaacatttgaaaaaaaaatgtcaaatatcaaaattccgaaactattattaaggataattaatcatatttttctatttcaaattataaataaatccatcgcgctattctttttttaggaacatcgtattatttttattctagaataatttctgcaaatattcagcagaacgaactattagagtagtgtgaaatattatttcatctttaatttttcaaaacactatatatagtatgaattatatttacacgtgcatagaacaggctggtttctagagagtagtacatgaacgaccagatacgatgaataaaatttattttcaaatgaaaacaaatttcattatgtcatagttacgtttatattgtaacgttaacttaatattttattttgagtagattgcgtgcatgtatgcaatcctaactgttattcattcaatcacaaactagataagaaaatagaaaaataatgaaaattaattagaagagataaattaaaaagaagtacatcctcaatactgttattgctagagaaaatagaagaattgggagataaataccattaatgagagaaaactttttttccattaataatatcagttttactactcccttcgtttgaaaataagtatctctaggttattttacacataatgataaaaattaataaataaatgaaagaaaataatggtaatattagattcaaaaattaaaatggcatttattagaagtataaatagaaaaagataattaatgttacattaaaaaatcaaatacaatacttattttgacatttttttttcaaatataacacttatttttgaatattaaacatgtgaattaattaaggtagattgtccaagtttaattaatgtttcaagtttaagatgaaagtatttaactatgttaaatattcagaataaaatctttatagttgtccatattaattctatttaattcaaagaagattagtacaatattattattgacttgtatatataatcttttacgtacatgataataaaagatagtaaaataagcatttcacatgcattgatataccttaatagtgggacaaaaataagataattaataactaatggaaataaaatcataatcatctatatattaagactatttggataaaattgttaataagtattaattatttataagagaaagaaaataaactttttttataaattaaaattaacttatgcataagatgctttgtaaaaactttttcctataatttctccaaaaatttaactgatgcataaaagttaattttaacttataaaataatcataattcattttattttcttattaatgaaatgaacttttcctataagttaattagctcatgccaaaactaatttactgaagttctcttgtttagcttatctaaaagcttattattttaccttctcattttctacttataaaagtatttatggagaagtttgttcaatcatgtattaaatcctattaatttatattc

SEQ ID NO: 144 - DNA, 2400 bp, Glycine max
  Soy_ogl_2550 Gm08:7972201..7974600 Cluster 1
accaggaaaatatgtaagttaactgaatacaacagtttttaatttctgtctatttaaactttgaattttcatcttgattaaggtatgataatatatgaaataaaattgagttaacttattttattgatatagtatattaaaaattattgttgtgaagggtttataatttatatatatgttagcaggggttatttgttgagtattccagcggaggaagcgcagttcatatctattttgcataaaatcctgaatgcgaagaaaacactcgaaattggagtattcagtgactactttcttcttgccacagctcttgctctgcctcttgatgacaaggtactttttctttttctttttgttatgcatatactccaaaggacagaaaaaaatgaatcaaaattaagttattttttttaaaaaagtactttattagagaataaaagcaacataaaagaaaacattgaacaagcatatataatgatgatggaggaaagaataggttctggtggcaagcttctggaaaaaaaactaaaaagttatttataaaagcaagaacaagagttagtcagtcacaatatagagttagaaaaaaagaaatactgagaaatttatatcggtatcttactaatagaattatgtctagtccttaaccaaagttaaaatgttcactaacaactttcttataaaaaatagaattttttacttttcaagtattctttaggtttcttactttgagaaaattttatgcgatgtttggattaagagtgaaatataaagaaataaggtttaaaatataaaagacaaatagagtagaaaatatgtgctggttggatggataaaaaataagaaaggaaaggtaaagaaaattctttctcttataatataagtaaaaaaaaaaagagtgaaataaataaataaatgacataatttttttaaactaattaaaaaaactagatttaatccaaaaataaaccttttagttagttttttttttcttaacagttttttcatgtgtatgataatatacacattctaataactaagcaaaaaggattttatgatgggttccttccagataacggcaattgatatggatagagaagcatatgagattggattaccctttattcagaatgcagaagtggagcacaaaatttactttcccgtggtgatgcattatcagccctcaatgatcttattgatgtaagcttttttataattattaaaaaacaatgaaaagataccctatacatatcgaaaacattacaagaaaaaagttatatattaacggttataagtcggatttgtttgcatatatataatctttatctaataacaatttaaattcaaacattaatatttcttttataataatagattaaaatttataaaatgatccatactgtccaaactctctgctgactcgatccctaataaatgcatgttaatataaacagtaacataatataatataacgtgcaaaagagtacatcattgttttaagaacataatataaatgcacgacaattcgattcttattgaatatcaatgtatattgtttattcttaataccgttaattagaataatacatcatattcttattgaaagtcaaaagaataactttgaatccttattaattttcaacacattgttttttaagaacaattcacattatcattaaggcacgtgatttctgcattaagtatttagttttatttgtatttcttataggtgttatttctcaattttaattttaattttaaatcttaaatcgtaacacaaagttaaattgattgtgttttaccatttcagataaactaaaatttaaaattattgaaattttaattaatcctaagttaattaaaattaattgatatatatttagtataatagaagagccattattaaaaatgaaaaatatttactgttttttgtaatttttttattctgtttaaatttaaaaagtatatacaaactatgaaaaacttattaaaattttttaattgtttttttaacagtatgtatttttttttgtttgataaaacatgataaactatcatgtttaccgtgaacttaatgctgtgaattttcttttacaaacgatattacctgaaatttttaaaaattgtaggtattatttgaacatctggacaatacttgtatctttatgagtggttgcatacgtcttatacttatatttatagcaaataaaaatttgatgctcatgctcaacaattctgaagagagcaaattttcacattgattcacgtcttcttagttgatactgtagccaacatgcatttgggcttctacatttgcaatggtttgttaattgatgaatgctgtcgttgcaacttgcgacaacctattttgctaagttcactcccaaaatatttgaactt

SEQ ID NO: 145 - DNA, 2212 bp, Glycine max
  Soy_ogl_2916 Gm09:709401..711612 Cluster 1
attagagaaatttggaggggtgtattttgtgtagaggataatttgacatggtggggtgcaattggccgagtataatatgtcgagtcatttgtagtgaacgtgagaaaataggaacattgatattgttagtggcgaaagagttgatttggtagggtggattgttcacacggggattttcatagaatatgtctttgtcttttgtgttttgtattttgtgttttgttgccattttttatcaaatattaagaagtgcattacaggaaaaatcataagacagcaagcgcgaatattcaattcgtaggaggaatttcaagttattgaaatttttggttttattgattaggattttttatattgattgtagtcttggacggggagaaaatttgccaaaaaaaaaatgttgcatagtcattatgcttgtaaaatttaaagccagaagtcaattaacctaactttagaaaatgagagaattttcttcaaaaaaaaagaaagaaagaaaatgagagaatctgttaaataaaggtacacggggactaaagtaaaaaaactgctcaaatctaagaactaaacacatttaagactctctctctaaaaaaacatatttaagacattattatgcatatttatgataatttcaattgtatatttggtaacacagttattctctatttgttgtgattatttttaattgtatatgtctttttttaagagattgtatatatcttttaatatcactattcttgtgtctatataattttttaaaattaaaatctgattttgaagttaatgagttaatattgttaataaaaatatttattctaaaatttaaaagtcatttgagttgcgatagtgttgaaaatcaaaagctgttggaattaattttgtttattaagaaaacttagctagcttaattgtaatatcttgttaaccttgctgtatttatcactggacatctaagccttgcaacaaggtgtcccaattttcatactaagctttatatcaataaaaataaataaatataaattgctttattgaattattttaattataatagtatgttaagtttataatttatcaaggagcactttagttgtaataagttaaattttcaaatttttatattaatttgatagtaaaattaaattataaaaaatgagttgcttaaaagaaaaaaagttaatttaattgtcatgttatttctactatcttttaacaagggaaattaaacatcgccatagatgtgatggcttgatactttgatcctcacaaatttaattcaagcaaaattttaaaataaagtcatattattcttaattacaattaataatatattttcatataaaataataaaattttaattattcttgaggagatgacatagttgatttctctctccctcggtcagacccatgactactctcatcattgtcatttgcacagacgaaattatatttaacacgactcatataatcattatcattaatatatttttttgcttttaccaaaattattatcgttattattatcatcaccatcacttatctattatgtgtacactaactattaaataaaattaaagtttagtgtattcttattctattatatgtttttatcctcttcttatatcttagcttacatttttttaaacagctatcttataatatcttaatcacaaaaaaaaccttacctcttcatttcttttttgatttgcttaaaaggaattcattttatacataccatctgttagtacgtatttgaatgttaatcaaattgtcatctacgtaggaaactttactcttttcattaattacgagcgaaaatcctgctcaagaacaatacataatcgccctaaagaaataaaataaatgcctaccgaatcttttgtcggatgaagcagctgtttgtgccattattttcggctgtgaatattggccatgtactcttccagacctctctaatttggttgctgcattttcgctaattttataaaatgcaatgcagtcattgtagaaactagaaagtacaaaaagttgataattctttttagtgtttttagtattgttttttcattagaaagagaattttcttttagtaatttgtgtaaaaaaatattattttattattaattttaattggatttcaagatagtacaccaattcaaataagattagacccgacaatgagataaactagacatgaatttgactctctc

SEQ ID NO: 146 - DNA, 2164 bp, Glycine max
  Soy_ogl_3198 Gm09:39697297..39699460 Cluster 1
cagcgcaagttgcaagcatagaggaacgaaaatatcatgttatatagtacaaaattcagtgctccagcattttgtcttttgaggaaagaacataaaagaagaatcatcatgatcaaataaggtcagaaacctcttcccagaacaaccgtgagcgacagggtgggcaccattagcattttctattgtctagcttcaaatgattctatgaaccatagcatatcctataaatataattatatgaacccagtaatacttttagtcaggatgcacttagaagagttttctgttttgtttaaatcaacaatttgaaaaaagtattagtcaagaattggtcagttgtgttgatcatacataaattcatacttgtgaatttatcccacgaatattattggtgaacattacaggatttgacaaaacaaacttaatatacaaatactccacttgtccatgggaaataaataatattatataaattcgcatgatctttgaaaaaaaaaatatgaagtcaatattaaatttaattacttattttattccctaaacatatgttattatataccgtattatcttttaagtcgacattacacatttttttaattaatgtgatatgattgttaatttacaccttcaggacttttttcttattattcaagaacaaatgtcataatgctttttaaattcaagaattaaaacgacagttcactcaaaaaaaaaaaatccagcacagacaatgctaaagaaaactcatagaaaaaaaaattaacagtttgctgaagtaacaaggaaatagaaaataaataaataaaaatcttgtgttgtcgttcggtgtcttgagcacatggagtggccaaaggggggaaggtaaagggttcacctgcgagttaattaacatgaagtcaggctcaagtacaagtgggtaacaattcatgtaaatctgagttggaaactgtggttacgtgcgttctttttcagtttttcctagatcaagtgattaatcaagattctacagcacatcaacgggagataaaaaaaatgaatatgaaaaaaaaaattgaattaaaaacatggtagttgagtaatcttaatcttgtaaaaactactttccatacacaagtcaacgtcacaaaacatgtacagtgcacgcgatattatgaaaatatcatgtatgagacgatgggcaaaaggaacgttatcaatatttgaaaatacacaaaatcatttcaaaattaaatgagaaataggagaaagacaaataaataaatcttatttatagagagaggaacttcattaaagataagccattttacaatttcaagtgttccaaccataaagtgaacaattcatcatttttttagctaaacgtgaacatttcatcaatggagtttgattagtggaaagatgagtatgagagcaagagaaacggtaacatgattaatttgtaactgaatgatgatatactttttcctatgaaacgggaaaacaacccttttaatctgctatcacgaaaaagtttgatgctactttccccaaagagtgattgtcatgattaagttcatttgatatggtttttccttttcttttcaatcaacttcttgatcgtagatactgtaaaatgtgtgcattattctctaattttcaccttatataggtcccatgtcagtctttaataaggttttgaatttgcttgtgaggttggatagggctctaaaaaaataagattagaaagtgaattagagcctaagattcttggtgcatttagtcaaggatttctcaataatttgagcaattcaattttactagtgctgaatcaagcctcacattctccactacgaaatatgcaagagtgaaaatctctaataagcggcttttttttttattgtttgttctcatcttttttttttttagtttgagtttgtttttcatcccttttcaactagaacttctaaaatctcttcagaaacaagttttgaatttgaattttgtaaatagaaaaagatataattaacatttaataattgtatttgaaagttatatctacagtgaggttagaatttttttcttctccacttaaaatgacattttttttcgtctttttcatttttcttcgtggtaataataaaatacttataattataaaaatacttccatgttaaagtcattaaac

SEQ ID NO: 147 - DNA, 3618 bp, Glycine max
  Soy_ogl_3225 Gm09:40247701..40251318 Cluster 1
acaattaacacaaaggtagcaaagaagaagaagaagaaaaattttggatttatttgcaccgcctagtagtagcagacacagagaagaagaaaaatttgggtttgtctttgaaaggttaaatattttatgttatatagaagtactaacattgtgaaaatgggtcccatatttttcaagtttatctaaaatctcatatggtgaaattataatattgtatcatactgataacttcaataaatttcattataaaaaatatttactttataatatattttgtcattttgtgtgctgccaagtgtcagattaagctactacacagcaagattcattggttataaaagttttattgataagtcaaactaaagtgtgtatctagtaatattataagcatatagtattatttataatagcagtaaaaagatcttttatagtggaatcataccacttgtaaatttgtttattgatagataaattatctacaataaaggtttcttttggttatctaattttattagtttctataatggtgtttaattgaatataatataatgcttgttcctactctttataaatcataagagattacttttattttgaaaaactattcttatttaaattttgattcttatgattttaattgttaattgagtattaacttaagatcatttaatttcagagatgaggagatttttggttgatagagcaagtattgagaatgtgaatgttgtacaacaagaagccgaattagaaccgccacctaatgtggttaatgagtttaacccaaatgagattgtgcgtgatccaggtcataggaaacaaacgagctttcaaatatattgcaaagaaaagatcttaatattgtgaatgccatggaattagttgatgttgtcaaagctcggttgggcacaatgagagagagtggctggaataatttttttgccgatgtccaaggattttgtgttgctaaaagtattctggtaccaaatatggatgacgaaataccagttcggggtcgttcaagagcagaagggaggactatcactaatcttcatcattaccgtgcagagattttttatgttgctattgataaaatatgtgtggagatggatcaccgctttagtgaaggaagtaacattatacttgattgcttctcatgtcttgaccccaagaactctttctccaagtttgatgttgataagcttgctcgtcttgctgatatttatcatgcagacttttctgatgatgaccgaggaacaattagggatcaacttgaaacttatgtgcttcaagtgagaagaaatgcttctttttccacttgtgaagatgttcaaagtttggctatgaagatggttcaaactgagaaacatttggtatttccattggtttataaacttattgagctagctttgatattgccggtgtcgacagcatccgttgaaagagctttttcagcaatgaagattatcaagtctaaattgcgcaataagatcaacgatgtgtggttcaatgacttgatggtatgttacaccgagcgggagatattcaagtcacttgatgatattgatattattcgaacatttaccgcaaagaagtctcggaaaggacacttgcctcgtaattttatttaacccgctattgtaagattatgtttatctcttttattttaaactatatttttgttgacaaaatgacgagtctcttttattttgattgattactatttacatattatatacaatgtgaatttgctatctttaaatttttgtccagactttataatttttctggctccgccactgcacagattcatggtaggtcggtagctaggaaacgcacgtatatatatggcagcggcaaggatgggtaatgggttcatttcatagcattggtatggcacgtgacgcgaaacgtccaagtttaaagtggtcaacgcacaagtgtgaaagagggttgcagtgtagtcaatggtggtgtgcctaggagagtgttggatttttccttttgagccaaaccaaaagaaagggtagggtgtcactgtcactgccatagccataatagagacacttgcagtaccatatacccagtcaaattcaacgccatctacttttaccttcttccttgcctctcacattaatcactctataggaatattatataatatatatggtacctttcagtacaagaagaaaacgcaattttatctcaaaatattttaaaacagttaagcaatttatatatttaactgtagtatttttgcttaccaagtcagattttattatggacctacaataattggctttatcactttttttttctttttttttggtttccaaatatctcgctataggcggtttcaagttacagttgaattagacaaggccagcatgctataacaaacggaagcaaaggtgtggatctaatccgacaatgaaattgagcatcgagttcaataatatagctacttgttatcaacgatacagaaacatgcatttgatatccaattaaatattaaaaataagacaaaatataaattaaataagattacagatttttttctaaaaagagagataagaaaaaaatgctactagtatattttaaaggaagagtatataactcgatcttaaaaaacaatttacccttagaataagtgtatttatatttattttgtctagtaacattttgtgaatattattgcattgctgatttttatttgatagatcaagtttaccaaattttatataatttaaagatcaatttaatgattttattttatgtaaaataatatttttatactatattaagtgaatattgattactatatcatatacttacacatatttaatttatctaagattacgtacaaaatgatagatactacttgatttaaaaatcaaatttgttaaacttgagttttatatataaaaaaattaagtagagtaagttaataaatttagaggcatacaagtaaggttacaataaggtaggtactcttatcagggtcaattaaggtactctatctcacttttagatacagtcacaaattctaatataatattagattagtatatataagggaaggcttgaagtccaaataaaaagaaaagattggaaaaatttgagaaacccaaaataagaagttaagccaaaagaagaataaaaggctttataaaaaaaacacaaacctagacaatacatgaaaacaaaacctacacttttgagacccaaacttaaaatacaagttcaactgaaaaacaagtcagaactaagtagaaacaattggcttttaggagaattagttgagaacgtgtgtagttagacacaacataagttaaaaaagaaaatgcaagtaaaaggacaatgcttcaaaaaaagtgtcaagtggtttttagacaagtacatatcactaaagtttacaagcacatcattctaatattatttttacgcttgagcgaaatacttcatcttgttttaaatataagcaataattttttttattaaatataaacaaaatttcaattatctataacttaattaatgagactatctttgtatcaaaaagattaatgagattatctcaaagtattcttcatttaataagactaaaaaaaattatacctg

SEQ ID NO: 148 - DNA, 2339 bp, Glycine max
  Soy_ogl_3578 Gm10:46394662..46397000 Cluster 1
gatcagttttttttatcacataattaaccccacctataatattttttttttcacaacctataatctttctactccctgcatccaacttatttctattattttctcccaaaatgggtgacaacgagacgtcaaaccctctgccaagtgttaaaaaaaaaaaaacctctgccaattattttgctagatatatatattgatatctttattgtatcaactgctatataaatattggtggaatatttcctcgtaactcttcagtaacactaattaagctgcgactatactattcggatctaagatcccttgaatagaactgcgcaactgctttctcgtgttgaatgtttagattttataagttctcccaaattgaaattttttaagttgaaaaatatattaatttaattatattaaattttaataaatgaggtaaaattataagttcagtttattattattattacttgtattcagcaaaaaaaaaaattattattacttgttttaaataaattagctctctattttttcttcttatatcaaataaatataagcgagcctttttttctgaattaaaatataacccttatcggctattgtctgtcttcgcttcccattttttttcctaatttttaatcatacacttaaaattttaatcttaatttttataatcttctaacacccttttttgccttttttatattttttttacattattaattatcatatttaattattattttttcttatatgtttttcctcataattaaagtgtacatacattcgttgaaagtgtgaaatcatcatttgcgtaagaaattggaggcttgtgtaatttagatcatgcaaagccattttcactaaagtcgtcccttagatgctgcaactttcttctcaattctcatgatgttttaatcattttcctttaaagaaaaaaaaatgaaaatgtaaaagaaagatgatagatagtatataattaggtgttagagttgacttccaatcagttacttaggttatctcactcaaattggtgtttcgcttcttcctaatctttccttagaaacaaacataatgtaagcctcatcatatttctgttaccacttctgcattacgtgagcaaaataaatcgtgggtgttcgggctgcacacatgttaggttgaatttcatcagagaaatttaaaagtaaaataattaaatttaaatcggataaaatagaaaagaaaaaaaaaagtaaatacatataataactaataagtaaataataatctcttcactaacaatttttttttcgagccaaaatattcttctgtcataagatatttttatattaaattaaacttatcatcacatgttaaaaattaaaattatttatcaattatgttagttgattttaataccttccctaataatctgaaaataatataaaaaagtggctctgatttttctcttttctctcactactgttattttcttttggcggtgcattactgtttttttgttacaggaaaggcagagccgccagccaccaccactagtacggagtaaggacaatatataagggtattacgtatcattaatgtaaaaataataactataccagaaactaaaaaaaaaagtaaaagaccaaacattacactaagctcttgcgtaaaacgacatttctcagtattttcttacagacaccctctcctttgtatactattttttgttttctagcatctttcattgtattaatttgttttaccctccagccccatttttcaagtaaatgctaattagtctaaaaaaaattcaaattaaatttttattaaaagtattatgttttttcatcattttaatacaattttttatgtaacttttaatataattttttttattactaatttcttaaccaataaattgtggaaaccattttatttcccagtccaacagtcatggctacttttcatatgagtgaccatcttatcatctcatctcatttcatttcactccttttccaatctttatcatgaatccaaacaaaagagaaagcactagatataaacaaagcatgttgtgtgtcgtagaaaagcagaaaataaaataactggtttcaattgatactccgctagcttcgacatctttctcctttcacatttttataaataaattagttcaaaacaggtaaaagtagccatgttgttaattcgtgtatcgtaaatatatatacaccaaaagaacctgagataacatgagcaagtattccatgttttggttttaacactatttgggaaaagagtggggcacgcagtagcagtacagcttatgcttccgatctgaataaaattggtaaccatagaagtgg

SEQ ID NO: 149 - DNA, 2100 bp, Glycine max
  Soy_ogl_3728 Gm11:4478901..4481000 Cluster 1
acacctacaaatataaaatatctaattcacattcttattttttttctatcaaatcatatatataatttatcatatttatattttttcctctctctcaagatatcaaccgacatcaatgtcaaaaaatatttttcaaataaaaaacagaaacattttattacaatatatattttttataataattactcattttatttcatatttttattttttttcttcacattattatattttgacgaccaaaattttcaaatacctgaatcaataaattttctttttttatcttttttttttctatcacactacatcattgaattaattatttatttattcttttttcacttttctcttaagtcataaataattgttgaagaaatatttttctaaaatatattataatttttgtccagcgatcatggtcactaactccatatataggtgtggtgcccaatcccaatcagacatggtctctccctctttcttttttttctacacacgcgtataaatagagatgagcacacatgttcattttttctatccaagagaagacacacacaaataaatctcacaaggagaaaggagataataaaattaaaaaaggataaaacatatagtgaaaatcaaatatgtgttcaatataagtttatgtgcttagtgtgtgttaagccaagttgactatcttatttgataataaaaaatgtattaaaggtttttggttagaagtgttttttttattagtattaaaggtatttggttacacagaccagtttaaaatttgataaattgatagaagtagcatatatatggctcataagctaagagttaattgtaagatttttttccacatatggcatatgttaaattttttgggacacttatttcacagaatattttcgttccagaaaatataggataaaaaaaatatctctcgtttgttataagataataaaaaatcatgggaatattttatttctgaaaaagataaatgtcacgttttattaatatttagtccgacaaagggagaaagaaaaaaatattctcataagataagaatatctcttcatgagtaaaaattcatatatacactcttaccgatcattgctctcttcatgttaaattttttttaactccgcaaattttattcttgcccaattaatgttttcataatttaatttattgtcaatttcattccaatgttttacaataaattttcttttctcttccatgctccttttttaatagacaaattttactcttctttcaattatagtaattgtcaactacattggaagaagataaggaatgtaaccagatttttcttaataaggattctttagtaattataatttatattcttaggaaaaaataactcaatcaaacatatattttaatcattctcaggaatataaaaacaatcctaatcaattttaatatttaaccaaacatattttttaataatacgtgagaataacatttaaacatgttatattttcagaaaaaaaattattgagactaaaaaaattatccatgaaacaaatgatccaaaaaataacaatttttccctccgctaattaaggctcttactttcaataaattatgtgcaaagttagtaattcactttttaaatttttttatgattatactttacctaataataatatttaaatttattagtttttaactatatacgcatatatgcccaaacatgccttttatattttatattgttaattttatccaacactcttcatgtaaaaaaaacacttctaattcaataaactaaaatatcaattttcaagctttcctctgatgaacttttagtttccaataatttatagttttaattaatttttcagctaattatatcagataaaacataaccaactaaactggtcatgaggatatataagaaaacaaacttgagaatgaatcatgaaaataaaccaatataattatataaagtccttagttttttttaggataaaaaattccatagtttccagggaaagaaagacgagaaaattcaagctattagaagttgaactaaaaaaaaggattaattagagacattgataaaactatattgatcttttaaaaaaa

SEQ ID NO: 150 - DNA, 2200 bp, Glycine max
  Soy_ogl_3765 Gm11:6154101..6156300 Cluster 1
gaatggtgactgcggttggaagtaattaaagaagggggaaattgctgaatgatatcgaattggatatggatcatgaaatatattatccatgcatgtctattccttacagtgtaatgagtgtatatatatatttatttccgaattgcatgtttcttgatgtgttgccttttatagttttattaattatctcttataatttgagtttagatttaattcactttatctggatgttgcctggatatatcagttgaatgcatctttggcaattggtgacattattatttatgaatgtcgtagcgtgattcaatttgaagaaaaacaaaatatattaattgtcttaaaagttgaaaatatttaatatttattttaaaaattaaaaatattaagcgacatttatttcacggaataaattatattcttggaaatgttgttttcatcaacatatttgataaccagttaacatttccctgaaatattttaaaatttattttcattaaaaataaaatattaaaataataaaataaagtgaacttgagaagttattttagaaaattcctatgaaaatattggatttttacccttatatgtaaatagatagagagaaaaatgtataatatatattttggaaattaacatgatttttataaataatagtgacttttattctttaatcaagtgatttataaagtatgagataaatcgaattaacatgtcacacaataatatttttaataacttatgccgaacataaaagtaatatattctcaactcattttctagaaaaaatttgtcagacttgaaagaaacgcctccttagtgtatgtattaaatactcactatagtagtatatactcaaagagtaaaatataatgaaatcattaataagaattttattgagatataaaattaattgtgtagttaagaaggagccaaaagaggtaaaggtcataattttgatctcacatattaacaaaatgtaacaatctaataattatatttgtcaataaaaaaattaataacaattttaatttaattattgaggttaaattatcatttgcctgaaaatttatcttttctttttagttttggaacattttggacagaagatactaccataaacagacatgcactaatgtaatagcgtggtggtctcataaatttcgcagcaaattgagacgttgagtgtctgcagcgagattccatctgagaaattaaaaggtcgtggatattatgagtattaattgttgtcataaatacataatgaacctacccagaaacactgtagaaaatggcctacataaaacaagattcccagttgtaacagagacaatgttttgccatatcgagcaaacatcaaaagggtttcataaataagccgcgaaattgattttcctccactgcaagtcaaccccctccctaggatactctactcttcactttaatttcatccaatgatattcgtactagtaatttaaggcaaatgctaatctattgattaagaaattagaggaattttttcttatcagaaagtataaaattatattatttatgacttatttttatgtttttaattattttcataataaatatttttttaaaaggaaatttaaccaatgtgataaggcctttaattattcttaattgaaagtcttgggagaattaagggaagaggatccttatcctcaaaagaaaaagaaactggagggagccaaatggttgtaacagttttgaggcagtctgatgagtactaccttgcctattaatgttgcggcctgtccatcaatcagacggagattccctcatttaatgtttctggtttctgcaacacacccacccagtatcaccatcatgcccaacccccattccttaatttcctttctcctctccctctgcttactgcacctcaagtaaagagaaatacaaaaatttaacatacattccatttttttttaaaaaaaagaaaaaaatactccctcccttacaaaataaatattctttaactttttacccatataaaaaaactaataaataaataaataaaaagtaatattttacaaaactaagcttaatattaatgttatattgaaaattttaagtaacacttgttagagatattagtaggaaaaaatattttttaaaaattaataacaaaataattgacatgcctcgtgtatataaaatataagtttaaatatatttt

SEQ ID NO: 151 - DNA, 2400 bp, Glycine max
  Soy_ogl_4138 Gm12:37892701..37895100 Cluster 1
ggagtaaccatcgacagtagcaattgcattatgagaagtgtctcgtcattactttttttttttttttactgatatggttccatgcttatcatgaggagcagacgaagggggagaaaaaaataggttacgttaaattaagttctccctactgccttttcactattggcaaacacattatccacgttttagattgacttttttctgagtacatggcaatttcactttaattaatccgaggatttagtactattgcaattttcatgttagagttaaaattaaaaaggtgcgattttaattacttggtaaaaaatataaaataaaaaaacaagggtcacgagaaggaaagatatgacggatcaaggacagtgcggttgttaagaatgaaaaggagtggatatgttgtgtcacattcacagataagttcgagcaactgaggttctgagcaacttcattattttgtttgtttgttcatcactagtattcatccacatccttatttggtatttgccaggtctaggttgaaagcggcatacgtacccttaaataggtactaaaagtagcactatattattacacagtactattagtaccaggagaaacaagctaaaaaataagtcaattttaaataaatacttttaaaaaagttataaaatatctctttcaatttaaaatcataaattattttacaatttttgttcttttctactaaagtgataaaaagttaatgtatatataaatctttcggtcatttgagagtatttgtagtaaatttacttacatagttaagatactcgattaacaatatcatatcaaatattttagaagaattgaaattgaacttgttggaaacactaatttcagatttaacatatattaaaaggatcaaaattatcctttaagggatgtttgcctattagtattaggctactaggtgtaactaaaatattattatttcttttttgagcattaaacatatttatttaaaaaattaacttttttttataattcttttcttggtataaagttgttataaatgtctcgtgaccaattaaattcattagagacataaacaaaattaaaatattaaaagagattggaaatgcagagatttttttttttggagggtgaaaagagaattcaaatgtaaaaaatggaaaagataaaagtaaaaatatatttaaaagggataaataaagtaagaaaaaaagatatcaactataagctataattaattgaagaaacttaatttagaagtcataactcattagttagtttaaattgttacacacttttaacatagtcaaacaaatttataagctcggaataaaaaaaacaaaattataagctatagtcaaataagttatatagtataaactaacttaaataacattctcatacttgtaattgtaatacataagataagatatttgttaattataattaagtattttatatgtagcatattcaacatagctttgccaaccatctctgtttctgatgagagggacatatacatgacagcacacatcaatcgtcgctattgccaacctacgggcctcaaatgtttgtctacgatttaggtaaagaaaaatgaggctaggtatttgttgcaggtctttaaaatagaaaccaaaccttcattattttcaatgttctgtcttctttgtaatctatctatagaggcacagaagagaagacaaggggcaccaacaataagataattccatttatttttgttttattttaattatttcccaacgtgcaaaaagtgaataaaccgttccttcgcaattcctcaacttactaaaatgcaataaaatattttgctatctagcttgattccatagttgtcaattacacactaatgacattatatcccattgtaaaagtgggtggttggcatttcaaatctgttgtgatattgttggaattcttcgttcagatactcaaattagttcactgtcatagcatatccaaaattgataatgagattctccttataattcttcaaatttagcaagttatgcaaatcagatttttccatctaatgaagtaggttagggaaggtaacttaaaatgaataatgccacttatgaaactacacgaatgcacagctttggtccctaattcgggcatatatgatcatatacgcatctcatgtctcaaagaaaggccatatgacccatattactggaaaagctcatgtgtatttgacaaaaaggcagttatactgggttcttttatttgatccatgcatcgttttttcgctgcaaaatctcctatgagaaatgtttctcgcgtgaaaaatgttttgatcagtcatgtttatggtaaataatgatcaaataatttatgtcaagaagaaaaaaattgtttcttagctatgaatttctaagcttc

SEQ ID NO: 152 - DNA, 1941 bp, Glycine max
  Soy_ogl_4653 Gm14:4449560..4451500 Cluster 1
ataataataataataaattagacaaatttgaaagggaaatcccaaacgcaataattattagaaaaaccaccacagataatttaatgcatttgatctaatgaaaaaataaaaacgtgaaggcacaaatatattaaatatgattagatttcaaaatattgtaatccttaaccctaattaaaatcattatttgtaattaataatttaatataatttaattttttataactaaacaattatatagttactgttgatgggaaaaaaaatattttttaaaggaaagaaaaattgatttaatgcattcttaatttcgaaattcaatattttatgtaattactattaacaacacagaaactatacaataaaatcaaatatgggacgtaaatatattgaatttcagatttcatataaatgactttgatttcaacatgaagtaagacaggagtatgagtgcaagtttaacaacagtcaaaggaggactaatgagttattacgaatttataaataaaaacagaggtagtatatattggtttagaatgattttgttaagaaaaataaattaaaagcacgagatgttccatctaggtggaattataatgctaaaaaactttgtcagaattattcgaaaatataaatgatttcacttattttattaaattttctggtataactaatcacattatttgagacaattgttgtgttttcatgttaaggttttgatttagtttaatgcattttcgtttaattacaatatcatatcatgtatgttttcttataatgttatcacactctactagttttgtttatttattttcgttattacttagttcaggtgggtattttatgattcaaacaaatttagcatcatatgtgataaaataactgatagaaattgaaaaaaaaaagtaattgcaaaagtactcaactgtccgttgcttaaataataaaatcgtttaaccaaaattacaaaaactaatgaaattgaatcttctaatattagttattcaaatttacacattaaatcatctcaatccatattaataaaataaatcaccgtcatttatttatttttattaaaactagggacaaatgagacattcgtgtctcattgtttacaaaattgtggttcgtgtaataaacagttgggtatgttgttcacattttgagagtcatcttttttacttaacaacattttgagagtcatcttttttactcttttttttttgcttttttttcagataggtagtaatgaaaaaaataattaaagataaattgaaaatagtaaatatatacgtcaaaaacggaataatttttattataatagttatagattaagtaattcaataaattaaatatatatatgcattgtatatttatctactaatatatgaatttacattaactttaattcctaaaatttgattaatttttttaagaacttggttttataaaatcaaatagtagattaaaataatcatacaacatttaataaaatcatcctataagtttttttttcaaaagacatgtctaagttaattaatatacagattgaatttaatataaaaatcatgaaaataataattttgaaagttaaaagtggtgaaattatattttttattattatatttcaattcaaatgtataaaaacaggtaggaaattttccactgaattcataggaataaacttttcctctaaagatttttcttccaatcaaaattaaaatttctttaattacataacaaatcaaattaaatcaacatgatcataactattttttcttggtaaaattagtgtttaaaattaatttctaaccaaataattattcccttttttatttattatcatctcataattttctaatattttggatttacccttcttcttcctctctctcccaccgcctccatcggtggaccgtcgaccaccaccactcaccacccatt

SEQ ID NO: 153 - DNA, 2400 bp, Glycine max
  Soy_ogl_4690 Gm14:5725101..5727500 Cluster 1
atacaatgttttgtgaccatttctttttgcaagagcatgagaaatgaaaattgtaagaaatgagatctctgcagaatcaatcaacaactttcgaatggggttgttgccaaatctgacactgtcaagactcttccccataagccccactgtcatatatgcatcgtcttaaattatttaactaataactaccttctaattaactcaattttgaattgaagcatctatgaattaattaatggtgtgatgactatagccttttgttgcatagttcaatagggaaatcaccaattatcatctaaaaaaatgtgcttaaaagttacggatgagctacctggttggaggagaatatataaaattaaaactgtttgttggaattttgttttagatgtggaatcgtttgttggcacattactgtgtacttttgccacatgacatatatttgttcgtaaagtacaagtattttttttaagctttcgtagagtacacgttttgtatgcataatttaaacaagataaatagttgcagtattaatggtagctattgtacggggaagaaaaaggcaaattaagggggtagtttataaaattaactcatgtaataatatataaataaattccttccttgagctttaagtgatttttctaaagagtctttcactttttctttcgagcatattctctttttctaatacgtgtccttagctcttgggttatgtaaaaaattatactgataatatacaaaaatgaaactattaatattaggtttaatttttaatttaaaaaattcaaaaaatatatttttatatattaattgaaataaaatatttaaaatttacttgaataaacttcttttataagtacttaaaaaataacaaagaagaaaataaaagaaattatgtttcttctataaattaaaatcaacttatcacctctttttttgaaaatgttagatgagatagtttttataaaaattaaaatacataagtttgttttaacttataaaaaaaagttctctgtattttatcatcctatttttttctatatttttttggtgtatctataaaaaggtttatccaaacatatatttctatataattaaaagaaaatgatcaggctaaagacgaagaaaatgatcaaggtttatccaaacatatatttctgtattttgtttttcatttttttctttttgttgtatcaataccaatttttcattcctataaaaaatgtgaaataggctgggggcccagttttgagcctcaaacttcaagccccacatcgccatttatacccggaattgactgacacctccgttcatacaaagaagcactattatttttgtaatgcgaaacgttttccaaatcaaacaaatttcaacacataaatccaaaataagaaaacccaggacggacccttgcttgggattgcaagctccacgtaatttgtgatttttatatttaaattgaatttggtttagttaattttcccccctacaattataacattttcaacacatatctacggctaaatgcaaggaaaatataggttataggacatttcataataaaaataagtcccaagaaaaaaattgacccttccgagtcctaattaatctcctacctcctcaagtgaagaacagaaattcctaatctttataagccttttaacctggtgcagatttaactaaacaggttcattggaattcctttcttttttttggtaaaaaatatattaaaaaaattaaacaggttcatcatcagcctaaggggaagtcacacagtgtggtaacattttatcttatgtctgtgtgtttattcttttttttttttttggttacatgtgtgtgtttattcattctaataaaatttattgaaaactagcaagaatttcgtatattttgcaaatattatttaaataatggtttgaaaaatatataactgtgtttatattgattaaaaaattagtaattaaagtgagtacacgaggaaaaagtgcaaacacaaaagttacctatttaaaaaaattataaaagagtagatatgtgaaaaaattaaatatttattcacatagttgatagttgagctaattttgaaaagtagtcatgatctacgacatatcccgtttgtatgtatggttctaggattattcaagagtactatattttctaaataaaacgccaaaagatgtggaatttttgttcaagcaaccttacacaaggcaattaattactctttgccaagtggcagcgttctactttgcacgttgataagtgctctacgttactcgtgaggaatgatatcaacatctatatatgtatattgcaaacactaatttgattgattctttgtacttttctttatttctcttgtatttttatttttatttctttctctctggagatatt

SEQ ID NO: 154 - DNA, 2000 bp, Glycine max
  Soy_ogl_4799 Gm14:46968101..46970100 Cluster 1
taatagaaattgcaatatatataaaaaaggaaattggaatattaataaaaaaggaaattgcaatatacggtgtaactggattaatactaatagaaaattgcaatgttagtatatcaatattaaaaggacagattaatgactaaaacatgatgataaaattgaagattcaagttatttttaatcattgtatactagctaggaattttcttcagtgccctttaagtctaacttattttggtactctttgtcattgaccaataacataacctgaaattggtatcactttctcatttgactgtctttcatagttaaggcagtactttccgtgttattttaaatagcctacaatttacataatgaagttttttttgcaaggaaaataacgaacttataaatgatgttaacaaaaaatttactcctcaaatgtacaggtagattaactatttttttaatcaaattattattaaaattatctattccaaatactattatatttgaaaatcattaaattattttttaattaattatttcctactaaaattacaacagaattatttctgggaaattataatttaataacttaatgttcttaattagtaagtttcttatcaatagctagtttaattactcacaaaacatttaacaataaatgaagagaaaaataataaaagttatatcggtacaaaatacattaaaatatagtaatatataagaataattgaactacaactattattctcaaagtaggttcaaaatagaaaaatgtttttgaaaaaaattaaaatcacgtactttatttatattaaaaacattaagattagacaataataaataatactattaaaaaaaacatgaataaattcgaaacggttccaaagagagttcgattttaaaccaaatttaagaattaatttttaaaatcagtttaaaatcaaactagtattaaaaaaatattcaaaattaaactgattttaaaaatgggtttagaaattaaaatgattttaaactagttttcaaactatatattttttataaaaaaagatattctgatttttgaaaggaaaaaaaatgattattaaataatagaatattatcaaatacaaactgatttagactaacaattctatcattaaataaactaaatcaattataaaaccaatccaactggaatcaaatttatttaaaaaaacaactcaattttatttatccggaccagttcagttcaaaaaggaattcaagtgtactattggagggtccctgattgatgaatagtctaatttgggtagtacgttcatgaagggaacacatactcatacattttgacatatacataataaattagtatcacagttttcttgttagagtgtctccctcaggtgaattttcataattcatttccaactagtcgttaaaccgtgtctgccaactgcagctataaatctagggggagaattctgtgactctgaatgacgaatttattctacgaggcgtttaagaaatttcaattgaactttgaaagagaccacagaaatcacgtgaaatacacgttatggatttcaaaaattggtctccataatgtgcaaggagtccattatattcttgggccttggtctaaagggtgatttggacccattaatagtttggttcatgtattctaagtctactttctaaccggaggagttgttttgtttacaaggggaaaaaaagagactagtgaattgcttttacaaaatttgcggcatggttaatttagcacttggaaacaactagtaattatttctttcctatattatacttttaatcactgagtgcttgaatcaattgatataagattgtttcagtttatacttttaagtttgaatgaaatttttgtgtatttgcttacaaccaaatcaacaccttaatttaaagcccaaatgaaatgttgattcttatgttcaatcaaaattacaaatttctttcgtcaagttgttattaaaagtcaatataaattttcaata

SEQ ID NO: 155 - DNA, 2476 bp, Glycine max
  Soy_ogl_4826 Gm14:48646925..48649400 Cluster 1
caagtacctacaaatatttgtgagtagccatgaatatatataaaatcgtgaatactcacttaacaaatacttgtataagtacgggtgatcaataataactattacctttatttatctcatttcattgtcatctgccatctctatcaaagattcaaataaaaaattaaacagaaataattctaccatcattttatatttatgataagtgaaaataaagatattttaactaaaaattataatgttttaaacttttttttttctttttgaatataattttattcttttttttttcaaaccaaaatattttatccaattaatatgataaatgttattaatatatgtctctacataggtaacagagaaaccattgaaagtaatactaataattttgtagtagtaatgactaataactccttaattcttatcaatgaagtacaaagcatagagattgcggataaattgcagtagagagaaagagagagagagattgcggataaattaagatgaaaaatctaagtaaagattcttcattcttactattgtattttacaactactagaaatttatttactcaaacattcttttaatttaacaaggtaagaagaaactctacttataattttaaatattattttatttctttaaaaatgaggattcacctttaaatattaagtaaaacaaatactaatagtgaagtaatcgtggtggttgaggcatgtcgtaagagtcgttgaaactattctttattttactactaaagagttaataaaggctacccttttacttcatgattttgtcttttcagctaagtgcaataatagtcttaattcgttgacaactaatacgttataagattcttttttcagagcacgaaatattttcctattgtatttgtttggtgtgtaaaagtaagtatagtactaagatagaatagaaatttaactcaaaaatatgtttatgaaacaatcacaactttgactaaattaagattacaattctaaattacaattttagtttcgtacaccaatctcacgtttaacctaaacttttatgtacctatattagatatatagaggagttgaggtcttggggccctcctcgtataagaaaaaaatatagagaggagctgttatacatgaaaaaaaaaatcttctgaagtttttatatatataatgacatccaaaaaagcttttgaattcaatatttcaacgtctttaaggatgctccaaatgcatatcaattaagaggtaagttatttctttgaaaataattaataatgagataatatttgactattcccaaaagcaacaaaaaagatggctagaaatggtcatggaggatataaatagacagagactaaactttttttcccctctcaatcaaacccccatattcatgcaactgctgtccaagtcacaagacttataaatagtttattgggcttatgtaactcagaaagaaatttgttattaaatactagatactagatagttcagttttatgtaaaaaaaaaaaaaagggttcagttttggtttagtatctcgcattttacattgataatccatacattatcaatactaaaataacaactatttcattgatagtatctcgcattttggtttagttttacttatatttcaattttatatattttattaaaaatatgtttttaatccatcttcacatatgatgttaatgatgtttattatgtgacacatggagatttcatttgatcattttttttttatataaatgtggcgttgcatcattccatgtgatattttgaattaaaaatttgatagaaacaatttttttaagagaatcaaaatagaaagaaatttcattctttctttgttattttcttcatgcaaactctttctctcttccaagattaataacttctttccacacacacatttctttcattttgggtgtgaagaacaagttatggatttcaaactacaactcttacgtgcagatcttgataagaaaattaaacataagaactcatgaaagcaacattcaataaacaaacaaaattagaaaaagaagacacaaaaataaatttgcaacttgaattagtgaaaaatgaatgtagaaactaaacatagaaataaaaccatagaatattaaaattccatgtgtttgagagaaacattttaataattttttttacattattttaattatctttttaaaaaaagaaaaaaagtacattattctccatgttagacaaagttaatatcactagtgaaaattttgtaagagaccattaaaaataagttttttttgtaaagttttgaagactaaattaaatgatatgaaaatttaaggagtaaaaatgagttatttaagttcattttttatctcaaataaattagacaattcccttccatatataatatgacttcctacattttaggtgccgtcaaccaattaggcgataatgcctgttataacttattgggtggtgaat

SEQ ID NO: 156 - DNA, 2124 bp, Glycine max
  Soy_ogl_4950 Gm15:9354601..9356724 Cluster 1
tcgtttaaaagttagttacacttaaaaaatttattgttacttctaacaatatattatgaggagataaattaattgttgttgaatgtgggatgggggaagaaccattaacttaaatcagttaccagtgttactccctaagcctaacggagacggttttggcaaaaattaatattctaaaataagactcccctcccaatatacacaaacacaaacacgcgtgcattttggtgcaaacaatgggtatattgtgattctgcgaacagtacagtaaacgaaatggaaaggtgtgcatgcattttatgttcagaaacaaagaaagtttaattctattttacagaaatttaagtttgattcttagaatgttaagaaccttgtagcagttttaaatgaattgatattattaataccattaattggtgcaaaatttctacttttaaaaggtgcaacacattattaaatgattttgaaaaaaattatatttaatatatcataaaaaattattaaatgaggttattaatagtttttttttgtcaattgtatatgtagacaattattcatttctatttttcttaattatatttttaatatttagtatgaattaaaatcaaaacactaaaaaaatcaatctagttcaatatatgcaatgtatcaataagaaaaatccgttgtatatacaataccataagttacacgtatatcataaacggttaacataattaatggattttgaattttttttccaccaaaataaattataaatggttaacatgattttaaaataataatatcaatatatttagagcattttcacctctgattgctttacgagttgtttattttaagatatcattattttaaaaaattaccatgaaagaaaatctgcatgttatgttgagttatacttaaaactaagttttgttacttctatacacaatggttgcttataattaaaaaaaatgtcttagttaaaataattggcttaaaattttaattaaaaaaagttggtgtaaattaataaaaattcatgaaagtgtaggtcatttaatggctacttaaaattataccattagaataaattaaatatatatgagtatattatttaaaatatatatatatataggtggtattataggaatcaattaataaaaaataaaaaaaagctaaaataattattgaaattgtacctattaaatatgttcttagaaaactatgaagccaatcgttgggaattatgtccactttatacgtatgataccatacgggcgaaatggataaaaggaaaatttttaactcttttaaaatgagtaactcattttaaagggtaaagtagataattttatagttgttgggacaattaatattaattaatattagatatacatgaatatacgcaacaaattatctaaaggataaaacatcaataattatttttttagtaaattacaccattaatctccttaattggttaaaaagtattacacaaacacctcttatacattttatacattacattaatcatttaaatggtttaaaaaacattacactgcatttttttataaattttttttctagatcataaatatttttttattaaaaacaatcatatttaacccgaataacaataaataaaattacttaaatgttaaaaaaattatataatttcactaaatctgatgatggttagcataatttactgtaaatttgtttcattattcactttagggtggttgccaattaggcacgtcatttatggagctagttcatggtattatttttagagaaaaaattacacactaacaatataaaaattttacatagtcattcaattacaatttattgtgtatgatgaatttattgattaacttgtaacataattattttaaaataatttaaataatgatatgtgattaaacaataaagtaaaattattttacattctcaatatatagtcattaaattcgtatttttatgaatgtgtttacatacacctaggtttttttacaaaacacgtggtttattaggtgacaatagttatggaaagaaataaaaataaataatatatactattaaacattattttgaataattaaaattaaaatataaatacatgtttttaattagagc

SEQ ID NO: 157 - DNA, 2200 bp, Glycine max
  Soy_ogl_4986 Gm15:11176101..11178300 Cluster 1
caacagtcattaatataattactatcatatttaatgtttcattatttctctctcataactaaaatttcatatataatacacatatagtacatgtcctacaattcttttcatacattccttttttatttttattttattcattttgcaacatacaagtataatatctttaaaatttgttataacattttgattttaattgttaattaaaaattataaacaaatactgtaattgtgaaattatagataaatttatgaaaattgaaaatttgaaattataaaatttttaaatacgaagtacatgtcatattatttattactttaatagataaagaattaaatcataattgttagaattatactaaaatgcataaatttatgtcataaagtataaaaatattaaatcttaataattattttttaaattaattataaaaagatatactcttattcactttagataaatgattttcatttattttaaaattagaaaaattgattttaatttattaatctgaatccaatatgtaaaattaacttttaaaaagaatctaacgccggcctcacaatttcaaaggccaaagtaatagtttactcatgaataattcttaaaactattcttcttaatttaataaaaactcataaaaatacattataattcgaaatgattattcaaatttatatcataagatagattttactgatatatataatccgaattcttactggttaaaaacttaggaactatgttcaaatttaacgactaaaaataattagacattgagtaattaattaaaataaaagtgaaaggtcactgaaaaactaatttttatatatatattccaatcacattgaaatataaaagaataatttctctaaagttagagttttaaatataaatgatatgagagaaaaaggatgatgtgtgaaatataatagtaattacattggtagaatgtaaaacatgataattgaaaaatttgtattaattggtgattgaaaatgagatgaatctcatttttatcttgaatcaagtagacaaatccttcattgcttaaatacggtcataaatagtggtcacggtagaatccagcatgtatctccagacttccaatccaaggcaccagagagtgcatactgatacaattctggcaaaaaaagtagaccagtacgtagtggttgagttgaattacagttgtaagagtttattcattttcaaaatagcaatattttgtttgtttgttctatttccagatcgattttaatccaatcataataacttaaccagtggagtggaacaagcacacacagacagcaattgcaactctgtggttcttgaagtacaaaatagcagagaatgtttggtttctatcactcacaatggtgtattgaaatttgaaaattctaaactaaggcctcatcaagactggttggacggaaattgggtgatgtcttccaaggtaaaacactcataagcttctcctttatataatcaatttgtttttgttttttttctttctgaaattgcaatcaatattgactattcccaaaatttacgggataataaaacttcaaacacaaaagcttgtcaaactctcttagatttgtttagattaactttttattttagattataaaccggtttctgcggaatagttttaacatcaattggaacttgagatttcaattgaacgatcccaagttaaactttgttatagttccagcaaaaggagcttacaaaaacaaatcattggcaacaagcttaacttgttatctgttcatggttgtcacttcactcgatttgaagttgtctgtttagttgcaataaaattgtattctagttcaatttttatagtaatatttttcggattatagttgcagcagttataaataacataatattatgtgcataagtgtcctttgcttcctaatcccatatgaagtttggagattagggcactggacaattttatagtaatatttttagtaataaggcattgctaaaaaactaaaagacgaaaatatttattgtgaaaatgttaagagaatgtaaaaaaataaaatggacaatgcaattttgagaaacaaaacctttctcttttaaaatatcagaaatcaagtgagctggtaaagaagtttggagatctgatgcctaaaaccaagaatgtcactgggattaaagtagtgctgatgaataagccta

SEQ ID NO: 158 - DNA, 2010 bp, Glycine max
  Soy_ogl_5220 Gm16:1056750..1058759 Cluster 1
ccaagaatttattcttgaaattcaataattcaggtgactgttgattgacaaataaagacaatgacaaccatgtagggatgcatcacacacaagttatcatatattgagagttgggattagtagatgatactcaaataaatgatagaaaaagtgtttttaaaatcttgttttatcaaacatgtacttacggtgtgtttgacggaaaagagagaaatttatcaaaaataagattctataaaacaatgcaaaagatttattaatgtaaaaaataagattgatgaagataaagaattgaagaaataaataaagcgaatgaaaatatgtgaaaaataatttaaagatatttgatctaagagaaataagggagaaatggaaacacataagaagaagaaaaaaaagaaagagaatcaattgtttttttatgactatcaatttttgaaacaagacaataatttatgtgggataaaattgattattttttattttattacactaaggtagtcgattatggtaaaaaaaattactgcaataattacttttctttaggtaaacaattactttttttataagaatatgattattgttcattcatcctgattatgggatcaacaccctttttatttattttttccgactatttttttctttatcaagcaggctctattctatatttttcacttatttcttctctccctttcctattttctcaccatttttctacaatcaaacaaaccgttagagtagagcttttggccctataacatccatttttaagaagagttttttatttatttaaaaaatcacattatgggtccatttctttatttgcaaaacattcacttgtttaaaaaaccatttttttagtttttcaggtgttagttttagttttaaaaaataactacaagctgaaaagaatctaaaatttgattaaaatcaaaagttgtcttgaatagcttttcataaaatcaactacttctttcaaaaagaattatttgtataattataaacaaacataaattagattctaccttttgtttttaaatctctagaaatcatttaattttacaattctatttcaggtgtatttgaaggctaaatgcgagcacattctgttaccagaatttgaaccttgttcttcgtatagtgagaaactaattaaacaaatcagttaagacaatttccttttttttaaaaggtaaaacatgaatataaaatggttcttttctttagccattgtcgatcattatttttctaagaatatttgacttctgaaaggtgtgaaggacttgacttacggtttaagctaattaaaatagtttatcattttcacacaataattggcatttgtcggtaaatgaaggtatgctaaacgtgcctaataaatttgtcataaatgtttcttcattgaacaattaacagttcaactaaactatttcttcattgaataatatatattattttttaagtttaaaatataaatcaaataatatgaaattagtccagcttaatccataattttaaatttaggtcacgcacatgcaaatgtcttacattagataacaatataaaagtttaaacaattagataacgatataaaagtttaatcaacacatataaatgagaaagattcataaatctaatgtgtcaattttttttattaaattgggataagaggatttacttgtgtgtaccccacacacatatagttttaattaattattttacaacggttacaaattttagttggtaaaataattttaaaatacgttaactactagtatttatatagtttttttataaaataattttactaaacacacctaaatttattaaaactacattctagtcattttattcacccaaataattaatataactatacttcggtagtaatgaccggattggtaattattttgaaaacagtaattatatatatgcaagacgggacacaaaacaattaaatcgataaggtattgaagtgattgagtttaacttatttaacaaaataat

SEQ ID NO: 159 - DNA, 1922 bp, Glycine max
  Soy_ogl_5237 Gm16:1833201..18324 Cluster 1
cctaagttattttgaaattcattagtgtttcatgttgcatttattatattaatattatagtgtactagttttgttcttcgtgatcacaagattatgtttttttaaaaatatataaagaagaaaatggttcttgtgaaacaaaatatatattttttttaaataatacaaaaactacatccattgtagcattaattgtcgtagaaataacttttacaacatcagttctaatgaaaatcgatgttgtaaatttttacaacagttgaattcaaaacagatgtaaaaaatagtttctaacatcaattttaagaatcaatgttaaagcttgtcaccatatatataattaaagtaaatgaattaatcttccttttcattttgtgtagcttatgaaaagtcgtgagagtctaaggtctctatcaaatttaattaagcattaaacaatagaatgagttttttgactgatgaagtcaagttatattgggtggtggagagagtaaaaaggaaactatagtgaaaggaatgacaatgttatggcaggcctaatgttttgatgaacttttcttttcttagtggagtgaataccaaatcaattaatcagcacatagttaaaatctgatgtcatggcaggtctaatgttttgatgaacttttcttagtacaagttaaaatatgataaataaagaagtgaaagttctattctactaacctatggcacatacacaaaaccatagagcatcagattggatgtttgtgacactctaaatattaaatctagtttttagatttaaatagataagtttattaattaattaatttgtcataaatctttaacttatttctttagtatttgaaaagaacttttaaattctcaagttatagaaaaataaaacttaattttgtttcagtaggtacaacttttttctttaagaaaatagatggcaaagtctccagggtgatgttggatatcaattttgaaggtattgagatcacttggaaacaaggatggagttaatcattttaattgggttaatcaaagagaagagtagtgttaacaaattaagtggttgacttatgaaataatattttaaaaaaattatgtaaagaaaagagaaaaaaaaattggggtgcccatagctttcttcaactaacaagtaactccaaccctgtttacaaacagggcaacagtagcagcaactatcatacaggtaatagctatggacggatctaaagggaacaatggcctcccatcatttaaaaaaatatatttacagataaataattattttagttctttttaagtttttcaccatcgtattcaaaaaatctctcttcaagtctttgaactataaaaaatttgtcacgtagtcagtccttaaactataaaaaggtcggtcatattattcttttttgggagaataatgtaaacaactttggatcgttttaggatggaaagagagttttttaaaagtggctaattcaaaatcaatggaaaagttaaagaattaaaatggctattatacatcaagtttgtttttatataaaaatgggataagatcaattgataattaggtgagactataaaaaattatgcttttagtagtaatagtttacaaaagtttttttcttcaatctaatggttaaattatatgataccatcttttttttaaagcatatatgataacgtcttgatgattatgatttatgaatataaaatattagataatttaagcattcaagctaataaaagatatttacttatattttaaatagcatattaatcatgtaatatagtattgattatttttaaattatagaaaaagattctaaaattaatttactttataaaaaaattaacaattggattggaaagatttatttgttgtatttttttttttgaaagagtagttttataatatttaaccccca

SEQ ID NO: 160 - DNA, 1913 bp, Glycine max
  Soy_ogl_5304 Gm16:4913088..4915000 Cluster 1
gtgcataaattttttcttatttaacgtaacctatattgggataatttattagcccatcaaacataatctactttgacagtactcttatacttgagtgcatgattaactagatatttaaatatatagtataagacgtttgataaattatgaaaaattatgacgaaaaattcgttcttatgatcttatctaataaacaaaaaaaaattaaaggggagtttattttacataattttattacattctcagtaacattgttcctattattagacaatattcccatgaaaatatcattttcccatcgtcccctaatagaaatataaatgtaaaaaaatatggtataaaaaaagaaaattataacattcccataaattaataatatcttaaaacactttttaaaaacttataacagatatgagaatatatatttttctcttcatattctcatgatttcctctggattctatgaaataaacgctttctaagataactagataagtaataaaattggttgttagaaattttaactcagtcaattatttttcttcaatccaactcttcacttatttttgtccctttttaattctctcataatcttcactcctaacactaactaatagaacttataaaaaaaaaccaatttttttatttgaaaatatttcaattgaaatttattgtgtcttgcatttgaagttttataaattatgccatctttaatagtacttacaatttagttatttcatttattttaaaatattgtaccaaattaagcggggtttcttcatggcaaatgccaatactctagctatgttagttggcttttattaaaattaatccaattgtgtaagtttattactgtccaatgatttattatcttgaagtttattactgtccattttgaaaacgagggcattacaaaattagttatattttttttatcagccaatgcaggttttttcttcttctgaatgacagccaatacagataatcattaaagggctactcaaacccatttacgtaactgataaaaaaacatttacataaatataaagcaaaacataaaatgttttgaagaccttaagattatgtttggtttagatgaaagaaacagagtagataaaaatataattaaaagagatcatttgaaaaagaaaaaatagtgtaaaatcaaaataatatattatttaatttaaaagaaataggtgagaaataatattaatttcttatgtaaaaaaattgatttgtttttgtttagaaaatcaatttttcatttactgtttgtgaagacaaaatttgcaaacttaatttccttataaatgttcgtactaaacaaccaagcctcaattttatctgcggtctatacagtaaaatctgtattaattaaaaaatcaaaaaccatgtcccctgagcactaaacagaacgtttgtgacccatataaaatttagtccctccatcctcttctttcttttatcaaatcccacaaacaaacttttaacaatattgtcgcaactacgtaaaacatgttctgaaccattactatctaaactttttgatagattatattttcttttaagaaaactatgtttatatatctatatatagttactcaattaaaacaaactaaccgtctttgattttcataataataataatattgcaaatgttaaccaataactaagacattaattaacaaacttaaagtattttttttattaaaaggtaaaagattgcaaaaaaattacatacttgccctaataataatagtctataagtactaacaatttaataattttatattttcatttaattataattaacctgtatagtgagttttttttttacctttataataattattattattgatcattgatagtgtattttttaattttaatgaacatcataataattccaa

SEQ ID NO: 161 - DNA, 2850 bp, Glycine max
  Soy_ogl_5491 Gm17:3644951..3647800 Cluster 1
atgtatttttacttgttagaaaattatgagcttaattttttctaactttaaaacaaacaaacccttgcttacattcacatatattttagaaaatatattatacaaattaaatttattcattgaagtatcaaataattttaaaaaattataaaaagtcgtagatatgatctattcactgaaaacttttaatttgacatttggattaataaattttatatatctagggttattgaaaagagtaatgcaatgaagagttttttttcccctttagtaacttcattttctttctctctctctctctggatataactctttctttcttttgactggaagatatatatcaatcttaatatactcaatatatatgttttcttgacattgcatcattgcttgtaaaaaaaaaaattgacattgcgtcattaagttggcaatataagccgataacttagttttacattttatcctttcccacacgcacacacagaaaactaaaactacttgaacttacaagtttaaggtgtttgacataagaaaattagtcttagaagaaaatagtgcgcataatggttagcaagtcatacactactattatgtaagtgtgaagaataatttaaaattcttataatatattttttttataaatcctctgatttaatttatgactaaaagaatattgaagatttttatattttcaaacattaaatctatgttttgtaaattacttgttaatgaagtcaagaaataaaaatatacatgagggaaggaattgctttagctagctcatgcgcacaaatgcacaatatctatcttgaaaggttacttgaagggtttttttttttttttttttgcacagccaacaaatttcaattttattaagatagagtgaagaaggcacaagaagtgatcttcactcagaatattacaagacagtgaatgcccctgcatagggaccaattacatggcattagcaaaataatgttcgaagggttgaaaactaattaaactacatttgtaaactttgatgattgccacatggaaagatagatggatcatggattatggattatggatcatggatgtctttcggctctgcacttgaccagtacaaagaggtagttgtgggtttgaattttctcaaattaatgtatccttacccactttctgcactgttaattttgcactctaattagttatttcaaatgcataaatgaacgatcgatgtataacaaaagtaattcacacagggagtaattaattattcgttaatttcatgagtagctgaggttctttttgtaatgttaaaaaaagaaggaaaaaacactcaaccatgcatgttctaacaactgtaaagaacgtaaaaaaagaaaaaaaaactgtaaagaaattgatgaatattagtttttcttattatatattctgctatcttccttattgttttagaaggaaaagtatgccgatagaaaggctgaaattttagttttaaaaacccacaaaatgtgatcaataaaaatgcgttctctcatatctttccaaataaaaaatatatataacaatgtattctttaatattttttgttataaattaaaacttattaaaaaattaacagcaaagaaaacaattagtatatcataggtacaaggcttacccgaacccttactaaagaaagtcaacccaaaggttattttgtatttacatatatgtcaacataaatataaataacctaggcttgacagataaaactagaaccatgttttctccagcaaaacatattatgctaccataccaatatggcaatatacagtatattcccagacctacctcatgaaatttatattcactatatccacctcttgatataccatgtttaaaatttattaaataacgtgacttcctttccttataaatgagagcttcactcatcattttatgattaagaaagtttaaataataacccccccacccccatataagaataattatatgataacacctaagccacaaaacttgatgagcttagtcattgtcgtaattatagcatgaattcattattgttccccgttccgccatttacattaagccaggtgattatagtggtatgaaaattcaataaaaatcataagaattgaattttcatagctaaaatttaatacttataatatcacttatttattcgcatatttactaagtgacgtgaacactcatgcagtcatacacaataataacattttccttttaactttctcaatttttttcataaaactcttttaatgattttttttataattaaacaaagaaaaacaaagactggccacatataagaatatatttaattaacagccgaagactacaactctcatttagaagcatatgaactattaaaatggaatttaaatgtcttaatagagttttttttatacacataattataaaataactataatcaatatattacagatactcaacatgatgtcacacctttcaagtttccaatgagatcaaactctgcgtcaaaaaaaaaaaaaaaagagatcaaactcataattactatggcaattattttttgacagagaatttactatggcaattattaatccacaatataaacatatagtaaaatgtatgttaattaattatgggttgcgtgagatctaaagctattggttgagtaattgcttaatgcctacaaatcataaaaaatgctattcataaattttacttgttattaactaaagtaatactttttattataaacattttttttcactttttttgtctccttgaaattttaaactttttattaacataataattacattctatttatgtaaagatatttatttataaaaaaaa

SEQ ID NO: 162 - DNA, 1880 bp, Glycine max
  Soy_ogl_25 Gm17:5189601..5191480 Cluster 1
ttttataagaaacaaatattatcaatatgttcaaactcagttaattaaatatattttattcaattcttacgaataaaaacgataaaaaaaaatattttaatcatggacaaccaaggaagattacatataaaaaatatttatttgtatattttatcacctaagtattattattttacaaattttatcatccaaacttttccattagttttatcgtctaaatttttagtttttgtgcattttcctgatgttaacgaatcagtaaaaaatttaacgaaaaacaaaaaaattattttattttatttaaaaaattgaaacaacatcattttataaccatcatgacagtaaaatgtccaaaaaaatttaaaaaactgaagtgaaaattaaaaacatgtgtagcaaaattaaaaaaaaaaacaggtattaaaattagcaagatgatatatagatggtaaaatgtgtaataaagtaaaaaaaatatatatataatgaaaggttagaaggtacaactttacaagttttgtttgtctgacagagtaacaataaatggttcgattaaattgagtttaattggctgagaaaaaaaaattgagtttaattgctatatatattgatagttaattttttatattgttaataaatcacaattcattcatctaaattttttattttatacatttttatcaatgttaacttattcctaaaaaaaaataaaaaacaaacaaatttttttatttttttagtaaaaaattaaaagatatcgtttcctaaccatcatggtagtaaaatgtataaaaattaaaaaattgaagtgaaaattaaaatacttttgtagtaaaattcgtaaaaaaaaaacttaggtgttaaaatccgtaaaatcatgatatttagatagtaaaatgtgtaataaagtttaaaaattataaagaaaggttagaaggtacaactttacaagatttttgtttaacaaagcgacaataaatgatttaattaaattaagcttaattgctatacattgatagtgtgaagttttgtatattgttaatcaatcataattcattcataaaatgtgtgacttttacatattgtttggttctacggaagggatgggattttttttttaaaactgattcaaattttaggaaatgatgaaaggaaaatggaagggggcaaaattcatcttcatctatctttgctctcctctaatattggagacctggaggggagaggaagaggaatatgacttaaaacatttcaattgaaatgaacaaaatatgtctgcttatattttgaaattacaaattattaggatataaaagtaatttacaaaaaaaatatctttcctctctttgtgagtcaaataaaaaaaatcacttgtctccctccattacaatatcttttattcttcaattaactaaacataatgtccaatcaaaataagtatttattctttttttttcacatttagagattagaaccagaatatttagtcaaaactagaagccatgtaggaataggaacacaattgaacctatatcatgcttgtaggaaaaatgaactaaaccgtgtttgactaaggttttcgcagcttaattggtctctttaaaagtgtgttgccattagaggcatctccatgacaagaaaacttaaattgacaacataaaaagtctttagtgcttgttgttttaacacacgtgaaaggaaatatgcctttatccaaaatttccgattttccattattgaaaatgcaaggagttgaaaccagacaatttacactgcaactcacatgacccgatcttatgtgtgccagtttacttctacttataacttgttttaatcctcttaaaaatatgtttatatatttttttgactgaaaaatatgt

SEQ ID NO: 163 - DNA, 2500 bp, Glycine max
  Soy_ogl_5538 Gm17:5677901..5680400 Cluster 1
attctagttaaagtatcattttttaaaatgttaacttttagtttttttatattattcttttttttcctttaacatttattagatttttttaatctttaaggtaagtttttttttaccctttttttacatatgataggattttctcatttttatcttgatatacaataaaatatgtatttttgttgttgttttttttggatattttataaataaaaatctataagtgtttaaaattaattttaaaaaaattataaatactacataatatatttttatcaagaaaaacaaattagaatttatataaaaacattacataaatatatttatttttataattttatattttatatttatgacttaaaagataatttttaaatttttagttaattttatcaaaaataaccttaaaagtaaagtaatctggtaaactaaaattacacaattaaaacagtagggaatcaaattttttaaataaatcagtgaatcaaattcgcaaaatgataaaaataaaggaactaataatataattaaatctaattatttatagttaaattataaaatttaaaaagtacgaaacaaaagttaattacgtttttatttttttttttctagaattagaagtatttcttttataggaggtaatactttttaagttggtaacatctataatgtggtagaactaattctctcaatgagaacttttctgtataataaattcaaacttaaaaaaccaattatgctgttcttgatctataaaaagagacccactagcactcaaaaaagggacgaaaaaagagaggaggaagagccgagagtgaaaaaagaaaagggagagtactagttttttttttcctcactcatgcacctgtgtttttattagataaaccttttttttataaaaaaaaaaaaaaaaaccaacaactggataggaatttgatgtgggaacttcacgttttttctttgtcttttcatcatacccataatattaaagaagaaagaattaggtaatcagaatttaaaatagtagtaagattcaagaggcaataagcaatgctcataactgataagtggtcactgttaaaaaaggtagagtagtcatttgcttcttcttctacttttttttttttttttgagagggagtagtgatcgatttgcttgagagtcctaaaagtgaaacgcaatgtcctctctgaacatgcattattctcaaactagttattacttattactttgtacggggttttgggatcgttgagggtgatatatttcatgcccaaaatttggaataaatggacgattagatgcgggtcgtaataagtggttatggtcttaaaggattaagaggatgcttgtttggaactaaaatagtgcattttccataatcaaatttccaagaatattatagaataaatagacgattagatgtgggtcgtaataagtggttaaggtcttaaatgttattttcatgatcctgtttagttgaaatttagtgattttaaaaaacatttaatcaaaaaattgagaaaaaaaagtgaaaaataaatgtgaaataataaagtgaagagaggtagttattctagaaagtaatttttatttctaagagaatataagatacccagatttcatcatggatatgagaaatatggtaaatttgtacgcctaaaaatcaataatttctgtaactatttttttaaaaaaaattgtatcaaactgacacgaaaatgtgatatttttaagtttattttcccaaaaatcctttatgatacattgaaacaaatttgaattaattttaattttttttccatggatgcaagtttgatttctaaatttctcttgcatttggtgaactattttgaaagagatttcctagtgtttaatagctaattgagtagttgtgattggataaaattactttgcaatttagacatatgcaatgtacctatgagggagcctccattgacaactccttcatgtaatggggtctttattacttttttttttttatgtgaaccaactgctgttgaggtgtaaagatcatcaaagccgattttgcttgttccaaaaaagtctttttttcatatgattaagaattaaattcctaatcacaatatgtttaaaaaatctaactatttatcaattatattttacctattggtcaatgacgccttatttggtaatattgattaattttttcttttttttatgataaaaagtgataaaacagaaagagatttccaatatcaccaaataagacaccttttttttggtaatattaaacatgtctttctgcgtaagattttgagcaaaaatgttattaaaattacataatgtacaatatagcacacgcagctatatgtgtacctttacaattcttgtaacaaacgaacaacgtctaaactacatatcagtgttataattcattggataaattttattatagaataaatattttattttttgaaaatgaaaataataataatatataacagcaataataaga

SEQ ID NO: 164 - DNA, 2808 bp, Glycine max
  Soy_ogl_5610 Gm17:9611193..9614000 Cluster 1
gcattttttttatccacgcatttaagtttatatatatatatatatatgaaataagttaatattcttagttattcttatgcatgtctttttgaatgggttcaaaccacaccttgaacttgttttctttcaataggaaaaatatatgtctatatttactagtttaagggataaagattttttaaaaaaaaaaaattgagttcaagttatgtaaatgaaaaatacgacttcaaaaatacttggaacttaagaaataaataatcaatggtttataaataagattcacttacatgcacctagacatgttaaaactaattaccaaaaacagctttcatttatgaattaaaaataaaccttttactgaatagtagtgtaacattattaacatgaattagtggaacacccacttgatgcaggcagattttggaaactggttttagttattcgtaatggtagtcataggcatagctgaaattgcatttgtcacatggagtgtccgtcaagaattttttaccaccatccactccacatgcaaaaaatgagacaatggatcccatctctctctgtctctctcatatattactttcgttggtcaattcgcggtacatccttggcccaacgtgactgaatctttggcatcacttgtcaaattcaaccaaaatgaagaaagagactgctctaaacttaattaggatatataaattttaatttcatttttaattattacaatttaatttaatgtactaaagtttaagtataaatagatttttttctattagaaatacacatcatgtataacaatcgttaagatttaaaaatcagcatttctatggtccccttatcctttcaggttttggcatttgcaccagtctctctttctttagttttggacacgtgatctgaaataagactttttcttgctctataatattattaaaagtcagttaaaatataagatagtaacatttcacataattaaaacgatatacgtccaattcaatagtaattatcaagaaaatgttttgcattggaagctagcattttaaaaatatctatttcttggaaacaaatccttttttgttgaataatgccgtgtaaattcacacacaacttgtttatgagcattaaataaaaatcacgcttgtaaatttagatttgaacaatatttatacaatcaaacatgaaggttaacttaaaaatattaatttaataaaacaaaaaaaaattagtcgatcgtttaattagttgaatttaaatggatttgtaaaggactcaaataatttatatttgaacattatgcctagctagctgagctgagactcagtgtacatggtatgtttggatctcctggcacatgcatgctacgtaggtgaggaacaataaggcatgtctttttgtaacacaaggcgcatttcatgcctttatgattcattaagccttcaatcattttgttggttcagagtcgccattaacttgcctccgcgtgtaggttttacttaacggcggcacttcttgtgtctaatttataatatattttcttacagtactttcaccaattttcttatgaattaaagtaaactaacatctaataaatatggagttggtaatagtgtaaaattttgtttcctttgtgtaagaatgatttatttattaagaaaaaaaaaattgcatgtgagatttttttgaattagtcacaattaatatcgacccaataaattaaaaaatgcctatagtttcttgtccaaagaaaaaaattaataaaaaaattcacttatcataagattatttgtttttgaaataactacattgaaaattatattaaataatttttaattaattgacacaatatgatttttttatatagacaatttatgaaaattaaattcttcttatttattagataaagaaaaggttaaatatttctttatatttaagatattaaatgtatatatttttaatctaatactttcttttaaagattactagaaaagtattataagaagacataacattattatttgctttgtcactgggtcttgtccgaggataataactagatgttgttccttatgtagcttttgtgttatttttcaatttaactatgttcacataaaaaatcttgacatttcaaatcagttttaaatatttctttcattttaattaaaaatattataaaaacacaaaacacttatgctttgttcggtagaaagaaagaaaatagtggaagaagatatgagtcatttgatttaaaataaatagagtaaaaataaagttttgagattttttagtttgaaagaaaaaataagaaaataaatcagtacattaaaaaataccattttaaccttagttattttttttggtatcataacccaaataattgatcatattgaactgtataataaactatacgacagcatatatatcgattatacatgtatacataattgattatgttcaaacataatctattattaaagtaaagtaaaaatttatctctatgttttgtgtatcaaacgagcagaggtgatagatttatttttctacttctcttccattcatttttcgctggctatcccatgcgtaacaaacagaacattaaaaattacccgtaggtttcatcctgtctaatgaatgcactttggtacctaatttctataggcttttgtctttctccacctaattacagtccaagattggcaaaaagtgcctagtccagttcacatggacctttcatgttaaagtaatcgttagtgcatgtcacatggtcttgttagttacagttaacactgaatttgttagatacagtttgtc

SEQ ID NO: 165 - DNA, 1915 bp, Glycine max
  Soy_ogl_5795 Gm17:39672886..396300 Cluster 1
ttggagaaaattttttttaaccaagtattggtatgtgtcctatacatagattatatagataggagattatcgtaacataataaactataaagaaaaacattaaaaaaagaaagagaaaggcataaataaaaaattcgaggaaggctggaattataattttatcagcctaagcaataatttaggagaaaagcttttgggattttctggttcttgtggttatgccacgaatttatttgcggagctaacaactatgctgcaaggtctcaaacttgtttgtgagtctggtcttaaggatgttatttgtgagatagactctatggagctcattcgtctaattgctcaagataactctcattttcatccttatgctgctatcaaggaattcaaagtccatagttggaatatcctgttttctcacactctccgggagggtaatagctgcgccaatttgcttccaaagattgggtcgtcttcaacaacaccctagttaagtgggatactctcccacatcagcttaattctcctttatttattgatgccttaagagtctcttttcctagattgtagtcttttctatgttttcttacccaaaaaaaaaaaaaagatagtagatatcaaactcatcaccaaggtaaactataataattaagtcattaagtcaaggtaaagtgaccaaaatctaagttgggaagctaccaatagtatttaagttatggttgccttgacaattttccatttttatatataagataatttttactttattatttgtttatttttgtgagactttattctaaaaatttgttgtattaattatttttatcctaaaatatcaataattaattagagtattctctccataaatattagttattttttagtgagaaacaattagatggagagagaaatacacaataattttgaaaaaaaatagtataggtgattgataaatataatataattaattatttattttaaagaatgtgaattaatcgaaagaatttgatatatatatgaatggaggtaatattttgattttaactttgtaagtattgagcaagcttttggccaaatagtgagtaatgacaaatcattttttctcacaggttctatactattcaggagcagagatgctgtcctctttggctaatcttcttgaattcccagctgtagtgttccctataactaattgggagtcattatttttaaatgtaaatcacgtaaagtgcaccaccaacctattgttgaatgttcatcgtatcaaatccaaccatgccaattggaaaggtcgtttgcaatctgtcatggtcatattcagttggttgatacaattattcaatatatgctatattgatgcctttgcttgctacttttttccttaaaaaaattatcacgcctaataatttgtaattgaacaatgatgcatgttgggattttggtgaaaatatcaaattgcataagtaacaaagggataagtaagcatggtcttcgtgtagactcgtgcgtaagaacggatccaagaaggcatcaaaggaggattggaaaaaaaaatgcacaattatttaaatacgtaacttctaataaataaaaatttttattgttaattttatgaataaattaaagataaaatctactattaaaaagaaaattaaacaaagattaactcaatactctgttttttcatcaatatttttttctttttttctctcaagtatataaaaaggatcttgaggccttgcccccctaaattcgtcaatgcttgtgcacaattgggtaattaatagtataatttttaaactatgaatattgagagaattaaattaaagtaactaaataataatttgcatgaagataaagaaattaagggacaaaataaaagaaattaaaataagaattaagaaagacactttagttt

SEQ ID NO: 166 - DNA, 2079 bp, Glycine max
  Soy_ogl_5800 Gm17:39745627..39747705 Cluster 1
tttatatattcaatattttttaatttataaattttgataatttgaaaaattaattactcttgtcacttaaaaaataatattaatatagttaattaaacaaactaagtgcattaatgatttattattttatttataaataaagagttataagttgaatttctattaaaatattttttatttccacttcatttaaccttttaaaaaataagaaaaacaaaatcacaggatttaaaattataaaagatgaaaattacaatttaatgtttttatctgtagctttaatggtagattttaggagcggtatctaataatagtcttttttggtgcctaacacctagctatatattggggaaatagactgaagaatggtgcaccaagtgtaagttaagctgcaagtgcaaaatcatgtccttccctatagatgtgagaaccctgaattgcatttgagaagtaatgttggatacagttttttcattgcttcaaatctgccaaggatccaattttatgcttttgaaagcttgcgcccctaaaatggtgtccgtttcaagcacaaatcgcctccatcccttccaagcagctatttgaatgcccatcatactcatgcttgcttcatcaacttctgccaagggacgattagtagttagttttgaaaacatattacaaaatttattttgactcaatttttatttttttttgcattttaatatacatgtagataataattaattttaatatcctcacactttaaatattcatatttaaatttttctttttcattttatttaaacacaaacattatatttgaactataaaaaaaacttaacaatagggacaaaacaatttgcaagtaatttttaaatattcatcattagaattttagtgacgaaagtcattattactagtgaaatttttgtctctaatgtcactaaattagaatatataattgatttaactatattgtaattatgaatcttgcctaatctttacaatgcaactcggttctggatttgtcttaatttggagatgaggcactcgcattttcatatcttcgtatatctcaagaaaatttcttaactcttaatcttttgggattaatttatgttttatgtaatttatcaacatgtttgattgattattacaacacacacttagtaaatatggcttataaatagaatcgttgattatccaatatatcttcgtggtgatgtaatatttagagtaattaggaaaatttcgttgtgggtcaatatccaaaccaattatcatttgtttgtattagatgcttacaaaagaatcctcacttgctttaataatattccctggccacttgcatcttaactttataagaaataaaagtattctaacttttttccgttccacatatcctacaattaatgaaaagggaacaatgaattgaaagtttgtaaaaattattcaatttaaagaaaaaaaatataacaaaatcaaaatttcgtgtctcaacacaaacataatggaattacaattttattttgtttatgcaaaaaattgtgattctattttgtcccccaacaaaacaaaatcatgattcccttggatccaaattaggaagaaaaaaatgcaccttgctccacgaatgaatgcaaacgaagatcacgttgttgaatgaggtgtgatacaaaatttagaagggagaagggaggtgagggacgaagggaaaggcaggggtgtgcagagaaataagggagggtaaaatggtttcttaacattttttaaagccaagggtgagaatagcaacccttctctttaagcctagcgcctgattttgagaaggaaaggaggctcatttattccaaaggtgaaataaagcgagtgttatttatttatttggacctttttaaaaatattttatcctattaattaatttaatgttaattttaagctctcttttctcctgtatcatatattacgtagaaataaaagattaaatcaaactaagttttcaaataaagtattctttttttaaaattttaaaaccaaatcacaaaaatctcgaaaagaaaacaaaagaaggttggattagatcatactaataaagaa

SEQ ID NO: 167 - DNA, 2300 bp, Glycine max
  Soy_ogl_5836 Gm17:41338301..41340600 Cluster 1
ttatactttatgtaataaataattatgtttttctaattcaattgatatttaaagtcatggttcatacttttcaatttgagtgttaatgtaataattaaagatgtgtcatattaattttatcagtgaagaacattttaacaaaaatggtaaaatataattataattttgatttgtaaatttgatgtgaattcttttatgttaaagacaatattattcatgtgcttttaaataatattttgattttgaattaatttataaatctcatattgttgtgtagaaaaatgatattaaattcaacatgtattatattatatttgtttcattctatttaacaacattgaattattatttacttttatgtataaatttatgattttgttaatagattttggaaaatattatcatgatatccaaatttaattagattttgtcaagctattacaacattaacgataaaaatcattatgctatgattatctttgtaacatattaacggtattagaaggcgttcccaaactctatttattatcatccctaactcaaatttatactagtgtgattaacggatttatatacctatttttactcgtgaggtacatgcatatttatatctaaattcattatccatatttaattaactgcgattccttagtattatatttacttaataaatccataaaacatgaatataaatatattaatatttttcactgaaaaacatgaatattattataatactaacacttatgatgaaaaaataataaaaatgtattgattaaaagtataatatataatttaattcttcattataaaaccattacaaatagaattaacaaacatcatttcaaaaattatttaaaagatttcaaatttaaatgataaaaatttgatcatattatccaaatataagtcgggtcagttacgtatattgtagtactcacttgtgtacttaaagtttttggttttgtaagtaattaataatcatccataaatggaaaaaaatcccgattgatggatgataaaaatcattctcatgaattattatgagtcatttttacggatacccattaatttaagtgtgactgtcatacttatttccgaatgtagtgagttggagtcagtggctgagcttgaccataatttttgggagcaaaatattaaaaaatattcataaattaaaaatttaaaataacataattatatatatttttttggtgaaaacataattctataactcaaaaccgaaaataataagaaagtgatttaagaattataaggttgattagatgataacaaaaaaaaaagaataaagactgcgggtccgcgttaagaaaaaaatattaataattaaaaactaatatttatcaataaaaaaataagaaatatttaaaaaatatcaacacatattaaactaatttaacagataaaagctatttcaactaattacaataaaagacaattaaaaaatgatataaaataatatatgtaacaattaaaaatttaaaatacataatttttaagtataaaaattaagataaaatttgtataattataatgcttaaatgagtaactaaatcttaagataataatattatatgagaagttatgttacttctgggcatatatgataaataaaaccaaaagaaaaatttattaacttaaatctagtccttttctgtttaaaaccctttaaaataggtgacataatatccttaaagattctccccattatttattttaatttttataattgattaacaatgaggatttgtctttataaattatataaaactattttttactgcttttgtctttcaagtttaagttgttatctctcaaatccacggctaatagttacgtacgagaatatgacaacactaatccttaaaaaaatctagttcatttttccctcgaattgttacattacccaatgcaaccagtgtcacccatgttcttgttccaacttgttcgagcattttttggtgttatgaccaatttttcatttctttgtttgactgctatctgtttacgttatcaattaattataaaaaatgttagcattatagtatttttaattattagtaaaaaaattatacaaatcttattaaatatacatttaataggttttaattataacaaccactaccgtacgtgcatgataaaattgaacgaaggctcccataaattaaactcgtaaaatgtcataatagatgtggacaattcaattggggagtagggtttaagttttttcttcttctttttttcatgtcacggcgttaaaatattcggctactgaaaaa

SEQ ID NO: 168 - DNA, 2700 bp, Glycine max
  Soy_ogl_5880 Gm18:1994901..1997600 Cluster 1
tacatacacacatgacatggaaaaaccaagctatataataaagtttcgtacaagcttcttggcactgtcgttttcgtggcatctgaggggaccaaaaagactactttctttgtcccaccgaatataactcgctgagattttctggggaaacaaacgatctgcataattttctgatgaagaaagttaaaaggaagagaatctgcagttggaagatctctcagctcacgaatctctaatgttgatggcttgcttttcacactaacactaaagttcgtgtgtgtttgtgatcaattaattaatgttgagttttaatcaatggagtatcagtttatatatatttatgacagcagcactaaactttaagaaaatatataccactgaattgtacaatcaatcagcatgacggcatctgtatatgatgcaaatgatagtacaatttatttattttatattaaaaatgatttctgattaactaatattataaagaacttttatactaatgtatttctattaaactatttttaataatgtcttaaagtttcaaaaacattttcgaccattcagtttgaatgattctttttagaaaataaactgagtattttaactatacatgttactgctacattggtttataaagatgttcaattatagcaaaggtagaatatttgttggatattttgagagtgtttaatttaaaagttctttttgatattttgaatttcatgcatatttctaattgcttttaatagagaatacattcgtccctgccaaaaaaaaaaatataagagtgtccagaattgaatcaaattgttttaagtcatcaacccaattaaaaaaacacaacaagaaatcaatcaattgacaatcgaaaaatccgaaaataaaaaaccatatttttattgtactttgtttcaggttttggttcctattattaaaaactaaaccaaacaaaattcctaggtcccacctttaacatacctatattatattgatttatagcattatcttcttgaagtatcttaaacttttgataatgataatttgtgattctatgtgtgttggatatgttggttaagttaaagtatgagttaacgacactaagagtatatgactagttggctataaataatttataatatattttcttataagagatttgtaatgaaatacataattttgggtgttcttttattattctattattttttaggagtaacttatgtaaatattgtttttaaaaagttaatatttactcaattcttgacgttaattatggagaagccatatgtatgtgacctatttcaagagtgagcataaatatctgtttaggatttcaattgttcatttgttctggagttttgaatgttaattatatgcttgtgttggtgagattcaatgttaaaatgtagttttcatccgtttgtttatccatttatatgcgtgtttattcactgtctcccttatgttttttaatcaaagcttctgcagaagtatcccacctgaaaggtaaaaagaatagtgcttgctaccagtaccagtatcctagttgtgcttgctaccggtgcttgtctaccttttcaacttaatcatattatagtatagctctagctagttttgcagtttattatttactgtagtctacccttttattgtaaagatttctacgttgaaaattttgtagtgaatgatacaaatataatgaatatatgatgaaacttagaaaaggcttgagatttattggacaaaatatagatgcagtttcacaaatatttttagtgttatttttttcaatcagaatgaaagtattttgataatatgcataataaaggtttaagttttcttttaaatgtcaacttgaattattgaggtgaaattttaattttgattgaaaaattgtattttaagttttgtctttttcttgaaaacacagtgcaatttatattgttattttcatttctgtgttcttctaagttctaaacccaatttcaaaggggagaatctgcaactgaaccaaatgattaaactaaaaaaacaagctagaaaagaaaagtaaagaaaaaaagagattgttttactagtcccctcctatgtagttgaaaccagtctgctgttccattcctaagttacttttcatataaagatgtgataatatttgactttcaccttcttgatggcccatggaccacttcttattagtggctagtgcgcatgaattgtattcttaagtcctttgtcccctttcttctattatgccttttcccagctgcactttctgctttatttttaatcaattccattccttttcgtatataagttttctccctgctgacatttattcttccatatgaaaaagttgtttgaatcctctatgatgtgtccttttttatttttatttttaatttgggtatctcttttacattaaattgaaaaattctttattcaccaaaagggaaggggggatgcataggtgtatacagatgttggatgtttactagggttatattagatactcatatggctgttcatcttaaaaaaagaaatccaaagtcagagttctaagccacttgtcaattgtcataacccaaaattcttccttcccaactgtaatattcgactatacttttctaaaagctataatcataacgcattttagcctttactccaatcctactttgttacttccacattgttaatggcaat

SEQ ID NO: 169 - DNA, 2379 bp, Glycine max
  Soy_ogl_5898 Gm18:2417622..2420000 Cluster 1
taaccaatgtgaaatcatgaaaaattagaaacaactttatgttactttgtcctaaacgtgtaaaatttgaattgatattttacaacagtgaaagcaaactaagcagcatgatcatatcaaatgattccaatttattaataatttctgagacgagaaaagccttagagcaattccattttgctatatatatttggcttattttttcaagttatttccttcatttcaaaatatataagtatttttttaagatttttccacaaaaataaaaaataacttaattagtggaacaagtttacttcaattattgaaacataaaagtatatgtaaagtacccaaaaggataagaaaaatatctctgtatatcatactttaggatctttcacttgaaaaataacgcatcatttaaatatatctccttttgaatatcacttaactatatattaggtttttctttctgatatattgttttttaattgaaagaatatacaaagaaacatacaaaggaatgaggaaattggattcacaagtaatgcaatttgttcataattattttaatttttagtatgagtatttaaataacttaaagtctgagattattttaaaatacattgatgatgtaactggttaacaaactcaataaactcatacttaaacaaataaatatatgtatgttaacaaatatttatagaatttattaatatacacacatttgttttataatgctagtatcttaacaaattataagtagatattttcttaaaatatattattaataatataatttgctacatgtaatcctccaattcaacatatactcttacctctctatgcactaataacataattatttttttacaagtctctttaagcttcacatactcaagtatgataagaaaaaaaattattaggacccgtcgttgttggcacatcataaaaaatatttttttagtaatgtaaaaattatcttaattgcatatctactgtgtagtggtgtgaagaaaatcatgatcattttgattatgaatgtaaaattatttggtatcacattagtgttttcatgttttttacacaattttgggaggttcattgtgcaaccaaacgtgttgatttttaggcatcatctcaaactctactaaaaatgatattcatagcgcatgttcagtctataacggtgcggtgaaagaaaattatgtacattttttttattgatgagaattaaagatagtactaaaagatttataataactcaagtatttaactcaattaacttacacatccatgacaaattgtgtccattttgactttgaatgtaaagttatttgatatcacatcaatgtttccttaattttttatgcagtttttgggggtttattgtgcaaccaaacatgttcattattacacatcatcaacaacctctattaaaaattataataattgtgtatgttcggtgtagcggtgcgatgaaagaaaattgtatccattttgacttggaatgtaaagttatttgtatgcaataatattggcaggtttatcacgcaaccaaacatgttcattacacatcatccataagttctattaaaattgaaattattaactgcgcatgttcgatgatgcagtggtggggtgaaagaaaatcgtgtccatttaaactttgaatgtaaaactatttgatattacataagtgtttccatttttttaacgtgattttgggaagctctttgcacaaccaaacatgctgattattacacatcatgaacaagctctaaaccattaaatgtcacaacatttgcctagagacaataataatggccaacaataagagggaaggactattgataaattaactgagctgtgttcacaatgaaaactccaaaccttgtgagaaatacaagatgccgaatttaagtcagtgatgaccttcctatggaaaaggttcaacctagcaggatgtttagccaactctagatgctaagaaaatgcaaggtccttgtaaggagaacaacatctccaaaaaaaaaaaaaaaaaactcaagagagctaaataggagctatataaccatctcacccatagagacgtgcttattatcggacaataaggacagccttggaaaaagctctttaaagctttattcacccatccaacaatcatgccaaaggaaatgtttgactcgttcctcacccttttagataacttgtggaaataagatgaattatcatcatcaatacaacataaatcttgccaacaaaaaaaatgaatttttcgacacccattaatcaacttgacaaatagagtttaaatttacatagctggacaataataaaggacatacgatcatgaatcgaacttgatgtgtggtgtggcactagcagttcaggatc

SEQ ID NO: 170 - DNA, 2300 bp, Glycine max
  Soy_ogl_6286 Gm18:59822701..59825000 Cluster 1
actcactaagaatgattagaactcacaagaatagatatattctaacccttctttagcattaaatattatttggaaatgagattatgacttactcaagaatagaatatgtttagaattaattattttattaataataaattttctcatctttatttcacggactagacaatttatccttgaaatattctcaggcatctttttattcctaggaaaataacattctatgcttattttaattttgtattgatttgattttcataaaaaaaataatataagaatttaaatttttatgtgatggaaattaaatttattatgtaaaaacattattatactctagttaataatgcccactacccattctctctctctctctaccttcctcattaccaattctattattttgttattgtacaaaaatgatgcacaaggtacaaaacatattcaattgttttaattttaacggggattaatgttgaagcccgtggaggttctgagactcagttaccaacttcaaaaaataaaaacaaaaacgaatgaaattaatgcatcttgtgcagacctacaagtctattgcttgtagagcctcagttctcttcagaggtcagaatcagacatcaatgctcatttgttttctagttctttacaactttattattctattcttatcactgagagaagggaaaataaatatataaaaaatccacatgatgattgagtacacgtgtggcaggtctatccacgtgcacctgtttgtattctttgaatcgatgcgtttgtcgcttatttctttcctccaaagccagtgaaaatgtgaaatctatttcttttccatttttcctttgggtctccttgcagtaactttaatttatcaccacacattataagacgacaaatgttttataacttttataaatatttattttataatttataagataataaaaaataaaattttaatatcttaaaagtataattttttttatatttaataggttagagaaataataaaataccataaaaagttgaacttaacacatattttagttaagatctttttttatttttaaaataattatcataaaaataagtaattttatatgtaacaatatattatgcctttaaaatttaagttataataaaattaatatcaaaataaattattagaaattaccttaaagtgttggaatatgtttatttaattaattgagtagaaattattcataattgaattagaaccaaaagttattctctcttttaatataaactatcatgttgttttttttaaaactaagctttgatcttgtttttcaaccttcgatatttcctttactaaaaaatttaagatatttcaattgtagtagtagctagaaattagaagagtcgtgataaaatatagtagtttgttattcaagtactaaatttgtgactttttttaagctaccaaacatgtgcacaattttagtaattgataaattcttcaaggtttattatctttatattcttaaaattttacaaaaatgagtattgtacggccaatatatagtggataaaaatcacctatcccactaactcactactactagctaatctcttccaattataaatacatggatacattataggtaaaaaaaaattatttttcaatgatatgtgagcattgattattcatttattaacttaaatatcaaagtgtctttttgtaggtatttatccttgttaaaaaaaaatcgacatactgaataggagaggtactggagaacactaaaaaatttaataaagaacaaatatatatataaggaaatgttaaggttaatattgcaaattaatcttgttatgaaaattaatgggataatgtttttctaaaagattgcaaacattatcgataatgttaaaagttttataagtattcgtaggagccaaaacaaaacttagagttaactttattgcttgacaattaaattaatatgctattcaactcttttaattatgcatgaaacataaagaaacccttaacaggaagatattaggtgccaccgaaacagaagttattttatcccttttcaagaagatatcaacaaaaatgaaacacctaattatcctcaaaatatttaagtacttaattctctattttatttttcaaattctaaaaagatattattattttaattagtcaatctcaacaaatttgattatccaatccagaccaacacaattaacgttgagatggattgtttaacaaaaaataatgaacacaatctaaccagtaaccaaattatgtttcactaagtttaatctcacat

SEQ ID NO: 171 - DNA, 2541 bp, Glycine max
  Soy_ogl_6560 Gm19:44361660..44364200 Cluster 1
aatgtccaccaaagtaaactcaacttcaatggttatctaaggaagttattaattttcagaaataagctcaaccacttaaatggttaaatgatttttatattattattagataatttttttctcatattattgtgtatattgaaatatatttgagttctttgttgttatgtttatttttgtgaccaatggaacataattaattaaggaaaaaaaatgtttttaggccatatacttttataaaatcttatttttaattcttgtagttttatatcatctaatttagtttttatattttacaaaatacttatttttagtcatttctcatgattttaacgttatttcctacatcataaataaattataatgtttatttattacacgaattcatggaaataatatttaagaaataaataaaataagaagacacaaaaacaaatctgcaacaattgttaataatggtgatgaaaataaacacaaaaataaatcctttaaaagttttagttaaatatgttcagggaagacatattgacaactttttttaaaaaaataatctttttaataaaaaaatatactctatttgatatgtgaaacaaaagttaatgtaatttttaaacattcgatgaagaggaactaaaaataagttttctataaaatataagtattaaatttgatgatatgaaatttcgaacaccaaaaataaaatttgaccaaagtatgggaccgaagacatattcttatggttaatgaattatgaagacactaatgttatacagtgaaaccctcaactacaagaatagccttgtttagagttgaaaggctattgttaactttgacatcgacacgacatagtcacaacatttggatttttattttattttatttttgaattcataaattcataacgtggactcgggcaacactaagctagatatttaagttagcatccgctttgtgtaataaattttgtaattagtgtcgcactgctgccactgtgacaacttcatccgctaatagagggaagggtgtcaccgcaatcgtcgttgtttgttccactcagcatgcctttaggtgtgaaggcaacttcaatagcatcagatttagctttttatgtgattgggttctatggactgggatagatatgttatttttttgtctctgattactgtttatgatcggggataaaattctgttcttacctctgtctttacactctgaaaattattatatatttgtatatattttttttctaattttgaaactaaaattaattttaaatttaaataagccataaaaatgtaataattcataacataaactcaatctattacaataaaaaaaaatgtcaagtctcatgaaaggaggaaataaataaagaaaatataattaatatatcattaaagaatggggtgagtaattacatacttgttcccgttttaaataggtcaagactgaccaacaataagtaagatgtaaaacaaattttaagagaattacttttactttaaatgagagaattatgtatttgattttttgctaagatatgtgacatctcttttaataaaggtgagatttttttctcttttaaaaactggcgacaaatgttttttattaatgggtctataacatgagttttaactattttatcctagattctatcttgagtcggctaatacccatactcagtcaaagtaataatttgtcaaaattaaaaccagtattccggtatatgcacgtggatatgagaatatttgtgatccctatatgttggtgcatcattgacttatccagtgtgtattgacttaagggttgcactagtataattttttcaattgtgctaattttcctgttgattttgcttaaaaattcgtaggaacacatttcttgtgaattttaatccacatgtaatttttctgtggataataagtttctgtgaattatttttcacaaaaagatgacctgcagattttcttgtggatttataatctccaagaaatttttggtcaacttatttgcaggaaattttctgtggattttaaatttgttggaaatttcgtaggtgacttttcagccaattttaattttgcaagaaattttgcaattaatttttctagaaataaaaaattatttatttcaaaatttgtcaaaatattcatataaattattaccttttattgtagtttttttaattatattgtttttgttttccgtgaaatattaataaatacgtcaatcaatcaaaaatcctgagctatggaggcgctcttctggcagaacaggggtatgggtctatcaaggtatcaatctgaactatggaaattatttggtgtgctgttatttcatgtgtgtggtagacagtgcggacagacatactttgatggaagatagtcgttttgtaacttggtcctgccttgctaatttttccctggatttcacaactcgtatcaccaatgggcatacagggaacacaggtgcgtgtatcacagcttcaaagaaaggtttgaaactctcattgatgactttctcattcttacatgtttggtg

SEQ ID NO: 172 - DNA, 2600 bp, Glycine max
  Soy_ogl_6784 Gm20:36231601..36234200 Cluster 1
tttgtatataaatttacttaattatctttctcttttattcatttttcaattaattccatttttcatcaggataccttttttcttccataaaatttatttccctctatttctctaacctctctcttccgaaaacaattttttttcaattcttttgttcattgttgaactccttttgtttttccagaaatataatttttaaatttaaatttatgagtcatgctcgtatactagattaggcattgtttttatgaagaagaaaaggaagaaaaataaatttgtaatgaaataaaataaaaaatactggaaattagttttcaaagatagatacatagaatgaaaaataaaaaacagagacgagcaaagattgaggtaaaagaggaatgatatagaaaacaactgtacgtgtatataggttactatgaaaaaaatacacgtgcattgtaaaaacaccttcacacaagtaaccaatagtgttttgtcacgtgaattggtaagaaccaaaaaatttcatatataaaagtgtacatgtggtgttgagctctatttaatcaatacttcaatagcaaaaataattatgcagatcagatgatacttcataatcctattaaccttttgtatgaaactcgctcggagactatgatgactatcaaattaaaattgtagaagaaacagtatttgaggaagtatatatacttatatcaaacagagatatatatgcaataattctttatttgttactttgcataattaatcggtttaagttagtgtttaatatgcctttataaaaaaatgttactgtttaatataattaaaaagaaatatctgcttgaggaatatttattactgcatcatcgttaaatgtctaccttagataaattatttacagccagtaaaataaatgtttatggatgcattggtgaccttaaccataaacgaattaatgacatttaattgaaataagtaggcataactgaattgtattggcctcaaaattctctgattaccaaatgcagtgacacaccctttccccgtaaggatgataaacacataatcttctttccagcaaaagcaagccctaataaatcatatcaaatcgagccactagttgataaaaccgtgttatctgtattttcgttaaaaagagaaaataaaggtcattaagcacatagcaattgacgatgaacctaaactgtctggcatagactctaaatctattaaatctcatattcgtcttatttgacttaataaccgtttggttttgccatttggccaaatatagttattcaatttaattaatccctggatagaatttggttcatatgattgaatgaacaaatgggtgtttttatttttgatcatcgcctccgtcccaaacaagccattgcccgtggcaacttagtagaggttggaaaagtaagcaaaaagttgaagattatgtcattgctttcctgataaattcactctttcactgtaagtttgcatgctcgttcttaaaacttaactgaaagtaaggatagtttatatttgagttctctttctcgtgtagaaagatgtattttattttttattttgtgatacatatctttacctttcatatcaaattaacattctttttattaattaaatagtaatttaataaaagaagttttctttctttaattttttagttaatgcttgttttttttaattcaatgataataaacataatgatatatttgaaaaattacatataaaatattcctttatcaattaaatcaacttttaagatattttaaaacaaaattttacctacatatacttttacctttttaatctgcattttattattaaatctattttattttaaatttgtgtaaattattgttgagttaatatcaaagtatttaatggctgttttaataaaattcaattggtagaaggaatcattaaaggaaaaattgctcttaaaataactttgatttctctcatatttattaattcaattcaattaaccatttttaaaatttccatttttagtattttatttacatttaagaatgctcccaaatatacctatttaattaatatgacgttggaccttaagtaacatatcaattccatacatcatataaagacagacataatatcaaccagtttgtttaaatttatttattaaaatagatattatttattaacataaactagccccgtaaataagtgtctattctaataaaataaatgattttatatttttttagtgtgtttatctaaattattttttctttaaaaaataaattttttagcccttaaaatatagtttaaaccactctttaatttctctttaaaaaaaacactctttaacttaaaatctattaaaggagttaataatctgatcaaaatatatataaatgtaaactacaaacaaaattatcctaatcgaagagtcaaaggttaaatacactaaaaatttgaaagaaaaaaaaacattgtatttgactaaattttaagaatttagtttttaatattatgaaaatataaaatattacattatttttatttaattttatttaatatatgctttaaattaaaataacatcattttatttagttattatcgttaa

SEQ ID NO: 173 - DNA, 1653 bp, Glycine max
  Soy_ogl_255 Gm01:50708148..50709800 Cluster 1
gatttgttaaataatgtagaacaactgtgagttttttaaaaattcatgtgatttttcattaagttttaaattaaatatgcaatctagatttaattttcttaaacccttttctataatactttctctcataagatattttctcacttcctctctatatatagagagaatttagaccataaacaatataaatccgtgtttctaaaaacactgataatatattttaaaaaaaagagacgaatttttctttgcctggttgattgtttgtaacagttggaatcctatctaaaggatttttaagacataaattattgactatatttggttgtagctaaatattacaaattgttgagttaattaacatttatgcctcagttatatttcggtctaattaaaattttcaagacatatatctatatttatttgagtttaaacaaacttttgaataagaactcataagaaaataaaataataaataaataaatgtaaaatatttttttatcataaattaaaatcagtttatgtacttcatttttataaaaaaaattcttcctcttgtagcatcttttctagttgaaaaatataagttgattttgatttataaaaaagtatgattgattattatatttttatttataaatatttaataaaaaattatccaaattaattcttataagtgttgtgtttctataaattcaaatctaagcggagatagccatattatactgtagggattaacaaattatatttgaacgggtttcccagctttgtggtaaacagaatatgggaatataactaccaagtaccaaccgatggtcgtttttgtatacaggcttacaagaattttgggtggcaacatcaccttattttctcatggaaaaatagcacatgcgtgtaccctaactgcctatgctattaaaagaaaattgctagcttctttcctttggcacgtatacggaaacatgttttcaactattaattatcatgtccatcataaaggtttttttttttatgatgaccatcataaagatattttagaacttaaacaaagttaaaaaaatataaattagataaagtatttaagaacacatttctaaattataaaaaaattaattcagataaattttaacagcatgcattaaatataaatcattttaaattataaaaaagtaatatacataattaacagtggcatgattaattatttaataaaattaaattaaatattaagacaagagtaaatactttttttgaaagattaaataattttttttaaattactataagagtgaataaagtattcatgatctcaatgtaaacctttttaatgaatcttaatatcttaaaagattaattaacctttcactcttgatcgaaaaatatctaaagttaaaaaacgtactaatccaaaaaaagataatcataaccttagagagtttttttaaaatcattaaatacttttgaaaaaaaaacagattaattttttattttttttcttttaaagtttataggtaccatccatcgagaccatcctgctaaaattatataggattactataaatgatagaacacaatttaagataattgtaaacttaagatttatactcgaattattagttaaggtagaacaatcgcatgtttattgatagattaatt

SEQ ID NO: 174 - DNA, 2000 bp, Glycine max
  Soy_ogl_2173 Gm07:4053301..4055300 Cluster 1
tggtccaacagatgcgtataataatgccatacccagatgtgaccctataaataaattattgcactcaacaattttctttctttaattaatattggcccccagcgtggatcataattcatgacatatgcatgggacatatgcgcaaattgatacctaactatctcaaagatagcctaatattgtttgaagaattataattagcatgcaccatgcaaatatatcatttgagatatagatatttacaacaaattaaactcattgttacaaatgtcttgtcgtacatgtttttttttatatataaatgtataaaattaattataaattattagcattttaattaattaagtaattaattctccttgttattttgttctgtttattttctttatttaaaaatatttttttgctccatgcaaaagaaattatttctaaataaagaaaataaatagagtaaactacaggagaattaataactactcaataaattttgagatgaaatttatatgacaaatgaagatcaaatatcaaaaccaaaaattatatactgtacataacttagattaatttgtatgaagtctaccccattaaactttaaagccacctagggaatgaataaaccaaaggagatagcgaagaagaggaggaacacgagaagaaagaaatgggatcccttggttctgtttttattggatgtcattggggatctgaatccaaatccaaatggaacgaaagagtgtatgaagtacgtgtgaatgaatgtgtatgctttccttttctctcttctgttatgaatttgggatgttatttttgtttggggttgaggtgtgagtttgggtttctggggtcatcttggtgggtggccatgacttctgttcttttcttttttctttttctttttggttttgttagtttcagtataaaaaagaaaaagaaaaacatttactgttggttttaaattgtcagaaagtttaaaacaagggtttgaaactataatagtattaacttcaatttagataacaatgatttaattgaagcacatttaaaaattataagacctaattgaaacatttaataattagaaggtcaagttaaacttcaaaaataaattaaaggataaaacattaatttaactttaaattttaccttcaaatcaaaccaatctaacctaaaaataactttataacatgaatttctagatatttaattgttcaatcaactaacttgagagagaggaaaaaaagaataatatatgtcattcttttcattcatcgatctaaatctaggatcaaatagtatagttgtatccaattaataatttcataactcactcggcaattcttctataatttatcgcaatatatttatttaatgttatgtaataaatttctgtcctatcttttctattcataaatttctgtcctatgcattcaaaaaataaatttctgtcctatcataaacgcattttactacttagatatcacttggaggacaaaattaaaatgtaatatactcttttacattatttttcaattaaaattaaattttcacattgatgatgtatatacaaccaaccgtcttaaagctttgataggtgagagtgagacctagattgtagaacaactttatcaagactgaaattgttcggcatattttaaacatggaaaagtctacagcagccaaccatacaaaagggggaaaatatatatttagaaaaccgaaagaaattaaggatatttttttttttatttttggatttaatattttttgtttagttcttaaacaaaattttgggtttaatattttttgtttagctcttcttaaacagttttaatcattttatctggtaacaacattaattaataagtaatgacataacaatccatgtttataatctaatgactagttatgttatcaaggagtttaataaaatagttatatgtattttttataatatgtgtctgtaatctctatctaacctgatgtcatcaattagtctgaac

SEQ ID NO: 175 - DNA, 1859 bp, Glycine max
  Soy_ogl_3479 Gm10:40751601..40753459 Cluster 1
gaatacatttaatgagaaaatattctaaaacacaaaaaaaaaagccaattattagtttcttacggacgtgataaataatttcgattcccgaattcaaacacatgtttagtaactacattttaaaataaatagtttttaaaaattctctcgaaaatgtatactattttccccttctaaataaattatctttctttagcgtatgtatatgtggagtggacatgcatgagaaaaatattttttaacgaaaaagagaggaaatgcatgagaaaaaccctaatccctaaacagctatatatcaattgtaaaaaatttaaaaataaattaaagtcacataaaatttaaaactaacactacttttgcaaaactcgctattttaatgttgactatttataataagatttttttttctcttgtataaaaaaatcaattatcaatgatttttacaagaaaattcaaggaaatggtacttaattattgacactgcgagaattcattaatggactcaacaaattgaataaccttttttttttttacattcataactcaagataattgacttcaacaaattgaattatttaattataaaattcaataataaaaaaaaagattatagtgatagtgttgagtcatcatgtaaaccaacctagctgagcttaattctgttgaaaacccaacatatttatttgcagggtttaaagtttaaacaacttataggcaatgacgtagtgaattaaagaataaaatagtcaaatactccatgcttgaatataaaatttaatgtttgagtttatgtaatgcatggtgtaaaatatatttttaatttaatatataattataattattatatttatagctaccagatatacgatgggtcagcatgagaaccagtgaaccacctaaactttagaacgaatgaaaaatatttggtttcatataacgactattatcgtgcaacattttattatactagcaagtagcaaatgtaattttattccaccaaatagtaatgtactaactcacagtggtactaatatgacgtaagtaaataaagatagacctgtaaggatgatgcaacgcttgataactttggtataaaatcatttgttcgagtaatattcaactaacattactcaccattcacgagaaccttgatctaccacttccaattaatttttcttcaatcatttcatcaatttattgtatttttatgtacgcgcgtgctattatgcctcgtttgcctctgacttctcttgattattgttttttttttaaaatttagatcattattcatactcttcgcaacaactagctaaggtcattctcattatttctaacgtgaacaattcctcacatgcgtataatattcatatatttatatataagtacgactgattaaaattttgaaataacattaaaatagttttaaaataaattttgtttttttgacagataaaataaatgttaattagttgtattaaatatatatctgatcagaattccttcataagcacatgattttttcttataaatacaaaaaataaaaataaagcagccgccttagtactttgtacttacgtactatatatttgtcgttattctatcgcggaatacaaataaacctcccctaaccctatcccagtgacacatcgagagtttggaatatcttgttagaccgaaaagcttctcatcaaattcaattaccaataaagccaaccatctttatttgatttaggtaattttatagtaaaaatatttattacttatttttttggtgaaataaaaaatacttttctaattagtttttggagagaaaaaacataatttttagatttatacaagaattgaatttaaactttagg

SEQ ID NO: 176 - DNA, 1700 bp, Glycine max
  Soy_ogl_6417 Gm19:38408001..38409700 Cluster 1
ttatgctggttgttgaaccaactgcgaaatatgtaatggattagtaggaaacctaaatttgcccaagataagtccgttaacatttgtgcgatccggcccatggagagtagaggactagttgcatggtattacattccaccccccaccccaaccccaaataattacatagacttctagttttttgtttactttattttgcagttttatattaatttttactaaaattaaataatcatatatttaatttaatttaatacagaaaatttaatgagtgattattcatttcaacaaaaaattccccatcctttaaatattaaaataatcatcattaaaagtatttaccacgtgtttgcgattatatttacaaataatcattaggaccgacttgcggtgggtcgagataaatgcataatgacttagattcgattttcatggtagcattcataaaatatatatatataaaataaagtaccattaaaaaaacaatataaatgaaggttgggcaattcatgaattagtatccttcccttctttcttttcttaactagggcccgagccttatatgtttccttaatatgtgtttgtgttggtgggaacactgagtaaagaaatggaaagaagataaattgatgaaaatttcactattttgtttgggagtaaataaaagtttttttttagtctaacgtttaaaaacattttcccctaagttgacatgaaataagaggaaaatgtttgttaagttatttttttaatcgtatatcattatgcaaataaattttatcgatgattgttctctgtaaaaaaaatttatcttatttttttttatttataagactcaaacttaatatcttatttaaaagaattaaatttaattatacttgaatcttattatattacatttgtctgtttttatgtttaccttttaaaataaaataaagaaaaaatatatttattttctgttcttatttttatccatttaaagaacacatattttttatttatcatttattcttatcaattttaatttttttctctcatttcttttctattttacttctaactcaaacataacattactgtaattttaattgtaaacaaatcaattacttattttttattttacagactttaaagagtatctattctctaataatataaagatttttttagttttttacattgccatccaacaagccataatgtaacatatgtttattgattttatataattattttaaaagtcataacatcaataattttttttatcgatttatactactatcagtacatagaaactaaaattatttttaaatacattctactatgacattaaacttatttaaaactcaaattatgaaagaattagaaaagtactgattctagtatgtgaggagaaatgcaccacgacctatgtttggattgggccatggctaactgaacctctaaaagtataagggctttgttattttcccctcatttttattaagtttacactccatttttttttctttaaacaaaaatatcattgatggaaatatatttctgttgtgaatttcaataagattttgtcaaaatatataatgaaaaaatgtttttattgtgtatcttgacaaaatattgatgagatacacaatgagaacatatttttgttgtgtatttcaaaaaatcttattgagatacacaatgaaaatacattataa

SEQ ID NO: 177 - DNA, 2033 bp, Glycine max
  Soy_ogl_19 Gm13:36925001..36927033 Cluster 1
ctcctcctcctcttaaaaataacaatttatacttaatttaatgaatttcaatataaatatatttcttaacaatagtggataaatatgaaagtatctcctgataatattttatcttttttacaattctcaatgccaccaataattattttaaaacatttattgctatttttaatattataaaaggtgagataaagttttaaatatctttattgtttgttgtaatattttttcatctaaattttttatttcatcttccaatgttaccaaattgatgatagctgtttaaaagttaaaactacctagctattaaatatgatgtgcatccagtgtctatagtgatgccaccacatagacactacatggggaaaaaatatctaaaatgtccatttacattaattaagaggaaatttcgtacaatatatattcatctttcaagaaagaaaagcacaaattttaattaaaataaaatgatacattttctccttatcctctaaagcacaagattattctaatttaataagggattttaagtttgagttcaagagtatacaattatattaaatattcaaaagaaagaaaagtgatacacttgcttgagacaaaagaaagtgagggaattataatttaagcatctctaaaagaaagaaaatataatatactctattttttagattttgaacacatttatattttaataatgtatagaatagaaatttaacaaatttaatggttaaacaatgtaatattatattttgataatcatgagtatcaatttttagatcaaataagaatttatatgtaattaattttacagtcaatgtttatttacattaaaagaatacattatatgttaaaataaaaaatatttttcttaaaaaattactaaacagtgttaagtatgctgagactttaattttaaacagagttagcatactaaaccctattcttttgagcaaatatggtggaacaatacaattagacattagtgaaaagaaattgaaaagaaatatttaattagtataaaaaatagtatgtaggaattatagcaggtaagttagtattgggtctctatagaggttggatttgcaggtactaaagttaattatgtgcaaaatgtagttactaaaattagaatatacacagcgcaacgagaaaagaggtgcaggtaacaacaattttaagtcataggttgcacctactctgacggcgcctagctaggttcagattttttttaaactttttagttatatatttgttcttataattgataaattgtagtatattactacttaatactctgtattgtaaagattagagaaatagagtagaatagatggaaacaaaaaaattaaaaattaaggtaggtgattgaagaaaaaaatgagaaataatagaagtaagcatcccatttttaaaatcaactctctcctatatctattaaaacaaacacacaacacatattttcatatccataaatgtattttcatccccgaaaacaagctgagtgtagtatagaataagtgtaatttagattccaacaaatagaatattggggaggagtaaaaaaattttaagtgtgattaaatatgcattgataatttgtttcaactaataaaaacctgaaacttgtaagaatattataggatccgagaattaagagtcttaattacgataattacctatatatacaaggaattaaaaattacaactttataaatatttttttaaaaaaaatctcacatatttatcaaataaattaaaaatatactatcacactgcaccaatacgaatacaaattattttagtttttgttttggatttgtaatatctaatttttgttggtaactttcttttattttatgctccccctccgcccccaacaacaacacactttttcaagaagataaaaaatgaattgcatctgccactggattaatacctgctttcactaaaatattctgagttctaaaaatgaatgtgtaaaatttgaattattttgtattgttttgtttttagataattataggaataat

SEQ ID NO: 178 - DNA, 2100 bp, Glycine max
  Soy_ogl_31 Gm01:1703401..1705500 Cluster 1
attaccctgtttgcgaatgaatgatgtattctggaatgtagttaggacatagatttcaagagggatgggttagagttacttggtaggaccctgcaagttgctaagactttaagttgtgagggaaaggccggtggaggaggcaactttgaactttgtcccaatctctctttgtacttttgcgtttggcgttggcctctatcaacactgcgtaatcgttactctccgtttaatttgtcgttaaatgaaaaatatgaaatgacttttctcttgctgtgccctcatttacttcgttagattaatactacatactatcactgtggcaatcaaataataaaaaaccttttctaaggaaatataaatgcataatcacgtatgtattaatgggaaatatttataattaagtttaacttagacaaatgtatcatgcatgaattatatatttaacagattttaaatcaattagacacttatccatgtatctgaaatgggttgatttcgtcttaaaaaaatatgtacagtgcacgaaatattcagtccgtgtcattaaatatcacaacgtcaatctgttgatgcaatttgaatagataacatcaaaagcgagaaggaatcgcgttcattgggaaatttgtcttttactatttgacttttttactagatagattttagattagttgaactatcagtgttattagttttatttatcatgttcattgcatacaaagagactaattataagcaactactttatatgaaaaaatagagattaatttataaagtaaattcttgttttaattttgacattgtatttatcaacatttttattctttgctttgcaaaactctaccttaatcagtcactcaataaaacattattcattttagttgttaatgttagctgaaaatattgtacaaaaggattaacatatataaaagacattctttaaagtataaaattaaaataaccgacattcattaaatattacaacgtcaatctattgatgcaatttgaagagataagttcaaatttgtcttttactatttgacccgatagattttatggtagttgaactgttactgttatttatgtaacatgattcattgcatggaattgaagaggctaaacaattacgttatatgaacaaaaaggctaaattataaagcaaattcttatttcaattttgagattgtaaatatcgacattttagtcttttggtttacaaaacctcaccttaattaatcacactataaaacatttttttttaaaaagttacatatagaagaggaactaagtctctaggaaacgaaatgtgagctatgtcagctcttacaacttcgagaacaaaactaggagcaaattcaaaaacactagtgaagccatcttccatagcatgcttagccaaaccatatgcaacttgttggcttctctatatatatgattccaagtaatctctctctcgtttttgtggactaaatggatctccctaatgatattataacaagggtgcaacatataacactcttcagaaagaagttccacttccaagggagaatcgaagttcacgcaaatcttctgaaacctccttgaccaagccaatttgagaccaaccatcatcgccttcaactcagcaatgagaactaagcacccaccaagattagcaccaaacccacaaatgaaagatacattgtgatcttgcaacactcctccacaagctgacttattcccttttccgaaaacatctttcattttagttgttaatgtttccggcaaatatagtacaaaaagattaaaataagctccaatctttaaagtctaatattaaaataaatggcattttaaatcttaatgattaatttctttgaataaaaataaaatgtaaataaataaacaaaataaataaaaataatgttagacttggcaattttagcctaacttaattagttgacctgaacaaaccataattagaacttatataattctaaatatgtagtcccaaaaaggacatgaatatataggtttaatttgatgggacctattgggctaggttgggctagtaaaatattgactcggtcttataagttattatgttatatttttttatca

SEQ ID NO: 179 - DNA, 2388 bp, Glycine max
  Soy_ogl_939 Gm03:37712513..37714900 Cluster 1
gtttcatgaatagtaatgtgcctttatgtatgtatatgtgagtttaatgaaataactcattgtgcatcgaaaaaaaacttatagtgtattgattaactaacatattatattcctctatgaaaaactaacatattatataatgcattaatttttgtttttaaaattaatcttttattttactttattaaataatataaaaaaatttgaatacgtatattaagatattagttatgtaataattacttttttattaattagttattatagttttttagtaatttttcaatatgaagattcatatttaatacatcataatatcataatatatagagagcgtactcacgaaattataatttttttccattaattttttatctgtaatttttggttttctttgtcatgaaatcctcaattttgtatgttcatttcttttaatttatttcgattaaattttaaacctaacatatttatttcaggtatcataaaaaataatttaattaactaaaatgttaaaaattaaaaataagcatatgtaaaatagaggatcgggcgggataataaaaaatatacaaattaagataaggacttaattacattaacaatatcttaaaagatccttattggatttttttcttaattgttattaagttaaaattgaggattggactttatatgcataaataaaatatttttttacacctataaataaaatattcttactttaccaaaaaaaaaaaagagattcttattggattttttctttgaagttgagaagtggctattcgactgaatttgacgccgctagagttcataattcggtttcaattaagattagggactgaactacattaacaatttttttctgtatattatcgtgaatagatttatgaatttcattgtaaagacatttgacgtaaattttgatttaattattattaattaattgagttcaatctcataactaagcatattattcacgggtgatatattattggagggtcaacgaaatgcaaagtatgagcaaaaacggttatatttttgctgttagaaggtaagatgtgagtagtttttatatgtcttttattaaatgtttttatatgatatatcttcttatagtatccttatgtaatattcttataattcttcgtagaaaaattaacaaataaaaaagtaaatatatgctttgtttgaataaacatctctccgtttttaggcgtgaatatatttctccattataaaagagaaaaaaagtttgagtttttcatctaagctaaattaacttttgcacttaatgttttaaagaagttcttttattccacttttctaaaatttgtagtgcataagtagattttatcttaaagaaaaagtataattcattttatctttttttatttttttcttataattattcataaagaaatttatttaaattaaatagacaatgtttaatatcttggaaatattaaaaaaaccaatcttcttttatttaataaattaataagataatttataaaaagatatatatgataagaggatgaaatttttcttatattattcttttgttttgaagagttaaaactttgaattataatcattgttatgccaactactttcaagaaaaactgtacatttagtcaaagaaagatagaaactacccattctttggtataatcattaattcattgagaaatttgacatgttaactactttcaagagaaattatacattacagtcaaaaataaaagagaaactgtaaattgtgcagttacaaattaacttacacagctgcaataattaatattaatttaatttaattttaaatattaatttattatgtatgaaattaaattaagtgaatgaaattcataggttccacttctgcagaggatgaaatcctactatatatattgattacgcttgcgtctttcccaccccatctccaaacacaaacacaatagttcccctcacctgtaacctctccaagtttaatttgtttttgtttttctgtttaccctaaagtgtgggataaagtgttggctcctttgtatagcatggacaaggcaaataattctttaaacatgtacaaccattggtatgcgttcataataataaagtcgatctctctccccctctctctctctatatatatatataggttaaattaagataaagaaagttatcatttgcatgaaatcttgacaatatttcaggagcggcaatgactatactactgaaatcttctccccttaccttggcgtctacaggtttgcattccctcttctttctctctttcattagtcttatttatttcattctctctcattcctatcagaaacaggacctcggagaacaggaaatggatagcgaggctcgatcgtgagggtctgc

SEQ ID NO: 180 - DNA, 2300 bp, Glycine max
  Soy_ogl_1974 Gm06:15816901..15819200 Cluster 1
caccttaacatttgagaagaccgttaattggttggaaaaattaagaagcctttcgtgccaattctttcaccaccacattccagattagcattggattcgatacctgatctaatgcatcggaggattttctcaaactgttctgaatcaatctgggattctcataacagacagtaaaagataaacatatcaaatcatgattaatttcttgcatccggctgattttcattaaataatttcataacaaaatatatatgaaattcagcttttttttttcaatttcatttattgtatttttggttggctgtgtaattctcatttaacgttgatgagtttgatcgtttaaagtttagagtgattattttttcacaataaatttttttaaacattcaattaataattctctttctctctctttctatcatgccatcaatcaaatcaaatacttatcactcattttttcctttttctttgaagttatggacaatttaagcttattcaagaaatattttttttccctaaagtttaaagagtaaaagaatgtaaattgtattaggaagagaaatattgatcttgtgtgtttcatgtccctgacgaaaatctatcattacttttggcaaaaaaaatttcataccaacaccatgattacgaaaaaaagaaaagaataatgtcatgggaattatgacaacaataaacccataaatctataagccttatatccgtgaatggaaactaatcaatccaagaaaaagagatggattaatgatattttcagccctttaaaaattgacattttttttgtttaatcctttttttaaaattatataattttcatccttatattttcgaatacttaaactcagtgtgtaggggatgaaaaacttatgatattatagggaataaaatttgagtatttcaagatgaaacatgctagtaattaacacactttttaatacactttctaacacttttattgtaggtttaaatttgttaaaaacagctaaatcaagatagattcactaaacaagaagtaaaaccacgcaagtttataataattttcaatacattccaaccattaataaaaaaaatattaaaaagaacatgttaaataatatatttgttaactctctttaaaaaacaaaaaagaaaaatctcatgatttgaaaagtgaataatcaaaattaaaaaaatgcctaattttttatgaactaaaaatagcattaatgtgatagatagatagatatttacctggggaccttggtccaagcccttcttaaatgtatcaccgacaacacgtctcaaagcagttgccttcgctttctcaaaaatctcatcgtatatccgttcatgcacgtaagtacgtgacccggcacaacagcattgaccctaataataacattatagtaataactacgttaattattcacatgtgctggccctatcacttagcgaattgaaagtagatagcgtaaatggaatgaacctgattgaagaacagagcaaagtgtgcaagttcgactgccttgtcaacatcagcatcctcacacactatgaatggtgattttcctcctagttccaatgtcacaggcttaagattgctcttcgcagccaattcgtatatgatttttcatgtttcggttgatgcagtgaaagcgagctacaaagatccacaaatgattatttgtcgatcgccctaatcagcatggtctgatcattttgcaaaaaagttcattggtacaaagaaatctttttttgtcaaacacaccaaagtaaaaaaaagaaaaaagaagctataaaagtagtacagtgattgaaaaaagataaagggaaaaagaagatgagaggttacgatttgaaattcctaactgatatttctaacgaatccctaactgatgtttctaaccaaactaataaattatataatgtttgttgataaagaaaacaaagtgcaaaatctcttttctaagaatcttgaaaatcattctttatatatatacatatatatgttttattttttagttttttttacaagggatagaaagagagacaaatgtaatataaaactgataatgtgattaaaaaaatatatatcacaactttttcttattgctccacttattcactcgttcctctcctaatggattaagtacatacatgcttggatttcatttggcaaagttgaaaagttttttattcttaaagcaataatttagttcttctcataacttttgtgaattagaaattgaaaatgtacattgaaattcgcaaaatgaatactttttcaacttttatctaaaaattac

SEQ ID NO: 181 - DNA, 1965 bp, Glycine max
  Soy_ogl_2995 Gm09:4596442..4598406 Cluster 1
gcaaaatgaaaaacatcataaatttcgtattacaaaaaaaaacactaattctattttaaattttataaataggaataaaaatggtaattatatcttagagttcttgtcacagtcctagcatattattggcagactgcactaatatcgaaggttgtctcccttttctacctctctttagttgaaaaaaattacttaccaagactatatttcttaaaaaccaaaattaatataataactttttttatgagaaattaaaactatttttcttactttaattataaaaacatcttattatgttcacttattttccactacataaatttataattcatataaaataacgaaattaataaaagtttgttttactttttcttatataactactcaggttaaacatatagtttagtttttataatgtcatgaattcttaatttgtttcctatagataaaaatgtattaaatcaatgcttataagtgtataacttatcaacttggttatatatgtaacgaattgtaatttggtctctaaatttgtaactcattctaaatttaacactacatataaggattaaattatgaataaacgacaaatataggtatcaaataaaaaatgatcgagttatacatgtaaaattcaaacaaaaatgtgtaacggatttaacgatcaaacatatgatgaggatgaccaaattggaatgcttatatatataaagactaatttaataaatttttacatataaagattaaattgagaatcaacagtatgtttaaggactaaattatatgtttaaataaatatttaaaaacaaaaaaagtaaacaagtaatattttttaatcaaaaataaaatcaaaagcatttttttaaaccgaacaaatgtgtcatatttttttaataatccaaaatgtatttttaaaaaaataaaaattaaagacaatagtttaatctctgttcccttcttttacaaaactagtgagtagccgcctaaattgaaagttgtagatgtaatgcattgcatttcaaccaacctctttgtctgagaatcttaaatcgcatttgttccccacctactggttctgctaacctaccattgcaagattttgcaggatcttcttttcttttcagcattttaagttagtcgtgtatatatatacatattttatgaaaggtgtctcagtttgattaagttaatagaatcattataggtatgaaagttctcatttcaaatatttaatggtatttgatatacaaaattaaaattaaaaaaaaatcgcaccagttaatttttgtgtttgtagtaaaaaaattcatatgtttttttaggggtaaaaacacacacacatatataaaaggtaacattattgttagtattaataaaaatatgtcaactaattttttttttttgtaattgtaagttataaataaatattttttcgtgtatatattgctcccgatcgtattactaaaaagaaatattcctataggtaggctaataaaagacattaagatttatgttaggtaacttttaactaacaaattaagattactttgtaatccatcgaggaaacaaactctcaaatttttcaagagttcaaattctttgtattgttagtataaacaaatttgattgtcaatcgataaacaattagtagtatgattaatatgatttttaaaatattttttataaaaattaataaaattatcatgataatttaatttaagattaattgtatgacaatataaacaactttttacaatatcaatacatacaccattttctcatttataaatatatatgaagcatcacgatcatattattttacttatcattttctaagagttatagtgtattaattattgaagtttaacgtgcaaattacttgaatctacattattttatagataactcatcagttaaagataagtcatgtccaggacagatgtacatacatttttaggaggggcc

SEQ ID NO: 182 - DNA, 2523 bp, Glycine max
  Soy_ogl_4173 Gm13:20773625..20776147 Cluster 1
aaaataaaaagagtgcagaaacgagataatggggtgggagagagagaaaagagaataaaaaaatgggtattttaaccgttaaagtaatttgtatggaaaacaaaaaattatctcgtgactaattacgtaataaataatcagaattttattcccttcattagcatttaagttgtattgtctcaggatatattttaaaatcaaatattaaataactagaattgtccaattcaataagactttttttttttctttcgaatcaaacgtgtatccataatcttatactcaaactatggaataatttgtggtgggatggactactattccatttttctttttttacttcagagtgaagagaatggtatccttccccacctttccacggcattattaaaaggtgaatctgtgtacttgcagagaatatgcattatggtttatatatacatcctaaatttatagtctaggaggccaatttgagttttaccttacttcaaaggtttataataagaatttgatggtaaatcaattcaacaatgaaattattttaacttaattataagttttgagtttaaacattaaatgcgtatctatattaaatatttggaatgaaattttttaatctttataataatttattcatggttcaaacaagattattttctttaaaagaattttatcatcggtaaaagatacatttggtacatgtttgattcgaaggttaaaatgttatatacattccaatataaatgtaaccaataaaaataagaactcagactgttgaaaaaaatacttttacctcaaacttaattttgcacctaataatcaaacatgcacctagtttttttttttttttttaaaaaaatggttttctctaatcacgttaaaagaaaaagtgataaccaaagtctaatagagttagcccttttggttaggcaggtgaatgtccaatcctcccaagtgcctccacttcccctgaccctacccatgtggtaggactttctttgatattattaaaaaaaaaaagaattataggatttggatagggggaaagtagaatattctcctcttttctcttatttatctgtaatgtgtacgagaaatggaaaatagaataagaatatttacattacactttacgcaatacacacgttcccatatttgaaattaatatgttttgacgaggataggataattatgtgtgtgttaggagtgattcacgtaatatatattatgccgatcgagatttaccgtaaagataaaattatgtttttaatttaaaagttaaaactattacttttattttaaagattacaagaatattaggtgagaaacaattttatttgagttgaatatgattatcaagaatgacaaaattttataaagtatttcatgtaattttatatccaatattcaaatttaagattacttattaaatcagcacaacttgttactaatttatttacacgttgggtgattactttgcttatacttatctccttttctcttcaattatggagtgagtgattaattatatatgtcattactctgttccattcatgtttaacttttttatttcttaaacaaactaactaactaatacaatagcatttatccttcgtgttttgttcatcttgggaggggaaggggtatcttctcttagaaataaaggtaagacactactatttgtgttttattttctgtttctccttttaataaaactgacaagaaatgcgctgatttaaataacactaaatgtctttttttatcaattatgttttagtgtttttattttaatatattaaattttaaaatttcaccctgttgttaaaattttcatttttatcttttatgtttttaaaagttttattttgatagtttattttattttttgctaaaacatgttaatactttgttgataatttaaattttcaaataattaattatttaatttaatttaatatcccatcaattttttttttatatatctcgacactcaaattcacttacactaatagactaaatcctttcgtgtacagtacagtatgattatgcccttcttcattaccagcgtttccaaaactctaacattatgaatcgttatctcatttttaattttaagttatttttacacgacatagtattacattttaagtaaatatgtgtgtgaattattccatatttaaaagttatttaattttcatccaatttaaaataaaccttggcatatttgggaaactaagctctggaaactttttttttaatttcaatatttatatttgtttataaatctatagtaacattgctatagtttaaaaaatcaaaaaaatatttcaaagcatttgtaacattttagtataagggttttctttattcaatattcaaaataactatatttttcaagtggcacttttattataactttttcacaaattacgataaaaaccgctttacaattaaggatagagattacattaattaagccttattttaaatgagcttgacattttctataaaataaaaaacatt

SEQ ID NO: 183 - DNA, 2000 bp, Glycine max
  Soy_ogl_4497 Gm13:36928901..36930900 Cluster 1
tcacaacatttaagagttttaatttaattattgacttctattagttgtaaaaaatatcaaaataaatcttatattttttaataaagtcttttttatcaataaatattagcaattagttttattaaaatattagtgagagatgtgaatctatatttcttcctcgttcttcttctttcaatataagcatctctccaattaatcttataatttatcttttaataaaatcttatctatacatacaactaaaaaatgatcgacacaattaaggaattcaattacctttctactactagaacatgattgtgttgattcctcttcttagccaacttgaaaacttatgtaatatcccaaagctccgttgaacttacattaaactatactatttaattttaaataaaactttcgcttatttatttataaaaatgaacgtattttttattatttttaaatgacatttataacatacatcagtcatagaacaaatttaaagtacatctataataattataatactgcataaagtgtattttaaaataaacatttaatattttgaaaatacaaagtatttaatacttatcatacaaaggaaataagagaattaggaaacaaaatcatatttagaattattctcttttaatcatttatattacttattatatttatatatattttttctttttgaggtgttaattagaaattaggatctaccaatctttttcttacttcattgaagtataactcttttagtagctttgaggagaaagggacatttgtggaagttataaaaaataatgtcaatcaaacacaaagaacaatattgactcgattttgaaaagtaagaaaacaaatttaactttttaataataaaagaattaaattgaacaaattaaataaaaagagaaactaaaagaataatttaggttaatttaatactactccaaaaacaaattaactcaacttataaaaagagaggatatgcaaatttatgacacatgttattaacaactaaatgattattagatttgatatgctaatgttaaaatttgagttttaatctaattcaattctaaaaatttaacttataagataaaaatgttcaccttcttaattatattattaatcgatgtgtgaaatatctattacacactcttatgtgtgagagtttgacatcttgagataataaaatctacagaactagattaagtagtcgaataacaatttgatggtaagtaacttaataggtccaacaacagtcattactatagaatataatatcattttaaaatttgaatttaagcttaaatcaatttcataaaactaatctttaagatgagacttgtaatgtctctgctgacaagaatgaactaatagtagacctaatttttttttaatgaaatgctaaaataaattaaataattcagtaaaccagaagtttccacaacttgaataattgctacactcttctcgtgtattacagtataatataaggattattgacgggagatgatttagttaataaaagtccaaaccattcatgtgtacttggaatgaagtattcttccgttcctttagactaatttgtactaaaaataaaataatacagtgatcaataattcttatatacgaataacaacttttacaaatccacaaactaataattaaactgtcaaaagtcaagaaaaacctttcaataaccactcgcagaatttaaattttgagttcacttgtatttttttttctcacatgcattctttctaaaagaaaattaattttatttgatgtattaatggatattaaatatgactatttttttcaacaaaaaattgttcattaattatgtaataaagactaatatctgtcgttagactcaattttgattagatctattctaattttcattaattacccaacttttactatgtatccactttcggccaattagccgcacgttgttggatcttctcgagacatctttgttttcacaaattaaatttcctaat

SEQ ID NO: 184 - DNA, 1718 bp, Glycine max
  Soy_ogl_4949 Gm15:9334972..9336689 Cluster 1
cctacttatactccaagatattgaagttttattgcactaattaacttaataaaagtgtgatgtttatttaaaagtaagtcatttttactttattttaaatttgatagttgatcttcaaagacttagaataataatttagtttcctaataagaaatttaaattattattcataaaaaagagataattcttttatgtacaattcttcacccataatcacatgtcctcttcattataagacacatgtctttcaatttttatgataaaaatatttttattaagtatgtattaaattaaataagatttttactttctatttttgaataattatttgcaattttttcaaacaaaactaagcataacaagatattttcaatttactattaaaataatattcactgattaacataataatatattttcaaaaaaatatttttttatatttcaaattatatttttatttgcaaccaaccagtaaccacgtcaatttgtaaacattaaatttgctttccttttacaaagaaagtattatgcgtacaattttgtactactagctcacgtcaatttgtaaatacgaaatttgctttcgttttaaagtgattatttaattcattcttgctatatgtagtcaacatatttgaatttgaattcgaacttgaattttctttacttatgactaaattagaagttaaatgaataacaaaaaggaaagattcgtttcatttggttgggaaattcatagcagagctatagtgtgggggctaaaagcataatcataaaatagaaaaagtaaagaaaaaaaaaattacacttatatatcctgaggttttttaattgcaaacaatgtaatttttacctacaccatctccttagttatttgaataagcttacgctgacactccttatgttacactaacctgtcttaatggtttgagaaacattatatcatgtgcatccctgtgtgtgtggaggttgtggtaaacataaaagcaaacatattatgtacaatatcaaaaattctcaaaagagaaactagcttaatctttttaagcaccattttggatttgagacttataaaaaaaataattaagaggaaagatctcattaaaattaatcaatcaaattttctaactgagattaatcattgcaagtcaatggatactcgtactaataacataagttaaaaattattctaactccattttttgtcaaactgtttttaaaaattacatagatcaaaaattataaactcacaaccgccccaatcaggtttctattttaaaaattgaaaacacttgcattatttaaatgtcttttaagaaaagcttaccaaaacaaatattatttgaggtcgaggaaaaatatttattcttcaaaaaagaaataagaatcaaattaaaaaaatgacctaagcataattaaattgatttctcttgagatcaacacaaattacacttactgatcaccaatattacacgcacctttctcctacttttcatgcttttaattttttaagagtattatgtatatgatttgtgcgtgtgtgttttttatttagaaaagtcattttttatttaacgaaaaaaatgcacttttctaaataagaaagacatatataaaataagaagattaatataattattgaagaaaatgttaattaattaattttaagacagttagtatagctataataaatatatctttaagaaaaatttaatttg

SEQ ID NO: 185 - DNA, 1704 bp, Glycine max
  Soy_ogl_5530 Gm17:5521601..5523304 Cluster 1
agaagttgacaagtaagatttagcaaattaaaaatgtcaagttgttgaattttgaagtaaaaaaaattaattacaatatgacatttatttaaaatattttctctccttttcccatctattggatgaggaaaaaaattgtaagaatataatgttgacataaaatttattagtttattatatttttcacagttaaattaaaaaatagataaacttaatccttgagtacattcttcttaaaaaaaatactgtacggtctaagaatatatgtattttttctatctagaagttgaagataatataattactatgtttaaatcattgtcttatttttacttttttggcccattgttcttatttttatttattcttaaataatttatacactcgtagtaaatgtgataaataagagggaaattcatattaaaaataaaaaatattaattatatttcttaatctatgcattatctcataaagtaaacatataagaaaatggaagaactattttctgaacaaaagtatgaacttaagtaaggaaaatgaaacatatcaattttattaaataaaatgagtgatatgtatctatattttttttaccttataagtatgtatttagttaaaaaaaatattataaatattttcttaaaatgaaggataaaagtcatattttgcaaaatctttaagaaaaatgtaattagtattcttaaatatcagttacagattaaaaatttaaaaattattaatactatttccattatattttttatacattttgaattatttttataaaaatatttatttattagtagtttataatggataatttacagatacagggtgagaaagagtgggtttataaatttggatttgcaaattgcagtaaacgacaagaaggattgttgggcggtgaaagaaggtaataaatgcaaaaagttgagtcactctctctccgtttccaatatcaaatccaaagtatcacttttttgtgggtcgccagaaaaggaaaggactaaagtttcacgcgtcagccttttctcattaatttgtctctccaccgtttcacacgtaacaaccccaatttccttctataatgacaactgtagtgccaacttaacacacccagaaaaaaatcaatcaaagtatttaatttttttaaaacaaactaatactcacttctttggaggatatataacgtttaagattttttcacaatattaaagtaagtaatttgttggatttcaaataaaatattaaataattttttaatatatattttttatcattttaattaatgatttatttattcttatgcactacttttattaagtatttattaagaatattctttaaaaatatttaatatagtattaattttataaaatgacatatattttgaaataaatttttctctttaaaacttcatatatcaaaaagagtatttattttctatttatattataagggtaaaataaaaaagtaaaaaaatacaggtaaaattttttatttagatgaaagaaataaaaaatggaagaagcagcgatatttttctttcacttatttaaatagccagaataaaaaatagaaaacaataaataggtgaaaatatcaatttactctgtaatgttttaataatgttattcttgcattatttaagaaatgcttttaataataatcataaaaaataaaatagaaagctaatcataccaa

SEQ ID NO: 186 - DNA, 2100 bp, Glycine max
  Soy_ogl_6319 Gm19:1511601..1513700 Cluster 1
tattacacagtttgtcgtttacaatagtgtttctcacactaatttaattatgacacagatggtcttcatttaaggcagtatatatattaggtgtggaaacaaaaattggcaataaataaaatgtgaaattattacctaatgttgagtaattaaaaggaggtaatggcatatatgagtattatatattatgagttaaaataaagataatattgttccctctagatttcttggaaaaattatcttcttttgagtctaaattatgttggcagcgttgtagctatagatgttgacaaatcaagaagattcatgtaacctcagagcagttctctggtttctggcacaggtacaaaagattcaggctcatcaaatttgtggtattcgacggaaaactttgttggaaaatcatcaatcctaaagtatctccatggaatgctgaagccctttggaattgttcaagttcagagatctgtttcaacctcttctaacttcattttttccttatttgctgcttaactaatggtgtaccacaccagaacaatttgacaaaaatatagtaattattgttactatctaatttttcctttattatttttttaagaaagaataaagtttgttggttatctccataaaaattatgtgtgatatgtatattgaagtcaatcaaggcaacatattatatatttttgtatatgaaagcaataaaattttctactcccatcctaaatttaaatattagaaatttaaaatgctatcctaaaaaatgtcgtttggtatatggtaatgcatatttgttactcatgcatttagtttctatcatatgtgattatgtctccataaaaattatgtgtgatatttatattgaagtcaatcaaggcaacatattatatacttttgtatatgaaagcaataaaattttctactcccatcctaaatataaatattagaaatttaaaatgctatcctaaaaaatgtcgtttggtatatggtaatgcatatttgttactcatgcatttagtttctatcatatgtgattatgtatataaaaaaaactttattaaaagagataactaaaatctaattcactccccctcaaaaaataaatctacttcactcatatctttatgtcttaaatgtttataatcttttatgtttgacagttggttggggaataccctaatataaaaaataaagtactaaacaatttctttccttgattaatttctttacctgactcacaaagcaacgaaaccttagggccacaataatatactggaaatgattctggtagaagtttatgtttccttttcttgaaaaacgagtgaactgtttatcattttagtttgaaatggaaccaaattataaaatatcataaaaatagtggtactgctaatgcttaattttacaatctttaatttaatagttgttacgctttggagtagctgagtagccggggatgcttggaagacgaaatcccttaaccttaacattcataattaattcaaccaaaggagttaatttaattaaaaaaatgttggagtactgatatatggaaaaatgacagttgataatgtcctttttttcatttgaatttggcttgaaggtcttcttaaaaatttgaattttctcaataaattgacatgatcggataggggtgggaaaatattagaaatccacacactaaaatcaacgttaacatgataaagatgaaaaggatgtgtgaatggcaagctagcttacgtcttagggagatgagttatactcaatgatgatattcagaaagactaaagaaataaaaattaacattaaccatatcacaaatgtgtttgaaattataaacgaaaactactttttcaaaaaaaaaatcctttaagaaattgtaaaaaaaatgtcttcttttgaaagaaaaaaaattgatctagacattgagactgagttctcactttttttatttatttgggagatccaagggaaatagacataccgggttaaatctaaatcctctttcctaagtaattgtttgaagtggatattagttttaagtttttaaaaatttaaatattaagattactttttagttaatagattttagtttcagttttt

SEQ ID NO: 187 - DNA, 1800 bp, Glycine max
  Soy_ogl_967 Gm03:39409901..39411700 Cluster 1
tgtaaatttaattaagattttatatattttgttttagaaattaaattggatttttttctcaaaatatattaggatttttttttttggtgctggtgaaaatatattaggatttattcatacttgattaggagttacaatactactattatatatagatttaactcaaatttgattcatattatatcaggagatttgtccttaatataatttttttaaaaaaaaatatttgttttttaataggaattcacacagtttaatgaaattaattattttttttataaatatgaaatcagtttttttcaaataaatgagaacagaaggagtataaaacaatactatatgttaatattactattgaataagaatttcttcaagaaaacctcaggaataatcctcgcaactctttaattatgatttgagaaatcatgtaagaacgatatttagaatgtgggcaggttcttgtggtaagttctcattctttcgtaattgcaaaattcttgtaatatcaagtatccgttctaaaattaaacaatgatctttttagcttctttttttcaaaaatagtagggagtacaagtaatactatatagttgtttttttagttttggctaaattaccgttcacattaagcttaaaaaaataattaaacgaagtacaaaataaaaaatatcttaaaataataattgaatccatgcttttttattcatacataagataataaatcactaatgcacttggtttatttagttacttatattaacagtatcattaattaaaagttattattttttaaacaaattgttttttgggtaatatcattaattataaacgttacttaaattgtgtaattttttgggtatttttaaaataaaatttaaagttatgccactatttttttataatgatgaattatgtatttcttatataaaggatcggagacaatattatctaataaactctttgtaacacacattttatgagttcaaatcttaaaaacaataatttttaaaaaaatcattaaatgataagttagatccatataaatttatgattctcaatacattttagtcaataatagaatatttaaaaagagcataccaccttcactatttattataagaaaaaaaaactaatttcacactaattaaaaaattagttaacattatttaattttcaaactaacattcactggaacttaatatcaacaataaaattgagttattagaaataaaatattaattaaataaatgatattttaaagattaagttattgaatatagtaaacttagttaagatttatttatatttgatactaaaatatatgattttgttttgtttatatttgatattggagtacctttatagaaggaaaaccattagacaattcaagactaccacgaaggtaactaatctctacatgaaatctaattaaatattattaaaatttttttcataattcaaaaaacatcaatatatgtgacaaaaaataatcaatcaccatgaactcataatgtgagactaggtaacaatttatcgttagcattctctttccaaaaaaacaaaagtaagagttgagtaacattataggtagctagatttttttttgcgtggttcaaacacgatagatagatattcccttatataaaagcaaaactcgatcatgatttatttccatttaagtaagggacttaaaggtttagattctgaaaattaatattacatcaaatcctaatgcgtaactaccaagttatctcgcattaacttttaacatggcttaacgtaatgtcctagcttacatgt

SEQ ID NO: 188 - DNA, 1727 bp, Glycine max
  Soy_ogl_3635 Gm10:48942526..48944252 Cluster 1
ttttaaggattaaaattaatattttctttcaaagagaaaagcctgataaaatcatatttatagaaattaaaaaaatgcaagtttatattcttttatatatttagttggtgcctttgaaaaaaaatgaaatttttaaattttctctttattttcaaaaaaatatatagaaagacatggaatgcttttttctgtctcctaattttaataattgggaatatttttgcagctaaattagaaattttttaatctaaataaaaaaatattaaaacatttatcaaatatattctttacccaaataatttaagatttcaatcttgattgatcattatgaaataaatcatactgatctcatttgtgttcaggaacgtcaacaaaaaataatcagcacttggacaacaactttatactaaaacttctaatatcgtaaggaaaataagattaaagcgtttatatctaaattaccactctattcagatttatataaatcaagacccctgtacgcgactacgcgacagtttaaagtaaagaaagaagtgaccctgccaaatggatatttgataagatgatttatctttgagtattgaatgctttatattttcttttaaaaaattatcttaacattataattatttttttaatctaaaatttatcataataaatcacaaaataaataaaatttgataaaaagaaatattaaataagttttaaaattaattaaaaaagtattcctataaggcacgtcatatcatatataaggtattacaatcaacatcttctcccaaatgaactaaaattgaaccaacgcatcagttcaagtagtaaatatttttttttaaaagtaaaattttgaattcaagttttataaataaataaaaaagtgtcgagaaaattatatttttctcaaataagattaatttacttcgacttaagttatttaaaaatttaaagtaatgttcaaatatgaaaagtcttaaataaaaatattaattaaaattaaaaggaaagaaacaataactatactacataatatataggttaataggtgtcccactgtcccaagaagtaaaatgggtaaagacatgcaataatcaataccaaaaaaaagacatgcaataattgcattataaatagttagataaaagtttatggttgaaattctgaattgatgtaacattcaatgaaacatatttctcgaaaaaaaatggttgtgtttacataaactgtccttcaagaagaaaatgactctgctaaatgattttactgtagtagttattaacaagtaaataaatatttcacacaaatgttatgataataaaaaaagtaaataacctttttaagtgtacttggctttcttttagaagcaagtatttgggtttattttagttttagttttcagttaatatatatttatttgtaattatatcttcttctttatttcttaaaagtttacaaagaaaattataaaataacaattttatttgcaatttattgaaataaaaaagaaaattgaaaacaaaataataattttataattttgttcaaaatatatcaaccaaaacaaaataaaacaaaccaaaccctctaccttcccatatatccaaaatgccaaaatattttcaacctgtgatgctatcaaattattgtaccaaatattttcaagagaaatgattgttaaaaaagaataattcacgaataatgcgagaatagttactctatggatccatcaa

SEQ ID NO: 189 - DNA, 2000 bp, Glycine max
  Soy_ogl_4134 Gm12:37781801..37783800 Cluster 1
taagaaataacgtggtgagctatcactgttaatccacattactttttttttaacagaagttaatccatattgcttatttgcttatcgagtgtaaagagtatttaataattatatatgccaatttgtcttcatcatatttattagttcaaaagttatcttaagaggaaggcgagtcaagtagaagataagcattttttttccacttttactctcacttcataaagtagaattgtttttcctattatatatgttaactaaaaaaccacaagaattatctatatatttaaattttaatccaaatgacacatgcatcataaaaataacaagttacatttttagtcccaaaaaaaaaacacatataaaaggagttagtgaaagaagattagggattcttcctcccactttttgggaggagacaaaatgaaattgactaatatttttctcattttcattcaaatttatatctttttgcattcttctatttttaattttaaaataaaatttgtaaaatcatattttcttgttttaattaatttttaatatttatctcagtaaaagcttaaatccaaatctaattttgtaatttctattagaattattcatcttttgctttttttagcgttagaattgttcatcttttaatctgtaaaaacaatagtgttccccattttattatttattgtaacaaccgtcggtgttaactgttgagctcttcggcatgattcttagtaaatttatatttcagcctaccaaacgctatcagaatgagcccaatgtcttcgttgaatttcaggctagcccaacaaagaagggggggttggatcataaaaatgaaggcctagaataacaaaacgaaatcaaaacaatgaatctgcgaagatgattttactagtcattttggacacaaatttagttttttttaataactgctgtttgaagagaaaaaagtttgataatgaataatgttactttagattatgttatgttgttatttaattaaaaatgttatgagacacttcattttctgtcattcttttgataaaaaatattaggctaataatacactttatttgatttttttcatcttgggttacactgttatgaattactagtaaaacttaagccatgcatgaaaatttttaaattgaataaacttttatgaattaaaactcgaatcttatctcttccgtccccgcttatataaagatttaaaattgaattttttgcattaattaagagaagtgtgatgtttatttaaatgatttcgatttcaaattttgtggatgaaaaaaattataatatgtaagaaatattccattaaaagtaataagattagcaaaacttccatttatttataccgtaaccaataccctcctcctggccgttgacggagaggctatcatagagaacattggtgggactcacgtggaagagcacaatggctccatggattattattcttagaaattgtaaaatgtttttacattggtatcttttttacattatatttgatcataaattataataatttattaaattttataataattaacttaaaaaccatattaacaataatttttaattagtttaccatacaattcttttttatactaagggagggagtaaatattgatgtggagcgtgatatatttgggctagatttttaacagatagggttttagattcgacccgtaggtggcccattgtgttcttgtcttgtcttgttctcatgataccttttttttttttttttctagttcattggcttatatgtgtacgcaatttgcatcattgagtcaaattcacatttgactataacattcatatgttcaagatatatataaaataattatcgttgatttttaaagtgtccacaaaagaaattatttcatcttaaaataataaaaataagtgtttaataaatctggtttaaaacagactgatatttaatagtattctttatcccgacaaaattaacccctagaataatactcgtgaaa

SEQ ID NO: 190 - DNA, 1836 bp, Glycine max
  Soy_ogl_5256 Gm16:2441686..2443521 Cluster 1
tatttgtcaagtggatttaactttagagattgaatagtatatgagaattatcataaatatattattttttattctcatggataaaaatatatataaaatatgtaaattgaattttttaaaaaagatttttctaagctgtacagcattacacaggttaaatcttattaattatccacttttaactaactataactacctaattaattgtgattctttacaaaaaattctctctcctaattatgatacaaactcaccttcctatattaatataatctctttctttccatccattaatagaaatttaccaactcttcaaattgtacaattaaatatttttcctaaactaattccttcgcatccaattccaacaaaagtgtaaaatttgcttcatgctgaaaataaactttgaataaatttgacatacaataatttattccaacaaaaacgtttttcttactaatgttgattgaaaattaaatactaattaaaatgattaaaaaattctgaacaattaattaattacactaacaaattcaacttttaaaatctcaaataaataatcatatggcatattacagtacattatttacttagagaaattttcaatagtaaaatactactactataatttttttagaatgcacaaaaaaaattgagagcttttattcactttaaattttacatagaggtgttaagtcgacctgacttatttaagtttacctatgataagttattaatgaatttctaggttaagttaggttagaccagttaatattggtaggctaatattttttttaaggaaagggttaaaattatgttaattaatttattattatattataaattatcaatttcgacattaacatattatgaactcatatttgatatttaatatattttatgatttgatgtaattctttgcaaatgtgttttaccccttaaactttgttgtttattttttttttagcatgaggcttttttttcaacatcataaatattatgtgtggaagataattccgttagagtcaaatatgattattatatcatccagcaaaaagaaaataggattattatatccaaaaaaaatctttcaagtttaagattaatgattaaattaaaacaatttcagttgatttacgatattgaaactttatatatcaattttttttttttaaaaataaaatagtaaagttggaagctgggtaggggcaaattagcccgtatgggttaatcatttttcatgtatgttggggttggattaagtcgaactaaaattgaaagtttttttttatattgggttatttaagttaacctattaagttcaaccatttttttaaataaaagttcaactaattctagtatcttcaatttttttctaaaagtattatgccatgttgactttaaaataaaatgttgacgaaatacatacccgagtctaatggaagaaaaaaaaaatgtttttacaaactagcaaatcatgattttttttttaaaagagacgctcatgttcaatatccaaacatgttttgagtaaaattatttattgcaaaagatacttctaaggaaaaaaaaaacaacttataacattaaaagagtaagtacaacaaacaatagtaatgatttatagttacactgcataagtaataataaatatctttaagatattggcgtaacaattttaaaaaataattcatatattatatattattttttaatgaataaataatctctatactaccaatgtaaaaaaaaaatcacgttattatcaaaccacaaattaatatgtaataaaagaaaaaagttagttcatttttagttttaagatattggtgtaac

SEQ ID NO: 191 - DNA, 2000 bp, Glycine max
  Soy_ogl_5810 Gm17:40073301..40075300 Cluster 1
tgccaaaatatcgttcaaaaatttaatcggtggatatgttttgtgcatcaaattatatctacgggtggacaatagtttgtattccaaataaattaaatagaaaagatctgatgattttatttatattgtttaatataattttttataaattaatatttttttaaatcaaatttccctttttttttggaaaaaagcagaattaaattaaatgaatttatattgtttaaaatattttttaatatttattttttattaataatgatattattttaaaacaaaaatataaaaattctttagaattttagttgttttcatcaatattttagtgaccaaatattttaaataaaaaatatagtaattcattaaaataaatagtttatcattaaacaaaataaaaaaagtagaatccaaattttataataactaagaaaataaatatgtcatctagtatttttaagaaagctaaaataggtaaaaaaaaaaaaagttttttaaattgaacaaaggagtaaaaaggaatttcaaataaatcagtgaagataataaaattaagagaaaaaataataaattataagctagattacttttcataagctgcttcaaataactgatgaaaaataaactaataaaatatgcttgtgtatcaaataaatttataagttactcgtatttttttaaccaattaattattataatcaataatacaatgaattcaaataaaaaataattcgttcaaatatacattttatcatctttgtatcgagatgtagaatgtagaactaaattacgtttttggtaagagtgtaagtggtttaagttggattgaatttagttgattaaaatatttagtaaatttagctcattttaatttaatttaatagtcatacttttatttacaggtataataatcatatatgttcacttatatgtttgattttctcacttttaaaataaacatgttctaattttaacatatcttttttctccttttctaaactattaagagtatctctaatctaatgtgaatgtttaaaaagttgtttaaatattatttaccaatttttccattgaagttgatttttggttatatattatctaagtgagttgtttatataaataatgataacctaattgattgttataaaaaattaatccaaaatttaatgtaggtcaaatgaagtacttctttaacaactttaatattagagtaattttgtataaagtttttaactcattaaataatcatgcattaaaaatgctataacggatcattgaattcacatctcgttcatcacacgttactttcaagtatattggaaaatggaagcatcaaataattgaaaaatcctcaattcattttgtttcctttataaatttgatttttgttcacgcaccgttctctctctctctgtttgcatcaacttagtagagtctcacatattgaagtcttcctttgacatttatcatggaaccttccatgttttggcttcaggtaagtgatccaatttactttcattctatggtccattagcccaggaggtacaattttgaaaaatgaataattttaaagcttccatattacgtcttttattaaaaatttgttttcaaaatcttacaggtatctataatatatttatatgttcgttaattgctccactactcattttttttctcaaacatcatgtaatacattattgaaatagagaaaatatagtagtctcttttactcatatataaataaaaataattaattttacaataattaagaaaattagttgatatcctttaattttattaatttcaagtaaaaaaataagattatttttaaaatttccttgattggcacttgctttcaagaattaaaaaaaagtctttaaaaataattaaaattaaatgaattatattttaagaatgataatattaaataaaacaaaattaattagatttatttatattgaagtctaatatataagattacctttttgtttacataccagtcg

SEQ ID NO: 192 - DNA, 2334 bp, Glycine max
  Soy_ogl_7008 Gm20:45718922..45721255 Cluster 1
atagtattcaggacaaggagcaaggagacgaagcaaaaggagggaaacaaaatatgaaaaaagaatccaatgcaaaattctgtcagaaatgaatttatataagagccagaggaattagtaaattatttctgttttagcacgcactatgcttcctgatccttcgtcctggtcttcttcttaattgaagtatttagcctccactagtttgtacttttatatttttttccagtgacccactacagttttcccccgtttccttagagaaagtgtattaagatctaattaaaactaaggaatgggccttaaaataggcaatatgattgctaatgcatactttttagcatgaacctaaattataagtcaaattattaaatagctgattttaaaaataagtgaatgtgttaacgatttgcatacataggattttttttaatatatggctacttatttttaagaataaaattttcaataataataagttatatctttaatatatttttagaaaatttaagttataacttcttaaaaaaattattctaattttttattcaatttaatattggttagcttttattgtgagagaaaagaaaatggatttttttttaaaaaaatatgcactgaaaatgtaaatttttatattgtcatttaattgcatgtcataattaatatataatgattttttttagtttttataatagctaatttaaaaatcaaattaataataattttcaattggttaacaatatatacatttttttgcactagctgtaaatgactattaaattcttgaaaaaatgagagtacattgacaactaccatctttatgtttcaatccttagaactctctgtattatatagaggtgcaatagtaagttaattttatttcccctgccttcctttcccaaaccaattgggagattgttgtttttctcttctcttttgtcctcttaatgaaacaatatataaaggattattcctctcctattatccttttaagctatacactcttgtaagagtaaaattgtgtaaaattcattcattatttagttttaacactcgcacctagttttaaaaagatattacagagtaagtttaaataaaattagtccggatcattgtaaatattttgaaatttaatgtttgtctctaaaaactccgtaacgttactgaggcacaacttgtgctgcagtgttgtttttttaatacaaattcatctcttagttttttttttttcttaaaaaaaagtctctaaaaacttgttggttggtttgaatccctgatttttttaaagtaaatgagtttgatctttattgataggtgaattccatttaagtgttgagttatttaatgacaatccaactcaacattgctacatcctacatatatcctaatcattgcctgaatatattttttatcttttgtaaatatctcaaaattcaattctaatctctgcaaatcactttgttttgtttgatttttttatagagatttgtttgaattgttatccttttaaaaacaaatgatttgtccccaactgttatatatgcctttctagaaagtgcagggaggtcttaattcgtatcgtcacttaagtatgcaattctttactgcatactgcatgttcaatatatatatatattgaaaaccagatatacaataatgtttgtgaatttccaaaataaattatttttttaataaaaaacaaataatacctatgaatgattatcatatttaaattttaaatatgaaatgtaaatttgaacaactactgtatgtaaaaatacttattattaacactagtatctcatatcttagacagatattatattcacatcttataacttataagaatatttttttatattttaagttttaatatattattaattatttattattaataaatatttaaatatattttatatacacatgttttaaaaaatattattattggagtattgtcctaagtataagatatttttcactttgatgatgttttatgctccctttaaactttatttaaaagaagaagatgatttagtttttttttataactgtattattaatatgaaatatctaatgattttgtagattatcaatctttgtcaaaatataacttctgtcttaaattaattaatcaaatatgttaaagttaattatcatttatacaaaataattataaccagtaaattcaatttattagaaataatgataaaatttaatagaatcatttaaatatattataagatgattgttattggtttattcactcgtaatcaattagtaatatttagagtaatatatattgttattaattgcaatagtatgtttaca

SEQ ID NO: 193 - DNA, 1982 bp, Glycine max
  Soy_ogl_246 Gm01:50325725..50327706 Cluster 1
aagaaaacaatttaaacaaccattcaaattatagtattgataaagatatttcggtaattgtacgtcatacattctgcttcaaacttaatataaaaaaacaattggaggaaaggaaagtagaaccgattttggcaacaaaacttcaaatacaatcccaaaatacaccaatattttgatttacggatgccaaatgcttttgcttatatcgcagatgcatgtgcgttgtacgaagactggggaatacaagtgtgcagatgtgcgattgagaatgcgcaattgcacatgaaggatcataatgcaataacgcggctgaaatagccatgtacgcatgacaatgaatagtatttatagggtgacagagaaatttaatcaattaaaatatttaaacattaaaattttttattaggcaccttgattacattatgtttttttctttttatttaaacaataaaatcaatatcaataatttttgataggataactattcactactcttttaggagtttatgacactacaacaaattgtcttgagaaattatttttaataacatctcatgttgatgttcagactttgttttttgttttgatttcttctaaattttagttgttaaatatttgtcgttaatcatcacgtaagtttaatacaaaaatttaacaaatatatcaccttttgctttagttatttatcattttttcattttaatttttataaatatcttattttttatttgtagtctctaaaaatatataacacttttttaaaaaaatttaatccctacaaacatgttagcccctaccaacattatcacaataacgtaacattaacaatcttgatggtaatatcatttattaatagaatatttttttaatgataccaatgatgttatcatttatcgacatatcatgtaatattatgatttaatgatgcgacgtgatgacaggtgatgacatcatcacgatatcattattattaactatattaatacttaatgaaatctgttaacaagaagatatggattaaaaaaataaaattatattaaattcaagaaaaaactttaaagaaaaaaaatcaaaatttcttattttatatggaccaaaggttatttaagtccataataaataagagacaaagatatttgtttttcttaaaataaatcataattaatcaaccagttgatattgcttaaaattagttaattaacgatgcttaatctgtgcaagtttgcacaaaatagaaaaattcatttaaaaacaaagggagtaaaagcaataatttcgatatgtgcaagtcatgcatgtgtatttgtaaaattaatatttaagttaaattaattagtaggtctctaaattatttgactcacaattgactcaaatagttaatttttggtaactacaatttagaataatccaattaaaaaataaatacatgtttgagaaactaatttttaaaaaataattcaaagatctaattaaaaattatctattaatttaaggaattacaaactaatctaacttaatatttattttctctctctttgattatattctcatacgtgatgcatcttttatatttgctcattttagatgataaagtaaatactaataaaacaaattgaagtaatatcaaacattaatgaaaaaatcaacactgaagattaagtatgcatacttaataaataactaaaagttagaacctcagttattcatttgctcattcataaataagattacttatttatactatcctctgactcctgtaagagaattaaattcttacgaaaaaatatccgtatatatatattaaagtaaatttcacttaaattttttatctctattagttcaaaacttaaattctataataatcgtttatttaaatcaattctatcaaacattattgaaagattaaatagctcaattagtactctttattatataatttatgcacattttttatataactacttaatacatcccaaaatgtc

SEQ ID NO: 194 - DNA, 2489 bp, Glycine max
  Soy_ogl_1289 Gm04:7897401..7899889 Cluster 1
gaaaactatattcaaattaactaattgtggattatgtgtttgaatacggaagtataaagacttaacgaggaatagtaaatattataattattctatataggagtattaatttttttaaaggatttctaattgtgtatgtaaacgcgtattgtaactcactcgatcttcttaaaaaaaaaaaaaactcagtcgatcttttcaataaatgcaacatcttttatattttttatagagagaaaaagaattatatataatgtaattgtaggcactagaatttatatatgctatgacaaaactgaaacttcaaaaatttacataaacacagagaaataaattaatgaaatatcacgttgagctaaattaacgttaaaaaaatgaacaaacaaaaaagtaagctacaatctagcttaaagttgaacatggtcatttaataaggcatacgtttcaactttcaaggagattcatacgtagtgaataaagactttaggagaaagtggattttcaaattttgcaataagttagtatcctttttattctctctctaattagtcaacaatactaactactcgtatttgtttttaaagtgaagggaagaaaaaaattaaattaaaaccgaagagaaaatacaaaagaggtaaaaaaaattatctttatttttttgaatcaaataaaaaattagtatgtcattatttgtaactagttaagttaactgtgtgatactaagagttttttatattaaatttaattatttgattaaattatacgttccaaaaaaaatagttaaatattattgaataaaagtgattaaaatcaattgtgcgtataaggtgtaagagaattattgacaacaataaattatgaaataaatgcaatataagaagtattattttattgatattaaccataatttgttgaaatgatactatgaaattttatgacataccttcaaatccatgaaaatagtataaaaataataaacttaaactttttttcattgagtctaaattgaaatgcataaaaaatatgataatcaatcttttgtatcttgaacctataaatacattaatttaaaaatgctttatttatatttatttttacaccaatcacttaatcattacaatattgataaatataatcacaaaaattaaatatcacaaaaaggtttattgtcaacttgtgaaatctttttaatgtatttcgagtacgattcataacatcatttattttctgtctcaactaatatgattttttatttttgccagcaccaaagcataataggtttattcataaatttttttattaatatcttttttaaatagacaaatgttgttcaaatacatataagtataacttgcaaactcagttgattgatataaaatttgacatgaacatgacatctaataaagaaatagttgaaggcttagtcatttcgcttacaacttgagttagttgagttgaatttatattcatcctaagaaatcaaaaaaattatttattaagataatttaattctaaaatagaatgaaaaagcaggtaaaacacatgtgaaaaaaatagaaacacttctctttgtattctttgactacatcaatggtaggatttaagagtagttttgttcaaaaataagcattagaaattcccatagtttctagacatataattaattaaaaaattgttattgcaattcgttatattgtatcaaaaacctaaaatgtaaaattttaaatttgtgttacccatgagttttttcaatttgcatagttatgatataataatgaaagcattggctgaatcctctttacctaaatgttgttgtatgataatagtataatctccccataaagtgaagcgaaaggtattgaacctacaaaagaaattgtcatttttataacaaatgtgttagtataaataagcataaataattgtaaaaaacatcttgaattcaaataataatttattaaaaatatactgtaaatcttgaagctcaatctcaatgatttttttttctttccattttttaaattcctttatacgatttttctcaatcacgtcaccaattgcatataaaataaaagataaaatataaaaaaatacttgatatgagaaatacttgttgaggctttaaaaatacaaaaaactcaacaattataggatcttcatcattcgaagcaagaatgtctctaaaggatataaaaacaaaatgacaacgcagaattttctcccttcgaatctctgaacaataggtgtttggtaagaaaatcaacctatgattatcatttatagacttgagatttaggtcatttttagacaccaatatattttgaatcaagtatttttttttctttaagtagttttcagaaattgtttacatatttttttttcttgatagatgcatgaattgtatcactctacacttaaacatattgtattcaaatttaaattataaaatgttgcataaaaatacaatatttgaatttaagataaccttt

SEQ ID NO: 195 - DNA, 2135 bp, Glycine max
  Soy_ogl_1691 Gm05:37104101..37106235 Cluster 1
ttgtcataaatagataaaacaatattttcatttatttatcaaaagaggagcattttttgaaaccaaaatgaatttttcttagatatctattttctcttctccagatgatagtgcagtaaaaaaaagtccaatattagcaaattatagaaaagtatattaatcaataaataattaaaagattgatatttttatccatatattcctattaattttttcattaagaaattataattatattatttgatattatatgtcataaatatatttaaattagtataattttagcaaatctaggacatgaatctaattctcctatgtatgtgctaccttctgtacacccctcctagcctcgcttgtagcagctgatgcgataggagtttcgttttccccatttgatgggagttaagtaataatattattccctttgataaaaaatagtataatataaattaaaattaaataattttttaaaatttagggtaaaattatacaattcactctagaacataattgcatatataatttttttcatataataatttaataatttaagtatcaagcttaataaaaactttatatttaaatatcttcaaataatataaaatttaaaatagtaactttccgttgacggttaaatgttaaaattattaaatatattatattactccttctgtttaaatattattgtaaaaataaatgcgggtaaagttagttttatttatggaataatttaatttgaagtctaaaagtataaaataattttatgcttttacgatcattattattgattattggtctttgcaataaatattttaaatattatttgtcagttttttatacagtgttatgtttcaaacaagtaaagctcactttaaaataatttttgaaagaattattataaaataaaaagccatatcatacgtaatacttcaagtatcgaaatatatactcattttcttacaaactaataaatagttaaattcgaaagtgtgaatgatgataagttgttgttttgaaaaatgaaaaatataaactgaggacataaatatataaagagtatgacaaattaattttaatgttaaatttaagagattattttattattgagtcataattttaaaagattaatttaataataaattatatatctaaaaattgatttataattaaattttatatatgattttatttttcacgaaataatttattatcatttcacacttttaaaatgaatttaactacttttttaaaatctactcatgaatgcattgaaatatccgacaaattttgaaaaatagaaactgttagaatggtagtagttgagaatataaatgttgttttgaatatcgtgccagttagttagtggcgaatcccaactcttcattactgctcgagtgcttggcttgcaaagtcaggtgagtaatttattcaattgagtcacacagattattttatctttaatgatttaactgttttaaaaaactgttgttaataaaaaaaatttcttctaatctttaaaaaaatataatgtttttttatgggaacaaagttagagtataagtaatttttaactaatccacatttaaaaaaaattattaatattattaataacattaaattaaatttgttgaaattcatcccatcactttttttaacaactatttttcacctaattataattaatgtgtgttggtcatcaataaaattatcttttaaaataaaattatgttcatatgggagtaattaagaatatcttaaaaatatatatatttaagaataaagatagcatttttttttaccttgacatcaattataaggaggggtgttgataaaattgtaaagtttgaggattatataatataaattgatattttgaagacattaactaataaattaattgtaatatttattttaaaatatgtattgtattgagagtatcaacttatttgatatttatcttttagataactaaaaatacttttatagtatatttaatactttttaatcagtatcttaaattaataagatcctacaattaaaccttttccaaaactccttccgtgctttagtatttttccttttagaataacttttctattcttatttatttgttatttaaaattttaagacaatat

SEQ ID NO: 196 - DNA, 1900 bp, Glycine max
  Soy_ogl_3924 Gm11:36425601..36427500 Cluster 1
tcttgcactgctctgccaatcactttttttttttttttatttctcacaacacatacacaccaatcattttttttcttcttctaaatgtcatattcttaataaaatttgactataccaacatatcatttcattgatttgagtgatccagctctcggtgaattttttaatagtgatccgtcaacagtctaatgaatattcatactcgaaaccaatttacggtaatccaaaaaaaatcttgactataacgataattgtttgaatttattaacatataacaaaatttatcgaatttaaggaaaaaattgtgaccgggagcatttccaatgagggtgcttacacaaattgtttaactttaagcaacgctacttaacttttttttactataacatatgacatagtgttgctaatataagtatgttacttatataaataattgttctttaacaagtttatattatgaataacatatttttaaacattgtaagatccacaaaattaagttaaacacttattttagcaaccttagtgttagaatgaattcttgtatagagtgtttaaagctaagataaattataagatctataaaattaagataaataattcatttaaccaactttgtattggagatactcataggtgaaattaagtgaaaaagaatgagagaaaattgaaaataacctcaaatcaaaagggttatttatttgggcttttgttgtttttaaagaaaaattttattcttttctttttctttatatctttttctataacagcgatgacttatttatatcgaagaatctaattagtcacttttaatgagatatttcttcttaattattttttttcatttataaatttgaatccgagacttttaagaaattcatagttgatttttcttggaccaacgtggtgttggtccttttttttatcccctactataatcatctattattagttttttttgagtgaaaattcataagagggtattttaccttttattcttacataataaattaaaatattcatttttaagtgagaaaaaaaattctcaaaataaaatagagtttatgcagtgttaatgtaaagatttttacaatatttatcaattaaaaatcatcttaaaaataaatttgtaagtaattattagaaaagtcaataatattatatacatgatcatttattatgaaataacaatataaaaaaatttacgctgttagtgtatttaaattatattatgtagtttctcttacattgagtatttcataatttatttttaatttttataattattattacttaaatttagaccatttaaatttgaatttaaaaatcaatatttatattttaacacataatatcaaattaataaattcattccatattgtttagcgaacgtcatatagtcatgttggaaaagaaaaaacatcttttcttttatcaaatacaattatttttttcttctctctccagttacatgtcttttttttatcattaaatgaaattactttactgactcactttagaggagcttttatcaagttaccaattatattgatctaaattctaattccaaattaataggcatagcaatgatatcttaactcaaataatttatatgtgcttactaacaaaattaaattttcaactcaatttttaaaaatattttttcatttattagttactgcatattaaactaatgagtttaagtacaataaagcattgaattattctaaaagaataaataaatacataatcctttaatgactgaatagttacattaatttaatcatactgtaaaaatcaaataaaaaataatatgaaaacaaattttcaatttaatcttttttcctaatatttctttcttaattatttcaacatttctctctcacatcattaaaaatat

SEQ ID NO: 197 - DNA, 1568 bp, Glycine max
  Soy_ogl_351 Gm02:3438867..3440434 Cluster 1
cttcatacttttagccaataaaagtcatgaaaatatataattttttaatatttcaggaggtaaaaatatatatggtattatattggcaaaaaaaaaaatgagaagaaatcgggttgacaagtaaaaaatatcttatattttaaaactttttaactattttcttcttttgaattatttttgtttattttgatgtttcttctttaagtttttttacaaacaaagaagaaaaaaattaataattttttccttatctcattcatattataagttttttaattgtttcttattatatttatgtctttaggaaatgcaagtcatataaatatataattttctaatattcaaagataatgaaaacatatatggtattctattgatagagtttttttatatgtagagagaatagaaaataaatgagatagataaagtaagaaaacctcttatattttatagactttttatttgtcttcttatgtgttaattttatttacatttccaattaatttattttgtttttattgctctgattttctttctctcatttttgtgtgtaattgagggatttaaagtttgtatgccatgagtctataggaaaggaaaaagaagagaagaacataattgtgaagagcatgatgatatatatttctctttttgtctttgattatgttatgcttataatatttaatcatacaaatttgtattgaaattgatttttggatttgtatttagatagtttttttttgttgaattttatatttagatcatggacatcaaattataaaaaaaatgacttaatcgataggtgataatgttaagaaataattttattgaatttgtgtaagatgtttaagatgattttttctcttgagaggagtttataaaataaatttagttaaaccgttgaaacatggatgttacgttataaaataaaaacataaattttaatttctttaaactaacatgtttctctaatgatttcaatataatattatccttaacttttttcttctaaaaagtaaataaaaaaattaattaattatttttattgtcctaaaaatttcttatttgtcaaacgctggcagaaaacaaacaccattgtatatttctataatgtgctaattttagatttaaatgtttaaaaatgataacaaactcaaaaacattggcaaaggaaacatgacttgaatgattttttttttgttttgcaattataattagaaacatgtttggataatctttactttctacacatatttttttatatttatctatttttcttattgttctcttcacctcatattttactttaaaatatatataaaaaaatccttagaattgaagtgtagataccctaagagtaaagataattaaagatcaaaataagaaaaaaaattcaacaagtgacataataatgtgatcatttcaatatttataaatgtatttgttaaatattataatattcaagtatgtaccacaaatgattttgttaattgtgtatagatagacatgtatttacaaacataatatattaatatcatgttaccataacaaacaaatagacataagta

SEQ ID NO: 198 - DNA, 2000 bp, Glycine max
  Soy_ogl_716 Gm02:47475901..47477900 Cluster 1
agttcaattaatgagttattaaaaaactaataattaattactgagttttaattttcgtactgttacttagaatttactcgatttgtaatgtcatcgcttccggtttctagttgtttattcatgatgttaattttttttaaaaaaaaatacgatagtttttaattgataataaacgtttttaaaagatgtgatagattttgcaatctttcagctttgaaattcaaatccgagatgtacacgcagaatcagatattcaaattaaataacaaaagaaaaaaaaagcgcgaaagggacagaaaatgagaaaaaaaatgatatagaagcattttcgtcttccgcactttgataggagtattattatttttttctttatttctctcttcttttttatcatatacttataaaatttgaatttaaaaacttattatttaaaataaatttaatatatactactatcacttaagccaatcatttgtcctgtacatgctatattttaaacacgcagaaaaactaagccataatctctacgtttaatttggaaaaaattacgagtattgctcttaaacttaagttgtataggtgggacaaaatttgaatatgaaacataaatttaatgtcattactcattaactaaataaaatttttaaaatttgcttgaattacaaaataacatgccaaaagaaatactttgtcgaaaataaaaccctacttttccttggtttttttataatttcaccttctaatggagatctatctaaaagcataataataataaaaataaataaatatacttcgtgtgtatcatttatatttagagagagaccaattaatgtcggatccaggtagacaaatgattgattcacctattaaatgattactgattgggtgaactcaatttaaatttttactaaaagatgtattttttttttttgtacagactaaaggatgtatttatagttagtgtcaacaatttctcaattaggattgtcttaaaacaatacgcatgggattgaaaaacaggtagttggatacgaggcttgaatttgttcaacaaattaagttaatttttaaagggaaattaaatttggaataagagtgatgggggaccatttacttgaaactagttttgaattgaactctatgatctccgaactttatataatagatgccttgtatatatatatagaaaatccatgttgcaatttaggttacaaattgtcagttcacaccaaccatgatattaaaactttcataaataaaataagtaacatcaaatatattttgaataatattgataaagaaatttaagaagtaaatttcaacgaaaagtgataaatttttttcttgacaggaacgaaaagtgataataagaaattcaactcctgtcaactgtttattttgtttagtatcttaagttattaacgacctccacgtggtaattaacttaatcttgaaataaagatttgcaattctgtgaagtaactggtgaatgaatgaatatgatgaccaattatctttctttaatttttcttttgctacgtaattttggtttataattttgtttttaagtcctaattgttcaagtaatgattgatctccgatcatcgaatcattagcccaacaacattataattatcaatttcacgtccaaatttcaacggcagagctaaaaccacacaatacttcaagtattcaactgtgatattcttttaaaatcaatttatttttaaaataagtaaaaaaaaacaaacattgagtaatagagcatcgcattcttaatttacctattcttgtaaatttgtttttctattattaaaaaaataataatttataagttaatttttcttctcgtgtaactaatatccttttttatgtaataaaaaatatcctttttaatttttatgacacatgtttttatcaatttttacattaaattaaataattaactattcaaaaaaatttaattaataattaaatttcttggtttcatatcaagcata

SEQ ID NO: 199 - DNA, 1720 bp, Glycine max
  Soy_ogl_936 Gm03:37702381..37704100 Cluster 1
atttatctatctatattaggtgtataattcaaataaacacatccaatgataaataaagtgtttaatgtattataattccaaagaaattataaattaagtcttaaaatgtttagtttaaaatattaaatgcacctttatttatttccttttagattttaattaaaggatttcgtcggatagagcataaattttacactaatatttaacccttacatttgatttgacagttcaagattataaatatataggattcgagtaaattcatcaaattataaataaaagagaaatattttttttttacaataacatatataatagtttgtaccataataacatttttgttaaaagagttagtttgtaccataataacatttttgttaaaagagtttaactcgattgattaaatgaattatcataaactctttgatattgatttttattttttatcaataaaaaaataatagtaatattttttgtgtctgtctttcttttgcacataatttaatatatatttcataatgaaaaaagagataaatacaaaaaataagtttataaaatttattgtattgttttatatatccaaataaaatatttaatatataattaattcaaagaaattatttagtattcttttttttgaaagaaaatttatttattatgtcttaaagtatttagtaaaaatgttaaatgttgatttgttaatatccttttagatttaaagggatccatggtatagagcataaattttacacaaatatttaacgtttttcatctgatttatttgacacttcaggattttcccaattcaacgaagcaagaggttcatgcatttatgaaggaaatataaaatcaatattttttattatgcaggaaatcaatattttttattatgcaggaaatcaatattcaataaaaaataaataaaaaggaagtacatttaatattataaattcatttttctaaaacataatttacagcttatctataattattaataatgagaattatctcatttagtatccacatttcattggataatttatccttaaatcacttcttaaatttaaattttttcttctaacctacattaacttcctattacttttatattaattgttaggttttttattctatcatttttaactgtatttaacttctattttttctattatttaactgtatttaaccacagtagatattttttctactcttcccctagtttgaataatgtaaactacagcagtatattagcatgcactaattaattaacatgtgattggttcgaataaaattgtgttaaaattttttaaataagattttgagtttgagtgttataaataaaaaacgtgaagaagaaagattttcctaaaaattatctaaatttgctgacaaaatttgttattaataaaaaaacgtgactaataacatagtgcaccaataaattacccaattaaaatctaatatttaagaaataaaataaaatagtttagtatagcttttattctctttccacgtattatgaagtcaagactaagccgactccagaaagtaaacaaatctccttgtgaactttatcatttatgaaataagagattttgctgtaatgaaatcgaatgacattaaataaacattgaaagagtgttgtacaatctgtaaagaaaaaacagtgttctatacaatctgtaaaaagttcagtattattccgtcgatttttgacata

SEQ ID NO: 200 - DNA, 2101 bp, Glycine max
  Soy_ogl_1681 Gm05:35094600..35096700 Cluster 1
gtagaggaagaattctattgaaataatgacgattaaatgagaaaacaaagttaggaatagacatattttataatatactttctataaaatttattattgttattgtacacaaacacttcaagaccatagaagagggtttttcataaattattcgatttaattcacaaaaaaatctgaataattttttattatatcaaattaaagttaaaaaataaattcaaataacatcattaaaaattaaaaagtaaaggtaaatcataacaaaaacatagacagtacaattaaccaagtgatattttacagtagatatcgatcctcaagtggataaatggaattacaaatagccaagtacgttgctatgacagaaatgtgagatcagcctaatgctaattcctaggggtaatgtgaacccagtttatttttttcggtgcatgatgtgaactgaatctttagacaaacctaagtgtcttctttggtttttaaaatataatttttatcaagattttcataagcatggattattattgtattattaacagatcagaaatcattttagatatagttttataatctgattatataataatcaaccaatttatcatacataattgaaaaacgaaaatccgtagtataaaaatgtgggagcatatattgcttttttgttttatcaaaactaactcttcgtatcatttttttttatttaattcctcgtataatctttttcttttaaaaaaaaaaactcctcgcatcatttaccactcctaggtccatttaatagcgagcatataagaactatgaaaatgaccaatctttttttttatcatcatatgcccaatcttatcctgaatttgtattatacttttagtattcttttgtcaactaagtcattttagcccttcttgaaacaaaaaaaattcaaataagtttacgagattttagtaagtcctaaagatattttttttttccattttggtccgtttggaaacataaataataataataatataagtttagagaccaaaatgatcgaaaaaaaagattaatttcaaaaacttcaataaaatcttaagaaattttagaaatttatttgatttatttttaattttaatttttaagaattaaaataacaattaaatacaaatttagatactaaattaatcgtttactctatttaatatatgaatgtaaaaaaaaaaacgccaaaagcaaaatgtactattgcactggaacacgtacaagcaaggaaatgatcattattgattcttataccgtaacacttttcatggtgtggataacactaagaatttttaaattagtgatggaaactttccttcctaacctttagcaaaataattttgtagaataatatagtaaaactttgaagaataatagttcgaaaattctatgaaaatgactttagttctcggcgaggaatatgcatttgggtgcgatgatatataaacatttatatattatatattttactaatattttttttatcaaatattattttttaaatcaccattggacatctaattttgtgatgggatctccaaatatctttacaaattttgacctaattataagattaatcatcaatttaaaacataatcagatctaaaaattcttatttcacatgcttcaaacttgagaattgcatttcctttgttgtttttttttttcttacaaggaccatcatcatcaatgatttcttctttggtatttcttcattgttgtagaaccatcatcaccaatttgcaccaacaatctttaagtttaaatccgaccaataaaaattgttccaacatccaataatatattttatggagatcaaatataaatccttcatcacaaattctacgtgtttttaactgaattatacacattgtataatttttttttaatcttaatctttcttattctattacatcagaaatgtccaacctatcgtatttagacttatcgcctactcttggtaagcgttatccaatgttgaatgtctatagattatttttcttgtgctatttatcaatctctagttttgtgttggaatatttgtctcgaatagttcctgctcactaaaatacaaaattgattacat

SEQ ID NO: 201 - DNA, 2046 bp, Glycine max
  Soy_ogl_1769 Gm06:2797255..2799300 Cluster 1
tgtacttgagtcatactttttgtacttattggattatatataactttattgaactcggataatttaataaattattgaatattataaaatatatttgaaaaatgcagataatatgttattaggaatttttaacaacataggactaacatgtattcgttggaagaaaaatatataataattaagtaaatttaactaatgttccatcttaaaatgtatgctaataattaatttaaaataaaaataaataaatatatttttcaatgattatgcaattactaacaacaattagctacaaaatttatattaaaaagcatgtagctaagtaggtattttaaaattttatctatttaaaatataataaattttaaatatttatatttatccttatcttaccgataaaaaggaaagtcaaaatatttaaactttaaataatgtttgactttattttctagagttttaaaagtatttcaaagttccaattaaaatttcaaatttcaaagttaaagttgtttagtattttacaaatttattatctttagaagttacttttatattaatttgtttttttaaatatgtcattggatattgggatttaaaaaataaaaaggaaaaagtaaaactcatggaattaacttttttaaaagtatgcttatcagaattttctttattaaaaaagttaatttacaaaatatttgttttgaattttgtttagctcagcttttattttaaaaaatagaagctggtcataaaataaattaagcactacttaacatgatcaataaataattctatctaataataaaagtgtattacaaaaagttctgaagtatgtttaacgttcatcttaaaaaaaaaaatcgtttcagaactatcaccttttgaggtttcacacagtgattagatttttaaaaattacttaaaatataattattatttcaatgacgtgtcatttcataattatttgagtccaataatagttttttttttattgaggcgacgatgaaaatccaacctacatcttgtgcatttaacacaatcatttgccactaattaatatttgttgtcaaattaaattatttgtttaagcgatgaagtattaaaaatagggttttgctaactacattaattgaaaaaattttaaaaatatatttattatggaaataataagaggatataaaaaaattaaacatcacataattttacgtattttaataaaaaaaaaattataactttttaattaatatcactagttagcatttaacttaagaattatagtttcatagtcaattattttcagatttaaagagaattataatttcatagtcaattgttttcagatttagagagaaaataatagtttttgttttttttttatgaaaaaattcttatcaaattcattaactatcccctatgatttttatatgtatgttgatataattttaatattttttaatttattaaccagtattttaagaatacttttttattctaaataagagaccatgattatctctcaattcattggatcaatactaatctcattcatgatatataagtatggtttctctaaagaaatcttacatataaaaaaaatcaaatacaaatctttatagttattcacacatggataccatagaccttaaattactatatcaatcacatgaattaacgaaattcatcaattagttgaatatataaaaatgatatatgtaacattgattttttaataacaaaaagaaatactattctttaacatatttcataagcaaatgataggaaaatcaaatatatatatataaagtgagagaattatttgggtgaataaaaaaaaaatgggagaaattgagtaacgcacgcgcttaaaatgcagtttggttcttggaggaaggaatgatgacatagtagccgcccacgtggcataaataataataaatgggttttggattgttgtgttgtagctgatcctaaagaagggaagcagttgggcagttaattaaaacagctggcaccaaactctaacgcaccgacttcttccgttacattgga

SEQ ID NO: 202 - DNA, 1389 bp, Glycine max
  Soy_ogl_3220 Gm09:40193601..40194989 Cluster 1
ggtaattcaaccttatttacactttagttttaaattaaaaataacctaaaggattgtcatattttttattctagacataaagttgttattattaatagatattattgtgtattattaatacttaaaattaaaaattattatatatttaatgtgaatttacatgtgtacgttaaatattaaaaacttatactaaaataatgttttttaatattatttatgcattatttaattattattttgttgataccgattcaattacagttaaatcatcaagctttaattaatgcctgaaatagtttaatgatcggttcgattttaaaaccattgataatatcccgacctaaattaattattcttactctttaaagttaaagtactaaataaattacaaatattgacaaaattactagtatttagtttttttaatttattcctttaattgttttttttttctgtgttcttgtcaactatgtcatttcttactgctagctcgccattgtgattttttttgtcaatgatggtttttatttattgtgacaattttttatggtcactaaaattaaaaatttgacaaaaaaaaacaaataacagctaaaaaaataagagtagtatttaattttagtccctgtttaatcttttatatgtgattttggatctccttctttttctatgattttaatcctcatattttagaaaatctgtcatttaagttcaattttatattttgcatacattgttttttctcttttatttatattgtattaataaaattatttcttattggtggttcttaaataaaatttttttaccaaccttaaatcaatatgttaaatttggaatttaatttgaacaaaaaaaaaaatatatgtgcaaattatggtttgaaccaaactgaagattttttaatgtgagaactaaaatcacaaatcaagaactaaagggataaaaaatgtaatttagaccaaaaaaacaatataaagcaaaatagtgatcgcaaaatgaaagaaaatgttagtttgcttgaacggagagaaaacaatggcaagcagaaaactttgaaatttaaattatgtgaaaaaaatatttttttccttatataaacttttcttttcaacaaaaaaagattaatgtattattatttgtgttttctctctcatttttttcttttatcttgattcttaattaaacatggggtaacaaattaaaatattattttttctttaaacttctaggacattaatctgtttggaaaaaaagatataaggggagacatgaaaataaattaggtgatttggtaggagagagttagagaagaaataatttttaaaataataaaatttatgtaaataattagagtaaaaataatctatatattaaattaatttacaa

SEQ ID NO: 203 - DNA, 1356 bp, Glycine max
  Soy_ogl_3476 Gm10:40570501..40571856 Cluster 1
ttaatgcgatttaggttttagataatgttgataatgatatattagttgtggtatgtattgttgaatgaatctgttagaatattccttgtcattataaatttataatgcaaataaatcaatatatcactttgtggttagaccattagactatatcatagtttaaaaaactgggttggctggttttattgaaaaccaatctactgacttatataaataataaaaaaacaccaatccactgaccaggctgttaactaaaaaaaaaaagagactaattccaaaaatagtaaagattagtaaaaatatggtgaaaaaactagtttgaacattttataaaaataattttatttttttaatttaatctaaaaaattaagataaataaaatcactcatttaaggattacacataggtatatattatttgtctaattattattatttttttatcttaaaacatataatttagtcctttaaaataattaaattttttatatcatgattaaaacatataaaatcactcatatattatttttattttattatatcaaaaagtttaaatgaatttgtacatctatgaactttttgatcatttttaattaggttcataaattatatttttttctcgtccttaaatttatatttattttttaatgaggtctttatctttaactccattaaatagaattaacgataaagatttaattaaaaaacaaataaaagtttagagacttaactaaaaaatatttttggacttaattaaaaaaattatatagtttagggacctattaattaacttaaaagtaaattaaaaatcatagaaaaatattgtttaattgaagactttatttagaagggctgcattaggtacacaatctttaagggaaaactaaaagtgcaattaggggattgatgcttgtgaaatatgagaatactagttaaaaaacatgtagaggttgagaataatgagtttacaacctaaagaggtaataatattcgcctagagaggtaacaatactggattataaataacctttaaaggctcgagaagaatacttgaaaagaatttgagaattactcagtaagtccttgaattatttaaaattttaattagacttctatatatatatattttttttcaattggatccatcaaattgtagagttttttacccaaaaatataaataaaataaaaaattattcaaataatacaagtacaaaattatttatcgaaataatacaaaataaaattaagggtgagtaaatcggtttttcacatttcaatttaacaaaaaataacttgaaaaattttgtttctcaatgttgggaaatcggtggcatatccactgatttctcaacatg

SEQ ID NO: 204 - DNA, 1411 bp, Glycine max
  Soy_ogl_83 Gm01:3343601..3345011 Cluster 1
ggtagggaagaattagctgtgttccaatacaactagggtaagacataggccatactaaatttattaataatattagatttttttataactttttttcatttctttctaccacattaattattttattatatatgagaaagcattcatatactcatcatctaaaatatttttacgttgttaacttttttatccgtcataatagtaattaggaattgaatgattttgtaaaataattttataatactaatgtataatcattaaacttattttatattttcattttgttacatcttgtaaaaattataaaaaaatagaattagtaaaaaatgtacattaaaaatcctataaaagtacaatttaaaatcagaagataatattctctctatccctaattataagatattattgactaatttaagtttattaaaaaagtttgttaattaatttattaacattaatttttttataattattatttttatcaaaattacctttaagtaattaatgtgtggagagagaataataataataaaattctaatttttaaaattaaactctttcatcttcaattctcataagagagaaaaagataattcatagcacttgttttttataaattgaattaattaagaatattttgataaaaaataattaccgttggagaataaaaaattattttaaaaaataaataaattttaaaacaatatcttataataaaggatgaggaagtacatttttatgtatcttaataaaaagaaacttatggttctacttcctttggcctttgtctaaatatattttatcatatcaacgtattgtactgtactctccccattctattttataactaaagcaaacacagttttttattctcttttataaataaattttgattatttttacttcattcaacgagattatgttaaaaatattattcgtttaataagaaacttatacttaatatcaaattctaataatttttttaaaaaaatttgtttttaattaaaaataacacactttaataaaattaattaacttttcagtaagtacgaagtcattttttttcttataataaagaactaatggagtactttttattcttaggcattagtaactgttaccattaacctatcaccacattgttgaaatccaagctaggcatagggaatcacaaaaagtgtccaatagtagtttgttcggaatactcatcacagttgacaaaaggacaccacactataagacaaatcacccaagcaagggactctgtagattattgatttccgattagcagtatatatatactttgtgcttagtgatagattcatagtaaattatttaaactaaaaatgaatttcatgtaatacattgtagactcatacactcctaccctttattggttagttgcactaac

SEQ ID NO: 205 - DNA, 1744 bp, Glycine max
  Soy_ogl_272 Gm01:51824401..518114 Cluster 1
catagttgggattaaaccatgttctgcatccatcatccatgcatgtgccccaaattattaaggagcatagtaaaatgctaaaattagtcaaatacgtatgtgcaaatttgcttaactaatggaattaaaaaatttgattttttttaattaatatgacaattttaataatttgaaccattagtagtagtcacagaagactgatattttcataattgttcttactcgttggtatttaccgcttgcggcttgtcaagagttacttcatgttttcagcataacataacatgatttcatagagattttggatcaacttgtaataagttaaaaaatatatatataatttacttaatttttattactttatttatataaattaattttagagttaaattaggttaaattcaaaaattaaaatgatattaacgtctatcctaaacaacaccaaaatctaaatttaagtcaagttgaatacacattttacccattaaaccatttgaacacccctgctacaagttataaatttttaaatcacttatatgtactcaaagcataggacacaaacaaaatatatatgctaaactttaaaagaataagtctaattaattaacttttttatattatataaacttatttttaagttgtaatataacctttattgtaagttacttaaaagtttatttgtaataaaagtgtttaaataagatataaaattattctaaaaaagaactatagccttgactgcatgtatatcaatacatttaatttttaatatttgaattatggataacacttattttgttatcatttgtatcgattgttgttgtcagttttgatcctttattttgacattatgtttttagattttaataaaattgatttaaaaaataatagaaaaataattttcagtttttgaatgatattttaaaatatgtttaaaagaatttaaatactatttgttggtctgttaacttcatggggggcaacctagttgtgatcctcgtgttatagtcttgttttagcgcatcccttttttcttaaaaaagaatttaaataataaaaaggtattcttgaattataaatattaatattctttgtgagttacatatttatgataagatgtctattttactttttttctcgtggttattaatataggtttcatgtggggctagttgcctcttcttgccagcaaaaaaaaaaatgtcaattttacttttcatggtggtatttttcttttattgaatcttttcttgttggtattgaggatatatatcagttcagagaaatttattaatctcttttaaaatatatagattagtaaaatgaaatttattttgtaatgaatttttttacaaacacaattaaaaaaattaactaatatatttaaaatactaactatgtatcaattatagaagttgttgagagatatcagctttatttctctgtcacgtaagatgtcagttttatagtttatcatttttttttttacaattagttttaagatagacttgacggagcaaaaatactaataagtattcttaaattattgataaaagtaaagacgataattgttaaagaaattaatgtattaaaataaattaataaatactgttgggataatttaaaagaattaaatattaattaattttaatcttagaaagatgtaaattagaatattcatgactcatcgcgtcctattaatctaattggatccaaagttaattttaatgaatttaaaggcgac

SEQ ID NO: 206 - DNA, 1400 bp, Glycine max
  Soy_ogl_2611 Gm08:11481201..11482600 Cluster 1
taaaacaaaatttacattttttaatttttaaatttgtgaaatattttttcaatccatttttattatttttttaagatttaaatgtataacttatgataatttttaactgcatttatcaatatgtttattgtcatgcatttgttgtttttctagattattgagtttttttaaaaatccttaaaatattaataaaagggttttctaaattttaaaataaactaatcaaattttataatatgcaatttgcattcctaaataactaaccgaattgtgtttgaatttagaagaagaaaaaaacgaattttgtttattttatggttaaatttatttttctctaattcacattttcatttcgttatgaattataataaattattcctaagaattaatcatgttcgagaaaataaaaatatacttttttgattcattcttatttagaaatattaaaatttaaaccaatgtatctttaaatacattcaaaataacttctggtttataatatttttaaaaaatttagtattatacctttgaataagtatctcttaaaaagtgagtaacaagtgaaaatttaagaattcaattactttttaagaaaaaaagactttttttttgtgccaaatttcagctcttttgggacatcaactgaaatttagtaaaaaaaacttcttctttttttaagaacaaatgtttcatttattttaaaatttgtaacttatgattatttttcaacaactattttcccttcaacttcatacatattctttttcttatatgtcgatcagttttttttttgttttagtcaaacgaaattatttatgttgaaatcaattttcagtatcctatgctcggataaatatttatcttgtgccacccaatacctgctaagtggatatcagcaaatgtttggaatattttcgggaatatgtggatattttataaataaaaaaataattttaaaaaataaaacacttttatcataatttttatatttacagcaatataaaaaaactgcaaggagtaaaaacaaaataaacataatttgcaatgagtaaaaataaaaaattaattttgcaatgatgaaaaataaaataaaaagtgttaaatcgcagtatttaagccaaacatatattattatttacagtcttaaatatgaaagaaaaggaggtctctagttggactctctagaaatgccatagtttaaaatctgaagaaagaattttaccgtttcaagtaattttattcacttgatctaaattaatcggattcttaatatttaagaatactaataaacatatattttaaaaaatatttatgaacgaaaaaaatacaaatgaatatattcactgttgagcgagcagccactttcatggagaaagaaattatatatggagctatagcac

SEQ ID NO: 207 - DNA, 1200 bp, Glycine max
  Soy_ogl_6512 Gm19:42413001..42414200 Cluster 1
gaaaagatgaaaataataatggagaaaaattttatactttttagtgaaatttatattttttatattttactttaattaaaaaaaatcttatatttttatcctctaaatcaaacacgccattaattttcaacttcaattccttttgttcttaattaattgtctatttttttataattattatgctataagtataaagtataacttatataattaacacagtaatataatatttcattaagttaacatataggagaataatctttatttggtgagagaatcatctctgtaaaaaaaaaattagatcacgacaatcatattctacaaacataattaattaatctctagttcaatagattggaaaatattcaagtatttattgattttatcaataattaatatttgtaaaaaaaatataacaaaaatcctttagaaaaatattttctttaattatttttttttcattcacaacagttttaatatgaaaccgtatttataaattgtctatttaagatcgatagtaaggattacacaaataactaaaacagatggggaaatgctttttaaggaattaaaattgagaaaataatttttggacaaacatttaacaatttaatattccaataataaaaaatataaatattattagattacattttttaaggtattagtaaattacattattactccatttatattaaaaataatttttaaataagaatatgaaacttcattaactgatttcaaataataatatttttttatttttatatttttttgtcgtgccaatgaatattctaaaagtaatagtttctttttgaagagttatcaatagaaatttttgttaaaaatataatagagatgtattgatgacattaaatcttatacttttcataaaaaaaattcatttttaatacttcaattaatgtgtttagggtcctaatgaaaatttacattattttttacaaactatgttcataaaaatataaagaacactctagctaactcataaggaaataatcagattagtcaaatcctagtagctagagtttaataaaataaagaggtctgagaaacatctaatttaatttataacaataaactaatactaactttccaattaactttaatcaccacagctataaaatcgaaaggtttattaattcctaaataaaataattttcgttatgataaaaagagtca

SEQ ID NO: 208 - DNA, 1600 bp, Glycine max
  Soy_ogl_3634 Gm10:48893001..48894600 Cluster 1
cataaatgtttttaacagtttttctattgaaaatacagaccttttttcaaaacaaaattcttacataaaagaagattttatatttaacggattggttttatttatttttgttgtcaatataaagaagatataaggttgattcgggaaaaagataatgaaagaaaagaagaagaagagataactggttaaaaaaataattaatatttaaaaaaatataatatttactgataaaaaaatattattgaaaggagacttaggagaagagaaaaaaatggtagtcgcgggctattggtgagcttgggttacgtgtggccgacaccatcatgaatcggtaaggttgagaagacttgtttgtttgcaagacatattcttgatctgaatccttcattatgtggagttatgagttgtgacttgtgtcatatggcatcagcacgtgtttatggaaaaggaatttcagtccataagttaaaaaataaaaatgtaaggggaaagagcttataacgtaccacatgggatttgcccagcgcttcttttctttccctttcatttacattccgcagatcctttgacggcttcgtcaacaaatcgctctcctaacctcttcaaactcgaataaatggtgcctttcgcttaaaacattaacccattttagtcgcatatgactttaacttatttcacctttttggatcaaataagttttgattttttgtctttttttttttaaattgcccatttttaatcttttattttatttttattttccatgtttagtccctcccaagcatttatgaacaataaaaataaatgataaattgaaaataagtaaaatatacagaaattaaaacacaatctaaaacttggcagggactaaaagcttttttttttacaataattatctcatattatttcattcaaaataacttcctaaatacaagagaggatatgataaaaacagatatgactaacaaaagtagtgagtatagaaatatacttgctaatttttccgaataaaagtttatttaacccttatgtttttagttcttaaaatttggaatttcctaagctgaaaataaattatttcaatctttataattaaaaaaaaagagagtctaattttagccactataaatagatctcaaatattgcttcaaagtgtatgaaacgaaaggttataagttaatgcgataaaaaaatattaatattttttttactttgatcagaaaaagtatccactataaactactgatatttgtcataaattatgtttgtagtccctggaatttagaatgaatttgattttggtcctttgaatttaaaaagatgattttagtcccttaaattttaaaaatacgtgtttctaatccctaaaaattaaatttgagagattgtttttttccaaagttatttttagtccttaaaaaagtacacggactaaaattatatattttttataaaaaaaaattgaacaactaaaataattttttaaaatttaaaagaccaaaattaaattcacctcaaatttaaagactaagaatataattaaaccaataattattggctataagctaaccgcgaggacttcaagtttccaacttaaacc

SEQ ID NO: 209 - DNA, 1649 bp, Glycine max
  Soy_ogl_6991 Gm20:44601901..44603549 Cluster 1
gatcatttttttgaatatgtgattaaactaatattttttattataaaataaaataaaatttagtagtataaattttaaataggttcaattatttgtatattatctcggatttttcttcttagcttaaactaagaatttgattactatttttatactgtattctaatcgcatgctgctatgaataataaatatattgttttttataataaaaggttaattaaaatactaaaaaatgcatgaaatttaaactcagaaattgattagaataagatctaaaatttatgtcaatagagctcttgatacccgagctatgggatatagtcaattaaaaaattcgaagaagaagaaataaaataaagacaaaattcatgtatagtttgttaaatattattttatcctttttttcttacataaaattaaaattttatttcagcaatttatccaataaataatactgtatgaaaattaataactgatcataaacatatcacgttgcttgcttgcttgtataaagtaatagtataagcctatactcataagcaagactacttttctatcaatttatactctcccttattttaatgaatggcacaataattgaggaggaatctgaacctcttaacagttaaaaaaaggatactattacttacacttaacaattttataatataataatttatactatcatttaatcatatttgttatatgtatttaagtttgtaaatacttataatgattatattaaaaatcattggttgatgttataaaccattttatgctaataatatatagaaagtaaactttttggtaatatcagttacgatatgttcttatttttttcccataataattttagtagaaaagtagcgtgggaaagtgttactaaaataatagtactcgacttattttatcacccaaaattatttaaactattttttacacatattttattaagttagaaatctgttataagaaaaaagagttagaaatcaaatttaacggttgagtttctgtttctttcttcaagtgagtaagattgacacaacttccagagacgccactttagaaaaagaaacataacatcctactttatttatagtcagacctaacagttgatttaataaatggagtttattaaaaacagaacactggcatggcatcccacgtggtttttcttggttacttgtcgcaaatgccacaaagacggagcaccccagttttctgcagaattcgcttttaaatatttaaagcaaaaattttcattatgttattgttgactgtgcacatagtcttcacaattagttagatgactaaagtgaacaaagtatagcaagttttttataatataaccaacttattttgttgcaaagaatgttaaattataaaaaagtaacagaaaaaataatagtagaaaactaggtatgttaaggtagacatgtgattatcaagaaaaaagtattagcaaagaccacttaaattgttaaaagtactataaaaaagaaaattacataattaaataaatatcagaactataaagaaaatatcatcataaattatattcttatgaattttatttttaactttatatataacgggtctcaaagataaattcaaggattattattacatactttcttttcatttcttat

SEQ ID NO: 210 - DNA, 2797 bp, Glycine max
  Soy_ogl_1154 Gm04:924501..927297 Cluster 1
tatttggatcttaagaaaagaatgctgattaaaaaaactaaaaaatatatattttgtgtataaattataaaaaaatataaaatgttaaaaataatgtaatttttcgtttttcaataaaaatattttcattttaagcctattaatgagtgttctagtatttgtctttttattttttattgtacgctatcaagatcggtttcgtgtttcaaagagccacctattgtttgaccaaactttaatgagtgtagccgctaactactttgcatcagaaaataaattaaataaagaaacaacttttcttcatcccacaaagtcattcattttgctttacgatagcattgcatgtaggtgatgtagttttaataagagaattatttaaaatcattattaatgtacataatttataatatccacagatgatatggtatcattattcatttattaaaatttattatattttttactatgaagaatttttttagttattgtaacgaaacaagatttttatttattaatggtatacaaaatttattttagaaaaaaaagtgatggaagatttaaaaatacagtttacaacaaagaaattgcatgtcacacttaaagttgttacttaataatatgatccggaaaaaaatctctaaaggattaaaatataaaaaaacttcttattttttacggaccaaaagttacttaagtctttaatacaatattgttttttcttatcatttctattttttattcttttactctttatttaactcatattctaaataaaataatctataaaattaatgcagtgatataaagtcttattttattttgttcatacgtgtgaaaataatttatttaatagaaaaattcatttgattttttcgtgtgtaatttttttttggataaaaagtaattatacattataaataaaaatagtctcttatccgagtggattgagagagacatgtaatatgagaaaaaattcaatgaaatatataaaaaaaaaaaattatattccaaatggctagcattacatgcctcgtctagatttccaaattaagttgattttaaagtttaatggatatgtattgtaaatataaaaaaaatatatcattaatgaattagaatttatatttaatatgacggaagataattactattaaaattaccaaatttaccatatattacaatttgtaattaattgaatacatatcctattttctctatttttaattctcgttttcttttataaatattaatacctttctggtttttccaagataaaagctaagcatctgtcaaaaaatagaagagacaagctaagcatttttaaaaatttctgctatgtattaatgcgcaattgtttttgcaagattcgatttgttttttctctgcacatattctttatgattcaaaaaacaacataaatgtgtacctatataagctatagtctttaaccatagtaactaaaattgcgaaccatatagtaatgcaagaattcaattactcaatcatttatttatacgcgtttctccattaacgagttgatccatacgctgccgattcattatgaaaatttaaccaatcttccttgtgtttactgaggcaatcagccaacagttaaaaagcattattattgtctcctctatttccctgttttatttccttttagtctcgtgactcgtcgtgagtgtaggataacgtcaatgaggttttagtacaggattacgccactaatcaccacgtaggattaggtaattatttcctaattggagtaaaaggtggggtgaagacggaagatctgaaatcggaataattattttatttcttatactgttatcttctatactagcatcaatccctatgtatgggtatactactataataaacaactggattatatttcagccctaaaatgttaatgctcattagtgcactgttaaaaaattataagtggttttttttaattaaatattgatattgccatattttattgtaatttttattattgattagtatctttaagataaaaataataattaacataaaataggtaaaaatgattagcaagtcttcatatttttatcaaattttcgataaagtttttgatctttttttaaatgggttttcatttttttaataagatcttttcatttaattgttgttataaaaaaattcacatacattagttatagatacaaacaacggactcgtgcttctctagtgtcaattatgataaattttttttataagagttttattttattatataataatcattatttattattaaaaggacccaataactcaaaattatatgtaacacattaaaataatattttttttattaaacaactcccattaacgttcttagttgttttattttattatataataatcattatttattattaaaaggacccaataataatgttaagcactagtatttaacaagcagcgtctccaatagttacgtcaaataaacacctgtccttagtaagatcagaaccgtgaaaaagtgacagatgaagatgctcttaagattctttaattaatatatagaaagtttctattgaaaaacataatattaaaaagataaaaatattattatttttgtttgtttttttaaaataaaaatatttaataacttctactttatttgtaaagctctttttaaaactttaatttttaattgtttttaagtaaaaaaaagtcaagcctaatatagcttaagtcaaacaaaaatttaaaatattttttaaagataaatatatttaaatttatataacatatttatcaaattttt

SEQ ID NO: 211 - DNA, 2102 bp, Glycine max
  Soy_ogl_3226 Gm09:40305630..40307731 Cluster 1
aaagttatgtggtattcaatcaaaaattttaaatggtataaataagtcttgtggtatttatttaagacttttaagattttttaaatgagggcaacaaaatccaatgatattcaattaagattttttataatttataaaaagtattttggtattcaaaaatatacaaattttgatggattattttttaagaatgaatttgatgaatttcaccaaagcttttaatataaaacatctatcaaacaatctcacccaaacctttaaaattttgctaaactcttttactttttttctattagttactaaatttacttttctctcatcacacatacattattctctttaatattcttcaagacatgtgtcatatatattttttctattcttttcaaataaaagaattatcaaatatactcttttttgtgcacttttttatttgttttctaaattaatgtttgtcttatatattaagattaatcatttttttcttatactgattgtgtcaattacttgtttaatgtaatatttttgtgactttcatccttagtttcatcattcacataacatagttgagtatccaagcttcaatgtcaaagtccttataaatctataaagttcttttatatcttttaaatttttataatataaatttattaaaatttaaattacaaaatcttaatcctaaaagtcttttacaaaaatatgataaatcataatatttctacttaaatttttaaaatttacaagattttttatgttaaaaaagtcttttaaaattctaatcaaatacatccattagaattatatttttaatttctttttttagtattattagagttgtatattcaaacatggtgttccatgaaaaaaaaaaaggtgtgttaggtagcaaacaacggtacgacagttcctttttaaaaaaaaaaaacagtattggtttttaaaaatatgtaagagagagaaataagaaaaaagtgtaaaataaaacaagtgatataatgtaataaaaagtgtataaaaatattgaaaaaaatgttgcataatcaatattactctggagaaaatagcttgtcatcagaaactgcatataaaatatcacatttttcttgcacataacatattatattattggatatttattttgtaagaaactatttatattattatattgcaatagtagacatttcttaagagggatgcaaaaagttttcgtctgtcatgcggccatcgtgggactttttcccttttcctaatcttaataaaaataagctatgcaactactcagtccaaaattgactatacccttaaagtgcatctttcaattgtgatggccttgcatttacgaagaacaagactgccaacttgctagtggctgacctctttttttcattttctatcagtttttttcagagagagtgtggaaatcaaagacaagctagaaaatagaggtgttaaagtgagtcacgttgactcaccatccatttactataatttagtgaattattactcatcatctgtacgcagttacgttatcacaattcaatgaaaaaaaatatggacatcgtaaatttttcatcacctgataaaaatatttatactttaatttatttaattagtgctttaagcatttgtcataacaaaattattaaagctaaaatataattttttttcactctattttcttaaatttgtgtttttatttttcctatttttcaattgaaacattttattttttatttttaaaaaatttgtaattttagtctctccttttttattgagacatttcatcctccacttttaacaaattcacaattttaattcttatgatcaattttaaacgttgatctatatatgctataaatttgaccgacaactatttttttattttcatgtgataaatatttttctcaaatatttaatttctaaaaaacttaatttattaaaaataaaattaaaagaatgcatagtcaataagccttaaattgattaaggagattaaattacaaattttgtaaaagtagcaaacgaaatatctcaattaaaatataagaaaattgaaattatggattttttaagagtagagaaaaaaattcagttaaaaaagt

SEQ ID NO: 212 - DNA, 2009 bp, Glycine max
  Soy_ogl_4825 Gm14:48617592..48619600 Cluster 1
tagttattttgagggggagagagagagactagctagtaagaatttttcaaaattgaaaaaaaaaaaagaatctaactgattattataatattatatcttgttttcgattgtgactatgtataaaagacataaatgattagttattttgaggaagtatcattctgcttgtacttatgcatgttgattttttctgcatgtagattcaatgagcaaagaacgcgtacatggtatatggattgagaatgatgcgcacgacattaggtataattcagcagacttattcttacatttttaaaactctttctttcttcttatttttctcacactaattgtatgactaaataaatgtctctgttccttgtaatgatattgacccccatttttggtagcactgggtaagggaaaatgccaatacatagccagttgaagcctccaaaaatattatcatgttttctttttataaaaaaaaaaaaagaggttgcagatttatgttagttgttattggttttcggtcaattaaagcaaatttagaatgtttaaaattattcaccaaaatttataaaatattttattaatttgaaaatcttctttattagtttattcaccaaaatttacaaaagttaattacttttatcatagttttatattagaaaatcaacaaataaacgtattaattttgaccaaccaatactactaattagtccgtctcctataattaatcatttatcattattcaccacataaaacctagctccattaatatcccccaattctttatatttgtgttttttatattctgattatatatgtggttatataatgggattttgattccctagctatatctccttttctcattccttaggtctaataagatctccttagaattttaaaacaaaatataaaaaccatttattaaggttatatcacaccaattcaagattattttgtaattagcaatcagaatgtctaaaacatatccacaacattttgtttaaaaacaaaataccaagcattcaaacttgttttactttaatttgttcaattatttcaaagtgtgcactaaaaaatagttaaagtttaatgggtatgtacggatgataatgtaattttacattatatttcctctgaatttatatataatcgaaaaattacttatattttggatttaaatataaataaatttaactaattttattcctattttataatattatttctaaaacatcattcatttagtcgtaacttttttcttaagaattttattttatttatgatatcaagtttcaataaaaaaaacattttaagaataatcttattttttactcaagattaataaaattaaataagtttaattaactttcttaatcaatgtaaaaaaaattatttttatttatatatgaatccaaaagaagtataaaactattttataatttcagtgtgtaactttttttctattatagttactctttacgtgcatcaattctttcaagagcttaaactattatggaaattaaaacatcatatttgattttatgtctgtacattattttttttataatgccgtacattaattgattatatgatattctttataaaaaaaaaatttgatactccgtaaacactagagaggccagttattattgaagattaactcaaagcatcaattatcaaatctaataaaaaaataatctcaattttaaacatcataagaacagattaacagctaaatgagataatgagtaagataagttggtataatgggtttataaatttctacttttaccatgagttatatgatgatttttaaataaaactatgtgtgtagaagttcagtttattttgaaaaaaaaaaaaagagttcagtttgggttgaaacaaatttaaaatttaaatccaaaatcaaatttaatctgataaaaaattaaaaaaaatcaattttttgatttaataaattttaaattattcgatttcaatttgccagattatatttaattgaattgattaat

SEQ ID NO: 213 - DNA, 2125 bp, Glycine max
  Soy_ogl_5496 Gm17:3949603..3951727 Cluster 1
taaaaaagattcattttttatacctaacaaactaaacatcacctttctaaaccttcataataattattgttttctttcaaatataaactcaaactttatatttttaacaaaggtttagagtttagatctaacaaaacctcacaaatttttttagcttattttcattaatatttttcagtaattttctttgggtatgtgctttttatcttatcttattctatctttttatatcatcgatcttctgtactatttgctcttttttttccctgttttgtttcgagtacttagttgattttttcggaccctttcacgggcatacttattaattatattgcagacttgcacacattaccatttctccgtgttcacccatccatcttccctatttgtggttgcatgttttgtttcgaatttcacattgcaatttaacaatttttctccgttgcgtaaatttattataaacggctaaattccaggctaaggtaatatttacgactaagaggttagtcacattactttcgcctacgataataccttacatagttagataaattaaatgctcaaatcttaatttccgatttttttcaagatgttaggattaataaataaaatatttatcataaaaaagttcgtggtcgtcgacatttttatttcgtgtgaaaaatgcattttaaatttgattaaaaagcagttaagttattagcaatgtatcaagaaaaaacgagtaaagaaaattaagaaaacaatatctcaatgaaaattatactactataaagtttttttgcaagttaatttgggtggtaaattaaaagtgaagcattatacatttttaaagtgagagattcactttagaaagataaaataaaagactataattgattaaaagtaataaaaaagctgtaatagtaataaataaatacttattattaattatttagtttaaattttaataaatatatgttagtagatattcaaaaaattattattattgagactgttgatttatgtatgatttttttttttacttttgtgatgtcttatattctttcttttgactttctcttaaacaaagttgatttattagttatttttttgtattaataattaattaaatgattcaaattaatgtttatttaatttttaaaaaataataatatattaattagaatacttaaattaaagttttaaaactgaaacagataaagatttaccctaaaaggaataaaaaaaatttgatgaatttgccgagttgaattacaccaacacgtgcccgaatggagacatcaagttgatgaatgaactctgtgtcatcgctgggtaaggttatgacttcaaaaaattgatcaacatgtttttcttgcttctacatattctgcattgaaactaaataaaatggaataaaaaaacatgtttattttaatgaattggcagcatatattactaaaaaaaataatgtgattgtacaatactattttaattattgtatttttggagaatttttatttttatttctatttatctgtcgcttgtaaaatataagatcacattaattgttattttatcaattatattgttacttgtcacataatttttaattaattaatttatgcatttattgtggagtgaaaaatagaaaacttcacatgcatttcttgaattttacataataacttttaaaaaacagataaaaatgaacgaatgtagtataatgaatgggcaacataattattattaattaaggtgacataattgtatgtatgttcattttagtattttaatgaattgattgatttgaacaatttttaatttaatgtaattagaaataaaattttatcatctatcattttattattttgaattaattaaaattgaattaattacatttaagtaatgttgaatgaatatgaggttgttatgtgaatttttttattaaataaaattttattttttatataatataatagataacggataaatacatccaattaatttttaaataaataattataattttttacttgtaagttgcaactagttaaatctaaaaaagagaattgttatgatttgcttattgctattacaatgatatacatgatgtgggttgtttagtatttatagtttattg

SEQ ID NO: 214 - DNA, 2000 bp, Glycine max
  Soy_ogl_5804 Gm17:39790501..39792500 Cluster 1
aagaatttatgattaatatttttaaattaatctaataataattaaagaacactcatcatgtatctctaacctaagacaaaaaaaaatcatataattttcatttcatgaaaattgataaggttattataccagatattttgatccacaattcaaatattctacaatagagaaccattttatatatatatatatttgaattaccttgtttaggttttacaaaaacatattgggaacacttcaaagaaataatatatatgtctaaaatgttaagtatataataatatattttgttctttttattttatttacattatttaatatttaaatatatttttgtaagattttatcattttttatatcatagactcatacatgtgattaaacagaagcactaatttaaaaaataattttttaaactcgttcatctatcaagccatatatatagagagagcattgtatttgtactttaatttgtaggtcgagcattgcagtaatattgtatgattgataacaaattttaaaataaatattttataaaaaaataaaaacttaaaaataataattttatcaattataaaacaaattattccaaatatgacaagcttaaccccctatttaaatatttttttattataatattagtataattgttggtctgaatgacaattatcatcatgatgtcccgtgtgaatataaggtagactcaccataaatgttggtagaggagtatcatgaggagatgataatagcggacactgatgttggtgaatacaaagaagagtttatgattaggaagagggatgattcattatgaaatatgataatattagtgtgaggattagatgaatcctaagataagtaaaagtggtacagtaaaacacctaaaaagatgatccacggttatattcattttttttttatataaattctttcttggatggcaaattaacgaactttttataatttcacgttctttttatctttctttctcaactctatttttatcttatcaaacaaaacgtaaaaattacatccttattccactctacttctaccttatcaaacaaagcataaccacgagaaaaaaataacaattttaactagaaaaaacacatatttaatgttcggtaaatattcagaactattttctatcgtaatacataatctaatacaaaatttgtaattcttattaatttatacatatattttaactatatttaaaattgattttgttaaaatcagttttgtccaaatttaaagcagagagacttatcaatgctctagttagccaccattgaagaacaaacattatcaaattatattattattattatttactgttgaaatgatattatttgtgcgtcgtttttcttgtaaatatcccattatgtttacatcctatgatcattataaactgaaaactacattacatatcccataattcttttgacatatggaaatcgaaccgagtgacgtgacttgaaaagtggaacatccacgtcattttcattcaactatataaaaaaagtatacttatgcagtttttatataaggattcttgtggtgtgatgtaagaatttaacttggatttttaatttattttagtgaatttattattactatataagatttaaaaaatttactaattttttagtttaatggtagaatttaatttgagtgttttttactaatttatagtgagtcttattacgattaaccgtgagtttctgtggtatgttcttttgttacatgtattaatagtatgtaatgtgttatgttctttctcccctgaattcattagtatttttactattgttacaagtaatgttatgttctttttcctttaaattcattccgttcatgtatagattttgtagtatgttcgttatattaaattaagtcttgtctcactaaccccaggaccaaaaataaagtgttgtggtcaagttaattttataattataattaatttaaatatacatctgaattatatttaacaa

SEQ ID NO: 215 - DNA, 1700 bp, Glycine max
  Soy_ogl_6553 Gm19:44179301..44181000 Cluster 1
tgtcatgcatcttttctgcatcaattcaatattataattatttattctgtattacacatccttctacacgagttcgagctttcttcaagttaactaaattcttaatctttaatttttttaaaaaaattaatttttattctttaaataaaagtttaaccgataaaggtttcttatctttttcaaagtttgatttttaattctgaaacaaaaatttaagtgccgaaggtttcttatctttttttcattaagatttttagtttttaaatttttaaaaatttaatttttaatcctgaaatctcttaaaataaataaaaataataggttaaaacttttatttaggaactaaagactaaaatttctaaaattttaagaatcttaagatcaaacaaaaatttagggactataaatcttaatgaaaaagttaaaaaatcttaaccaaataatttttttggggagtaaaaatcaaattttaaaaaattttagggagtaaatcccttctttctttaatgtatgtttaattattcaattacttagagttttgcattatctccagcggcttcaatatttatatactgactattgtcgttgaaagtcaaataaaaattattgaaatgtatcgcacacatatatagaggtaacaatgtctataaattaaattcttatttctttaatttttttttataaaaaaattgaataaataatatatgtattgacaatataaaaatattttatgttataatttaatcataagtcatcatgttttatgtatagtaagtttattatttttataataatttttttattgacaatatataattatcaagagtcatcaaggatggtttttaattaatagattgtgtgaaaacttttatattgataatatatacttattaaactcaaattttttaaattaaaaatctcgaaatgtcataatagggcacgagaagcataaaatataagaaaaatgtattgcaaaaatgatattcttgctttttcctataaaagtgagtcaacctaaacaatttgactgaaattacgtgtaagaagaagcaaccgtaaagagcacgttacatggtgataccttggagacaaaaagaaccactagaggtcattagtccacaaatatggtagaagatttggaaatttcagggctcagctatgattgatcatatttcatagatactatatgcgtatggatatgcaaatacctcaataggagtatttcaaagatatataagataagatacggtacctacggaataaatatagtttaattttttattttctgtatacatgtaaaatttttatcctgttaattaattacaaattattcttaagatagtcaacactgattaattaaattttatctaagcgtgtacaaaattcataaagcatgacaactatataattctgcacatttaaactaaaaacatgttttttgacattgttaataatttataattatcagaagtcactgtttattgtttacaaatagaaattactagtattttacaagtagatgtaaatttaatttattttcttaaatatgaagaggacaactttttttcccgcaaagataacatttctatgtttttagctcatatataatttttatccttttaagtactttacacgtacgatacgggtctcgaatatacatctaacacggaagtatgaagctaaagtaattgttcatattt

SEQ ID NO: 216 - DNA, 1800 bp, Glycine max
  Soy_ogl_4964 Gm15:9882001..9883800 Cluster 1
catacgtatgatttttgtgacatgtataatagtttatgatttaataacactataaattattttacatgggcatagtctatttttttagaaatatatatgaataacattgatagaaaatctaattctatttcctcaccgcatatatgatacttcatgtcaacttgcatttcttatgtgtgaaattctcttttgatgccaaaaacttgcgcaaaactttccgcaagatttttcttcttcagaatctcaaacatctttagaagattaagcaattctaaaattttgtctctacttttcaataaatagtatctatgaggaagttaatacttaattatatggacatgtaacttcccttaatttttttttttggtgttaaaataaaggcgacatggagttgcctaagcccactctgccacaaggtaagcccaaattatggatccaattttcagttcctctactgaaattgaatatatcagtttgatcaaattaacatatcaaaattagtgtgattattttctgttttaagaagcttcaaacgcatgttaaagccttaaaggaaaagtaatgatttattgcttctctaaaaatggtgcataagaatgtatgcagatggattgaaatggtagaacaaacacacccttaattgcttcctaattggtagcttggcatgtagatatatagaatagaagaagagtgtatgttatctccttccatatcagagttccatcaattatccataatctataattatagataaaaggaatatgagtattttgatatacacatttttatacccatttaattcatataattatattcataaattattattttattcttataattatctttacaaacatgtaactattcattatcttctattaacttttttattattaaaaaacatgaaaaaaaaatagttaaacacaaagtacttgctttgtacgtccttccatttctagcattgtggttgtaaagaacttgtttaagaacttgcttgaatttcctaatgtctggcggcttggtggtatcttcggtgctagctttgaggaagacacatatgacaagtgatgtacactactgttattattgactatattattaagaatcccgaaataattatgaagacttatgtatattgtatacaattcaaaatgaattagtgtatcactagtgttttttcacacggtaaaatttaatttaaaataatcaataacataaaatacgttaagttatgtatatttaaatttaatggaaaactgctattataaaaaattctaatgaaacattagataaatagatatttgtaacgataaattaatttatctctatatagatataaattgttaagtaaagttaagaatattagaaattgtaacacaattaataaaaatatattattattagttattttggaatgaacattttatatcaatctttaatataaaatgtataacattgtcttggatcaaagaggaaaaaacaccaaatatgtaaatcgattgatatgtgtttaagcttaatgagtaaatatcaagtttaagtcttaaatatttaaatgcttttaaattttttttattatcatcttattcgactcaaatataatttcttccataaaaaaaatatataatgttctttaggaaaaaaaccaaacaaaacaaagggtacaactagaagttgaaaacaaaataaataaccaacaagagattaagaatatactttacgaaatacccaaaacacaagtgcatatatataatcgaaatgctcgttgtccacaacaaaaagctcttaatccatttccca

SEQ ID NO: 217 - DNA, 1593 bp, Glycine max
  Soy_ogl_5789 Gm17:39615001..39616593 Cluster 1
ggagtttatcttatgttttcacaaactaagtttgagggataagtttggaaaaggggaaaggattcaaaggtagaagtcaattaaaattttaaaattaaatagttgacaaatgactccttttaagtgaactgtagaattattcagcttttagagttcagagaggaggaaacatttctcaaaaaggaatgactagctaataacttttcaaaaatgataagatttaatgagtaatatcatttttcttaaaagaaaccacacacacacacatatatatatataaattggacacaatgtatgattaaaattatatacataagtaatgatttgttgattaaaccctttaaacatataacagtgattactcattaactagtattctattttttcgaagaattaatttcatgacttatgtatgtgagaaaatcttgattatttaaagagccataatgatattaagggcaagacatcacaaaatgatttttctatcattaagttagtgcaaacttaaggatgaataatggatagataaaattatacatacatttaggtgtgtttatttatttgggtaaacttgatgagtttggaagaaaaaagaatgaaaatgattttgaaaagttaaagttttgaatcaaattaattaatatgatttatataaagtccaatttaaataaaattaataaaatccaatcatttttttatttgggtattggctgtgttattagaacccaataactcgttatccgaacttgcaattgtaaaataaacttccttaatttaataaatgcacctcctctatgtatttttctctctctctctctcaaatatatacccccttttgtggaaattatgaagagttttttttttttttagatttataaattttttgagattattcctgtatttagagtgtgtaatgactatgaaaaaatgtaacattcatgtggatcttatatgatttgtgaagctaagggaataattattctcactacctaaattaacattgacattatcaatcataacaatttgatcattttatccttcttccttttttccacatccctaacttttttcccttcctctctcatttaccccttcctcttccataacatactcaacccttttttcttcctctctcatttctccaattattatcttctctctcatttccctcataccaccaatgtgttaatttttttacacaacgaaattatatttttgttatatttttaacaaagtgaaaacatgattttgtattttttttataaattttctaaacacaactttcatcgtgtaattttttagagaaattttttggaaaggactcatctaatctgaacacatgattattagggagttgcaattgaccccaatgccttttgctattcactcctatccctcaaaattccaaaattatccatccctgaaatgcactacgaaattgtgtttttgctgcataacaggaggtgtaaaagctatacacaacaaaattataatttcattgtgcagtgaaaagatgatcccataatgcgtcttggactataaagaaaaacacaataaaatttgtatttttgttatatttatttttgttttttt

SEQ ID NO: 218 - DNA, 1456 bp, Glycine max
  Soy_ogl_2985 Gm09:4210247..4211702 Cluster 1
gttgtcgcagcatatattcaagaaatgtttaagtggaaactacagaaaacatccaaagtacaaaaaatgaaaaattccaaaatgctaaacttatacaaaatatattaattttacagatttatcattttttacagcaacatatttatattctaaaattttattaaaaaagtattttttaataaaacttatctaaacctatagtttcattaaatttaacttaaattacgtaaatattataataaattatttataaatattattatatagcatattattcacattccacacacaccgtactctctctccctctctgaattagccatgcattgtcaattctatatataaactcataatcttttttatattattatttatcaattttattaatgattaatctttataagaaaatataaccgagatatctttaatgagattttttcttttaattacattttttttatttacaaaatttcaacttaagatcatatttaaaaatatcaagttcaagatcactcaaaccaaaacctttatatataaactcattgattagtaactataaaaaaatcaacatgtgaatacttatcaaaattgagttaggataataagattttatacgaggtataaaagaaaatccaataagtataatgtgtggtttagtttgattaattttttactttaggaactgaaaactaattttccataaaaatgtggttactttttattttgcaactttatcaattttaaatttttacctgtttgaaaattcaaaatgaattggtttaattttaaacacctctatccccaaccttacgccatgtaagttgagaggaaatgatcagataagatagttaaattaataaaaaggccgcatcataaaaatattaaataaaaatataagctaagatgattaacgtgacctaaaaataataattaatcagaatatattaataacaaatttatttatagttatttactttttaattgttatataggatacaactgttaatttaattgatataaaggataaaaattgaatcttatataaaattattaatgaaatagtactttattttatgatataatttgatgtttctttataccaaatgacatacgacatgaatgagtttccataggatagctgtttatcttcaacgttaatttatgaaaaaaagggcaaatgaataaaataaaaaatcttcaacgttaatttttaacttttgagcagcacgagtgtttgactttgaatttggagtaggaatctacgagataagcatgagtagttgagtactaacttttcgccacccatcagaaaactttgtttgcttacgagtattagttaagtgtgtatttatagattttatgtctatttatatgtattaatagaagaagggaaaataagtattaatagattatttttttaaagaaaatgaatcaaattaaaaaaatattattttta

SEQ ID NO: 219 - DNA, 1800 bp, Glycine max
  Soy_ogl_5246 Gm16:2153001..2154800 Cluster 1
tattcttcttttgcacaacatggcacatactaatttgtatttgacttagtcgggatatgtaaccatcttttatttcaatggtatctttatttggctgataaaaaaacttaatttagttaattattgttagagtttaagtataaaaatgaagtctcacctttattagaaataaataatttgagtaatatttaggtaaaaaaaatcttatagatatagtgtcttaaaattttaaaaataaaatatgatatcaaattcacttatctcatttatttatggtgtgagaagctttatgataatttgtatgcttttattttaactttttaacattttatttcttttacatgcatgatttgttttatactcatactatttatatttatacgggattttctataaaggagatatataaataaataatccagaaagttgaattcatccagtatgttaatagaaatttactttttgttgtgtgcggaaaaaaaccatcgagaagaattaaagtttcatagttacttttttaaaaagttacttctaattttgtatgaacactgaaaaactttaatttaactcaacattgaaattgaacgattatttatttgtttaaagaaactaaataattttataagagttttataagtgatttgtggtctctcttaatttgagtgtctgtccttttgaattatttatttacaagcaaaatttatatgtaacacaagaggaattttttggtaaagaaaagagaggggaagttcaactcatacattaatgcctacttaattaaaattttaattaataactgatcttacagagacagtgtacgcaattatgagtttgagaatgaagatttaatgttgtgttaagataggataaaggataaattgtcattgttaatagattgaccggattgttgtttttttatagaaataaatcagcaacattggttcaaataaactgaatagttgttgtaaaaggaattatctttgaattattctcttaataattaattatctttgatttccaaagatacaaaaaaataagactaacttgagtaaagttgataagttttaagctttaaacctatcaataaaaaatatttgctgtgagtttttataaaataaaaaaaagttacgttggtaaaaaaaaaatattacatataattaacatgtttttcgtaattaaattaaaaacaagtagaaatataaaatattcttttgatgtactttaaatgtatatttgatttatttttgtgtattttgaatcataaaaacctaaaaatttagttttaattttgaagtgttattaaattatgatattatgtttctttaatattattttatacattattattatttattaatatcaagtcattaatgttaaactacttaatctaacaaataatgatcaacacaaataataatattttgtgtctcttaaccaagtgatttaagaatgaaagattggatgagtcttaaaataaaataattgaaaaaacactccaatttagtccctcaccaaaaaaccaagacaatttgattttgtaattttgttagcttaaaattttcttatatagataatagaatactatatcaactttgttgttttaaaatattattaaatatttaatatataattatgtacttacaattttttttaacccataatgtttaacctaaaatgacatcaaataagattatctcctataaataatattgatagtcactatcaccaaaagaactaaatattatatgttttacaataaatctaatccaattcgatcctaaattatttttcacaaaaaaa

SEQ ID NO: 220 - DNA, 1500 bp, Glycine max
  Soy_ogl_3124 Gm09:36292001..36293500 Cluster 1
ttattcaaattgagttttgtgacaaggagctttgtttttgtagatattgagtgccatattaaaatattcttatgtttttcaaaaggaatgcttgcaataaattatgttttgaaaagaaggaaatttattaaagtgagggtgacacaaacatttcgtaaaattaacgttaattatatctaataataaaaaaataagttagaaatatattaatatttttccttgtcaaagatagttgatcttcccggtgctagtgattttgattaatataatttaataatctatccaaaatatgtcattaaagtaaatatattatacaaaataacacctgagttatacacatcaaaagaaattaatttttatttattaattaaaaagtatctttaaaagaaaaattaaaaaacgacttaagagtactatattatacaaatatactgtaccggagtcgtaaagaacacgaaataatttaatcttttcttgtaagtctttttatgcctacaatcaagaatatcttaatgaatgtattttagtttttttaattatttgccaattatgtaaagcttgattgattttttttttttgaatgtgtaaaacttgattgataactcaactatataaatataaaaataaaataaaactcaactatttatattgcggtcaaatgcttaattcacattgggagggaaagtgggaaactgaagatagttcgccgagttttgtcactatttcactaattcattattaagtccatatttatgtgattatgtccagcaataatataataagttaataactacgacacataaattgtaaaaaaaactacaacacattactttgaactctttcacacaatatcattttaaatgtggacaaaattttaaatacaaccatataaatatattcaaaaatattttttaatcaaaattaacaactcattccaatcaatttagttatcaaaataaaagtaaaaatcattgtgacaagatatttttttattataaaataacaccaacagtatttacaataatataactaagatttttcattttcgcatgtctcaattccgctccattcaaattccacatggaaccttttgttgcatgcaatccaaaaaatacggtgataatgaggtcgacataataaatgcatccttttggataagtaacaaaatatttttaatttttgattgccacaaaatattttttttaatagaaccataataaaatattccgtgttgaatatttcttttgaattaataaatgtgtcttattattcaaggtaaacattagtattataaatatttttttatcaatgttaattgatagttttttattagaatgtaagtataagacatttgaagcccaccacttatctctttcattttcctctttaatgactaaattaatttcagttacgtgatcattattagagcaataaatttttacatacgaagtaaattctttcaattaataaatagttctcttacacctaaatataacaaaa

SEQ ID NO: 221 - DNA, 1500 bp, Glycine max
  Soy_ogl_4708 Gm14:6209201..6210700 Cluster 1
ttattttttttgaaagagatttcttaatttccaataaatttcaaaaatgaaatactggaatttttgtcacaaaagccatacatggaaaaataaaaaacaatttgaggttttaatttcttactttttaaaaattcaaatatttaagttatatgtgaaagtggaacaaggaagtgcaatgcaaggacttaaaaaaaacaattacacccgtattctgcaattaaaattttgacgaaatgttattttttaaaactatatacaaacatttattaatttatataacataacattacatacccttttgttaactcaaacctcccatgattttttaaagagttaaataaattaagagaaatcaaagtaatgtaaaaaaaaaaaaaaacagatgtcaaagatcattttattaaaccttaagaaatatgagtatatttttttataaaaaaaattacgcatggtactttatatgattatattgacgtttgcagtgaaataacttatactagtatttaattgcaatagttgtaaaatagcatagttttttttatactaaatagtatagttaaatatatagaaaacaaaagaggaacatacttcctcagatacatataagaattatttgtttatgtttcatgggtaacttctggattaagaaatgagagtttttagtctagaaaaaagggtcaattattaagcggaagtggaggtcgtggtccatcccttcgtccaggaacacactttgggaaaaactccaattccccctttaatttcatttttctggttaactttaatgtggagccaagtctaaagaggaaacaggcactcacaacacgtcctcattaccttttttatttattattatcactatttgacctaaacattgcacttgacttgtttcttatgacacttggcagcattaacttgttgcttcagaaagaattacggtgctagtgctgaatttgatagttttgctaaaaggttgtataacaggttgcccataacacattggtttgaaactttgaattgcaaatctgtgtggatgccattacaagattggttcctcttaaaacgaagaggtacttcttaaaacaattgatttgattactatatagtaaaaaaagaagacatgacaatctcatttatctcaacaagtaaaattcattaaaatgagagattttcaatcaatcataaataaagtattaaaaaagaaaattattataaagtatcacaaacatatctcttatacataatgattttgttgtataacttttttattctttaaaaataaaatattatattttaactcatataaggttgacatattgatataaggtcttgttacattcatgtctagtataataatttatttattggaagaatttatatttagtttctttcatttgtaaaattttcttaaaagattaatcattgatccaataaattaaaagacactgttgatcgcttaatcctgaagaaaaaaacattatatttttcttgtaaacaaca

SEQ ID NO: 222 - DNA, 1900 bp, Glycine max
  Soy_ogl_240 Gm01:49931301..49933200 Cluster 1
aaatacttatccaaattaggcgtagatcttatttgggtaatatagtgatttgttttttctttattccctgtcgcaacatgagtacataagtttggggtttttccatgttaaccttcaaacttggaagataataattttttttgaagatgttagctgcaacactacctggcctaaaaaaaagctgtaatactaccttgagaaggcttggccttagtaaatagtagaacatcatccacagacatgagtttcggagttgggtaccatttgtagagatataacatgtaaaggaaaaaaactaactctgtattgtctaattacatatcatattttaatttaaataaaaataaaataagatgataattttcatccatttatgaaaaataatataaaaaattgatttcacaactaattatggatttaaattgttgtaaatctaaattatgtcatttttatttcagatgatcactcgatttttattaaataggtgtatattttatgagtgtcacatattatcaggaataaaaaataataattcaaatttggtggatgaatttttttatttatagaaattaaaataaaaattaacttattttatggaaacttaaaaacatacttaaatcaataaaaaaatcaatcaatcaataaatatttatataattgagttacttagagtgatgttacggtgtgtagtgtgtgtagagtgtagaggtttcctgggtcccaaaagatgccaccaatcccaaaattaactaactctcttctagtgacacaaagccaattgcagcaaataacacaagaattgtcatgcatttggctggtttgtttgtattaagaaaacttctatataaggcaaactcatctcattgcattgttgtattgtatgtacgcgccttaattttctttttttcccttggcagttctgagtccccctccccaccccacttatatttttccataaacgaagagagagtaatggcaatggcaactgttgttgtaaagagaccaaagaggtcacgctcagagccataaatgaagggggggcttttgatgggaacagaacacaacagccgaacaagcatgtgctttgtggacaagtcaaaatatgtaaccaaaacatttacctcgtctttctttcttacattctcattctccctccttaccactgtctctactccttaaaaatatttgcggtaaacaaaaataaaataaagaaagtaaaagtcttgttattcattgtcttgagacattagttaaaaaataggaaaaattatttattatagaaataggaaaaagttaaaaaaaatatgaataacataattttgtgtatttaaaaaagaaattgttttcttaactcatgttttatggaaatcgattagcatttgtgaaaaagtagaagttatcagaatctgacgcgttctttggaattggattcggtttcagatcaaagagatctttgatgcttgagtgccaggaaatgtagcaaataaggacttatgataagtaagtagatcacaatcacatgcactcgcttcgttggtcccaccgctcctcgtcttatctcctgccatacaaacgctgcaccatctctcatctcagttaaatattaaggcttaaatattgtcttatttgctgaatttaggacgtttactttttttacttttttaacttttaagaatattttttttagtttttaatattctgtttcaattttaaaatataaaatttagccattataaaataaaaattaatttataacatttaaaaagtatcacaaaatattaatttattacaagagactgaaaaaaaatgacttttcaaaatataagaactaaaaaaatatttttaaattttagaaactaataataatatattctcaaataaactaaaacagtaattaagt

SEQ ID NO: 223 - DNA, 2117 bp, Glycine max
  Soy_ogl_311 Gm02:1329001..1331117 Cluster 1
aaactactacctcgtaacataatatagttgtgcatgtgggagactgggagttataaggttacttgatgattaaaggaagaaggaaaagaatgagactgtgaatttgaattttttccactaggaaaaattaataaactaataactaacatttatcagtaaaaaatataacacttcataatatgtggattgtactgttatatttcttggcctcgcattatcgttaactagctactgccaataggacatattgtatgatttcctcatgatcaataagacttttaacataggaaaatcccacatgggtccatcatcaacttcattgcaccttaatactcatctaattggtaacctgacattagcatcaactctaatatataccactatcgagggaaatccctctgtacacaacaatgaggatctaaagatagtacacacaaacacagcacaaatagaaatatataacaaaaaaacacaaatttatatatagtttgccatctttttcctacatcaacaataacattttaacaaatattcggtatttcaagtaagattataagttttctatataaacatgagaaagccttctatataaacatgagaaaacccttcgtattacatgactccctctcacttgcggtagttccttctctcatcacaatgacctattttataattaagaatgaatctattcataaatgtgatttagtgagctttaattgtcccctctatcctccactcgacctcccgattgtatgattgtggaattctccaaaaaacaaatcaagatacattccactacttaattaaaatgttacttaactttttacccacttaacatttatttgaaagtttgaattgtttttaatttccaacacatttataccacattaataattattttaaatacatatcttcaattctttaaaacacattcacatagagagatgaaaaactttagtgtaataaagttccagattgagcattacttcaaacattgtgtgtaaaatatggaaaagttaactggatatcaagttacattagagatctatcaaaatttgtttccaaatcaataaccgttgtcacaacaaacttttttttttctcctacttttcaacaatatgaaggggaaaaaaaaagcattccttaatttaatagttcttagttattgttcttgtgaaggataatatgacgagtgacaaaatccattttgatttattagatttttagaacataattaataagacaatttccttcaaggttatggttaatgtagataaattttttttataaatttatgaagtttctttgtaagatgtgaaaatcgatgattgacatataatatttttttaagagattgacatatactcttggatcaataaaaaatgtttaatttgtattatttataaaatatgtttttgtttatacgttcttttattacaaggaatgataatgaaatattgggaaaattattctcgagttgaatattaaaaaaaatagtatatgcaatttgcttattcttatttagttcattataattattatttataagtcaaagtaatgtttattctacttatttttgtttaaaaaatatttgttttgaaaagaaaattattgaaaaattagtgtgaatctaattatatatattatatttttttatctaatgattctaatccaaaattttagttaagaaatttaagtcaagttacacttacataatgttggctgaatgcatattattatatactaaatttttcatatttaatattttcacaaatatagaatgataaaaaaaagccattaaacgaatttattttttcataattactctttttgatacgataggataaataaataattattttaaacttatatttattcaatcaacatatttagatatataattcacaagtttaaaaacgtcttacagaaattttatagttaaaattcataattgtacatataagtataatagtatatttttaatttacatgcaagttccagataatacttttttcttacaaatatttatgcaaggtataataatttaatgtttaattactcatttcgtatatgtgtgtaaacggtgtaaaccttgaaaatttttgcaggcaaacaaa

SEQ ID NO: 224 - DNA, 2337 bp, Glycine max
  Soy_ogl_1494 Gm04:48638652..48640988 Cluster 1
gaaaatcaaattcagttggttgaataatatatatgaattgttgaaaaaaatttatacatatatttggtttacatgaataaaaaaaaacttatttaacggatcagatctcaagtaagatcaaatttaatgtgaatttctgagttattattaactccctgccaaagtcacctaatgatcttactcatcgcttcctgataaaaaaaaattaaaaaactaaaaactactgcaaactcacattttctgaagccatagatccaactaccggcatccgaacctgaatcgcgttggaattgttgaacaacaattaccataccaactaggaaagctggtgccatagctcaaataattgtaagcaatcaactacattttttatacggtaaaaattgcgtcttttgttcgacagcactatatctttgtgcaaggaacatgagatgatccatcgatcagattaacctttggatcaaaggccacgtagatattgcttaactgataaacttgtcaaaagttggtagattttatattggttaaaggggaggagtactgtgtatatcagtatatttatagaaattaatgtgtagaaaaataaggtggtctatttggtaaacaataattaagataagagacaaatataaagagatcataaaaggatcaaattgaggggggaaaggaagatggagacaattccatataataaagggaagatgataaaaaaaatacccattagaccaagagacatgcaaataggagcttggacatggggtaccacccaatcgacaacatatacttctattcatctgtcaagaaaatggataaataagtaaccctttgctttagtagtcaaggcatctgctcaaggccagtaccattattgactcttttaagctgattaaagttctttgctttaatcatttttgtcccttgtttgtgacataagaaacctcttctataaatttcgtgtgtttcttgtgctacgtataaatttcaataactttctgaacatcaaagtgggatgataaataaatgttttttgtattttagaaattatttttgaatgcatattaaaaaaatgagagattgagatagttatgtataatatatatcacgagcagtgtaattttttttatgtttgaatgataaaactattttcaacaattatttttttaagatttcatcttttttgttctaaaactggcgtgttaataatatatatgtttaatatttttaaaacacacttttatttttttggagtggtttaaagaaaccataatttttaacttataatgttattaaaacagtttttcacttttttaaaagtatttaattattgtaaattttttaaaatacattttaaataaataaaccatttttttaaaaacaatacacaaaatatgaccgtaaaaagttggtcaaagaaatatatgattgattgtgtctaaataaagcgggaaagtttgtgagaataaaatattaaagagtgataatgaacactcatatctattaagcaattcattaatatatattattttttttaaaaattattacatcatatcacttattattttatcttttctttatcaggtatatttatttttcaaatatatatgaaagaaaagtttaggatgcatggtggcgtctgatatagtatgacatatcacatatgctgggtggaattccttttttttttttttcttcaaaaatagttttggactcatgagcgggtattgatcttatcccttctctattcattaaatatcaataataacctcaatgaatagagagattgttggaaaattgaggggaagtaaattttggaaaaatttgcatcaataagttataaacaacatctaaatatattaattcaaaaccttaatactaaggttgatggatcttcaaaacttaagtgtttttattattattggtaatgagatttaaacttaaaaccacatctaaatactcattttttttattatcatcagatcaatccctaatagattctctataagtgttttgtattgaattaaaaataatgaaaagaatgaaattaagaaaatgatcatttctcataattggcgaactaatatatacaatagattttgttgtaaaatttaaccatacaaaatataagtgatataaagaatgattcttatatgagaaaagaatgaaattacatcaaagaaatttgtcataatttgtattagatacttttctctaatatgtcaattaccaactaatcgcacaatggtcatgcaacaattaattaattcaaacatttagtgggtgatcaaattgaagaattaaaacaatagagcaaactaattgataaggcaaacaatgaat

SEQ ID NO: 225 - DNA, 2100 bp, Glycine max
  Soy_ogl_1518 Gm05:15131..1531800 Cluster 1
tgttttgtcttaaaaaacaattggtaattggtacagcggtgttgatccctagcagtcattggtacagccgtgttgatccttagcagtcattggtacagccgtgttgtaactaccatcaaggtaagggtaatgtcgtaattaatgatcagttgtatgatagtatctcaagggacaaggatcgcacgagtcgtaataattgacccatgacctcgtcatttcctcgaaacttcaagaattaaaaccgtcgctgtttcctattttcgatttcaaacgtaaaaaaacaatacctttttttttatcttaaatattaatttttttaattaattttatctcatttaacattactatatctaaaacaccattcatttagttgagattttaatttgaataactcattctatttctaataacaagttccaataaaatgtaagttagaataaaatagtaatttttaattaaaactgttatagttaaatatagttaattaactctttaagtgttaatcaaattttccccttatatttaataccagtatttgctaagaagcgagaaaaatattctgtccaagtcagtagggtcttagggtggcaagcgttgcgtgccgggttgtcatcagaataagaaaggataaaaaaatggagtacaacacatttcttatatttcatttggaatgatttttaatttcaagtttttgaatttttaaaaataaaactatttagagtttgttttagttttaagtttttcatttttaaaacactataactagttttcagattttatttgtagtttcagatttagtttttcagttttataaacttgttgtcatgtctgataatttatttatttttaaaatataaactaaagatttgagattgtgatgactgatgagagtgaaaatttagtacaaaaatatttcatttaaatatgcatgaaatggttcataattggtatacaaacaaaataactaaaagctacggcagagagtgtaggaatattccttttaaacatgacaggagttggaattagagatgggaacacacaagtatccttacaagagtctttacttttttttcaacatactaaaatgcttttcctctgcccatggtgtttgttttttttttttgttaattcttttttcatttatcgatctgttgtgcatatttttctacaatttcgcggtgtagctttggagcaagtactagtagttgccaacattgaccccgcaactccgataactgggaaagttatcgatgtcgatgcccaatttgacgtcgcatgcatgcgcaggttttaaaaactttctgcatatcactattgattagaagtttctagaacttgaaggagtcaatattattataaggatgagaagaagggcaacatatataccattgattaatttcttgtaattagattgtgccaagataagagacttagtctaagtgctttcaagtataagtataatctatttcatagatcaagcattagtgtttatatacaaatacattgtaattgatcgatctaacatcatcgcataagtatattgtatgtgatcctatctgttgctccgaaatcttcgagcatatatctcaaacagttaagattgtttaataactaagaattaggcaacacatgtatattgagatgcctaaggagtaaaaagggacaatcaactaggtcctttaaaaacaaaggctcatcaagaaaatacacagtctcacaattttaagtacataagcatgaatagactaatcataaactaatcataggaagtaataattcaaagaaccatcaagaaagaggaaatcaagaaaatacataatattccgtctcaagtacataaacacaaaaaaactaaatgttggaagtagtcatccaagaaatgaactagagagactagaccaagagggtacaatcgaaggagattgaattttatttaagttaccctcacgaatcaaagcctctttttgctttcatagcaaagctaatgttttaatattcatattgatcataatcttaatgcctgattagttatttctgaaactaattgtagagaacaaaaacaattaaaataatgataataattacattcatttagataaa

SEQ ID NO: 226 - DNA, 2200 bp, Glycine max
  Soy_ogl_1837 Gm06:7687101..7689300 Cluster 1
gtttttatttcccttttgtgttgaagagaagtatataaaaagatcgggaaaaaaagttgtttttgatgcgtttctgtaaaacttttaggaaaatgatgaacctatattctgttttagcgtccgattgaatggaagcaggagaaaaagaaaaagacaaaacataaaataaagttaaaataagatagaaaaatatgtgaatgtataaaatttttatgcgtatctggttaaaaagtttaagaattaaatgataataaacataatctagttactatgtatgcagtgcaataaatgcttctatcccagaataattaaatcctgtgaaaccttatgtgtgatcaattatggagtcatttattttaaaatatggtagaattgattttttgtggtgatgtgagaaaacaaaagtaaaggacaacacaaaagcctatgagtaattgattttgataaagttcattttaaattattagatgagattagagaatatgtttttaaattaaatatataactaaaattttattagaaactgtatatttttccattaaaaaagctgtatatttttattagaaacataaaaaaaattcttttaacacgaacaaataggagatattgctatagcaactgtgagagaaacattgaggacttacttttcgaagtagttagcatttgctaaaactaggagcatggtcacagcctcacaggtcaccgtcacattgatcgcttttaatgtccgtaggtgaaaccgactttttagtattgtactttaatcctttatactttttgatagggatcacccaatgttatatttttttagtttttgtaacatatataactttttagtttttttataataattcttacaatatttaatttttggtgttattttttgttattacttaattagtgttaactactgttttaatttgtcatgtgatgacatatcacctttttataatttttagtttaatccatgtaaatatacacaatttttattttagttttccaatatatgttttttcttagagtctgactctttaattattccaagtctaccacctcaccccttccaaaaataatctgaaaataaagttattaatgttctattcccttaatattaaattagtatttttgcgggaatatatcatatagagggatccaagttgtccattcattgagatgttggtgaacaaagatttaatttgcatcatcaagatctgtgtttggctattcatgcacctagaaaaaggatttattgagaaaattcttttaccttacattatgttatgagtgaattattcgttttcacctcttttacaaaactattcaatgctagttgcaagaagcgagcaaaaacgggaatgtgttccgatgctgttttttattctaaatttgccaggaatttgattgtgatcatctgtgaaacacagtcagcgtgtgtctttaaatatatttccatcttcaaagacacaatcaatcttcttcgttctcacaagcctttctcagacaattatatccagtaatagttgataggtttgcatcaataggggcgagggccgtgacggggaaaacattgttgttatttaaagcaattgaaaaatgttgtgaatggtagtttattattttgcttttattatttttaacattatgcttttgctattttcattctactattttatttttttcgtcaaaataagatatctttatagtccaaaattatatatgagactgattttctaaaaaagtataagagtattgattaagggacaatttctctacctacaagtattattttattagtataagcaagaatcaaacaattatcatgtatttaaacagctcaaactattacctatcacatcatttatcatttagattttttttttgttattttcattttactctctatctcaaccttcttctttttttcttttctcttgtctttgagtttgacatgtaattatttgtcttttcagtattggcctttagcagtaagacaattagtggcaatttgaattctaagggtgaatctgttgtgatgaagacttcaatttaaatttatctacctctgttgggatagggtgtgcgtgtcaagctgcaaaaattagaagtggtgtgtgtcgcttgcacaaggtccgtaaattagactattctacttccgcctttgattatctatgtaataactaaagagacaggtatatttgtc

SEQ ID NO: 227 - DNA, 2200 bp, Glycine max
  Soy_ogl_3692 Gm11:2417301..2419500 Cluster 1
aaatacaattgaatttggaaaaaaaaaatcaatatgctgacattttttttagtcattagattttttttttgttcatttatatatctgacatatttttatagcattttttagtctttactattagttttagtcagtttaatgatgtgattagcaaaatgaaaaatgaagaatgttatttaagatagttacagtaataaaagaatattttgaatcaagaaaattaaattatttttatgtatataatcagatcaattaagagatgtatttgttgttttatatgaataagaattttttttgttacatttttatatgaactagcattggaatccatgcaatgcaatgcaaaaatttttagtaaaaaaaagagaatattttgaatcaagaaaattaaattatttttatgtatataatcagatcaattaagagatgtatttgttgttttatatgaataagaatttttttgttacatttttatatgaactagcattggaatccatgcaatgcaatgcaaaaaattttagtaaaaaagagtgataaaaaatatactaataaaattaaatgtttaaatttttaaaaataaaaggtgaaaattgtcaagtcattgtgacggcttgattacttatggtttcattttataatttattttattttttaatatataatgaacaataattttttttattgattttaacattgttattacttttctattcactaatttacttttaacattatactttttaaaaataatttattttcaatgtattacttttgtttaacgaggattgtttgttaattaaactgaataatgattaataataatgggaagaagttgttgaaattgatttgcagtgcttgatccctgtggactttgatccaaacaggccttgccataaattaatcttggtatatataataggcatgaggcattgcattttgcatgcgaaacggagagatagatgagggaccacgatcgacgactaaacttgacagattatagaatggcccacatgcatggctacaccatttactattgctcctcttctctgcattaaccagataagcttttagctcactcatgccaattgctcaactataaattaactatttttttacaacatgaacaggagttggatatatgtgggggcagtacctttgtcaaaggcagaaaaaatcataattaattattttacatgtattattatttatatgaattaatacttttaaaatatatatcatataattagttaattacaggtttctcattataaaataattaagtaaatatatgttaaaaatattaatctcatcaagtcttttcccatttatacaccattcaataaaatgatgtcaatttcgccctcgatcttaaaaccaatttgatgttaaaaataacattgatgtgatgaccatttaaacacgataatgcttaattaagtatttgaagaatcaaaaatggatacttacttgattaaaaaaaacttttgaagaaagaattattattattttcgataaagaagaaagaattttctataaagttaattatttagaagaataatatggcgaacatatgaataccaaaggaagaaggcaagagtaaaacttgggtgagttatgacttatgagaataaattttcattttttgttgggctctgaaatgtcagcgcttcatttgtcttagcagacataagaatattcacagtattatataaacaaagagaaagcgatgaatggatagttggcgggtcaactagaaattgatgttgcatatataatgcatcttctggattggcgtttaaccaaattcccgtaagccaagggcaaaaaattacatcacaagacttttcgatctgattaattaggaaatcagataacaaaaaatagccgaggtttgtgaaattttataaattaaagatataaaagttccatttgtttcttgtatcaaaatattgttgatttgatgttctaagaccgcgagtcggtgacttggttgttgctgtttttagtaatggcaatttgtgctgggaagtcagtggcagtcccatgaggaagtgctacaatttataattaccacaagaatatgccaaagtgataacagccatgttcaatttgcagtatttattttattttaggggatggtgtggaatgagaagtcaatttgtaatttttagactttgaaaaaaaaaatattctaaaaatg

SEQ ID NO: 228 - DNA, 2044 bp, Glycine max
  Soy_ogl_4505 Gm13:37129835..37131878 Cluster 1
taaaatacagtattatcaatttatcatagtcctaattaaactttacatcctttaaaaaaaaatcaacttttacataatagatgatacaaggttgagtattattaatttttttataaattaaaaaactcaaatacatattacataaacatatattaactatacgatcacaagtaattccagagtatataataatttctcccttaatacggtcttccagcaacaagacatgcacacagtcgatactcgatatatatgaaacaaagacaatactggacatattttatttttatttttttatcagaaatatcatttcattaaaagcacaaaaagtgctggttaaaaaattcatggaaaccacacaatgtctcattatctatccccgcccagaacaatattctcgtccaacacctagtgtcgtttttctcgaccagtcacctcccagtactggacatattacttttcttttgtgtacataatctttcctttttcatttaaataccacaaccataatgtctctcattctcatctcttgtttaggatagtacgggttttaatatgttgtatccacaataaagtttactaattactactactaacataaaaattcagttaactgttactctagctaacaaccagtgttttggcacttgcttagaaataaataaaataaaaaatgcaattaaaagtataatatttaatctgaattgttttttttacataatttaatctgaattgttagaaaaaaaatgatttttcatttctattattgatgtttaaaatgtactttctttggtgaatggctattctgagatcaaacgagaaaattttaatttaattgatttaatttatacgactttatagcaatgtagtatttacagcatttatgatattttcttaatttttattttattttacattcgtgtcgatctcatcttacacaataaataccttccaaccacattataaataaataaaaaaaatacctttccaactacagtcatgttaaatggccaataaatgtgcccatgcccttggcatgagccacagagtttcccaattaaattgattttcaacgtgtggtcctatttttttttataaaaaaaaacaaaacaaaagagagaattttaataaataaaaaaaatccacaatccacataaaattggcaaaccagggtgggactaaagtgcagaactttatacagtagattatatatatattagtcgtattgggcatgttgaggtgagttttgaagttggtttaacgtgtcacgtatctaacagcttgacggtgccatctaattgaccaatgccacagtactccacacaagctaatatatatcatcattccccaacaaaatatgaccacgtaatccatggctactcctcttcttggacttggacgataacaaagtgaaataatactactagcaacagataaattttaagttgatttgatttctttaaagtcttatatttctttatatttatgttttagtttcattgatatgcatatatatgagcatatctgacattatacgccatagttttaggtgaaatagttcaccagctcccgttgccgtcaaaattttcttcaaaaactaaaacatttatcatacattttgattaatgattaggtcatatgtgaagtagcacatcaaaggtgtcacctattataactacacataattgttaatgcatgtgagcgtgcataaaagttttttcaataagctagtaaaatattttttatcataattttaaatatatccgtatatattgttgacattattcctatgttaaggatgtaagagtataatattttttttttatttctataactctaatattatgtgtgtgtgtgttttttttgtttaaaaaattacagagaataaaccatataattggaccttctagattttaagccgaatgtttatcccgagactacaattacttgaccttttgatgaaactagtttataagttaggcaaaatagtttataaattactaaaatattttattaaacatgattttaaaagtgattatatttt

SEQ ID NO: 229 - DNA, 1900 bp, Glycine max
  Soy_ogl_4624 Gm14:3800501..3802400 Cluster 1
aataatgatagtcttctaaattgattgatgcttaattgtaatctatcaatttggtgtatagatcccaattacacatttgttacattatagctataatacctgtgaaagaattttgaattacacacatcaagcaaggaattattgtatgatgtgagactatatatatatgtttgcaatgtgaattaataggcaagaaattattgtataatgtgtgagtattacttgtcttaatgtgaatcaatctctatattatatgtaattatgtttttttttatatgattatatgtcacatagagatcgactacatctataaatatatgatggttagaaggattaatggtctctactctcttataagtgaattagtttaaagtgaatatcttgattaatgtaagagaaaaaattaagaaaactaattacatattatatagagactagttaatactatagacacatgataatttcatataacatagtttctagcaacaagaagaaaatattgtgtgatttagaattactagatgttcataggtcccatatcccatcaatatcattgtgacataggcattggatacatataaaacattaatttttgtgtttatcctttttttatgattatgacatgtaataaatgatgttaaaaaaaaagagattaacacacaaaaaaaatgttaccgtataaattgttttacaaatagcatgaagcattaattggttaataagtgtgatggcctagggcccttaaatgacgagcccaaattttttatctctaatatcggaagaaaaaattacgatttcacacttggccttttaacttctgtaatttaatatccaattaactaattatacattccaattttccaactttacaactaatatttgtgcaatcagtttccaccaaaaccatgaagaatccttcaatgttttctaagtttatggtaaggaaaataatattttatcatatagatataattcatatactcattggctgtctggctcactgctcaccactcctgcgtgctcattgctagtgcctatttggttgcctatttggttgactcttgatccaaaaaggaactttataaatttccttcaagtgtgagaccgggagacacttttggcactttgtttgtatattggtatgtgcataaaattttttcattatcttttgttgctttgttatttatttaatttattttaaaaaataatatttataagttatttataggataattgttcatgttgaaatttaatggtttagagtataatattagtttcaaataaatattaagaaaagtagaaaatgtgactagcaatggtggaaagaaaacaaccacttaaatgggtaattatattcaatggttaagagtgaatggccttaatgtgatgtaatgagaattgacacataaaatattattagtattagctaattatataagatagccactaccactcattcaaaaatgtaagtattgttgtgtctaatttgatattatttttttaattatgtttagtgtctaaatttagtttttagaattagcaaattgaaaaagtgtgagcaggtattgaactttgacttctacttctaggtgtatataagaattgattgaagaaaaaaggtaatgcatatttttaaaatttgttaaaactttgttagtcaatgactaaatgcaataagccatataatttttaataaaaatatgcacttacttttttatagaatatatatttatagtttataatatttatattttacgttatgtcactttttctaggtcacacgggaagaataattttagttagtattcaccttcgtcaattcagactgctatgaatgagaccaatgaaactgtagctaattaccagcaaagaaaaaccaaacgtaattactttgcttgtt

SEQ ID NO: 230 - DNA, 1727 bp, Glycine max
  Soy_ogl_5568 Gm17:7592401..7594127 Cluster 1
acaagtataaaaaatataggtgggtactttaagaggcaacaataataaaaatgtcatggtgaatggagcatgaaaaggcagcgaatcccatgaaggaaatgaatggatgaatgagataatgtatctttgattatgtgattattcaatttagattgtggtttgacgtaaagaggggagaatatcaagtgtggggcccacctgccatcgtatcatcctaagatatgatcctgtacggtcctataacagtataactaacgccatcgctcattcccataccgctgcgccgccttcataacatcaaacacacacacaatttttacactcttctttaattataaattattatatataatatataataaatttattaattttaaaatccatgtaaataatatttttaattagttcatcttgtaaacttaccttataaagttaacatgtggttattaaatccttataaaaatttaacttaaatatttaggatttgtaacaatttattcgatcaattgtttgagttagatatctttaatgaatgtataattacattgaagtttataaatttaaatttcagttaaactttaattttgtaaattgtgtttgtaaaaatatttaaactcttagtttttaaaattgattttttagataaatttttgttctcaaacatatttttaaaatattcaaatataattttaaattaattttagtttcaattatatttttagaatattgttattggattttctgttggtattgagtaaaaggttaccagtgttttcaattcatttggtcaaagataaatcttatttgcggtatatgattcttgttaaaataccagtgttttccttcaactattaattatttttattaaaaatctaaacgaaagaatataaaaaagtgatgcattgattcttttactccatgtgttatatggatggagataataaaaaactgtcaaatatactaaaattaataagaatatattttttaaattatttggagaaataaagaggaatggggtttttaagagatgaaaaaaatattacatgttcttttaaaaaaaacaagtataatgtgatttttggcacaatgttataatgataaaagtaggacgttaaatattttaatgtgatttttaaaaaaaataataatttaaaaacatcaatgaagtgggatgatcttctaacatgtttaattttttattttaaaactttaaatctgactaatgtaaaaaatatatatatttatttgtgtctaattataaaaaatatgatcttctgacatgttgtaaatctatgtctttaatttttatcaataaaaaatacttatagttttacataagaattaatggtttataatttgactgttgaagaagttattatactcgttttttaaactgatgcgatggtcttatcttataagtttgacgcggctcaagaatttgtctaggtcaattattacaaaaccaataaaacattaatatattaatataaacgttacaattgctaaatctttatagttataagtctttatggtctaatttattacattctcatccgttataaataagaggccttctaagcaagtctacacgtaaagaggattcaaattcaaatatctaactcttttgcactaagaagatttacggacaatattgtttatcataagttcataacagtaatctaattcagaagcacaatgtctttaattttctttttaattttatctct

SEQ ID NO: 231 - DNA, 2085 bp, Glycine max
  Soy_ogl_6595 Gm19:45393301..45395385 Cluster 1
gtaaattataatagagcctaaaaaaatcacgagtaatataactttttgtctttcaataaaagtatttttattttaagttttttaactaatattctttggacacactttagcattttcctctaaaaatttatattgttctttatataatatgatctttcacattttttttatcagcaacgtctttcacattctaataagaaaaattaaattaaacttttaatttggttcttattaaaaaaaaacatttaaaatttcatatcatgttttaaaatctcaattttactatttaaaataagattttggtaatgctaaatattcacgagacttattaatacgaaagtaatttcagtcattaatgagaaagtagataaaaataaaattactgatcttaattattgataagaaaattaataatttatattttaatatataatttaatttgggtttatatatgttcataatattattagactattagttgattttctcgttaacaaataaggttacttatccttagtattactttagaggaaccggtccataattattccagcccatttttttttttttatgaaatattccatagcatttaggtatttttatatattgaagtgaattaaagtgtgacatttttacttttaagaaaatataatttttaaaaatgatagaagagtgtaatttgaggatttgtccaggaataatcctttagataaatactaacaacacactttatttttatttatttttttatattttagggagtcaattttttagttttcccctttttcacacacacattgggcttgtacgacagtccaaacagattaaaagggccgtttaaactgaattgccacccagtggataatgaagcattgaatgtttgtcagccgaaaaagctttaaaaaaaaagaacaagttgcattcatttttcctgactttaggatttattatacttggatctcttcagttaaaatgtatttttttttacctctctctaaccaacaccgttaagtaataatgttaattttttaagtgaaatatcaaaaagccccttctcaattcttacaccccactccttccaccgccaaaacgcatcacccccaccattgatcaatcaatgcaactcatttttaccatcttcaaactatttctagttcaaattcagatcttacgatttccccaaaaaactttcttacattttagaatctcaatagaaagttgaaagacaaattagaaacacaaattagaaagttgaataataaacatccctaagcaaattattcaggttaaagtagcgtgaaacattgaaatggacgtagcttcttccgcaaccaatatgcaataacttttttttagagttcaaaattacataatagtaaaactataggatcaacagtggatttaagccaatttaatttatcttattaaataaataaataaattataaaaaagtctgttgaaactagttttttcctttaaattttaccggtttgaaaccaatttaaacagttcttgatatttttttcatcttcttttctgaattatccaatcgatgccatgattaattggtttttgatatgaacgtttttttgtaccaatgaaagttattggtctagtttgattctttaattgtatctatgcataaatctgtttgtatttttaaaatgaaattatgagaagggaaaaaaaaggagttcgcggggctcccgtgtctaagcttttccatgcactgaaagagtaattttaatttggctgcctagagcaattctagttggattgtttgtctttctttattattaagctatggtttttaaacaagaatgaacaattggcattgtttgagttgacattttaaataaggaattgagctgtatcataaaaatggattcatttgtatgttaatcaaccaatgctctaaaaaaaaccaatacaacagaaaaaataaaaaataaagtagagttgcatcatttggtaaaagtataagacaaattagaatgatttctacaataaatctttttaaattgtatcattagaaagaatagtaaatgaccgaagctctgaatcaacatatataagttatttcag

SEQ ID NO: 232 - DNA, 1718 bp, Glycine max
  Soy_ogl_6988 Gm20:44504783..442500 Cluster 1
caaagataagtattagagatttataatacttaggtatcatatttaactcacagaattagaacataatttgatagatgatcaaaacaaccatgtttgcttgtgttttctactatgtgagctgcaactagttgattttgattagagttgttctatctagccaccaataatttagttcattgaaattatttcacgttaattttcattaatatatacaaaacatggttatttaattacagaaaaatgcgacgatgaaataaataatgaagtatatgcattgtggacgagctggataaaattattagtatcccaaaatagcgttaacgatagctaccagtggaaatcatgaggccaattgttggtggctccttaagatttcaggatttgctttccttctccgccacgtctcatctgaaagcatttgaataccatctcacacacgtataattaggtgccgtttttctggtaatgatcacatatatatcttttacgagaagtaattattcaagcaaaataaaactgttatagatagtaaaaaaaattctttaaatgtttcataacccaaactccaaatcactaatccctccattctaaaattacagatgcttcaggttagtatacacccattaaaaaatattaattgatgaataattatttggatagtggaaagtttagagataatattaggtggacattcttattgatgaataattagttattgatgtttattttggataacaaaaaatattcaatacattaataattataaataagaatagttaaaaaatagttgtggatttaatttaatcatagatttgtaaaacatctaaaattttgaaacaaacaaaacttaaatattaaaatatttataattttagaatgatgaagtaattaaattaaaacaatctctcacaagttaatttacgtgttcggggatataataatttggctctgctagctgatctagctatctcagttctcaacactgataaacaggaagtcgatcacatttgacccatatgcattaattcctaaattaatcgccttgcctttaaagcgatcgagctcacttcattttcatggtggctagattgccctcacccaacgttgaccagctgcaaatatcaaatctaatatatgtgctacataattagttatgtgaaatgacatttatttctctttttatatttctaaaaaaataaaaagattaaatatctcgatataaaaaagaactaaatatctaatggttcaaaatatttaactttacgttaattcttcacaaaataaaagaattcacgttgatcccttaacagatacaaatataattaaattatagtagtattattttttttctgtggaatacacgttagtttctgaaaaccatatatataattaagattttaaaaaataaatagggaagttttatatgtttaagaatttatatcgggactttcatatttttcagatatcaaatcgattctttattcgaaataaaattaagatagataaaaaaggaaataaaaataagaaactacagataagatgcatcatgcatgtgcatgtgatcgttaacattttactttaaattaattaaggcaccaattccactcgtatttctttgttcgttgaaaatttatttctgctgaattcctacattcgtttcttattttttttattggtagaacattttgtttcttattgaatcaatttaaaatttaaag

SEQ ID NO: 233 - DNA, 2000 bp, Glycine max
  Soy_ogl_88 Gm01:3661901..3663900 Cluster 1
ttcttgccaacattgctcttgttctagcacctaaaatgtgagaagtagaattattttctcttagtgaacaataccagtatcaaaaccgaagtaggaaaacatgtatatgaataaacaatcgaaaaagtcactgtcccttctctgctgattgacgaatgaacgagtgattatcatgcaatcagaaacacttttcagatccagggtactagtttttggacaggaaaatattaccatgttaaattattaaaaaaagaaaattaaggttcaaatattacttttgaagcttttgtttcagttttttctcatgaaaaataatttttaaattttttaggtggttgctatgtgttaaaatattatcttgaaaagttacttggagtaatttttaaaaataaagactgtaaatataactatcttttaacatataaatatttttataataagtttcatggatatacactttcaatataaaaaattttatattgttaactaattaaaaattaattttgatataacttttagaatgatgaatgccaaagtcaataaacttacataatgataattttaaacttacataatgacaatttttttatccatatgaatgaaagtctgtataattttttttacaaatcatgcacattactcgataaactgagatagagcccccttggtgcagatgaataacagtgtaaagaagtgcacatcctttttctctcttttataatcaaaatcaaataaaaacaaagcttctatattcttcacactaaaattactttacttaaaggcttcaatatgcaaccccaggtggcagcctggcaagcgcgctgagaacttgtctgttagattttcttcaccagaacaccatgtccaagcagctcaccaaaataaattcatatcctcattcgttcaggcgtttacgcaagcacgtggcactcgagttcaacatcttcccagcaaataaatgcatcaacattgcaaacaatgaaatcatcacaaagagttttttttttttttttctttcaaaatgttgcaccacaataactaatggaacttgacaagtgaactttcaaaaaagcaaaacaaaaagggaatggaatgaacccctcgtaagcttttgtcataaagttttgatcttcaaatgaaaaaaaaaaaaaaacggattaagctacaaccacatcgaaatcgtccttgtcttctaagaattgaactcatgcggtaacaccccattaactaaaatcaattaaaggcaccagctttcagcttcgtgtgcgtgcaatttgctgtgaaagtgaagttgcaagtttcatactcacggattcaacaaatcgggaaagtgggtcattgaagctctaagagtggaagtgcaagttgttcctggaaatggatttcacgcagagagaaaaagaggctgcgcacgataaggcgcagatgcgcaggataagagcgttcgcggtaagtgctttcgcgggagacaagttaccaaaaaggaatgacatgttaccaaacacaaaaggtaatgtgaattcatttattacttctagaaatcatagcataactagattaatatttacccgtgcaggtaaagattaatatgttacagaaaaaattaattgtttaatgtagtttaatatttctgataaaatataaattttccatattagtaatttttagactaaagtatatttttggtcttctattttttattaaaatttgttttaatttttaatttttttaaagatttattttaataatttatctttttaaatttgggttaatatgttgcctttctattataaaaatatttaaggctgcttagaattatttattttttacattactctttaatttcttgtcagtgcaaattggactctttgaagtaagattaccctcataataaagatgaaaaaggaccaagggaacgagaaaagaacatagtgcactgtaataaaatggatttgtgaattcacaattcatttttttttttaccaaaatgaactcacaat

SEQ ID NO: 234 - DNA, 1800 bp, Glycine max
  Soy_ogl_1268 Gm04:7091101..7092900 Cluster 1
ttatttgaccatagacgaaacaaaaggcaaaaaaaaaaaaagcattacagaatagcattattagcaacaaagaaggtggttttgcatatttttctcatattcgctgaacgtgaaaccttgtattcttgcaacctaacttatgaagaactttgcttcctgagtaaccgataccaaatgaatagtggttgcacgccattaaaagaaaaagaaaaaaaaggattataaaaactgcataaaatatacacacaccacaaactgaagaagaacttggccaatagaaccaaaacaggaaaataaaaataagattgagaaagcgactcacaggtagccatggaagaacggagtgcttaacagagtcactcactcggacggagaagggaatggcgccatagagagtttttgtttggttgggatattatatgaaaaatggagaaattatagatagcagttcattgcgtagttattataatatatatgacctataaaaaaaataaagtgtaaatgatgataacaaattattacaaccaaaaaaataattattatacaagaaagtaaaaacataaaaatgtaataaaagaaagagaaatacaaataacaaaagtgaaagatggatgaaaaagaaaagagaaccacgtgcaaggttaaaaacaacatgtgtttatgattggtagcaaaattttgggtagttcataatcaaaaagaaatgtgagcagttgggtgagtgattaaataaatcgtgaaacatgaaaaaaaaaattcaaaaaataaaataaaataatattggataacttctataaagagagggtgaatagaagtgagaaaaaaagttttccaaaaaaaggtggagaaaaaataatagaaatttttaaatgtctactgttgttctttaaagttagattaggagtaaaataaaatattataatgatttataatagttgaggataaaaatgttcaagaaagaaatatgacactgactgggataattccctttataatagttataaagaaaatagtttgagagaaaagaattcaaaataaagatctagttatgaattgttatacataaaagtgagttctttgaaagatataataagaaattttaaaataattaaagtgtaaaaatatttatataaaagtgaagatgaaaaacaattttcaaataggatattttctttatctattgatatagatgatatctaaattactatttattttaaacattacaatacaacatatatgcttttttttattacattataaattttatcatttacgtatttttttttatttttttctctaaatgttgaataagtttttgaatgtttataaattaaaatgtattgggataaaagtaaagttaaatatacggataaatctacctgtttagatatgtaaatgcaaaactcataattcttataactcgtctaacaaagtccttaatttaaacggattttgttttaatgagtcttcaaccgtacaatgccagccggcctggtccttaaaaattaaaagaaaaaagaaaaaatggaaatttaacccatattttaaactattttaaaaataattatctaaaaaattaattaaaaaagtgacttaaaaaacttttaaaaaatattttattatcattttataatccaattaatcacaggatgtccgaaaattatcctttatagattttaatttaatgttggctattttagaatgtatctaatttcaagtaaaatgatcacgatacttttattctatcagtttaatatttttattttatttttattaatgacaagaaaaatattagtattt

SEQ ID NO: 235 - DNA, 2517 bp, Glycine max
  Soy_ogl_3976 Gm12:2339201..2341717 Cluster 1
atagaaaaggacgaatttcatttaccaggaaaaaaaaaaacaccttgatagtcattacactagactaattgatgataaaatatataaataaattaagtatttttttctcaaaacctaaaacaacagcttgaatcgccttagatcgacttgggtctacccaagtttaatagataaatgaatttgatacttgtccgtaactttaaacgtttaattgcatttttgtttcaatttaactgatgagcaatttaggtcttaatcgtttttatttttatttagtactgtaaatattttaagtgcgttgattaaattcttctattatttctcattactttaaagtttaaacctttaattttttattttttatttacagaattaaaagaccatttcgaacaaatccacctttgaaaaatgaccagcatccacactaggccgaaaacagattcaacttccaattattgctagcctgttttttatttggaaaattataaatggacgctccataatccatatgcagatatgctagttaacatccagagagagagaaagaaaataaaagtataatattaatatgtgatatgataaaaaaaaaaaaaaggagatatgaaaaataataaatgtcaatgtaattttcaaaataatgaaatgttcaaatattgacacctttttattttgtgtctgaaggactctctaatcacatctaagcaccaatcttcaattcttatccaaattgtagaataaagttagaacgtcacctaattttaattatacatgctttaaatgagccacaggttcattcaaaaatttaattatgaaagttaaacttgtaggttgtagctatttagttatttaaatttttttaaacatgtagagtcgtagcaattccgttgtagtctagttggttaggatactcggctctcacccgagagacccgggttcaagtcccggcaacggaaacttttatttttcggttgaaaaacaacaatcattagattgtgccgctgctctatgttgaaccttatctaacagttcagacttttgagatatttttatatgttttcaaatagatttttatatttaattttgtaacaaaaactttaaaaactatatctaacatgatttttaactatgtcacggtataaaaaaaactacatgaaaaatgttttaataaattgttagtttatgccgttcgctcaaatatttactattttcaatattaaaacctatatataatttttttaaaaaagaaaaacctgtatatagattacgtacacaccatttaaatttacgttagcttattataatataaagacaaaagtaatggcgtgtttgttaccttgtcacgtcgagtcaaatatgcgtctcataaaagctaatacaaatagcttagccttagtatgtgtgtaggacgtggtttcattgattgatgcgagtatagaatgtgaacgtgtttccaaaacacgcattaaaacccacaggaatgcatgcaatattgcaatgtatctgtaaatttaactgagttacaacatctaatttctatttattttacccatgcataccttaattttagtttgaaatggaaatggaatactaattattattaagataaaaataaaaatgggttgactttcacccttctcgatctaattctattccatttcaattcaggaattgagttaggttaaaataatccacagaaaaacgagttacgtttttgtaaactcagcttattgatgaatccagttggattgagctagctcacaggttcccacttgacacttctaaaattcaccaaaatattatgttaaattacacgttcatttttatagaataaaattgaaaaaacaaagcatacttttagtacacaatatatcctttattattgattaaaatctatataagaatattataattaattataggtattgtttataacttaatataatgaataacatagaactttataacaataaaaatgaattaaaaaataggttactaattatcaacacttgcccttttgcttaaaataaaaagttcaaatgaaaaagaaaataaggaaagagagcaaattaaaatttgaaatgaatagaaaattagtgatttattttcaattttttattcttaaaattattttttttgtccttttaaatttttcttcaacgaaataaagtaaaatatactattcttgatatttcctctctcctctttttgcctgtctttctccttaaacaaactataatgttgagagcataccttgttatatgctccgtttgagctttgaggtttcgaaggagtgaaagtagaaaaaaaaatttaaaaggaaaaaaaatgtacataacaatgtttttttttgtttggttgaagaaaaaaaaaacttcaagaaataaatattttaatgttcttctctaatttaaatttcaaatttgtttcttctatttaatttttttcctctctatcaaacataggtgaagctttacaaccatgaacattgtctaatttgttcttttttaaaggaatcat

SEQ ID NO: 236 - DNA, 1400 bp, Glycine max
  Soy_ogl_4413 Gm13:32556590..32557989 Cluster 1
atctcatgagaaacatgttataaaataaggaagacacattatatgttgtcttagaaaaggaacacatgcaagttgtatcgtttctaagatcgagaatttgaaattataatatatactacataaaatgtcatgtgtgtatataatatcttatccactgatgagagtagtaaaacagagataaatttaatattttttttaaattaaaatcaattaaaattaaaagatattattattgcttttttggataaaagatatttttgtccataaaagtataatgtgataatttaattttaaaaaagaaaatttttatttaatttttaaatatataaaagtataataattattatttaatttttgaatcatatattttattattaaattatagtgtttaaagactgccttaatatttaattataaaatttaagtattaattcaatattaaattttatatcaaaacacaattatcacatttttttacgtatttaaaacacaaaatcaaaattttatttccttttaaagagtaaatcgttacatcattataattttagaacaaaagtggacagtttttcttaattgggaattatctatttgactcctgggtcacggcggtagggtcatcaaattaatatgaactgaatctttggagttcggagagtgacaagaactctttcacactagaatcgcacaacaaattattttttatgccttattttgattattagtcaaatatagagacaaaaagaaattaaaaagtataataaaaaaatgtgtatttgaataaatataaaaaagcaaaagataattcttccatcacttatttggatatgtaaaaaaaagagacaaataaataaattatataaaaaataattttatattaaatacactaagttaaagtaaattacactaagttaaagtaattttgtattaattatttaaaaaataattttataaagactgaaaaacaatatattatatgagcaataacatatttctttttctctagaggatttaactcaagtgatttaatagagtgcattgttataaattcttttgatacatgtgatctttgattaataaaaaaattaaataacattactttttacttatcttaaatgaatatctatcttttgtattcaatattagtaattgtttagaaataactataaataaacgagtaaattacataaattattccttaaacaaattaaaaaatacacaattttatattacctttatctactcttacattaactccttcttagttaatgatgaccaagtgttactggcgtgcgtgcaaatgttaacaagactagtttctgatcaactaggattgatgaattcttcttcttttcattctattctataaactttgtaaaataaagtttttcaaggttgtttct

SEQ ID NO: 237 - DNA, 1840 bp, Glycine max
  Soy_ogl_2233 Gm07:6412461..6414300 Cluster 1
aagtgaaaataaaggaaagatatcaacaaggtttgtgtgtgcaattcctatagcattaacaagatcagtacttccagaatttctgttttcctttgtcaatatttttgtattttttttagtaccataaatctttgtgtttgattatggatcttaaagatgaaatttttaaaaaatattttagtcattaagagaaaggtggcagtttgacaagttcacttaacttacggataagttgaggttaccaattaccataaagttagtaagtatatatgtgatagctggtttttacacgaagtatgttattaatagtatcctttttcagtttcaatgactaataatttattcagtcggagttagactttatgttagattgattattcatttaatttgcataacacgtcttgttgttttttggcttttccttgttttaaacttgttctttttatataaaatgatgagaatgaaaatgtgaccttaatcttatgctaaagaagtacaaagaaaaaaagaagttattatgcatttttatataaatttaattataatgtcctaacaatataaatattttttacattattatccaatcatgatttatcacatattaaaaaattattaattttcataataattaattaaatgttgtcattaatttttttgattagataataatatatttttgtatggaattagctaatgatataaatgactatataataataaattaataataataatatgtgattaaataattatatataataattaaaagtggtaaatttacttacactaatatttatgcaaataatatatttgtggaatcatctttccgaaagcataaaaacataattgtaaaataacctttgtaaaattatgcaaacatactttcggaaaggtgtttatgggaagggtaaaataattaatgtctttaagaaagacatttttagaagtagaagaaaaaaacaatgacttatgacaaacttttatagaatagggtagtattctatacctttctttcatcttcgactttgtctgcaccttcttccctgcattggagttgtcaacaatggtgttgggtggtagactagaggagtagttttgtctgtttgggtgttttggaggtgcatcaagcaaaaaagagaggtgcagaaagtaaaagcctatattgagccgtgtctttggactttcaacatccatgctccattccagaccgaatgttgcgtatatattttcaacacaaaagaaagaaaatgcagcgtttgaaacgtcattaatattttttcattttctcatactttcattggcattggaaacattactcccctataaatataggagaatgctccttctgtaaaatatctcaattgagtatagaagatagaatttgtattcagcaaaaaacagaagatagaatttgtgtaaaataagacatgggttttcttttcctatttgttttacaaattcaaatgcacaaagaaatgatgaaattgcatcacccattatcatcatcatcattaaatatttctcccttttgatctttaagtttgtcttcataaaataatatttaaattaagtaaaagcaaaaatacttgtatttttcccatttcacatgtttttttacaatctttattatttttttattcaaacatcatgagttggattttataattttaatctaaataaataatttccacatcttgaattggtcaaaaaggatttaaaatcaccttccaaaataaaaaaaatattgttttataaaaatcattttaactcactttgaaaataaactaaattaaacctttaaaacataaaataccaaattgaatatattctaaaacataaa

SEQ ID NO: 238 - DNA, 2200 bp, Glycine max
  Soy_ogl_433 Gm02:7201201..7203400 Cluster 1
gtcgtcctttaaataaatttgtaaatgactcgtaaaatttgatattttctgttctttgtttctcttcaaatcaaacaaggaaaagttatatagttaatatgttaggatacaattctacaatgcacatatcttccacatcccttacaccactttacttgattttcacataaaaatacatgtattggaagtatttctaaccatgctttcaatccctaccatttcactccctcacctaatagaccatacaattaatgagttttcttcgtcatcatcatgagatttataatacttatacattctatttaatcaattaaattaaattctattgatattaaaataaatgtattactagcactcttttaatttgttaaaagaaatgctttctataaatgtggatataattaatgttttgatttcaatttaagttgaaaatgttaatttttctatccagatcgatcataaatattttttattggtattttaaaaaaattatgtcccacattatctaagaatatgtaaaaataggaagtcattcttaccttataaattaaattttggggttgaatttgatttaaatctatattataagatgatatagtttttttttaaaaaaatcttatcctaaataacgagagacaattttgcgagtctagcaggattataacgaacgtaatttttaaaaattacactcaactgatcaattcaatcaattaatccattaggacctccaatttggtgattggtctgttaactcctataaactgacttattttagaatcgcccaaactataccaatggttaaaaagccattatgaactgtttttttaattcattttttaattattttatttttaatacaatataaaatattatatgataaataaaaaaacacgtttaaggattacacgcaggtaaaaattattattattatacattattaatttttatctcgtaaaatatacaatttagtcatttatattaatttatattttttatttcttgatttgttataattttatattactttaaacataatataatattgaaaatgaaattttaattattaccaatttaaccattgttcaaccattaaactatgaacaagcattttcatcatcaattattaattagtctagttttaaaacatttactataggcaaataagtttaatttccttccaagtatttgatacaattctataatttttttctcggactcaaaactaactgaataaatttaaacaacctcatacccatgcattcatgcgttttgtggttgacattattaatttcaacaacatttaacattttcttagcgtgttacctaaacccaagtttttctataaaaaaaaaaagttaaaatattaagccgtggtaaaataaaaagtaacataaacaacaaataaaggtaattaaatctataataagtactaaatgaaaaatattaaaaggaaaaaatattaaaaataaattacaattatccaaaatttaacacaaaatattccttttcaacataattgttatgtatgtatgtgcgtgcgtgcttaattagctttatgcgggaatgaaaagagaaaagaaaatgacttagccgtatagcacataagttaaacgacattaaagcaaaattaatgtcatatgcttttctatataatttttctatttagctctccattattttatgaaaaatattatatattagaataaaggtatttaatataatactaaaatatcggatagttttatctaataagtaaaaggattaaaaagaagatattgtaagaaggcttagaattattaataagtaattaatgtagtaaattatgtatatttgaccaggtcaatggtgacaattattagcgattggcagctacttcaatactcttttggtgccttttagggtacatgtagtcaagaaagtgaccggtaaatgagtgacaacaacatattaagtagtacataattaggaaattttggagaaggttttgatttgttctatttcaaaattgaattaaggcttttactttcatagtccactcctaacaattcattatccagacttcttgtagcaaactcagttgtgttttaaaataaatatgtccaaaaataaataaataaaaatgagcaaggaaatgctcgatagcaaacacattgaatatatctctattaaaaaaaaagataaaaaaaaactctaacaaaaa

SEQ ID NO: 239 - DNA, 1800 bp, Glycine max
  Soy_ogl_952 Gm03:38936201..38938000 Cluster 1
agtccgtcatgttaccgctggaaatagaaatcatcagttgttttctaaacacatataataatatcgtaattggttgctttatatttttaatttgaataaatatatatcattcatgttatatttaatcggtcttcaatttatttttatattcttaatccgcaagaatcgataaacacaacaagaggatgactaagagaaagcaaaaggaaaaaaaagacttgaaatatgtcaggaaaacattttaagttattttctatttcctttaattatctatataaaaaaagcttttttgacaatattgacaacaattagtaaataagtttattttaataacttatatttgttttgtgagacattaccttgagtaatgttttaatttctaactttttgtatttatttatctagatatttttatattacacggtttattatttagatatttttatacgacagggtttattagagttttaaagtgtaattctttttacacagaaagtacatacagttattaaactttataaattatatctcgtcaattttaagatttgcataaaggggtaagcaccgaaatttgaacaattattcacacttacataaatgcgtaaattctcgtcatcaaaagagagcatccaattgggtaatcaattaattaaaagatctaaagaataaactctgtaatccctttcagtttggactaaaaccgaaaaacacgagctggaaatggttgtggtcaccccctaagggcccctccctccacaaccaatgaaacccaaactttaatatccttcatttaatcattttattattcagattataaagtcataacgtgtgaaatgtgaagatattcttgagtgcactcaaatgtaaggtcattctataacttttttattttttaatgaatataattaaatatgattgtagtcttgtatttattttgtatatatgattgtcgtacgttctcatataaaatgataaaaactgttttaaaatttattgtaactctaactaataaatttgtaaatgttcgcaccttctataatattcttttcctaatatatgattatactatattactcttccaaccgagcatataaataagtcaacatataattgtttcagtttaatcaataattttaaacttaagtcatacatatacaatttcatcaaaactctcgaaaaaaataatttattatttgtaataattctaaaagataaaaaaatacatgcgatctaagagagaaaaaaaaatattacacttctcttaactaataaatttaagattattaaaaaaaaaacatgtatacttttgagatctccatcagatagtttcgtgaagagacgctttagaaactaaaaaggaagaaaaaaggacctaaatcaaatcaaataggttgactaaatcatgcagggctagaacccaattagtgttaacaaagccgtgaatgtgttttgattaccggatgtaatcaaagtaatgctaattttacagaatattctttcaacacattctttgtatattattacatgacttctcttattttatattttgttctcctcttctttttatatatttctctcttaagtttcaattgtatatattttcataaaaaaaaaatgttgtgagccgtcactttgggccgaataattcattcatgaaatacaaggagcagagcagagcatatatcatatgtgctctgccacacaatgttataacatttgttgtaaagtaacctgcacttagaaaaaggcaatgaaaatagaacacaagggaaaaaacgaaaaaccaacaaagaaagtgac

SEQ ID NO: 240 - DNA, 1800 bp, Glycine max
  Soy_ogl_1230 Gm04:5386801..5388600 Cluster 1
atttttggaaattagaattaaaagaattagggggagtgcaactagtaatagtcttgtgtacattgtttttggttggtctagagaaattcgggggccatgaatccttttactttttctttgggtacgccacatgagcgtggtggagaagaaggtgtgaatttctttcatgcacatgcatgcaacattgataagaaataaaacaaattataatataaataaatgtcaccgtgacttaccacgggcctggaacagtgggattatttcttatgcttattgtttagcaagaaagaatataggttttatgttagtcatcatgtatttgagttcagtccaacttgtattgacactattatagtattattcatgaagtgatatgagttttttatttatttaaaaaaacaggtcttattgcatgtagacctaaaagaggacgtttgtcaaccggttcgtttaagtttattttttttaaataaacagttttatactttagtgatgtatttgtctaaaatgttttttaaaaaatatttttctattttttaagaaataaattttatctacttcttaaaaattaattttttatttttttaaaatataaacaaattggccctatacgaaaatttccctaaaatttgaatctcacggtagaaagaataaaatgtgtaagttgaagaaggctttccttatttatttttttttctactgtttcatatttttcaaactcttttttaggtgaatgtatttttcaaactctacgcttatactttttatattcttttaaacagtaatttaatacatttcaattttttttagtttttcaaaattgatcatatttgtttttcttcgtaataaaattcatcctgcagcagcaacgaccaaaaaaaatatttcatccagcattctactgtaaaaaaaatattattccattatatttaccatcatctttcttttattcattttttacttttcaatttgtttatattctataattttcaatatttaaaaataatcttatcatagagaaatattgacttaattatgttttttagtccttaaattttagaataaaatgtaaatccatttttggtcccccaaattgaaaaataaaaagttcattttaatatttcaaattcaaaaaatacattttcaatctttggaaccaaataacattaatagatttggtgatgtggtgctttgaaagtgaacacatatatgtcaaacattagcaatgtcacgtcactactttcattaattttgtctagctccaatgattaaaaatgtaatttttgaaattttagggactggttaaaatgatttttttccaatatgtggaccattgatttatttaaaattttagagactaataatataattaagccaataatattttacattttgtttttgattatttttaaattagtttttgtgattatttataattgctacaataccatgctttgattgctttctttcattattgtcacgtattttcatcttttgaaaaaaatatttttattttaatatttatcttatatgtcatgattgtgtttggtaatacactcatggagttttgtttgtcacgtaactttattttaatagcttattacttcaagtaacttacaacttacaaaaatgagttacttttatttataagtgattaacttttttttttctttttcatttatatctcattatttgacttgtgttttctttttaacttttttaatcaaatatttaattatattcttttatgtcattttatattctttatcaaacttatatgttaatcttacaaaacattta

SEQ ID NO: 241 - DNA, 1900 bp, Glycine max
  Soy_ogl_1231 Gm04:5421101..5423000 Cluster 1
agatatataaaagagtttaattttcatatattaccatgatcaattttaaaaattattttcatatattatcattgagtctatttatttattcccattcacatcatttgattgattaaaattagctagtgagtaactaaaatcacaatttttaatgacaataaatgtttgaacatacatgtacttttcaggagatgatcttattaaactcaaataagattattatagacaataaaaattttaaaaaatatatttaatatatttatatatctatttttttttccagatacatatctaaaacttcaatcccacactatagattaagctactaaaataactgaacgctaattaattaatgcaattgtgagaatagaaagcattagaaaaatatatataaaaaagagtaactgatcattttgcttattgaatgatcgataataatttagttcttaaattattctcttgtataaaatacgatttcattgctaaggagtaggaaagacgcgcaaaagaaggaggtgtgattgggttggaagggagggcccatgagacgtaaacgcagaggaaggcactgttcatgcgcacgcgagtgtaccataaaaacatgataacatgatcattaatacctttagaccatctatcacatccctcggattcagatttccttttcttcttcaccgtaatccatataaccatatcaatttcacgtgtgctaactagttattgtgtcacaggagtttaagaaattaataaataaatgatacagtaataaaaaaataacgggtatttttttttcaaatccaaggtatctttcaattaagagttaaaagataattaatctctcaactactgaaatctacttaaaaggtcaatttttctcaaacattttttcatatacttaaagaataaaaattatttaaaggtagttaatcaattttttatcaagattatcatcaacaaaaaaaattaataaatatttcatactaataatatattaacaaaaaaaatatttattgactatatcataccttgataaaaaaaataaatactgtaataataaaactataaaatttagaataaatgtcatgatatgtaatgcattgataacattatcggtttgtttgtataaaaggaaacaaaatcaagagataaaatacaaatttttcttttatggtctacttggattggaaatgaaataaaaaggaaaaaaaaatgacaaaatagagtatagaaatatatgtaattttgatatataaaaataagaaaaaaaagtctcagaaaggattctaatgagtggacaaattggtgaaaaatgaatagattgtatctaaaacttcccatgttaattaaaaaaattaaattaactaaaaaaaactttttatgtattattttaacgtagtataaaatgatttattatttttatgttataaaaactgtttttattcaacgaaaattaaagaggaaataattctatacatgacaacatcacttatttccttcttgttttcttctaacgaaaattagacatttctgtcatatttccctcttcttcagccccctctcccctaaacacacccaaacatatacattgttacggtaatgcacaatactcatttttatttacacaaattatcacgataggaatactttaacctaatgaacacttcttaaaagtttctacttaaataaattactatgatacaataattttctttgataaaattacccttattagaagagttcaaatgtaattgcgaattcatttgtatttagtcgagatacaaataaataaaggttccgttcaaaacaaaattaattaatattttttaattgtttttttataggcaagaatttgttaataatgggcaattaaagcacgagatgtgcctcaaattgaaaagca

SEQ ID NO: 242 - DNA, 1800 bp, Glycine max
  Soy_ogl_1399 Gm04:44662601..44664400 Cluster 1
tacttgaaattgttttttaaactaaagtgatttttttatcagtaaaaatccaacacttgtataaaaaatttacaacgaatatatactgttaaacgttgaagtaaagtaattttgaactcttaagagaaaaaacacaattacctcatacttcacctaacaaatgatcttttatatatataaagttcttaaaataagaagtatttatcttttatctatttaaatcataatcatctcgaatattgtaaatttgaatcctctcacttttatatttaaatgtcaaaatatacttttactgtattttaattcttttcatgttacataacttcattatttaatacacatttttaaaaaaagctcaaattattaattgttttaaattattttaaatgaaaattttccttacgagtttaaactttttaaattaattactgtaaaatattatattaaagttcagttaaaaaacataatctaaaattgatgctttaaaaaaatttaaatttcttcttatatctgaaatttatatttttcttataattctaaatatatatttatattttaaaaaatatttaaattaaaaactatgtatcatgtatcaaatattattcgagtctcgaaggacctgattttaagccatatatctacgggcatttcgagttttcaatcattttttcattcaagttataatgattatgattgttcacgtacgagttagtgttcagacaatttgaattctttaaattaaaagctacagtgatcatatttgcacatgaaaaatttacctgctaatttgttatcatctttttctaataatttaaaaattatcatatgcattcaaaaacatattatataaaaatatttgctcatacttttgcttcttccaatatataaaatataaaaatgacataaatatttttatttgcaaaagttaaatggcctgtatgaaaagtgaagaaaatactgtataagttaaagcaaaaattgtttttaataataataaataaaaaatctaaaggatctcatccagtatccatacaagatttcaaccttcattttgggattattaaaaccttggagcccgtgtagattttgactttgctgttcgcactcccctgatatttatatgcttttcttatgtgtttttgattttttttttttcaaaaatatcatttttctgactctattttttaggacatatggatttaatccatagttggatcaaaatgtcgaattacgacaaaatgcaggtaattacttaacacaccaaagcaaatacattagtgtgtgaagtaattttccaaaatgctttatagttcgttgcaacctaagactatggttagttttttgttcagggtgctttgacctaaaacaaaagtgtgtgcatgtttgggttactgtcaaaactcggaagtgttttcaatgtacttttattttatcaaagcaactttattaattctctggtccacagtcagatgtaccctgtttatctattctcttatttttacctgcttgtgctttgaacatagactagttttgtgagttgaccaataaaaaattgaataaaattaaaatgaatttaaaaaaaatgattgaaaaacctggaaattatagaaaatgataaaaaccaaaaatgttcaacacggtattaagtaaaattgtaataaaatacacatgactgataaaataataaaatctacctttttatgttaaacaattataaacattcaatcaggagaggttgatagtatattataatcaaacataaaatagtaattatcaaaagaagataggtagaaacacact

SEQ ID NO: 243 - DNA, 1573 bp, Glycine max
  Soy_ogl_1530 Gm05:1853928..1855500 Cluster 1
taaagaataacaaatggttcttaaaaacccatgattacgtgagttgttccataagaagattgaatggtgggtatagtgggcatgtgaattgcaaacaatattttccgggacaatatcatatgtttgccattgccgaagtgggttttactgtggaatatggagagtgtatgaagaaaacaaggaggagagccatctaacccaaaaagaatgcctaaaatatctaaaatcatatttatcgtgatctgcttttttttctaatcttgagttttttattatcatgttataagtgtaaaattgtcatcaactttttctctggatcttttttccattatatttttcaatctataagattcaaatgagatactttacttaagaaatctaaacccaaattcactcgtaccttcatagtgattttaaattataagtacgaaagcattttcctagagacatttaagagaacaaagaaaaaatagcaaacagttatacattgatcaacaggggataatttttgtatctaactatttattttaatttattgtgcaaagaccttccaatcaaaaatagcaaattataactaaataaaaaaaatgaagacgaggtgtgtgaaagagagaaaaaacaaaaaattgacaacgattgcaaatcaaaggcattgaaagcaagaaacaaggagtcagtggcaattcttattgattttttttctttgttaccgattctcatagaggaagaacatttttgttacaattgttattatttttttttttttaccaattttcttttgtttcaagttgcattacaattgtatgtcacaatacttaagttactccaactgatcaagttgtatttttatttatatttattgtagtatatgcaataatgatttccctcaaagtatcatgcttccttagatattttataggcgttcaaaatttgttttggatgtgttgaaaactaattttttacccatgcaatagcacggaaatttactcttattttagtaccttcctaatatttataaatgcatttaatcattatcattttacattattaattttatttatatatcttttttttaccatatttatatatctcaatattatttaggtgttcaatttattattcaaatcttttttatgctataattatgcgtgagttcaacggaattacttaatttatttaagagtatttcacttgaataagaaacattgaatcagtgaaaataacaaaatcgaccttaagttattgttagtctttgtgtgggttaatatatataagtttgttaattggaccaatacctatggattacttgttagatttctaatatcagaattttttatagtcactatatataataaattatatatattaatctttacttcttatccattttttaatagctttttcaactaaagaaacaataaagactctatactgcttgaccatttaattattgaagcatttttcatgtatgttataaagaacgagtgctttacactgttgcatataatggtcaattgttttttttttcttttttgaaaaagtccaacccatttgattaacgcggtattaacaa

SEQ ID NO: 244 - DNA, 1755 bp, Glycine max
  Soy_ogl_2162 Gm07:3415309..3417063 Cluster 1
ttatttgttaaaagaaacagaaaaatatttttttaaaacaaataacattttaaacaaacaagttaaaaaaaagaaagctgattattttaaaataattatttatattaataaataaattcaaacaaacttactcttaaacttgaatggattgataattattcgaattactaaaatctctggcgattgtagatcttactatcttcctaaccataaaatcttgagataaaagtcaatactccctcacctgctaagattctaagagacattgaaaaatggatttgatatttgatgtaaagtcactttaaggactactttgtttaagtttttttttttttacaaaaataagtattattttaaatgaaataagaagttttataatttgcagatgtgtttatttgaaataataattttttatttttttcaaaaagcaatttccatatgtttttaaaaaatatttatataaaaaatattttttaaaattattttttaagtttaaaataaattatcctaaagaaaatatcatataactaagcataaaacaggaaaactgcacaattttcaaacctaaagaaaaaaaaatgaaataactaaaaaaaaaaatcatataactgaacctatagagtacaatattaaaatcttacgtacaaaaagaaaagaaagatatgccctaattactgaaggttttgtttagcaattgtctccccacaagcacgaaaatgtcaaagtgtcagagctcgttgaaaatgtagagtagactcagtcgttgacacacaacaccattattgtcatcttctcttatcgcaaattaaaatcccacaaatttcatattgccaatagtttcagagcttgtcaggttgcaagagctataagatttatataaaggtgcatcttgatttgataaaagtaaataaaaaggatcttacttatcaatatttttaaaatattgattaagaaattaaaagagaaaaatatttattatttaaatcttaaaagaatataaaaaaaatataaactatataattttatgtctttttaataaatacaaaaatctttaactaatgttcttaaaaaactgattaacatttgtaaataaagaatttgatagtacgaaaacacttgttttgtgtgtgattttaaaatttaggcgtgagataacacaaacgaagcacaggatataagtaaaatgaacaaactacttactgaactgatagcttcttatcccacaacaatttcacccaatccttttcacctgttcaataaaactaactttctctccactttgcccctcgtaaaaaaatgtttgggttcgtttgacaattgagttttataagaaaataaaatggagtttttatattaatataaatttactattttttctgatatgggtattaattcaattttgtttcaacttttttattattagatttgttaatttattcaaatctcaatatatttcttaagcagttaaaattttgttcttggttaagaaataagaactccaattcctttggctcttaaaaaggaataagctttaaatgtacaaatccctaaagttaataagcatctaatgtctccactacatttttttaaggaatgtctccactatttttttttaacaaatgtctccactattatgcacccttaaatcgctccctctaccatcacctttttaaatgacaattttattagttctgtaaatttatataattatttgttgagtaatttgatgagcattaaatattaataagataaaag

SEQ ID NO: 245 - DNA, 1813 bp, Glycine max
  Soy_ogl_2889 Gm08:44645888..44647700 Cluster 1
gtaaacatacagtaaaacaaatgagtccttgaatttaaatggggcagttaattgaaagtttaatttgccttcagctttaatttatatccaaaggcaatggttgctgggaaaatgaaattatagacataaaaatgttacataattattacacgacaatgatttactatctaattgtataaaatataaatcctcgaaaaaaaaaagatcatgttactttctaaaacaaatagtacagataattacaaggggaaaaagtgttcgaagaaaatatataaagagtaacattaaagaaactcttcaaaagtaagttgtttatacagtatatttatataatttaaaataaaattaattaaagtagattgataacaacaaatagtacagataattacaaggggaaaaagtgttcgaagaaaatatataaagagtaacattaaagaaactcttcaaaagtaagttgtttatacagtatatttatataatttaaaataaaattaattaaagtagattgataacaaaatattttatagaattatttaattatgacttattgaggagttctaaaactcaattgaaattcaagaaatcctagcaagttatatacaatacaatgtgatcaattgacatgcttgctatctatttttcatgtaaggaagaggtgatgtctataaggcttccatgctacctctcttgtatgtaaaaagtaatagatataatagtaattcatcataacaaatataaaataaaaatgttttaattcaaatataataataatttatatttattaaatatttaatacatatagattaatcttaaacatcaataaatattgatccataatatatgggacacataaccgtagatagttgagctaaatcatccatatgaaataaaacaccttatgggcaaaatctgtttcaacataacttttccagaataaataatggtgtgttacatcattcaagttcgagaagaaaaaaattcagccgaattattaaaaggattcattttcaaacacagatatataatatattagcaagtgtgcatactaaagggctttgaaatatttttttgaaaaattgttacaatacgttgttctttttctaataccaaaatataccataaagcgaatattttccgttgatggcggatccttcttgttgaaacatctcgatttacacatgctattattaatgatgaaattgtctgaaagcaaaattacagacaagtgctcttcacagttgtatttttagtagttttttactcattttctctcacttttatacaaaaaaagtagcccatacttttaaataaagacttaatcatttaccaattaaattttaattaactgagacttgagaaattaattagtgcagaggaaaaaaaaacaagtattattaatgcaaattaaatttatggcataaatttaataattaaaaactgatgaaaatttgataaggtaattttaaattttatcattaaactttaattattttacaaattttatcactcaagttttattttataaattttatcacttaattttttaattttgtgaattttaccatcaagttttttccacaaattttatcatttaactttcaacattctatgatttttattatctaattttttgtacattttacaatcaagttggtaacaagatgacatcattttattttatcattatctttttttgacacattaatggtgataaaatatacaaaaattaaaattctatgtgacaagattgataaaaataaaacttaaatgatgaaatttgtaaaataataaaatttagatggtacaatttgta

SEQ ID NO: 246 - DNA, 1845 bp, Glycine max
  Soy_ogl_2943 Gm09:2128256..2130100 Cluster 1
acatttaaatctatatatatatataaaggttttattttgtgatctaacgagtggatcctatattcattttatccaaaaaaatatgaaataattttttttattttttatttatagaaatctatattaggaaaataatatacagaattaaataatttaataaaaatctatactacacagaaattaaatacataatcatgtatataaccttcctttaattatataaataatataaattgatatttgatatgacaattatttatgttaacaattaatagaaaattggaaaaatatttttggacatattttaaaattaaatgaaaataatttattataatatttattttcggaaacataattaaaaaaactagttttaaaaaattcaaatttaaatatgataaattttggaatgcactaaggaagtacgaagcatccatatcatttttttaatgtttgtatcaatttttattatggcttaaaaaaatctgaatttgtaaaagtaatatgtaacaataaaaatatttaaaattaagataaatttggaaatgagttatatttcctatttcaaattcaggtccatcattcctttttatatgatttctgtcctctttttttggatatctcatttttttcctctttttcttttatttttttcctttatatttgtataacatttgtataaaacatttataatattatcttggatgaaaattttgccatgtgaacaaatatcacttttgacaaaaaaaaaagtcattgacaaagtcactagataattattatcaatatccttatcaacgaaaactcagtacatcataacttattaggaggaatcaaaacaaacaaattatggacattacaatataataatattcataacaatcttacctttgtatatttttttatattcttttttatgcatagaaatgaaagactagaaaatttataataatttacatatttaacataattaattaagttaagcctccttcacttttgcatattcatatcctattaaaacattcaggcaaaaaaatatctcattaaaactttacttaaaaaatttggtaaaacaaaaatttagcgaaagcaaaaaataaatattctttaatacgttataaatattgcctcattacaaaaacatggtttagtataaaagaatacattgtgtataagatcacatgagatctttgagttgacaaagtcaaatattgtagacatgtttttcaaaagatgtagtatgaagaagtgatttgataaacaaatatgcttgattaccacataaacaaatttattaaatgtatatatcaccgttctttgagagatagagtgaataataattttagtgaaatatgaggttttttttttgttttacaaaggtgaaatatgatttattctatcactttaaatgtatcgttttatttaacccagtaatacatgtagtattattttcatatgagatcattgattataggtccttgtaaaaacatgaacttggaccattggggggaattctgaattttgaatagataaacaaaagtggttattttaagaactagaagattcggtcgccatttaatggtgaaaaggcaaaggttcatgctatacaaacgaaataaaagtggcatcaactttatgtgtgaggaactaataaaaaaggcaacaaacaccacatatcatgctcaattggtcatactcatcataaaaggagttggtgattcccgtgaagtgtcaattacctaatgagttgggtatgtatatttattggagtggataaggggcatcaataagtgaagtaggatgtttttgggacaacatttgtggtgcttgtgaaggtgtgtgcctctt

SEQ ID NO: 247 - DNA, 2074 bp, Glycine max
  Soy_ogl_3732 Gm11:4706368..4708441 Cluster 1
atgcgatacttattaactactttatgtgttcaatgaatagtcaaataaccacttgtgtatgtaatatcatgctatcatgtgacacttctaattttttttcttttaaatcgctaaaataaatattatttttatactttaaagcgaacattatggactaaaattagagattttagattttgaaaagattaaaatcacagaaaaatataattttacataaacccaaatttttttacttattttataaggaccaaaaattataatctcaaattttagaagaataaaaaataaatatttttttataagtagtaaaataaaacgcggttagtttataagattaaaaacatatttatgtattttatattttagaaacacaaagtttaagtgggaatatatttctcttattggatgaattaaataatatattactaaacttattagattcacttccacttccacgtgatgatttaaagcaaaggacaaaaaaataatagaaaataaagaaataagataagtaatattaaaaatttactatttatttaggaaatggggaaggaaaaaaaatcttgtcataccctcgtacccacaaaaataaaacttttaaagataattgaaaaataacaaaaaaaatgtcagaagatataatgtattcgggtaagcagctcattcacgtggttgttgggaaaccaggaccattattgagtgagttttagaccttaacttttcttgggtttgggaggactatgactaatccaaatacgaaatgggctacgcagcccagtgcttagaatagtcatgtatgtagtattttgggctataaacacttacaattttatggcatttattttctgcactcgtattattacatcctgcacttttcatcatatcctgaaaactcattccgaagtgcaaatttatgttagatgctgggtgtaatagttgtagtgcaggatacaatagcccaattttatactcttaagatacattgggccattggcaatatttttgggcaatctagtggatgtatagtaagttgattgttgtttcatgtactttcactactgtttattgcacttttccatgtattgtgaaaaatccattctaagatataaaactgtctttcgggatgcattttttataatacagttggaagtgcaggaaacatagtaagagtacaagaagttttatcctagtatgttctatttctgtctcgtacaccccacttaatttttcttgggcttaaatataactttttttctcttattttgttaaaattgtaatttttggtttattttaaaacgtacacattttttttccaattttagaaatttcacaactgtagtacaattatcaattttgctaacatttatttcttatattttaattaattaaattgtttttatgatattttaaattaatgtcatgtctaaaattcaattgaaccaaaataaaatgtagttagaattaaggattaaacaaaaattaatattttttaaaaaggaagaccaaatgttattatttttaaatgaaatgattaaaattataaattaaataaaatagggagagtaaattatatttaattttttttttgttttttttaaatatttctaaaacatctttctctcaatccaagaaatctaatttatttgattgaacgtgtgtgagttttttttatatatatatttctgaaacatgtttctcttatcccagaagatctaatttagttagttaaatcatatacacaaattcaaacccttcgaataacctctttggtgccactcactctcccctttcacattttttagtgaatgaaagtggatttaatttgtcattctataaattatttgttagaaggtatttttaagaatatgcacatgtcttggaattttattcctagaatgtattaaataaaaatgcactctattaatgaactaaatttttgcatgcttataattttttaatacatggtactctagtaataaactaaatgcactctagtatttaatacattctgaaaaaaaaaattacgcatctacaaattccttaaaatatttatctttatttgttagataaagta

SEQ ID NO: 248 - DNA, 1600 bp, Glycine max
  Soy_ogl_3741 Gm11:28801..5070400 Cluster 1
ttagtttttaaatgtataaaaattgtgacaaaatagtctatttttaaaatttgtgagactattttattattaaattattatgtttaaggatcaatttgacaataataaattattttttaaaaattaatttaatattgaattacaaagtttagatataatttattattaaattatttgtacgattaatgtatcatactttttatatattaaaaattaaatttagattttttttatcttttataaactagtttatcattagatcacattttgaagatgaatttagctgtttacctattttgatttacggatgccaaatgtttttgcttatcctatcgcagatgcccgcatgtgactgtgattgagaatgctcaattgcacatgaaggatcataatgcaataacgcgggtggaaataggcctgcatgataatgaatagtatttatagggcaacagaaaaatttgagcattgatataaataaaggtaattaaatagctccacgaaagagaaatttaattgatttgattgggcacttatttatattgtgttttttctttcttttttctgatacaatgtgttttgataaaatcgacatcgataatttgtaatataataactacccgttatttattttttagagtccatgacaccacgctaatttggcttaaaaaattattttcaattatatccaattttcaaattttgttttttttatttgacttcttcattttaattgttaaatatggctcattaatcatcagctatcaaatacgtatcggttaatatttaaatattttttttattacaaatatgtcactttttactttaataattgtatattttttaatttgtatttcttgtaaatatgttattttttgtttttaatctctgaaaatataattctttttattttagtccccaaaaacatatcattttttagttcctaataatatcattaggatgacataataatttagatgatatcattatttattaacaataatttttaatgacacgtttattgacatgtcacaaaagatttcatgatttgatgatgtaaaatgatgatgttattattgtttattacgtaaacacttaatgaatttcattaacaactcactaaaataaaataaaaaattagaagaactaaattcaagaaaaaaagaagctttaaagaacaaaagtcaaaattccttattttatagggatcaaatgttatttaagcctataataaataaaagataaatatatttgtttttttaaataaatcataatatatcaactagctaaaattggttaaaagtaaataattagttatgctgtgaatgtttgtaaatgatagaaaaatttatttataaacaataggagtaaaactaataactttaaaaacaatttaagaccaaaattaatcatgaatatgtatttgcataattaatatttaggttaaattatttcttaggtctgtaaactatttgacaaattttaaccattatctaaattaatatttttttccctcaattgggtccttaaatatgcatttgcttacttattgatctttttatcgaaccatatatcgttagaaaatttaacaataggaacataa

SEQ ID NO: 249 - DNA, 2064 bp, Glycine max
  Soy_ogl_4676 Gm14:5396101..5398164 Cluster 1
tttatcttattataaattatcatttgaattattttaaaaattaataaatttattatatatgataagttatgattggatgatcatataattttttttatatttttagtgtataattttttttcacaataaaatttataaacatgtagactacatattcaatattttaaaaattactttaataaaaaaattaataatctacatcaagatggttccgaaggcacgagttgcgcgatacactgtctgtatgctgtacctatctccaacgcacacacgattcattcataccatgcgcccacccagatccaagtttcagtgaaatataaagccaatttgatgttacttttggctaaaaaataaataaaataaaataatatagattatttaattaagttaatttcattaaattatgtcttttttaattaaagaataatatcaaatatattttttttaccttattaaatgaaaagtattttgatttttttttgttaaataaaatatgtgtaattaaaatttactgatattttttaaaaaaagtaagagatttttgttgatcatataggtactagttttgtttttttttgggacttttttctcttattttcttttttctgtctcctacttctaaatattaaggaggtcttattcatggggtacccatgtgggattatccatatataattctgtttaagggtcaactcaacttattatcacgatatattaatcttaaaattatatataactaaattatataattaaagagatatataactataattaatgtatattttataataggtattttaagatataaatgacatcaacataaatataatatcactttagacaaaatattggagtatttattatgtctattattaatacataattattttaaattataacttttaaaataatatataatatcaagtcaggttgagacgttacaaaatataatttggactcatcttaaaaatgtattggatttaattttttaaatctagatttatcaaagatcccttcaagctatgcatattttgtgagattgaaccaattataaacatccctagtttgttatccttattttttaaacaacctttcccccttaaaaacaaccaaaatgggaaaagaataagttattccaaacatgcattagtttcatttggatgaagaaaaaaaaaaaccttttgtatagtagaagagtatgaaataattgaaaagaaaaaaatgttaagcaataataaaaaagctacgcatttttagattcgtaaaagtaacctatcttctgtagattttttctaaaaaaaaatttaagctaggattcccaaccaaattgaaaaaaaaaaataaacatttttattttattttaaacaaaaacaactgaaatgagtaaatttaaactcttgcaaacgtaatttgtgttttctttaacactagtcctgttaaatgccggctaattaagttaaagcttctttttttgtgtgtgggtaagattcacaatatttaaaagttatttaaactcctgactatttttttttattatgattgggaaaataaaaacaaacaagaaaactaactcctataaaaggaggtctttggagctgcatcatctccgacgaagaccctcacgatacacatggatataggaaagattccaaggagtggttttgaagctgtttatcctagctactaacaatggcagtatgaggatggattacattctcttccacttccagcacgcaaactcagctcaaagaatctctcactcacaaataattgcgtgtaattctgcattcatattcgacgtgaatccaccagagcctttttgacatctctgatccaccgcccaaaaagggtagttttactgatttaaattaagttacatgaacctaattattaaaggatacataatatttcaaagcatttacatatttttattcacaagttaaataataatttaaaccactcattttatcttgaatcctacgtccttacattcataaacaatgccaaatttgaatcggttttgttttcaaaattataacatggactatgtttttattgttg

SEQ ID NO: 250 - DNA, 1967 bp, Glycine max
  Soy_ogl_5893 Gm18:2260001..2261967 Cluster 1
atgcctcccattgccgcactgaaatctgactgtagccccaatcagagctaaattatctcttatttgttacaatatttggtttcctgttcataactttagctcatgatcacctcttcatatgcatctggatgctgcaccacctctcccatacccatttactgcttctaaaattgacaaactcaaatttctgccacacatcttctttgccacttctttctgatatagctttcagatataacatactaccaacaaaacatataataatttatataacatcaaccaacaagttattggcaactttattttgtctcttcacatgcataactactaaatattactccctctttttcataataagtactgtataagaaaaaaaaataaagtacaaaaataacaaaatgagtgttattttaactttttaactattttatttatttattattttttttgtgtaaaacaacttataataacacttattataagatgaagagagtagaataataaatatattttgtatgagagagattaataaaagtaagtctcactgatattaggtataatgttccaaagctgcatttcttatggtggagtggtatatcattttttttattgataaataataattcgttagaatgtaaatttttattagtataaaaaattgaacccgtaatttttttttcttttaaagtatccaatccaccttatatatagtaggtgcctttatgttttgggttgggtgttggatgcgtatgcatgttgggaaggctagctagctattggccgttggtggttgtttttcttttgtgtatttagtgtacatgggaaggttatagttaggattaactggctttggtttctggccttaggttagttgttttggggcttaattatataattagcttttttaattataattaaaagtttatttgaattccttaattattaaaaattttaataaaattctttatttattaaaaacactataatcatattatttttgtgacaaaaatagatgtttttatgagtccccaatacaaataatgtaaaatgtatatttacaaaatttatgtcaattaagataacaagatgagaaaaaaaaagagagcataattatagtgttttaaataattaaaggatataattaaaaattttaataattaaagagactcaattgaatccttaattataattaaatgactaattgtataatttatgtttatgtggggaaacttttgttttggttgttggctcctggtggcatgggaaacatttgtttctttgttggtgtagaggataggttctttgtaactatgtaagggtgggtacccttgtacctttatcctttattttatttaagagtcgtttctttgttgattaagaaaaggtttaatattggaaaaaaatcataaatttaatgtgaataatttaataattaattttttatccttttaaatcggtaggtacttgaatcttataaaaaggatcaagagaaatatatactaattaaaaatattaaataaaaatggatagatttaatatgttaaaaacacaaaaaaatatactttatttaatatagtaattaaaaatatttgcaacaaaaagatgctccctcaatttcattatatgtgacgtagattttggcacatgtgttaagaaatataattaatattttaaattttataaaaaggtctctaattcatttgatttttgcatttactatatagtatttgttaagggtactccataagaaaatatttataatgtttaattagttttatcaaacgataattagtttagaacaattttttacactaaagggtgatataaaaagaaacgaaagaaatataaaattgttatattattaaataaacataaactaacatatctaataaatgatcattaaaagtgaaactgatttcaggtcctcaaaccaagaatgacaaagggctggaccatggataaatagt

SEQ ID NO: 251 - DNA, 1700 bp, Glycine max
  Soy_ogl_103 Gm01:4255701..4257400 Cluster 1
cgtaaccatgttgctacgatgctgctattgccaaaaaccactcaaatttgtaggatttcgagtttcgatgatcaataataattcgtcaaatacaattgtaacttgtttttctttgtgaggccttttcttttaagacaaactgttttaatgcatgatgccaccactcatttgttccttttttttttttattctaataattagtttttcttttaatcagtcctctgaaaacggatgttaaagagcatattttaactgtgatagtactagtataaaatatatggagaagattttgtcggaaaagataaaactttaataatttttatatctcaaagttaatatcatatatttcaattataacatgtttgccttaatgagagtttttcttttaggacaaactgtgtaatagagcatgttgccatttcatgctaacatttaaagcgttattgttattaaacgctcaagactaaaacatactattgtaaaaaggaaattaataatttcatactaatttaataaatacatttttaataagtttttttttatcgatggcattaatcagtccttaagaattttattttattttaatttctcataagtatctgccttcataaataattatatttgaaacacaattggatattaaatgtaaatgtctctagaagtaggaaattgaatattgatttatcatattataggaaattaattttttctgctagactgaatcctaatagtactccttaatatgatattgataatatcacacactaaaagagaaaaatgtaaagcaaatattagagatagatatgtttaaaattgagaagaccataaatttttttgaaaagaaggatatgcgtgattgtattacaaaggaatttgactttgaaattaaaaattactctaaatacgttatttaataaaaaaatatattaaaaattaaattgctctaatttaagaaaatgggaggacgacttcgagattcgagctaaaattgtttccacaaatcatggagtattttaataatctaacatttgccccatatcttacaccatctataagacaataacaattttgatatttacgaaggtaaagtcaacaaggagataacttccgtgaagaaaaagtaactaaaaaaaaagttattactactagtgaagacgaacaggttatagtttggtaaacttttacatcaaaagtggtaagtaatactattcactaattgttgctccaactccatgatcgatttatgacatagtttgatgttcccacttatgagcatcatgattttatcttatatttgagtttgaagagagtaaataatttagaaattattaaaatgataatttttttcttataaattaatctcaataaagtattctatttaaggttttagcccttcaatttttattttttaagttttaatcattgttaaattctttttttttattttagtccatatcataaagtaataacgttgatggataatgtaataatgatattaaaagtttattatttgttacttcatcaagaaatatgaaaagacaattaggtatttttttatgtttaaaatagttaatcatatcaaacttgttagtgaataattaacaaagcaatttataaaaataatatacaagtaattattttattaagtaataatatgatgtgatatataattatatcgataatctattaacttattatat

SEQ ID NO: 252 - DNA, 2000 bp, Glycine max
  Soy_ogl_733 Gm02:48321401..48323400 Cluster 1
gatttatttatttccttttccaatcgccaaagtacaaaagggattctcagtaccagcatattccttcgaatgttctattttcatctttaatctttctataacattattcattaacctattcaatattaaacaagatcgtatatctaaaaaagtattttagtgttgtttaaaaaaatacccacaaagttatttgttgagtgatacaagatttaatcacttagacaagatgttaaattctggtggataagaaaaaatataactgaaatgaaatattttcagtaaatgtaatatataacataaattaatcattagtgagataataatagatatttcacattagataaaaatatatattttagtattaaactaacacagagtcaaagagagtaatgtaatatttttcattaatcttaaaaagttaaatgtttaatatttgaaaaatataaaaatttatttaatattttaaactgaattataaaaatatttagaattattcaaagtcaaagtttagtttagatctcaattcttttaattcattaacattagtaagacatctagaatttttgtggtaggctgtagctggtttgtattatcaaaaatggcaattatatttttttctttcatgaataaccaagttattaattaatataaagtatttaatggatttattaaccactaatttctatccaaaaactcaattgactattcttagtaattttttttctcctaatcatattttttcactcacaattctcaaacccataatattacttaaaaaattcaagttgactttcatttgcatcaattgcatgttagttatattttattttttagcacgttgtttatattttattattattcattattctcaaaaaaaaaattgagtaattaaactattatactttgttttattttaacgtcactgaattttttactaatatttttcaatatcattaacaactaattttgaacatttatcaataatttacatttttttaaattaaaatgatatttccaagtaaaatttcaacactaatattaatgtatacaaaaaaataataatagagagttatttattttatttataaatcctacagtttataatagagttaaaaattaattagcaatgacatttaattaaagagaaaaataaaatctaatatgttagttgtaaatgtttaacgtttttcacaatataataaattaaagcatcaaacgttttatcttgcgtaaaagtaattttgaaataaaaaataaattaaatttggccatccctgtaaaaaatatttattatgtccatcataacgatgaaaaaagattgaaaataacttcttttgtgaagtatttacaaaacttagcttttaatttcactgtttttaaaaggaaacttcttcagcatcactgtatgctttttattgaaggataaaactctttttttcagggtaggataaaacttaattactgagtatttgtgatactattcatcaatcaaaagtgtcacgaataacacttcaattatgtgattgaacaccaagttcaggaatctccaacatctcacaagtgttattcctataatattattcccaaccatgttgcttactgtatttcagatccaattcctattccaatttatcaataattgtcatcataaatataagatcagttttaaatggccaatttatggaggcattgaaaatagaggcagacaatctatttaaaagagatgaactataattaattagatataatagtttagatcacatcaggttaggacttagctaggactgggattcctgatatttttttaaaaagtacatgtatgaaaaagggaaaacatgagaaagagaagcatgtagctgagaaaacttgttggcaaaatgatgaactttgcatttttatgtctcaaatcaatggatacatcacttgaattaaaaagggtttgcaagagaaagaacatgagggaatgttgagttttttccactccctagaccgcaagaggg

SEQ ID NO: 253 - DNA, 1654 bp, Glycine max
  Soy_ogl_1467 Gm04:47334285..47335938 Cluster 1
attattatcatgataacttaaaatttctagattgtcatttgtatccaagtgccattgtagcaatgctcaataatgggtcagcatcatgtgcattacgagtagcttttcaattttatttatttttttgacagcaagcttttcaatttttattcatgaaaaaaatatgccgaattgttacccctccggcaggaaaaaaacatttgttagttttgttccttatttaattttttaatttttaaaattatagaaattatgtattttagactttagtcattgtttaacggctgttgagcgactacaaacacgtaggaattaaaatccaaaaatttaaatagagattaaaatacaaatattttattttaaaggaataaattatgcttgtatattttttataataaattacattctcccttttttttttatattggtccttagtatccactcaaggggaccaagtccggtatgataaataaagatattaagagtgatcaacggtcaggttcgggttcaaaaacccaaatcgcattgacccgttagtttctataacagatccatttttgccttatatggtctttcgggtttgtccggtccggtttgaccttggttggatttcaatcgggtcaaatggatttaatcaggtgtgagtgatcaattttttttgtctgtttttaaaaataaataaaaaatagttttccagttttcacgagcaaaacctttactgaaagtttgatgatttacttagcatgaaaaattgtttaaggttgatgtaagtaaagaattataaggaaaaacaaattatatgtatgatttgaagaaatttaattatgattaaacgctaattgaaaaggtaaatttgatggttgttgaaattttctacagtttaacacagagcaataatcatgtatataaataattgataaatatattttctattataaatttaaatggagcttaaatatattttttattttatatacgtagaggtgtcaaaataagtaaattcaaacttaccatgaattaaggtttaaaatgaacaatctaattcaactcacttgtggtgagccaagaagatcctaatccacctcaacccaccaataaacccaccacattagtggattgggtgagttaactcactaaattaaaaaaatgtataaataagataataataatgtttttcttttaaataaaatcatcttttttcatctagtcattcaatgattcaaatgattctattacaaatataaatataaacataaacagtagcactgtaaattagtaaaagaaataatctcatacatattactaaggcttttacaccattagtcaaaccttaatggtatgatttattcaactgatatgatgctttttttcatcattccaactcatatgatatgccttttatatacaaaaaattgtgtttaaagttatttgtaaataatattttaaacataattaataccatcatataactcgatatctttaggggaaatattagaaaagtgatacataaattatttttgtttcctttttaatttttctttggaaaagaaacattaaaataaaatctctcaaaattggggataatgataattcgtgtttctgataattaacataatccctgttagttttttagagaagatagtttttttcccgg

SEQ ID NO: 254 - DNA, 1300 bp, Glycine max
  Soy_ogl_2431 Gm07:38667401..38668700 Cluster 1
gtctctcttatatatgtcaagttaaacatattacgtaaaactaaaattgactaggtgtaaaggagtaagttctaagcaacattgaactccagatgcatcaccattcaccactcatgcacacgacggggcatcattttcttccgtgattgggagtacattagaatttccacttaccatgctttaaatgcacacccatatcttatgacttattatagatataagtataagacagagtggcattaatttattaatttgggaagattttcagtagtactagattcaaattttgacagcaactgaatctgaattggctaattacatgaagcaaacaaaaaaactgaattggctactgaccagtgaccattcatactatatattagtgagtttattagtaatgtttaacattctagaatgtttatttcttttttatttagtctttcatttaatattttttaattataaaaaataaaatcatttaaatttttactctttttatttcacatgaaatactaaaaacaacggtgaaaagaaaataaaaaataaatacacattttatttttacacaataaaaatatctataactgtggtagtattatttgaatgataacaaaaatattagtaacatatcctgtaaatgaatgttgtatttgatgaatatgttgtaaacattaaattcgaaaaagaaaaaaaaacttctcatttatagaaatattgagcaaaatttcaaaaattaaaaatattgaaattatttttttctaattaaataaattaaagcttaaacgtaatgaaaaaaaaaggctaagaaaaagagaaaacattattcattttttctttatgaagaataaaaaaaatttagatgttatttgatgactatctcgtgattaaatttaattttactaataaaatataacatttaattattcaaattctatgtttacaatcttacagtgattttttttcatttatatgaaaaatagatgcatattttaggttataagtcataatcatattattatgttctaaataaaaaaaatagagtattatacgattatgctttcatttcatttataaaattgcattcaatatttatatagattgaattgtctcaaatttatatggatccctttaaaaaaatgattggttgaaatattgagtagagtatttattggacaagttattaaaatatttgtatcagtctaatgttaattatcactcttgtagatgctttttcttttatgtagataaaaataaaatgtatattttgttttattatttttatcatttttactcataacatgta

SEQ ID NO: 255 - DNA, 1961 bp, Glycine max
  Soy_ogl_3462 Gm10:39910201..39912161 Cluster 1
agaagttgccggtcttgcttcctcatcctccttaggtatagtattaagatcaaatggcaatggaagcttcaccgttttggcgacatcattggaggactgcatttgttcagcaagaggttggcacccttccattttcacgaagcaattgttatgatcacaagaagcctgatatactactcatatatatatatattgaaaattacatgtgcattttaagtaaaatgcaaaaaggattcacctaatgaaagaaagatggaagagagagaataagtatacctaaagaaatgttaataacactcagataatttttttaatatattttttttggttaaaatttattaaaagtataaaattttgtgagtcttgtattatttatgcatgtatctttcttttaattttgtaatttttaattaatttcaatcaataaaaaagaatttcatcttaggttgtttataatattatacttctcgcttgtgataaataaaaagaaatattttcttcatctcaaaataagtattattttaagtttttttatacataaaaaagctaataaataaatgaaaagtgtaataattttgtaaatctagtcttattaaatatataaaagagaataatattagtattacattaaaaaatcaaagtgaaacttattagaaatattaatagaaaaaattaatcaatattacattgaaaaataaactttgtttgaatgtttatttttgtttttattttctaaaaatagttttcattttcaaaattatcatgatttagaaaaacaaatgtttattttgatttacaaagaaaatatttatcatcttgcctacccattttcactttttggcttattttttaaaatattttctaattttttaattaaacatatttttacttttattttttgttattttttaaaatgaaaatagatagcactcaaactcaagaccacctaatatttttttccaaatgtgatactcattttgagatttttttccaaatgtgatactcattttgagatttaagtagtaaatgtttagagcggagaagttttcacccattattaattacttagtaattattagtttggaagcattcacatattggataattaatttctgataaaaataataaatacatacgtgttcgatagaaatctcatcaatgtttttagtttttgtattatatttttttcaattttttaaaaaagtatgtttaaaaatattaaaataaaaaaattggtgtattatatgaattaaaaatagttttttttaaatagaatcccgaaaagagaaattatttatttttgtctctaaatttaatgaaacaactcttgatctagttgaatttattgagctgggtgcataaattatcataatccttctaatattatcttttttattcctgcaaataaaaaaattaaatgagaaagaaattaaataataaaaatatttaaatgtagaattatacgcatataaaggtaatataagtaggtaataaaatatgaatcttgcttactaatgtgctaagaatattggttaaggaattttaaaaaaaatattaaaaatcatattggaaagcatttaaaaatcataggggagcatatgtttacgcatcccaatttaaaattttctccttttccttacttttttttccgaaggccttatttttacttaaccaggacaccaattaacatttatcataaatattaataattaaattagttatctgtcaaaattaaattaattaattaatgttaaaaatatgaatggatagctggttgtggagagtcaatctctcgaggtgttgagatttatttaagaggctaaattttcaatatcaatttttttatacaccagaagattaaatacttgaccacatgtttattaagaggcatatgatttgataatcacttttggtattgagatctatttaattaaggacctcttccaatatttttttttcat

SEQ ID NO: 256 - DNA, 2000 bp, Glycine max
  Soy_ogl_6578 Gm19:44828701..44830700 Cluster 1
tccgacaaaacaacaataatagggcattggtatatttcgaataatttgtgtcattgaaatttttctttacgaacgagtaatcacaggagattttctatgacgatgttttaagaaattttaagacattctcataaaactatcacaaaactttacgactaaaaaagccaggagaaagtacaaacaaaagcagaataaactcatgaacatatctttagaattaagcggcttaaattcttccttgtaatttaatggtggtgtaattttagccttttatatttgtacaatttagtgtttttagtttattgttaatttgccatcaattttttaatagaaattattggcttaattaacatataagtcataaaatatcctaatatgacatgataaataatataacagtttaacacattattaatatcacatcacttagatgttatgttaataatttctattgaaaaattgaggataaataagaaaggatcaaaattgttaaatttaaaaactattggacgaaaattgaatttaatccaattaaaatacattcaatcggtcaacaagtttcctacaacatgctaaatcaaaatgcgccccctccaaggaaatttggtggtgtgctaaggctgattgaagggagcaattccaactaggttaacactctaaccttcaacaaccaaaatacaacactccattatattaaatccataagagaaaatcaaaatcatggagggacaaaaaaatcaaaattcatgtacaatcatttcaacctataacaagaaagatcatatttattcctataaaactctttttgaataaaaagtggaaacgaaatcccaccaaacaaaaccatttgtggaactaccatgagaggtaagtttatttgcacacacacacaaaaaaaaaaaaaaaaccctcacactaaatgtgagaaacacaaaaggacatattacaagtgctttatatagtttagctacctaattttaagtgtccaaggaattagcattgggagacttgaaggctttgagaaccagcatgaaatcacgttgaatccaaagctttgtgcaacatctcaaaatggtggtttcaatggctaacataatcataataactcatgtacattaagtaactaattgagttagactttcttgatcaaatatgtttatctgtgaggaaaagatgtaaaaaaaaattattggttggacaactcaaggccacttgtaaatagatttacacaaatttattaggagccttattagaagaattaaaatgaacatggttcattgaggtgatccaattaatctaatataaaatataaattaaactaaaaactttagttttcgaattattttggcataatctgattcgaattttttataaaaaaaatagtccatcgtgggataatttatgttgatccaatgttttctaaaacttttgacgtttgagaaattaataaattcattttttcactatgataaagggatttaattataccatatttgtaacatttactcgtgcatggcatgagctattttaccggtgctttataaatgcacatgtttgtatgataagaaaaatccatcttaagaaatttttttgttaattttatgcgaaagtaagaattttgaattgaaacgtatcatattcataaaattaaatagagttaccgctaatatgtacatcaattagcaacatttatttcaacttaatcaatagtctcacattttaaattttggataaataattgcatttaatacataaaaatacttttcttccttactatccaactcgaggaggataaatttgtaatacataaagaaaaggattttgggaaagttttagatagagaaaatttcagataagaagtgtaaattaaaagaaagttcgaataatttatttttttatgaagcttttttaatcaatgtttttatttcgagtatgtggtgaatgttttgtttaacgtatgcacacaactttttgttgaatggttttgaaatttttttcat

SEQ ID NO: 257 - DNA, 1800 bp, Glycine max
  Soy_ogl_2407 Gm07:38085701..38087500 Cluster 1
aggtgccgaaaggaaaaaatgaaaaggggaatcggattggtggaaaagatggaggtggtggagatgggaataatgggatattaggcaaagttggaggtggcggaggagatgggaaaaataggatattaggcaaagatgctgggattgtagggaatataggccaagatggcaattgtggccaaggtggcaatgtagaccaagatgtcactgttgtttgctagagatggcgtgctgctaatgccatgtccatgcttgagaaggaaattgcaatgacaaaattaagcctaaatgatgcaactctgagtgagagaggccatgcctgcttcaagtgtaacttaactttaatttcaattaggtgtacgtggatatatatcctcaagttagttaagagcaagtgtgcatattccaaacactactagttactggccttttatagacaatgactgatatatctacttttgccataagttgacctattcccttcattaaacaacatgcaattatgttatgttattggactactgtgttgttgccactggttggttactaccaacggtatcaaaactggggtaccggccaaacccttccctctcttggataattcaacagagtaatttattactttttattatgtatggtttactacgtgtttggcaatccaacattgcccgtgcagactgggaagccaccacatgcactaagtttaattcatgatgaactaactaatagttctaatgtttgatcctagttgccccaagctaccagcatttcttaaaataatttaattctagtttttgagttgctttaataactaatttctccgtattttatcaaaaacttagggtagatttgattgagtgaaagagaatggatagaaatgaaatagaaaatacatatttaaatttaagtaaagtaaaagaggtatgagactcatactaaataaataaaaaattccttaattcctcatcttcttagcaatcaaacctaccctaaaaaacctcattaattatgttctatccttaataattaaaagataagatcttataatttagcttattagcactattaagtcttcgagtaggttgtaattggatgtgcaattactagtagttcggcatgaaagtactctcttttgacaatcccaacatatgcaacttgccagatagtattatggttagatagtattaaggttgttgtcctattttatcacttttcgaaatcaaataagaagttaatgaaattgattttaaagaacgaatcaaaaattaattttaaagtaataatgctgtttgaatatttttatttttacttctagctaaaaacaagttattatagatttcaatataaaaattttcaatacgaaactaccgagagttaattactttaatgatctagactcaaaatcaattctttaacttgaaattaaatactttatatttacctaaaattatgttaattgatattttaacgtgtctcacataaattgaaacatacggtttatgtttcacgtactgttcattgttaaaaataatttaaattctacatcagttaacaatataatcatattagactttataaataagggacaatccttactccttgaattagttcttggaattaagttagacccaaattcaccttttaagattcatccaaaaattatactcattcagatttcaaattatttgcatattttcattctgctgatgttagattttgtatttcatttaatagaagtgtttagaaactgacattatttatttaacttgaaatggaaaataagatttgacaattaaatac

SEQ ID NO: 258 - DNA, 1900 bp, Glycine max
  Soy_ogl_2976 Gm09:3935901..3937800 Cluster 1
cctttaaaaatcaatatatctaatatttaatatgtttcccatggtgagagacatcatacacacttacactgtagtcttgactgtcttttattctgaattagtgtgtgtttgctttggcttcaacttaatgttgattcttgtcctttaaaagcttattattgtagcttctatgtcatttgagttatttgatgtgattttggtgttggatttaatcagaactcaaatgatgttgcaaacatgatttttgcgttggatgtagttggaaggtgttgttccaactcccaaacacgctctccgtatgtagttttgttgtttttgaatattgaagatgttgttccaaaaacacttttggtgttggatgtagtcggaagatgctattccaaacatgctcttcatatgaagttttgttgtttttaattgaagatgttctaaacacgattctggcgttagatgttgtcggaagatgctctttcaaacatgctctttgtatgtagttgttatttttgaataatggtttagtagatatgtcacgcgaatctttcatttgttatggaactcgaagcaagttccctttggccagaatttttaggtcgctagttttccccaataattgtcttggaataagtggtcatgctgaaatagttgtgttgttattcttactatgtaatgttgggtactctatgttctttgttggctcaagtgtgttataaaaaaaaaaaagaaagaaaattccgtgatacacatgatgtgtaccattccgcctgtgcatgcattaggaataaaagttgacaatgtattcaaacttgtagatttgaatgttagatgctagattttcttgatccaatattatattcctatcacaatggaacaaattcaatacctcacgtcttttcaaaattaactctgcattcctcttttgttcattctttctcattcaaaatactattgtttatattttcattttaccaccttatcttctcttttgacctgcgcgcatgtgtgtatttatatttgttattatatagctagttttctagaaagaatattttaacaagttacatgcttggatttttattttttttgaaaaagttgaagctacatcttattataaagtatttctttgaaaagatatgagtgttttgttgatgcatactctttcaaaaaatatttcagcaagttatactttaactgtatttaaagaaaattttagttataatttgttaaaatactcctttaagataagtagatgaatgtttgcaattttctattatatatctagttttctagaaagaatattttaacaagttacatacttgatgtttctttcttcttttttttttgaaaaagttgaagctacatcttattaaattatttctttgaaaaaatatgacttttttgttgatgcatactcttttaaaaaatattctttaagataagtagataaatgttagcaattttttttttgatgatttagaaaattcttttgtatacgcacctatcctcactttttattttcttttgattttcttttgatttaaggattaaatagagttactcattggatgagaactaaagagtgaagataaaaagtaactcttatgaaattttgatccctcctctctctcttgatttccttgtattatctttcatgtttatctatcattacttggatgtgataatacctagttttgttcattactggcgcattacacaacagctaggatgcaataatttttgttattttctattctaactgtagaatgcaattttagttctttgattttacttgtacagaaagaacaatttttttttttttgaaaaaagagaaaatttttgggggttctttccttgtaatttaacctcggtggggagaactcttgaacatcacgtttggtaagga

SEQ ID NO: 259 - DNA, 1600 bp, Glycine max
  Soy_ogl_199 Gm01:48458701..48460300 Cluster 1
aagtgaggtttgagagttggaggaagatggtggtgacgactaacaatggcgcgagtggtgactgatggcatcgcgactggcggtgccaacggtggtcggtggctgggtttgtggtgatccttgagaatggagaacaagaggagacaatcatggaagtaagggtttgtggaaagagctcgcgacaaatatatctctatgttgacaattagagatgatcacgttgacaattagagatggtcacgtttacaatcatttcagtgacaaattcgtccctctatgctatgtaggctatttttattaatgatgacaaacaaaaattaacgcccagatatatttgtcgtattttttacactttcgagaactaaattttatattttcatcttttagggatacatttattaacgaattatatatttaaagataaaaataattatttatcctataagataagagataacatatatgaataaagtttttaaggtcgatggtatgatgactgcgcataaaaaaaagtcccactcactaaattcatggttactacacatttaatgatcattaattatatatttaaacttagtctcgtctgagtcgatggtactctgaattcttctttagtgtttgttttgactaacatttttttattttactattacaaaggtcaaataaataatgaaggattatttctaatttatgttggctaggttgacgtacttagcttcggtgttcaaaccaactctaaatattgttagactctatttcacacattttcaatatagtaccttaatgccgtgttgaaatttcatctcttttatttgggttagaacactctttgtattcttactaatatagtattttttttctaggaatcatgaataatttcaagaatcataatttgcaggcatgaaaaaaattcagtccctaaattttaagataattgattcatcacatgatatacatttaattcttagtgattatctttatcgttctaaataaaaagtaagcttcaatgaaaggatatatcctttccttgggaataaaagctactaaattcaaacaatgctactctctcttaagctcatccatccgctattgatgtttctttgcattaccaaaaaaaaaaaattgatgtttttttcttttttatagaagcaattgtgattcttactttcttaaataatttttttcagaaaatataaaaaatatattttagacatttttaaggtattctgtattttaaatgttttaaaatcattacaatggaaaaattctatattaaaaatattcttaaacgaacaacaataattactaaagtatatatttttaatttaaataagtaagcagtaattaaataaaaattaataataaagaaaaaaagacctacttaatacaatttataaaggagagtttattagtataacatcaatttagatgcgactaatgcattttattttattatttaaaaaacttaaataaataatgaaggattatttttgtgtcctcccaatcggattcctagtcaattgatctagtatctgaccattttaattaagtctcttttgctatttgatttaaggtcggaggatgtgtcatattcttagtc

SEQ ID NO: 260 - DNA, 1771 bp, Glycine max
  Soy_ogl_4663 Gm14:4964530..4966300 Cluster 1
atgaatcctatgtcatgagtttaaagaaagcttaacaattctttcagttatgtcatcttttttttttgttatatatattgtttcttttcatttttcaaaagctaaaaacttaataaaggtaaggcaatgagcataaacttgctcggtttcattttttttttcctttttacaaattcattttataatctggataaaattagttgtttacacaaacgacttgagcaagtcaattttgttgtttttttggataagcaagttaaacaagtcaaatttaagtattatatttttaacgaaataaagtttgaacgttaaatttggcttatttaaacaaaaaatatagattcaaatattactttttaaattacatttaaattttgaacgattagctttatttaactgctttaaaccatagatgagaaggttggactaaaccaactaatgatcaactcgaaaactagttgtctagttagattatcaattcagataaatattcctaaaaaaaaatcaattcagacaataaaaaaattgatgcggcggaaaattagtcaggaatcgtttaaaatagtttaattactattatttatgcgtattaaaagaacggagtagattaatgtagaaagagcactgctaaacgttacgaaattttaaagtacgaaatgcacgaatcatttaaaaattggtgacctgtaattattttataaaataaaaaattagcacgttaaaacaaaaataaataaagcttaaatgaataattggtttacaatcaaattccgttgatcctggagttattccaccaaaatcgaaacaaattaaacaaaatccaaataataattactcccgcaaattctaaccacggaagtgctactacgtattactcatcagcaattgagagctactactattgcttattagttgtacaagaaggcttcggtttcacgaagcactgaacagaattcgatttggataccatcgttcattgaaaatgagattttttaagttaaggcaataaaagaagacttaaatgggttatgtttggaattaaaattgcataaaaaaaaagtacacatcattctagtgtttagtacgaattttcattcgtaataaacaacattttgcatgtagaaatacattaaaaaaaagggattaattaatgtagaaattcactgaataattgataaaaaaaaatggataaggagtacttttaattttgaaactaaaggcatttttgtggttttctaaaacaagattgtagtatgaaaatatgaattattatcatttcctttctactgggagcggagggggctgttctgtttgcttggtgatactgtctgttacttggggcatttatttgagttcgaagttcgatgcttccatgcagtttattcttgtctattttgcagttttatatatgcagggagttatggtgttacaggtgtatatgttggttctgttttttggtgggtttgggagtgatcgtgatgcaagattggcttacataattaatttggtgggtttgggagtgatcgtgatgcaagattggcttacataattaatttggtgggtgtgatttcacagttgatgtggctcgggttattattttgtgacaataattcagacagaacaagcagaagccgtttttatttggtctatgtggcatgccctcggcttgttgtgaggactttgacaaatgcataaagttatgagatggaataatcatacttttagtactgataaaataggaaaaataataagtaaggaaagttctttcttg

SEQ ID NO: 261 - DNA, 1746 bp, Glycine max
  Soy_ogl_1050 Gm03:42725455..42727200 Cluster 1
cactagtgagttccttttgtttctgagatccaaggggaatttaaactaataccatttgatggttattcaaattatgggaaatatcttgttattgtcgatcttatcttagtatctgtcaaatttttataatacttaaataactttgaaatttcttaaattattggaaaaatattcttaacgtaaaacttatacaagattccttttaaaacttattaaggcattttatttacaaaatgaatataaaatgagtccctgtattttaaaaaatatatattttttacttcctacacatcattttatttcatgttcgacctcactctaagaactaaaaggagttgaaatgattagtatcttctctcttacctctactatttcgaggtttatcagtttgattttatttttttaaaattgctctttgttgattgttattttttcagcatttcctactatgtttaacaaaataatggtaaaaagatgaaaactaaacacatgttacgttagttaaccttcttagtgtgtagtgaggcgcacttgagttctttcagagggaaatttgtagctgactggttgatgaagttctttcatagacttagtcatcctttagttattttctatccccaccgttgaagtgaatgcctcttgtttgagacatcattgtaaataactatagaatataaacaagtattttatgtaataattaaagaattaaaataaattttacataacgtaaaaatacttttatactttttccgtaattctcagtaaattcttgattttatttattaatttataattgaattttaaagaatactaatataacattttaaaaaaaatgtttcaatttaatatgttaatttatttcccctactaatcatttaatcggaaatttaaattcaacctaggcgacttcaattattgccactagttataaatgaaaaacaatttaataaaatataaatgattaatttgacaaatatagaataaaattactttaaaataagcaaacactggactaatctttttttacgcacttaattcttacaagttaggagtcttcgattatactattttttagatttttaaaatgaagataatttcaacaaattaaaacattaaaaaataacattttaattttatgacaacaactccaccgatatttttgtaataaatcttaagaaataatatttttttaaaatcttccacaaaaacacaacaattaacgggtaattaatcaagaaaatagcaaacggtttctgtaaaaaaaaaaaatgatattaaaaaaaaattatgtaacatgtcccccccaccccacaacaaaaaataaagtatacaattttctacccattcgaaacatctatttttagggacaaaaattacttttccatgctaacacatattaaacatttgctattatttgataaaatactaatctaaagacagtcaaaacaaccggagacgagcaatcatggtagaaaaaatgagctgtaaaggtacttcaagttctgattttcacaacgataagtccaagtgaggaagccgtggttaattaactctaagaaatcagaaacatgacgctacttaggagtataggcaagtcagatatatgaatggatatgactcaaaattttgaattcagaaaggatttttcctttcatacatctaattgaatcatcattgcattctgttttcttattgaatgcgatgaaaagataaaaataaaaacaaaataataaacccagctaaaac

SEQ ID NO: 262 - DNA, 1653 bp, Glycine max
  Soy_ogl_1755 Gm06:940901..942553 Cluster 1
aataaagtcttaaatatcattttaatcggttttaaaattttatcttggatcaaatgattatttcattgtcacaaaaagagaaagacaaatattttatttcccaagataatgaaatgtaattaataatatatattcaacattaattataaaatcacacaccctccatccaataataagtatcatcctattttttttatacaaataaaaagttaataaatatatgaaaagtaaaacaattttataaaattaatcttatatataactttcttttctagacacaatagagcacagcaacattctaaaaatattactgagtataaaaggaaaaataataatatttaaatttattaattagataattattttgagatttatttttttcataatacgattcatattatgggatgaagagagtgctaaaaaataataatgagtgaaaaaatttgttttatgtttaaataaattaaaatgtaacatatatgtatcatcaagagaagatcctattttaaaatgaaaaagaaaaataatttaaatatctttgaaaaaatacaaaatttaatttcataaatatataaattaatagtaaatatataaaataaatcgtcaataattgaaaataatgccagaaaaaatgaaaatgatttatattataccagtagattaggagaaaagagacatttcatgcctactgtctctccatctttaaataaataaaaaaatatataaggaaagttacataaaagtgagtgatatgtgaaagtagttataaaagtaaaatattaacaaaaatggatatagttatgggaataaagcgtgtatatcaaaattttctattctctttaaagattaaattctaacaacatttcaagaaaagagtgtatatatagcaaatttagtttcctcaattatacttattacatgaagcaaacatttaaaaatatataattggtccgtattgtgaaaaaaggtcccaccgagatttgaactcgggttactggattcagagtccaatgtcctgaccactagaccatgggaccttgttgattgatgtatctataattaagttatatattatatataaattagtctccatttcataatttgttataagtaaatcgtagaggaaaaaaagacacttcttttgacattacagtgatttaaaggcgaagaacttgcatgcgagggatagccatcaacaaaagggttgccattcatgcatggggcttcatttcagaaattaggtcgggtactgcatctcatgcgaattattttgacaatttgtggtaggttcattacgtgcctaaatagaattagaaggtcctccaatcttttgcaatgcttaattgccacagactccagattccatgtgtaataaatcttaagacgagatagcattggacattgaaaaagccaataacaatatggtgactcaaaaaatttatgtgctatctaaattttatttataaatctataataattgcaatattaataattatatttttaatttcaaatgttaaaaatcacttatgtatttaaagtttaagtatataattaatattttacaacaaaaaaattgtttgtacaatgcattataaatgggtgtaaaagactatagttatatatcattaaataaaatctccaaattagtctcaa

SEQ ID NO: 263 - DNA, 2301 bp, Glycine max
  Soy_ogl_1756 Gm06:1245801..11001 Cluster 1
tcaaatatctggaaaatagcataataaaaagggattttgcagttaggttgatgtatcatcttataaggggcagaaggtaatacgatcctagttagatttcatattttaattttttttttgttattattaattttataaacaattgtatgttaatattgcatttcaaattcttgtttttataacatcgctcattatgcttgattgaataacacttttttataggttaactatttcattgattaattgtcttttataatataaaatatgtttttgtatttttcgaaataattatttgtgtcttttaccttcttgtattgctacgaataaaaatgaccaggaccagtgattctttttgtgtgcgggcttcttgtgcaatttttccgtaagttttgagattttcttttgaattttctccataaattttctacaatttgtgttataactttggaaaaagtatttttgtttctttatatttattaagaaattcatagaaaaaataattattttatgtattctcatacaaaatttgctttgtaagaaaaaattgtttttattacaattttttcaccaaaattatatatagattttttttattcagtagcaaacaaaggtataaaaagcctaaaaaaaacttgaagggttgtaaatatcatagataaaagattttcgtaccataaaagacaattggttaaaaatagctaatatttgaattaatatgaatatatgattaaattcttaaacttatctgcaataaaggcactataaaaatattttaatttatataatataaccatagtaattttggcactctaacatttttcgtgaagctccatcactgtttgtataccaatggtacaagaattagaaaacatggaagtaagaaaataacaacaatagatgaaaaaagacatcacattctacaaagaatgatatttccagcaaaaattcaccccaatggcatgaaaatcttatataaaatcaagaatgtttaatctaagaatccacaagaagcataactcttaaactcacaaaagagtgaaattcttatcttattcatatatgctcaaatgcaagggagtgcaatgttattcattgatgttattcattggcaactaatgcctccattttaataaggttaatggctaaatcaaatttttaaaaataaaagcaaaggctagcaactaaaaacccaaattacatcttaaactttaaatgtagactaatctaatgttagaaattgaatttagtgtcaaagaaatactttattacaatttaaacaaatttaaaatacttgaataaaatcgaaaaataatattgctagctcataactgacacattattattccaattggatcaagtgctccttgagcttttctttctcactttaagtttgaatatgtaggtgttgatttttgttcaagtgacatctcatttgcattcttagcctttgtccttattattgggcctccaagcctaatcagattcttcctcttacaaactcttcatttttcttttgaagactttcatttgatctctattagaaggtgtaataaaataggttttataaaagttagaattaaaaataaaaccaaaaagtggtaatcataatcaactcctcatccaaattcattcagtaaaaagatagaaatttcaatcctcaaaactgcaaagaaaaagtaatcaaagaagtgataggagaaatcgtgaaaaaagaaagagacattataaaagtgaaaaaagtcacgatagatgatataggaaacacttcttcacaaaatttcaaacaagcttgttcaagcctcgtaaatttaaaagaaaaaatttaacctagactccaatttattaaattaaaaatatattttaaattcttaaaagaggaggaataatataatacggcatttctataaaaatgtaattattatacaatttaacaggtagtaaattctatacctaagagtttactttaattgcactatttttttttctgatgagtttatttgcactaaattaaattaaccatgtcataaaaaaaaattagacaattacacttgaaaacaatttcaaacaatacatcaatttatttaaaaatatttgttaaaataaacacttgttttaataaaaataagcaatttttacttttaatatgtatgtctatcttgcttttactttaaaaaatataaatctgtttattttaaaaaacatatcctatctatttcttaaaaaatcacttatatcaaacatattttaaagttattttttaaaaatttaaacaaacccaatactctaaaaaaattcactttc

SEQ ID NO: 264 - DNA, 2039 bp, Glycine max
  Soy_ogl_2941 Gm09:1957401..1959439 Cluster 1
taaaaaaatgtaatccaaaatactccaacttcatcttcctatttaattttatagaaatgttgaataaaaagtaaatacattaatttataacatgtttggtttaaggaaggaagtgaacaaaaatgaaaagtgtgataatatgttagatacttggattgtttggtgtgtgagcaactaataggaaagtaaacaaatatgtatataaaataatataaatctctttaaaaaatgaaatgtaacatagataagactacttgtgtttttttttttaatctaaaataaccttcttacttgattaacttttcaattttgaaggaagtcatctctggatatgactctcatcacatgtttattttcttttctttctttgttaaggtcctttcaaacaatgaaaataatcattttttttatagtttgcattccttcctactaattaaggatgtttgaattaaagtttgaaaacttttagatcttctcaccgaaaatccaaaacatattctaaatcttttattctccttttcacttaaacaaaaagaccattaatgtcaggaaagatttgtaggagggtttagattattctaaaaactactagtaacacattattttgaatatacttcggtagtgactgatatttaatttattaaaattaattatttttataaatttcacttctttattaaaggtgttagtggatgggttgtgataaattgatctatttaaatattcttgaaatttgtaaatttgatacagtcaattttatgaactcaaaatgacttgatcaagaccaaacaacatttaagacaatacttaattaacctgacttgttgacaagatatattaatcttaacatcatatataactaaatcatagaattaaagatttatgcaatcacaattaagttatactacataatttacaatataagataaattatattgatataatataatattagacaaaacattatttattaaattaataaattatattatcaatccataattaaagaattatgcttctttaaaagaatatataatattagttcaggttgagatgactcaaagtatagcatgaagttatcctcaaaatataagatattgtttcttaaacacaaacctataaaaagttccttaatcgggttagattggtgagacaaggccatgagcatccccacttcctacctagtaaatctcttataatttaataaattttaattaatagtaataaacaatataaaaaaatattagatactatgttgataaaatccttctttccttgaagtttttgtaactataaattacataaattatattaataattatatttcatttttctttgatttaaaatgattattttttttgtgtgaaccaaggcattgggtgaaaatcaatgattatttctttaatgtattgaaatctgtttaaagaattgatatattttaatatatgtttttttccatacacacaaattataaatcatactcataaccacatgattaagaaacaattgattagttttttttttactttgtgacttcttgcacttttttttttataaaaaaacaacacatttttttcttatttttaaatgaaagtcaaacacaatttttttaaaaataaaagtaacaaaaaaagatatcaatgtactgtgtaaaaaaaaaactaagtgtagcatcactaaattcataaaagttaaacattttttattatatatagatgaaaatacggtgtcatgtatgcacgtggtatgagtcggtcctgataataataggttgatatcatatcacatgtgttaggtacaacatgggacacaacaatttgtattgacatagaatatcttctttagtgtataaagatgaaaatattttaaatactatcatttggaccttattgtctaacccatattaggcacgacttgacttatatctaaatttttttaataacatatgtcaagtttgtttgtaaagaaaaaacttattaaaaaagctaagttttagatctggtaaaaagattattaggaaccgtttgaatgattgtgag

SEQ ID NO: 265 - DNA, 1900 bp, Glycine max
  Soy_ogl_3140 Gm09:36817601..36819500 Cluster 1
ataaataagagtgtatttattatttaatcaaatttaaagtgcatcgtgattattaatattttaatgacaaatacatttttgttaactgatattgacgagtatatatatataagataggatctaggtataagtctaaatccatatcgttaatatagattaatcttatggtttataatatcttaataaaagtcaatgtaccttgaataaaaggtaaatatatgtgaacggttaaagcctgcggagtcaaaacgaaattagatttgtatgcccccttacgttttgtttagaaaattagcaaggaaggttgaaaattagacaaacatgcacgaaaaagaaggatagatggagatgtattctccttttatttgaataattaataagggaaagaaagaatatggtaaagatatatactaactctattatccaaaaccatttattcaaaagcttctgaaagcaaatttggattatttaatcaacttgttttaagagtaactaacatgaatgagacttttattaaaaataaaaaataaaaaaacactcttttttaattgcttttactccaccttttaaagtggaaaagaggaattttttttttcccctccttttttttacaatagaatgaggcaagtgtagtgcaaaaaacgggattgtcaaataattgatgcttaattatttttagaagaatattaattattttcccctccttcatttttaaatacactttgttgataaattatggggcataaaataagtttcttgcaatttcaaataagtcaggcatgcaataagctctgagtttgtacaccacataaaggacacaggtccgaatgagaaataagggatttgctattgggccttacactattgctattggctcctacaacgtggatgctttttctcattttccaaaaaatacaacgtgggtggtttttctcattttccaaaaaactacccctataggccttcctcatgaaagtatgatttttttttatagtgtaaaatggaaacaaactattattgtaatgtttgaggtgaaaaaaaaatactataaaacggaagtataattttactatatattgcacaacagaatcatatttttcttatatatttgtgttgaattttgaagttttgaatcctacaattttgaaaggacataatttttgaatcatatgatcaattttaacatataatatgtttatttcatataattttttgagaggaatgcctggcaagtaccttgaaggggacttgttcaaacatttttacaagaaaacctttccttctatcaaatttttgactttaaatgaattttttatatctagtgccaaaagaaggatttatatcaaacataacaatgaaaacataattttgttatgtgtcaaaatctagacgacaaccgaattataattatgttacgtgttacaattcaaacaaccaaattgcaattttattatttacgaaaatccaaaaaataattgaaccaccatttcattgtgtcaaaatagtgtgatgaaagggggtgaaaattgtttctttctaatttgagaatagcagtaaagcaacttggcaagtcaatgtaagatcataaaaaaaatccatctcctttctatccaaaataaagtaacaacaaacagcttaatttacaaaacttttaagagctctgaatctttaataagcaaacttaccacaaaaggcattgaaaaagtttctgactttgccatgtaggctgtagcagtggtagactgaacaggaggaaaattattagggagaaggaagaattcagatgataaatattgcatagccttagaaaaagaagcaattaagtatgcaacaatcaactttaacatccaggacaactcagatgataaaaacaaaatatgtttatacttttaaatcttgg

SEQ ID NO: 266 - DNA, 2045 bp, Glycine max
  Soy_ogl_4673 Gm14:5354501..5356545 Cluster 1
tccaattctatgtatgccaaagtgcccaacgaggaataggaatgtggtttattcatgttcttagcttaccttaagctttttgtttcatttcaaccttatcctcacaatggttcgttcacacaaaatcatcactataggtgatatgaaactaaaattacttcgttaaaccaccgaaaactaagagataaatgttaatattgttaaataaagttcaattcaagacatgaaaaatgacaatattctcatagaaaaaagagtaaaatataagttttgatctgaagtggatgagatagttgacttgaccgaagtacaatgaacttgtctaatttgtctgatctcttcaatcagagctgatatattcttgtacaattgtagagctcaagtgaacagggtgaaacaactacaaagatattttttgatgctcaagtcactaaaaatctcaaacaaagatcaaagataataaatgcctacttgtaacattgtcattagtagaatttgtaagagcaaatgtgggctggatttctatatttaaggcccatatatcatatatggtcggtaaagagaaattacacactatttaggatattattcgactaaagtcaacatttcaaagaatgcagcttcaatatccaaattagctcctgagcctcatccgtaattaatcgagattttagggggaaaaatcatcgttcatcattcaaattaagttgcagctctgagagtagctccattttcgtttaaacagaattcccacaaaacaatatcatactattattcaggaagatcaaagtcacgttctctaaaatgtgccttgtcatgtctagaaagtggagtggaccaatgggataaattataaactgcatgtccaaaagtttgattggttgaattgttgaacctcgaaagtggggattgactaatgaaattcatggctttagaaatatctatgatgagaattgaggacattttaggtggcaatctacttatcaaatcatgtctgattttgttatctgctcacccctcatggtgcctcaagcgttcttttgccccatatctaatataacataaatttcaaagctagtggttgagtctcacaggcaccatttgaggatgtcatgccatgcgtgatgcatcccttgttgctgtatcaacaaagcttgagaaacaaaacctaatttccaaactaggtaagctaatagcgcttaagaaaacattagttgttaactcgttatatatttatttaaggtcaaattcaagttttctactagaaataataataaaagaaaaagattacacagtatcaatgtaaaattttttatataattattcaatcataatttactatatataataaatttatttatttttaaaataatttaaacaaaaaattataattaaattataatataaaaatatttttcattatccgtgcgcattaaactctaataataataaacaaatatatcaaaacagaaaacgtattcctagatgtaactagtccatgaccaaaagcacattaaatccgagcaaatctagtccagctaagtgatggtgacactaaaaaaaggagatgaatgctacgtgtctacctttggttaacttcgagaatggatcccacatgtttatttattattagtgctacaaaacaggaaccgaatccaatataaatattatattcgtttatttatttatttttcttttaattcttttaacaaaattacgtggtattttgttttaggatttattcataagtaacagtttgacgtttttttgaaacgtgcctgagcaaactacaaagttaacattcaaccaatttctgagtagaaataatataataaggttccataaatttgtttttcaattgacattaatttcaatattatttccttcccttattagtttgtttgcttgcttgactcgtgatcgtgtacaaaaaaaaaaaccttgtaggcattaattattgagttgtaacatttatccatccacgacagcttcgtcttcaataatacaacgccttttattgaaaaaaatgaattattattatttga

SEQ ID NO: 267 - DNA, 1600 bp, Glycine max
  Soy_ogl_5306 Gm16:5011401..5013000 Cluster 1
atagcaaaaaatgaaggccattttttgacgttacaattccaatgcaagaaaacatgttaatctgcacaaattcatcattgatgaccatgagtctatgacagtggacgttagggtgtcatcatagctgtttaatcgtttgctatgaacaaggaacttgagaattaaattgcctcttgcctttggtttgtgtttcatacagctcagccaaaggagatataaggttgggaagagaagaagaaatggggttgcttgtttaaatttctttcattaatatattttataaaactaacaaaactaatatgtcagataaaaaaaatacgaccaaaaattttaatgatcacttttgagctttgactatttcacttggtagttttatatataatgtgtcattttatttttaaaaaggtttaaattataattttatgaaatttttctaaaataattttcctaaaaattatgtttttatgtccaaaaattaagttaaaccaacttaacgtttgagtgaaaggatagaatatttttttaaaaaaggaaaaaaaatattaaaaatgtatctttttattaaatcaaagagaaaataaagaaaaaaaggaaaatgaattttaaaattttattttcttctgtttttaaatgtaaatttcagtttattttctttcctcctattctttcctattaaataagcaaaaagttatgatctgttttaacgataaaaaaaattataattagaagataaatattttttttttggttattaacgtattaaaattaaattcttaaaaaccatttctattaaaaccaatttttttttatctaattttaaaataaagtggccatgcatcttaaaatctcttctcatgttaactaccaaaaaaatctcttctcatacctatatgcgttgccttgaaggaactaatctttcaatattcattgtcggctaaatgcttaaacaacagaaacataaatgaaatttcattgtcattggcagagaaataggaatcattgaggtagaagttagctaaacgatggtgatctaacttaactaaaaaagtagagggttgagagaaccatcactttggtctccatctcataatctttcttagatacgcatgagagagatagacactgaaagtcctcattcactgcatcacatccttcaactttatctttagaattggataaaatttggttctaacttctagctaccaactaaggagttcaagtattttttcttattgtatgtaattttctttggcccaataaaattttgtacccaaatttagaaagaaatcaaacataatttcttttattaaataaattatttcttatacatgaaaacagtcacattttatatcattgcgtcaatcttggatttgacaagtttaagtataaaatacataaacaaaaatatatttgtttttaacattaaaaagttaattatataatttgtgtttatgtaaataaaaataactaattctttgcttgtttaaaggaggttgttcttgaccaacaaattttgtttttctaaattagaaatatgttgtatgagaaacagttttatttgagtttgtaacaaccacatataatatgataagactatttt

SEQ ID NO: 268 - DNA, 1700 bp, Glycine max
  Soy_ogl_5865 Gm18:1359101..1360800 Cluster 1
gcaagtctaattttttttccctttttgtcccactttaccattcctaaatgcagtctacgccattcaacaatgtattttgtttagagattatataatgtatgttttattggaattgaaacaatcatactcgaaccacttagaattattatgaacgataaaaaataattcttttaaatatttaacataattacatctttaaaacttaaacttgaaacacaggataaattaaagtaatctctttattaattgatctacatgttctataaatcataaatgtagactgaaattatgtatgccaacaattttcaataaaaaatataaaatctaagactcatatgcacaatagctctaaattattttaattatgattaatttcaaagaaaatacaatatgaccctagatgttttttatttagagtttaatggttatgaatggttagtacaacaaattttttagagtcaatcaatcaacagaaatttagtgatatgatttttaatataattattataaaagttaataaatttattttttatgataatttatgattggataataatgtaaaattggtttatattatcgggtcataattcttttatcaaaaattatttttttattttattttataacattaaatatttaaaatttagaataattattttaaataatttgaagtttaatgcatatttaatttattgttgaggaagttgttttttaaaactcttattgaggaagttatgagttataatttgagtaaaagtttatccattataatttttaggtgaaatcgtacttgatctttttatgtgtttgtgagtcagtcaaatgaaatgaaaaaataaaaaaaacaaaaagtacgtataaattagcaaaaggtccaaataacagggaccacttgttgaagattaacatcaacatgcacgatttacatgaagccagtgtcaattttaatttgattcctatattaataaagtttacggctgaagaaggccactcgattgtgcaatgatgcctctttcttaatcttaaccatccaatagacgtaaaccacggaaccattatctagtcataggatagccattacattacattatgcgccaatttttgtcctttagatatatcacatgattctgacacttttaggtcacatgcacacctaagcatacaagttacaacccattgtccttattcggcattcaagtacgatcacatggttttgcaatgttttttattccttgggagagaaataaaatgaataaaaataaaaaaagatacatgcgtgtcagaaataaaataaattttaagaatatttaattagaggaaaattaaaaaaaattagcaatcaattgttttttttttattgaaatttgattatttttttcttgaatatatttttaatccttgtaaaattaataagtttaaactttagtccatataaattcttttcttgattttttattcctcaaaaatttaaaattttgtttttatcccttctattatgcgatattcatttattgcttatgtgtaaagtgatcatgccatataacatctcttagtgtctatagtataatgtcaacataaaatattttttttaaaaaaaagttagatctctaaaataaatattatttatctaccataaaattaactttagagataaaaataatgattttaaattttggaatgattaaaataaaaaataaaat

SEQ ID NO: 269 - DNA, 1500 bp, Glycine max
  Soy_ogl_38 Gm01:1881101..1882600 Cluster 1
aaaaatgtaacattttcttagcattggcaatggtaagtaagggaacatcacaaattttcagctgcttctattgatcaggtttgattttttcttcttcaattgacaaggaaatgaggctaggattttagagcttgattttaaaagattgatgaagcaacctaacaagttttcttattgtccttttgcactgttgttcttcagttcagcaacaatgcaacatcatcgtgttgtcatttgaaacatggacaaaaaatgggcatgttattggggactataattagaagtgacttgaaaggcagatacaaccatttcaaacttatgggccattgttccataaaatgagaaggtaaaagtcacggttaatagataagctgtctgaatccagctgtggctttaatgttagacaaattatatgtcaaatttaattaatatttcaatcataaagtgacatggatgttaacaccatatattaattagcatgagattattccagttcagctagatcagtctttttgaatccgaattccgagtatatacttataagattgtctccgtgaataattgacaactatgttaaatttttttatttttataacaattactttaatgattatgttgaaaatatttttaataattaataatataaaaaaatttatacgacagtgcatgaaacttaaagtcaattatacattaaaaaaatgaaaagaggaggtatacagcaaatggagtgaacacggaagattgaaaagagtgacaatacatttttatagattattgccttattataacatataagtttatccaaacggagagatatttgataaatgacaatatttttttcattatttaaagtatttgtgttaataattaacatattttcatcttcatcaccaatattgtctcgcatatttccacaagcacatttcttttttcatttccttcctcaatcgtgacaacattaatttttttactaaagtatttgatttctaaaaaactgataaaaagtccacaattaactaaaacctaaagctataattacctaaaatatctttttggttacaaagtaaaaatatttatataattaattcaatcatataaaaatattctttatatcattttccatatttcaactactttaataattaattttattaagtacttctaatttaataatctaactaaaaattaatattttaaatttcagttagcatttgttttctctccaacgagccctgctgagaacaaccccatcacctaggatcttaacaagatcaccccagcacttttccacgtgaaattaacttgttagtggaattttcccttttcagggggtttgggtggtggggaggttgtgatttgcattatatgatacttggaatttaagtttttatcagtgtcacctagcataggccactataatattctttgcatagtttatatgaggattttgttgttaaaaatactgtttctcacattcacacagtatctatctctttccat

SEQ ID NO: 270 - DNA, 1700 bp, Glycine max
  Soy_ogl_5315 Gm16:5324201..5325900 Cluster 1
aattaatattttgtaactttttctaagttacatgacaacttttttgtctatccctcaaaatactcacaaacaaaaaaagttcccattttctttcccaattcccactctctcgctccccacgtctctctctccattatcttttttttttttttttctcttttcaagatcgaatgggtattccaaaaaattgaattgttttaattttgttttactgcgtgcatttctttccaaatgatagttattgattttcttcaaaccaatttgtttttttttaagaatacaaaggagaaaacaaaacaattaaaagcaaagtaacactaatttagcctaggaaattatactcctgcaacactgacaaagaggagcaaggactttgcaaatatttgcaaggtgtcctccatagcctcacctatcttgaccgtcaaatctacacagtggtttctttgcgcaatgattatatataaaaattttaataattattattttaatattatataggatactatagtaattttgatattattgtatttgtgttgtgtactgttcatcaaaaaaatgcacataacaaaaagttgttttaaactttaaacatttttcatgtcttggtttctttgttttgtactcttttttttgaatccgagtattttttatcgagagtcaatgattaatctcttaagatacggagatccaagaaatttatctctcccaaaatatataccatgcttacaagggataatgttttccgtgaattatgtcccaccatgttcattttttattttgtacattgatgtgtttcaaacacgctcataatatatcaatcttaatattatataaaattaataataaaattaaagaattgtaaaattaaaacaatttagttaaccttaaagtccttataaatttttttaaatctttttgttctatactaaatttttcgtttcattcttgtcatatgataatctttttgcatgtgatctatgccctcagtttgtaagtgttaaatgatattactaatggaggtccaactcaatgttgccttgtctaatgactcataatgtttttccaagtaaacaaataggggtagaaactaaactcaaataaattatagggagaaaaaagggaaaataaacattccaaggaaaaaaaatagagaaaaaatatacgaggattaacttattttaacagatgagatttagtgtaagtgttaagacttacatctggtgtaaatagatcctataatgcaaaaaaaaatattttcttacaaattttaagattaatacttttttttcaaaattaaagaaagatagaatcatgagtgcaatgttaaacaatggaaattgaaacttttggataaagacaaaccataggggaagataatttgtattaaaaaaaggataatgcagtctttttatatattattagatttaactacgaagcgctacaagtttaaagaataatgttaggagaaaatcttcacctcattagaggcaatctactcccaagaaccccttcccaacttcacttgataatagaaggcttgaaaatattaaggatttcgtgacaaaatcaattaaatacattaacctagaagaagaaatcaaagcaggataggaacaaaatatcacaaagtgatgaagcatgggatctagaacaaaatttgttgataacattcaagcacaaatcacgggattcacccatag

SEQ ID NO: 271 - DNA, 2000 bp, Glycine max
  Soy_ogl_5590 Gm17:8603001..8605000 Cluster 1
ctgatttatattcgtccgcattacggaaaaaatgaatctacctatcaacgtacatgcaataatattgttctgcacgtaattagaggtgtattgaatttgtcagagatacacgagtgttgtacacattaatatgtgcttatataaatgttgagtttagaattatttttttgtttgaaagagaggttagaattatttgtaaattgtaacagtttgatgtgaactacagaggaaaaaatgttttgtggacactaaaaaatatatatcttgtcagaaaaacacacaccaagagaataaataaataatgtaaatgagtaatatgacttagtaagaaaaaaataacatcgaatatcaattaacttgattttagtatgtttatatagtttcacatttaaaaagttaaatttaaaaaattgagtctagaagttgaaacagtttaggtatattttgagtttaataaaagatttaatactaaaagcatctcccacgctcattacttaataggtaatttatttttagacattatggtttgatatttttacctttaaattaatgtaatctaataagtgtcgggttacttaaaattaagtttttgttgtttatatttgtaataattgtttatgagtaaaaaatatttttttgtcatttaaggatcattcaagggatataatttatcaattgcttaaaattatatcactgaaataaaatatatatgaatgcttaattattacgtagtattgtaagaaccaattaatataagataaataatttaaaatagattgcttaaattacactccccggaagatgttctaaattttattgttaatttgcttttaaaataaagcatctaaatattacatcatttttaaaattaattttaatcaaaactaatttaatttaaaatcaattttttgcctatttgatttggtgtccgtttggacacgcataaggagatagagaagcaagtatttcttgttagcttctgattcattacaaaactttatcttagattcgttaaaaaaaacttaaaaaggtaaaccccaaacacaaattcaaaacacgcactttacaaactaactaaataaatagagaaatgaattaacaatttatttagcctaaaatgtataacagactcttgaaaaccaatgtgtctttaatgtcagaaatcaatttgtcacgttatgcacatatttatgattaaattaattgaaacacatactttaactacatacaacgattaaaatatagtcttattaaaattaaaatcaattctatcttgagtttaaaataaacaggtcattgtgaaattccagagtacaccaaaataaaattgtggaattccagaatatatgtagccatgaccacggatgagtggtgtttgcctctgtgccgcacaaaacggacttcactctatttcggggactgttgttttggtgaaagtgaacatggagcacacacttcatcaaatgcatgattgaaatctctctctcaatattgacaattgaagatgagaaagaaactagtattgccaattggttagggaccttgtggaacgcatagcaactattaccacaacttaggttaaggtatttgggaacctgactttaagaacttcattgcatatatgttttccaatttgtgaaacgcacagtaacttttataacatcttaggttatacagtattttccaaacatgtattttcatacaagttttccacctttattcttttgtgtgaaaagtgatagaaagtagaaaaacgtcaactcctatagtactattggacaattcaatagaaagattcaaacttacacctatgaaaaaaaaaagagaattgatatcaaaattttaattacttatatcaatttacattgactattctcactctttttaggatgaataatacatagacgtcttaatatatcaaataccttattattaataataataatttatcttatttattaataatatataggattttcttctcttatcaatctttcaat

SEQ ID NO: 272 - DNA, 1200 bp, Glycine max
  Soy_ogl_1261 Gm04:6620001..6621200 Cluster 1
ataaatttattttcatattagagttataaatagttgaagaaatctattttcatgttagcttaataatcctcagtggtttttctttatgatttttttttaaatgaaagataattttttacactcaccaactcaccactgaggtgaaataggtaagaagagaaaggattttagttctcttaacgtgaacaaatgtataaattaagaaagtaaataacggaaattacattttgatagaaaatatatgcatgaaatcacatataagttaaaggtatcgtaattatttttttatttttattttcaatcaataaaatacaaataccgcttttcatactttgtgtgaaatcttgtagtaattagcaaccatgaaatgaaaatatatttattattaattaatttgaattaaattatttcctaatcttaagtaactttaaatcaatagaaatatacttctactttctcattttctaaaggccaaatctgaaaagaaaaagaaaaagaaaagaacatgagaaatgtgatggatggggtcgtgaaaaaagaagaatgatatacaaaatgtaagaaaaataatcaaaaaaattaaaattcttaaaaaaattatcaacaaaggttagttgctagttttttatttataattttaaaaaaatgattcataaggaggtattagactagtaaaatggttgttataaattcattttttaataatataagcaatacattctttgagggggtatttgtatatcttgaattatcatgtttatcttaattttcataagctgaaaagattttttgagtaactttaacttttatttttttaactaacaactattaatcattttcttaagtgaataactattaatctattaatttcatcatcaatccgttaacgatttgatattttaataatttcataatttattatacatatacatttttaaaaatataatttttcacttttgtacgttaaacttgcgtattaagaccaaaaaacttgcgtatacttttttttttcagcgtaatgtatcaacaaaaactgtagcaccctcaagaaaaaaaattgtagcacggtaaaaattgccttttttttatttgatcctaaactccaggtgagattagtcaccaaaataaaaatcagctataggtgatcgattcttgagttaacaacctcgaagtcaaatgctgacttcacgaatctaattc

SEQ ID NO: 273 - DNA, 1571 bp, Glycine max
  Soy_ogl_1920 Gm06:13517393..13518963 Cluster 1
ttacaatattattagattttgtcttcctttttttaaacgatcaacaacctaaaaatcttcataaaattaaattttatgagtgataataacatactagtatttttcaacacatttcttctaattatttttttcctccatttcttttattttacaagtttttgagaaaataaacaaactggagatgatacaattttatgaaaaatagtactagtatttttttttttttaacttagtaatagaagaaatagagaaaaaataaatgaagagtatatatatccatacaagcaagcacgcaattcaacactaaattttttttcttccatggaatttatcctcataagattcatgtatgttggatttcatcatcttaggaattgacgcattcttttcatctgtactaccccgaaaagtggccaaccagacacgagttgtatgatcaactttaaaagggacatcagacatgcatggctgcaacgttggagcatgctttacgctcaaatgcttgacgtgcttattttaactacctaaaagtacagcatgacgtccattactttatacctatttgttttccatgttcatcaagtattttactctactcttttgattagtgtaattttttttatcgggtaaaaattaaacatgatatcagaatatttataatattcagatacttaaccaattgagttaaatttttttgatgtgtaattaatttgttgtttaaagtaggtatcggtataataatattatggaaaatttgttgagagcaaacgtgccctaagtaactgtgtttgcacggcgccttacagttgtagacatttaaaaaatcacaatattaatatattataattatgattatgggcgtcaatttaggggtcagtttgttacataataacaaaaattattctgatggaaaataatttactgattttttatttatttttaacgtaaacattctcaaatgatcaatgtataggatgatgatgaatacatgcatgcctcgattgtctattgtttacattttcttcaaaattttagttttgtgttttgtttttcttcgccattgctttcaggatacctcattccccctttgtttaatttctttcctgaccattataattggtcctccaaattactttccagtgacgaaactagtaggtgaaggagaatatgggatatccagtagtctgattatatattgtataagaaatatatttcatagtttaaaataaacacccattaaactcattgtttaaaatatatttttataattttattgtataagaaatatatttcattttatacccctctaattaagggggttaattttcacgttaacaaaacagagatatcgaatgaattttgaaaaaaaaaactacaactcagtatattttgctcttcttgaaaatattgttttattttttaaggaaaaaaataacataatacatatgcatatatttttactagccttggcgaataaaaaaaattaaaagattacatactccctccaatatcgaatatcagaagaaaaaaacattaatttacaataattaagaaaattaattaacatcata

SEQ ID NO: 274 - DNA, 1363 bp, Glycine max
  Soy_ogl_1373 Gm04:43845801..43847163 Cluster 1
ctctatctttatttttgaaaaagagtactcaatctttttttaaaaataaaataaaaaatagttaaagaaaatagtgataataattttttgtgggcaaaattacaacaattgcattttgaaggtttatgaagaaactaaaaatagttatatttattaaaggataatttaagaataagaaatgtatataccaaagggctaattacttttattaatactaataattataaatattaaataaaaagttaaaaacattatgtttactttattttttgcataagatatttctttaaaaaatcataaatacaataaatgaatacacaaaagaacaagttcgattgagttggtcaaaattcacatcttaataaaaaaaaacggtcaacatatggtcaattaatagctatgcttattttcacatttataaatatggacgaaccaatgcaaatgcagccttcatatcccaattgaccaaaatcagtttcagtttaagagatagaagctttgcaaaattctgaaggacaaaccaattatttaatttccttggaaaagaatttcgctaagaagttggttgtgaccatggtgatctcagcgctggttgttagtcttggagtcagtggagcgcaagccaagatttaccattgcaatcaacccttgcaactttcttacgtgccttttccgacgatgcatgtgagtaaattctgaacggagattataaaggttcaaaatgcataactgactcaaagggacaagaattttgtctttgctattgaattgaagttgttttttaactcgtgtgatgtacagggtaaaagttaattgtttgtgtagtttttgttggtatcatgatattcctgtagaggaatttgtttgaccatttttaatgtaattttttctttttaataaggtttttttcattttattcattaggcttaaataaaaaaatttgtttaagggatcaggatcacttggatcaactacttattagtaggttattggtataattttagaatgattttgtattaaataatatagttatataactaaaaaattattgaagttattttattcaattatttttttgacatataataagtaaaacattaaaaaaataatttaatttaataaaagtaaaataacatgtgttattgttaacaagatcattattgttacaaaattttgtaaatgtatggaaattattgaaaaagataggtaattattcatttattcttcacatgtcccaaacatctgattaaaacaagtaaagataaaaataatttagtattatattagaagtatataggtaatatgtggtgaataatattgacaatgtataaataatatatagaaatatttgatgaattatatt

SEQ ID NO: 275 - DNA, 1500 bp, Glycine max
  Soy_ogl_1513 Gm05:1314401..1315900 Cluster 1
tacgtaccttacactacagtacataatgagacaaatggtactttttatttgcactatatgtcttcgttctttcatcaacaatatctcacttcagaaaacgacattaagtcttattaatcaactataaccagatgaacagatctttgctcgtaattattataagaggatgatgtgatcgcattgagttatcaaaagataataataggtgatcttgtatttgagtcataaataaatagttatattaaatatttaaataaataattaagttaaatacttaaaaagaggaattgtaaaagatactttgatcactaaaaaaatactaagaaaaaaaagatagaaggcataaatgtaatataagaacttctgaaatttcattttttatgatgctgttttttatatattgaaatagatgatttcgtcatttatatctcctggtcaattttgtataaatttttctttttaaaaaaaaaatattatataaggagggaaaacaaatatttagagaatttgtaacaagtaaataaaaggttcaattaccctttttaatctcaatttttaatttttgcttaattttatttttaataaattaatttggtatattttatctcaaacttttatgaaattaatgaactttatattatgtcattttactcctaacataattgtttttttatcaactttttattttttttcgtaaattttgcaccaaaattttttacttttagtaaattttatcccttttttttattttcttggacaaaatttatctcaattttttgcacttattaatatataaatgatagaaaataaaatttgtaaatttcttaaaaattatggataaaatatgctagattaaaaaaatgggagtaaaattggtttaaaaaaattaagggaaaaaatatatttaagtctaatgaaattttagtttcagtttaaggttttagaagttattttctccatattttttacctttcacttaacccaggtttggaaggagagaaataggaggaaagagaagatgaaattaacatatataggtagtttcaatttttttgttttcaactttaaacacctactgtgaatcgtatatttttttctttaaaaagtttactaagaagatgcaaggctcctcacacaagactatgatgagaggatctaaagtgatagtagaatataaaagaaaatatttacgtttttatgagtttttgtggcttaagcccaaatcaagctaaaacaagcacatatttaatttgtgatcaatatttaaagttgaattcctacattttcatcaagcaaattttgatctaaccaaccattgactcgatgtggattataggatataacaggtatgaaaaaaatccaactccaattttggacttctgaaatgacgcataagtttggtaaaaaccctaatctatgcggatttttgtaagttcaaattggactatgattgagtcgaggtaaaaaaaaactcatattaaatttgtattcaaaatttaa

SEQ ID NO: 276 - DNA, 1900 bp, Glycine max
  Soy_ogl_723 Gm02:47733401..47735300 Cluster 1
tatttttgtgatttatgaatttcaccaacgaatttccaaacatatcctgagttgctaaaaaagagctgggctgatagagatacttcaagactatgtatcaaattaatacacagaaaattaaaattaaatgagtacaaagttattacgatattacatcatgcaaacatcataattttgagtcaaaccaagtttggctcaacttaccatggttcaccttcatttcactaccaaaccaaatcgtagctaatcttatccaggttgccaagtttgtgaacaagtgaagcatgcactccaattgtgtccttggagtaaaccactcaggtttggattccaattaatttcagtgtacgactatcatcaaacattatttatttatttatcattatcatatttgtacaagcatgactagttacagttaaaaaatctgatcatatcatctttagacgagtcattcttttcaataattttttttatctacaaagtttaaatttgaaatctttgtttatgatgattgagtctaattctacccggattaacaatatgttaattttaattaatgtgtttatgctagtatttgaaatttaattttagaagatcttaatttcataaaattaattttattaaatgtgatttgagcttaagtcatatatgctcaaaaactttatcttaaaagtaggtttatactaaaaaaaacaagtttttactaaaatctagcataaattttcatattcaacataaatttaagttttcttctaattaaacgcgtttgagaaaaatcattaccattttttatatcgtgtccggttagtgtttgtgtttgatcaagtatcagacaatactattaagtaattaattaacccgttttcagatagcaaagcaaacatccttgggccaaactttgttgcgaaatcgtataacattgctactttgttgggccttataataggccagtttgatactttggatcatctcagtttcgcttaccaaagacaaaatcataaatacaatcaaaacaatgggaaaagattttactttgtttcttgagtttcaatgaagttttcatttagttcctttttttttttttgacgtaatctcatttgtgagtcggattgtaaaagtatcacaattaagtaaactaaaagaaaactactgaattatatcttggatgtaactacatttattaatgacatgaataaatattaagctaaacatatcatattatagatatatattaacatgatttttaatttatactagtcactagttgaattataaaaataaaaaaatagagatagagagagagagaagcttttattaaagtcatattgatattctgtataaaatcttatttcgcattgaacaaattaaggcagatatttaattataactattagttattaagaacttaatcatgaatgaaataaaaaaaaagttataaatatttttcagaaaagaaaatgaaaccaattgcattgcaaccatgtaaagtgtaaactgtacccggttcagaaaagttataaatatttttcagaaaagttatattgttttatggagttttctaatcaattaggcaccaaattccaaaagctaaaaaaattaacgacaaaggcagtggtgcccaatggccccaattgacaccccaacctaagataaaacatgactctgcatattggcatttgccccagcaaaatctttagttgtttatttatttatgtcacaaactcattatttatcgagtcatgaactgatgcttatgtttttgtatatgtcgcaacttagagctaagctgtgagtcactaactaattaacctagttgagataacattattgattaaggggggaaaagttcaataaaaaaaaggaaaaaaatcaaataattgaatttggaattttttttttc

SEQ ID NO: 277 - DNA, 1782 bp, Glycine max
  Soy_ogl_1838 Gm06:7891601..7893382 Cluster 1
tacactctcacgagcaaaaaaaaaataaaataaataatatacaagtttaaaatcatgtcaaaataaaaaggccgatcattataagaaagaaaaaaatgtttgtgccagtggatatcagcatgtaaaattcttaattttttttgaatatttgtgccattaatatgaaattacttaaacatataatactacctttattatttatttatttttacgtattttaattaacaaaagtttttcatatatgtttgaattttttaggcctttaactattttttaaaaatttaaaaaaattaaaatttatgattgaagtattttaaaaaaaaatatttttgagctacttctattttttagaggctctacctgtctatttcaaaattagaacggacgtgtaacaattttcttcttttgatattcctaatatcagcttttataattgatatggtttaattacttaataatatcttaccaattgagtaatattaattcactaaataattaaaataattccaaaccaaaattaccaattgaataatcaaaatagttcacaaaaatccttaaccttgccactttattaaagactctagcatttttttttggagggtagtccacgatattgcatcagactgcagtgtcttgtcaataactagcagtggcatgcgccaacacatcaaattcataattacatttgtcaaatgagtatgtggggatggagtggcgacttttgtctaaatcagctattattaaaaaatgtggtgaatttcacgtatttgccaattaacgatataaaaacaaactaaatttttcttaaaaaaaactataccagtgatcttaattaaaaaaaactagtgatgactgatgggtgatgacacttaatggcctcactgggtcttgacgacaagtcgaagagaagatggagtgataaaaaacttgaacatggaaatatgaatcatacgatagcaggttacttattttattgcaattcatcacatggcaatggacgtaaagaaatgtattagtgcataagctttgttttttaagaaaattaaaatattaaattgaattaaaaggactcaaaatataatcgtaatctatcttcaaaatacattaacaattagcctcaaactagattggattagtgggacaaactaacaattaagtgatggtcattcataaaaaataggatggacattacattttttcttgattgcgcgtattgcattttgacactgcaattattgggcacaattgaacaatattttcagtagtgaatgtaatatgtttgatttgattaggacgtttcaaatattatatttagccttccaatcaacgacgaatttatgtttatattaaattctacaagatttttcacaaccatgagagggataaatttaaaaggagatatgttataaaattgacaatgtaatggaaagtaataaattaaaaaatattacgtaaagaaatatcccttttaaaataaatagtagtaattgataaactgaggaatcgatttttgatgttctgaataagaacagagatagagaaaaacaatggaataaacataaagaataaaacgacaggtttgaaacatagaaaaaggaaatctttgtcattataaataagagaaattacaatttaatatgttgtttttttatggtaaaaatatcttgatacttttttttttaatgaaaggggttcttgatgcttattaaaaataatagtaataaattttaatatctcatcataacttttttgatctaatcatcaacatacatctcttaaaaa

SEQ ID NO: 278 - DNA, 1762 bp, Glycine max
  Soy_ogl_5499 Gm17:3970301..3972062 Cluster 1
atattttaaaagtaaacaatataaccttactttcttatccattgatttcaaacctgaaaaataaaagtgcaaaaattattctctattctcaaatattgttaaaaagatattgatactcatatatatgtcatgtcatacgacataatttaacgatatatatcatattttttgtggtgtgaaatgagggagtgtatcataacgattaaaaactaaaggataaatttatgccatttaatacaatattttttgagaacgttctatcgtttaataatgtatctaccttttattgtaattacctataattaatttacaattaatttgttttctgaccttaaacttaacacaatgtaaacaggcgagtatgattaattctaacatgccctacttattgccacgggttggctactgttatcttaatgcatgttaatgattttatgtttgattcaatttttattttaaaaattcaaatcaattaatcgttttataaaatctactagcagaagaaactaactgttaataaatcacagttcatttctttattaaaaaaagtgcttaattgtatcttgaacgggtcatctatggagatattgggtgagaagcaagaaaatattcataacaataatttatcggataataaagtcaaatataaggaataaacaagattcggtttgatttatttgtcatctgaaaattaaaaccacactgcacaaattaaatcaaagaaaaatgatacttcagtttctcagaatgaaaatatatttaaaatttcttttacaaaggaacaagtaaacagtcgctttggccgagtggttaaggcgtgtgcctgctaagtacatggggtttccccgcgagagttcgaatctctcaggcgacgaacattaatttttatgtttttatcgttccaataaactactttgctatcttatgcatctggcaaaggtccaaaaccaaacgttgggccctattcacaggaatcattcaagtccaaaacaccatagcagtacacagtgtttgtgtcactctttcaaaacaaaaacaaaaaaccttcatactaaaatactagaattttgttacccagcatgctagacccttacagcctcacttatgagcaatttgtttggtactctaattttttttccatatttagtttaagttacatatttttctcttgttttatttaaacatttaaataaagaaaaataaatatcaaaatcaagttaagggaagagtgaattataagagtgaagttttttttttcttcctatttacatttacatgaaactttctgaattagaaaaaaagtactcgcaaacatttcaaatcttcagaattaaaatcgcattgtttatgacattatcttttgataggttttaatggtgatgtaaacaagttaaacacaggtagaaaacttaagtaatatatgtgggtgttaatgttcaagtatgactccttttttagtaaaaaaaaagtatgattcatttattttaaatgaaacaaccttgagcttgcttattagagaaaaaagagcttgaatttgatttgttttgtatatttataattttttcatttttttaatatactttaaaagtgttttataagtccattaatttagtatttttttttataaatattttcgtgttagaaaatgagataaaagtacagagaatgaaaatatttaacaaaatcatggttgggttaccttaaatatttaagtttaacatctcatccttaatttggaaagcatgcacacacacacacacac

SEQ ID NO: 279 - DNA, 1300 bp, Glycine max
  Soy_ogl_6628 Gm19:49634701..49636000 Cluster 1
ttaaaaaacatgaaggaataaaatcacatagttactatacttaggaatcaaagtgcaatttaacttattattataatttcaaataccaaatttatgttacactcaatattacaaagatggaaagatgaaaaaatagagaataaaagttacattaattgtacatttactgttttcttttattgcaattgcaaatttactgttgtttacctcaaaacctgtgaaaaaagttcactccatttgttatgtattacatgtcactttaagtattttaattagtttcaatatattttttattttgaaaaaaataataaaatatttttttaataatattttcgtttattagtatctcatctaaatacttaaacatattcacaagtacattctaacttatttagtaagggtatttttttgacaaacaaagtcaaattattaaagcaatttatgtaattaataattttacaagaagtatatatatcacctcaaacaaagacaaataaaatgggactaaaatattgaaagaaagaaaaatttccaaaatgttgatatacaacaccaaagtctacgaaattataaaaatttgtgtattagtcattgttcaatagcatgagtgtgttagtgaatttttagcttcgagtggttcatttgtccagaaacatcttgtcactttaaattaataatagtcttacttacatttaacttatttctaactaacaaatagagaacatgttcttcaaaacttgtatagttgtgatttgtgtttaataataatccaagcatggtattctaaatttttgcctcggagttcgaaaatacttttttttattgtctgaatgtatattttttttttcttaaactatatagatcttaggtctataaattgaattccgcaattcaataaatatgatttatttaaattgtcatttttatagtatatactaaataatatattaataaaatttatttgataatttattaaatatctatatatttactgaacaaataacttatgtttttaattaatgcattattaacactagctaggatcttgattttaagccgctaataaaacttatgtccatagtaccgtcttttttatgtttggtctatatttttttttgccactctctcttatttcgggcgtcatgtaattcttatatgcgaaaatgggttttagattttagtaatattggtgaaagtgacgaaagattagaagagcatgagatttggggttaattggataataagagttgggttgaaatcttaccgagcaaaatgatgaagtgtatgaatatataatatg

SEQ ID NO: 280 - DNA, 1700 bp, Glycine max
  Soy_ogl_4808 Gm14:47714701..47716400 Cluster 1
tgaaaagagagagatgatgggtctcaataattttaagagtaatcttgaaaaaataatacaagtttaatattactaactaaatcaactaactttttttaaagggcattagttaaaaaaaaaatcttatatgaaataaatggaatgtattagaaggggaataaatagtgtgtatgtgaaaaaaaaaatcttatatgaaataaatggaatgtattagaaggggaataaatagtgtgtatgtgaaaattaaaaatctttttaaaaaaaattcacaaatatatgtttcaaagaattttcataaaatctttcggccaaagatataaatgtgaggagacaataataaaagagtgttagaaaaagaataaaaataattatttttatattgattgactctttaatttttcttcaatttgagaagaattctattaattaaatatgactataatatatattattttctttaccacttctaactcacaacaagtattatttagacaatttttatactaatataatctcatcctaatatgctaaaacactctgagtattctttaattattaagttactcttgacaataatatttaaagatttacacaaaaatacatgggtgaaataacatgctcaaactttcttattgtatatcttattatataagtaatatatatgggtgaaaatttttctaccaaaaagtttaagattaaatttttaatatcaaatgcatgtcaacttaaaaaagaaagtaatgataaaaatatttataattcgattctgtttcacttagacacactgaatcatgctaacatgcaacacgaataattcaagcaatggaagtttttttatcaacccgcgtgaataaatatgaatatatttgcatgtcacctcatagctcacagaaatagatctttattctttcactgagggcttttcaattttaagtgcattacaagtgtgttgtagagtattattataaaaagtaatatacaaggatgaaaagtttctctccaaaagtttaagtttaaatatgtaatcttattatataaagtaatatacatgtgtgaaaagcttcccctcaaaagtttaaggttaaatttttaattttaaatacatatcaacttaaaaaaaacataataaagatattttaaatttggttttgtttcacttggccaaactgtatcatgccgacgtatgtcacacgggttgttcatgcaatggaagtttttttttttttttttttatcaaaccatgtgaataaatatgaattttatttgcatatcacctcataactcacaaaatagatatttgttgtttgactaggggctttttcacttttggatgcatgaaatttgtgctccagagtcttatcttattatataaatcaagtagcatacatgcgtgaaaagttttttttcctaaaaatttaaatttataatttcaaatgcacgtcaacttaaaaaaagaaagtaataaaacatttttaattcaattctctttcacttggccacactaaatcatgccaaaatgtgatacgagtgacggaataattttatacgtatatcacctcttagctctcataatagttatttgttgtttgaccgagggattttcacttttgggtgcattaagcatgggtgaaaagtctcccccttcaaagtttaagattaaatttgtaatttcaaatacatgtcaacttaaaaaaaaaaaa

SEQ ID NO: 281 - DNA, 1656 bp, Glycine max
  Soy_ogl_4967 Gm15:10106056..10107711 Cluster 1
cgtatgtcctgaaggaagtaaatttaaatcatggcaacttctatctaaaagaaaaactcaaataagggaaagtttaaaaagtagaataaatagttagacagaagatgttccactaagtaaacagttagacaaaagataagaagcatatgcttgttctattagaaatccagctaaaccaataagatgcaaattagccgattgatcagtctaatgctgataactactacaggaccccacctgagttaagaaataattaagttgcaaaacattctaatgctgacttcaacattcactaataagcataaaaaattattaatttcttttaattataaaattgtcacattgtcgttaggaggatttctggtaaaaaatgaattttttaataatgaataaagcaattatgctattattaattattattggagagggggagggctctaatccaaatcaacacagacattataataaagtataaaaaccttaaatgtgttaccgatttatgaatatagtgaagatatctttgctttacatatggtatcaagcagaacagctagctctatttttttggcatattctctcgtgcactagagaatatacatggttgcgtacgttggcatatataacaaatttgtcgtggacaaacgactgaatagtcatttcagtatgtattaaacgactgattaatttatatttgtatgtttttatcataaaaataagttaaaaataaaatttagtatattttttttatctaatgcataagttatctaaaattgtttcaattcagaattagttttagactaataattaattatgaactattcttccatgtgaaattaagcatctcaaaaataatctaaaatcaattttctaacctaaaatcaattacttagatatattctaatttactattaacgtttacttttattacacttgtaacttttaaagaaatattttttttaataatttaataaaatattatttagattaaaatatgcccggtaatatattaaaaaaatttattttatcaattgaagaaaattaatttctaaagaaattgaatagttgattttgtatggaaaggattttttttaaaacatattccatattattaataatgtgttttttttgtctaaaatcttaagtactttttagccgaacttcgctatcaataggggtggcaaagggacaagttaggcctcttcttaaaatgaatccaactaaatttagtccatttctataaattaagagtaaattcggttggattaaaaagttttccttttaaaataaataaataaaaatttgtgtttactgtaacccattattatttttgtagtttcttttaaaaataagttaaagtttaatgtttctgatatttgcttttaaagtcaattgtggatgcatttgatattttaagcgttgaatgttttgatagattaatcaatatataattgttataattatgtttttataattaaattcatgttttttctttctaattttgtttatttttttggtcaactcatggatcattcttttaagtttttttttcttaaaaagtttcgacaagctaacctaatttaacccgcaattcacctatataggattattgagttgggaaaatcctaatttattatcaaaatgagtttaatctaactt

SEQ ID NO: 282 - DNA, 1163 bp, Glycine max
  Soy_ogl_6201 Gm18:56454838..56456000 Cluster 1
gaacttaatgtctataaaaaaactattgaatagaaataagttaaacaaaactcattcttaaaataaatacatcattttctaactaaaaattatgaaaagattataaactatctaaggaatgatttatgttttttttataatagaatgatttataatttaaactgacatcatatatttatcatgaatagaaagtcaaagaaattaataaactaatactatcatcttcctccgtcatcattttgttaatatcgttaattaattttacacatgattttttaatagagtttaatgatcatgtgtcattgtaagattttttaacccttttctctttttaatatttatatctctgatagttatcaatctgacaatctcaatttatatatacattttttaataatacttctaaattaacaaactaacgaattttctttcccccttgtctcctaaatttcttccacgacgtaccacagtgacattcatatgatattccttggcatattcctctgctgatgatgtcgtctatcaacacaatttccacgcttatttttaaattgattgataacaattactaattccatttctttttaggtgtcgttttagcttaaattgagataaccaagaaaattattaatttttctgattttaagtgattttgttaatatatttcttactttactccttttaaatgttttgttttcacaaaattctccaaattaactgccatcaattttttctcccacgtttaaagttttcaatggtctttttctctcttgaaatgctaaaatttatggttatttactttccactaaaaactctcaaatttctattgaaggaccgtggccatctcttgaaatactaaaacgttttgggagtagatacaaagtattggaatttctctaaatgtaacaattcatattcttttggtcaataagtaataaatacatccttttttattttttcaattatttattatctaattttatggaaaatttataaaataattaaaggatacaagagtataattgagaaaagaaaataatattagcttgaaatctaaaacggacagataaaaaggatttttttatattttaaatgtaacacttaaaaagaaatggcgggagtaattaataaatgcatcccgactgaaattatgaattcaatct

SEQ ID NO: 283 - DNA, 1260 bp, Glycine max
  Soy_ogl_295 Gm01:52487141..52488400 Cluster 1
aagtgatgggagaggatatgaaaggaacttaaagcattgcagttgctttcactgtcttaattgcaattcctttcttaattaagttttctctatgcgtattacatgtcacaaattggtcatttttaatattaatttaattggtcaacgcttgcacaataataaaattataggataaaccaattctagggttgttgagtaaccaaattaagcccgtttgtatattagtaaataggaaaaaaatattagtaatttatgaccattaattaataatagagtaaaaagaaaagaaggaattggtaatttaatagagtctacacataattatataaaaaatttaaaaaatattaattttttcttcataatttttttattaatttgatttatatcaaaataaaacatatttttattgatatgtaacggtaactctattagttaaaatctcaaaaataattacaatttcttgttattttttgaactattttttcacactttcagaaaataattaaattttttttgttaatcatgtaaagaaattatttaatggaattattactaaagatcaacaaaaatatattttatttttatttggatgaaattaatacggaaaaaatttataatgatgaaattaatacttttcaaattttattaagactccaaacatattttacttgtatattagtaaataggaaaaaaatatttgtaatttatgaccattaattaataatagagtaaaaagaaaagaaggaattggtaatttaataaagtctatgcataattatatagaaattaatactatcatacataaactatcaaaactaaagatcatttaaaattatatttgactgaatttacatttgagtttttttttaaattaattatttttctattttattttttaatataacatttaataatcaatatttatttttgttcttctcatgtaaaaattaatgaatctcaatattttagtgcttaattatcatatatggtttttttaaggaaattatcatatgtggtactgagtatgcatcatgttgggtatctgtgaatcattcttcataatagtttttttttaaggcaaatcattcttcataacagtaatacacatttcgtgctcacaatattgctagatctcctgaaatataattccaccactcgaggctataacaattcaaaattctcaggtagtgggaccaaaacaagaagtcagttgtacatcatactatatactatatactgcttttattttttatttttata

SEQ ID NO: 284 - DNA, 1801 bp, Glycine max
  Soy_ogl_1440 Gm04:46594800..46596600 Cluster 1
gatagtagatatgaaaaatcttaaatgcaaatattttataaaaatatgattttatattgaccaaaataaaatgttattaggaatgaaaatatggtgaggtgggtcatagtagtactctctggtcattgtctcatatagttaattagtttatgattgtggaaaaatattaaaaataaaattgaataaaaaatataaaaataagaatgcatacataaaataattagatgtgagtacaatttaaatgaagtcgcctattatttcattaaaatcttttttatggagttaattactttatgattgtgaaaaatattgaaaattaaattaaatgaaagaacgaaacaatataaatataagaatgcatacataaaataattagatatcacattcattttcttaattagatacgatgtgattcacgaataaattgtgtggctgagagttatttttattattttgaaataaattttatacttaatgcaaattaaaatccataaataaataaaaaagataacatgtttcattctaattaaattaaaatttattaaaaattaacatcttttcatatgttaaataattaaatgtcttcacaaaaattaaataattagataatataaataaatcatcaaataattgcctactttattttgaaagatttatgtacgtaaaaaatagctaagaaacacgcccatcagcttccataaattctatcaatcccataaattaatcatgtattcataaaaatattgataatgaaaatataaataataatcatcgtgcaatgcattggagaaaaaaaaaagatgagaaacctatatttaaaaatgaaaatggaatgtacttttgattaaatactaaaaagaatttttaggaacgctataatgattattgtatttaaaagaatattccattagattaatcaaattgattaccataatatataaaactaaaatccatataattcataattgattcatttagtcaaagtatatattcatgataatcagtataattctgtatttttatgagctaaacaaataaagctataaaaatgatcaattacaaacaatatataagccatgaatattttgataaacatgataaattatatggcataaacttgaatatttggagtgtatattttagttatactttatcttgtttttatatatatttttaattgaattacaaattaaaatttatccataaatgaaaaaaaaacagttgtatcttgtagtatatatattagataaagagaaaaagagacttgaaacaatatgaataaatgatcaagattttacctttacgatagttgtcatataattgcacaaaaaataactaaggcagtgaaattataaatgatatagtctagacagaatttcatgaatctagtaatttttttttttttttatattttgaattacactaatttataattaaaatgattataataattatactgtattttgcatattagatattgttaattttttattaatttaattaattattagattaatttaataaataaatattattaagataatatatcaattcaagtaattatagtaacggcaggatgattactataattaattttattacataactaaattaccaattacacttaattacatattaggtgacaataaaaattaagatcgattacatattaatattcatggtataatttcggtttgacaataattgtaaatcaattagggaccaatttatcttgcaaatgtattatttgatgagaaataaatatatttaatttaaatttttaatcgtatccgaaacaaac

SEQ ID NO: 285 - DNA, 1700 bp, Glycine max
  Soy_ogl_2156 Gm07:3253301..3255000 Cluster 1
tattaattttagctcacatgacttattaaattaaatcatttatgatttttttaagttgttgattttatctctgtctttattttgtttatattttttcatgttaataaaatactttatttctatctaaaataaaaatatcatattagcattaaaattattaattttattagtcaattattatcacaatttggtcttttttgaatatatttaattattatatacttataaaactttatgcaaaaataaattattattctacaaaaaattattttttacaaataaaaaatattttttaaacattcaaatccgattaacctaacccctttattattattaactcaaataaaaaattattttttacaaataaaatttaattattttttaaataattaaatttactattctctcttttaaaatgaattcacttggagttgatgtttctttaatagatgaatctctcttgaaagggtggctaaacaaataaatgttggaacttttctcaacttatcaaaccactaattttagccaatagataatcaatccattcttaaactttttaattatttattatctaattttataaaaaaatgtaaaatagaaacatttatattttaaattcaataattaaaaaaaaacaaaggaagcaaaagtttaccataattccatacattaaatgcatagtatgaataaatgtgttaaaatccatttttcactggtgataatttgcaatttacaaaataaggtagcataaaattgtgatttacttttccatcagtgatacttttatttccagtaatattccgtaagtgatagatgctttgttcaacacgtttcagtttgtggtggccactttcttcaacacggggtggtcattggttttcaaggtatcattattttcttcgatgtcgtggctatcgcgttttaacttttaaggtaccattcaatttgtgatatttttaatgttatcggaaattatttttcagaatatgtatatatttgttctgggaattactttttacgtttgtttcataaagtaatttcgggtagccttatttaattttcttttttctcgttactcaagacaatggcacatctttgatagaagcttactttcaaatattttaatttagcatttaaatcatttttcccatttttgaatccacacatgtgatgtgatgcatgcagcaaatacgttcaatttccattataaaaagtgctctcgttgagtggtagaggaagagaggtgagtgacaggaaaggttgagcagaaaaattgtttcaagaaaaatctcaacgtaaataatttgaaattggagatatttagaagtatatatatcaattagggttaggagatgtataattattatttgccaaaatcagaattaggaacccaaagcaatgagagagaaaacggaccattgtagataggcccatatattagtcatttgtgggagagtgttgatcctgggtatcacatcagactacttgaaaaaaaaaattattaagtattatgagcacaattttgccttcagagagttcagacaaatttgcctcaattttgctactcttcgtactgaaagcacatgtgttgtcagctacttaaaaaaagaactactttaaaagaagtgatatttttttcataagtaatcccaattaaacatataccaatttgccttgtgcatctaagcttataaatggat

SEQ ID NO: 286 - DNA, 1653 bp, Glycine max
  Soy_ogl_4656 Gm14:4813011..4814663 Cluster 1
agtcttattattaatttaaaactgcaaaaataaaaaagtataaattttaaaaagatataaacattgagctgaattacgatgactttttttaggatgacctaaagtataaattaaagttatccttaaattatatttgatttaattttcaaaatcaaaatcccttaaaaaacattcaaatagaacaattatcaatgaagattggatctagcataaacaaataatcctaatctttgctcataaaagtgttcagatatttagtactaaatcaaatatttagtacttaacttgaataaaattgtctttgaaataaaatactttgtgagaaaaaaaattaataacaacgaacttgtcctaaatacatccacatgcttctaaaattttctctaagagatgtgttacttacacacatttctatttaacatgaacaaagttgaaatcaacaaataattgagagtctgcaagaaaattgtattaaggttgaaaatttaattcaacataataatttattacaaattggtgggttatatttttttagaattattttttaagttatacaaataaatgataatattataattgacgtactcaattatataaaaaggttttattcttttctaaacacatactggtatattgttaattataaaataatattaacaattacaataattatttttgtgaaaaaatgttttaaaattaaaattaataaaattaatttaacattaacatatcaagaccaaatagaatagccataccatcaattggaaaaatatgttataagaaattcattaggctagtctaataaataatttcaaaaggttaggataaaaataaaatatttaatttacaatttttattcaactcatataaaatgcctcgtttctaaactttggcttgggtctttatattcgtttagcttgatagaagagtgctttcattttcttgaacaactagtattttagttcgtgtattatagggattaaatttagtatgtaaattttataattataatttttttattaaaaaaatcattataatctgttatcataaaaagtgcgaatcaatattcatatcatataattaaagaaattaaaaatggtgaaaagtattcattatataatgaaccaaaataattaatatttaatgatagtttgtgatataaccttggctagcatttttttagtctataaataattttttggtgcctattttagttttagtacctataatcattttattttgtgcctgacagattttattttttaaaaagtatctactattaggaaatatcgattaattaaaaagtgtcataaagtaagtcatttaaaaatcattattatgcatccaactcattttcacaattggtacctttttaattttttttttcaggtttcaaaataataaaaaaataaaagttagacacctaaacccaaacatccttattttattttataggtaccaacaagttatttaagtcatcctgtaatttataatgaggtctttctacattaatctagactcaaaatatatttttagtttttaataaatagttgaattttatttatgattcttatttttttatccttgataaaataaaatttaaaattttgtccctattgttggtatttcaataccaatggatgaggtgtctct

SEQ ID NO: 287 - DNA, 1527 bp, Glycine max
  Soy_ogl_4706 Gm14:6097574..6099100 Cluster 1
acttttgagaaactaaaaacttaattaaccatgtattatgtattatgtataaaatataaaatataaaaaggtatggatggtattataaatccgtgcaaataatttggaaagaacatgttcaaatttgttattttataataagttaaagactttacaataatgtttgttgtctatatttaaaatgattattctatatatcaatgcatactattcaatcaaaaatgactttaaaataatatatccaatgtgcaataaaatggtccataacatatgacaaatacattaaaagtatgatgctgcatattttgtaataaacagtgtatatatgcaagacacaataaaataataaggaaatgattgaggaaaaaaagggctgtgggtggcactgttatttgaatagtgagtgaagttagtagtagaaatggctttctagctatccttgcttgttaaattaaaggatacgatttgctttcatttattgttgggccgtctatttattatgctcaacaggtccaggagcatctgtattacaggccttggtgtgtccatgtaataattccaagataggagtggctattggttccaattagattgttatagtccttatcatcattcaaaattttaaatttactttgacctacaatggaattatgaacattattcttaaacgaaattgtgattttgttatggattgtgatttatggaaacggaattacaattttattgtaatttttttattaaaatatataataaaatcatatttttattatataattgttttgttttaaaaaatatacaacatacgattttattgttcaatttcacaaaaatatattattttcttcatgttttatactactcaatttacttttttgagtttgctagtgtctcaatgagcaaatccaaattctcaaaagtaccaatatccacacaaaaaaaagttaaaagaaaagatttctcaataaaaataaataaagtagttacacatggattggatgtagctggcaacttttgtttaaaaataataggatgtaacatgttgaattttcttggcccatacaagattattagctaataaagttgtgatgagtgatgacacgggattcatgtgatattatttataaaaaaatataaatgtcggtaagtttattttaagtatttgagtaatgttttttttattaaaataatatttttaataaaaacgtggcttttaaatatttcaaattaactagttcttcaaacaaaacaaaaaagtaaatcaagtaattaaacataaataattaatatactaaaataaagattgaattggatggacgaattcaattcttaaagaaaataatatgaaagcaaatacgtattttttattattaggtacgattttctttaattgccgataactgacattcacaacaaataaaaattggacacttgacctaattttgatttattttcaattaaaatttatcacaatttaagaaaaggacattttttattgtttatcacaatatttgaagaaaaaaaactatt

SEQ ID NO: 288 - DNA, 1378 bp, Glycine max
  Soy_ogl_4934 Gm15:9066501..9067878 Cluster 1
tgtatcgttgttgtttctctccaatctgcttctatataacaaatccaaccttctcaaaattgaataaactagttgtgagagaaaaagaaggaaaaatggatttttttttttttttataggagtggaatagttgttttgattctataacgttcaatgatgaccagtttgagacaagaaaaagaatcgaaaaaagaaaaagaaaaagacattattaaaaaaaaaaggagttaaatcttaaacacgtcatcatctatgagaagctattggttgggtacaaattcaacatatacacttcatttttaaacataatcaatagaaaatttataactagtaaattaaaataaagaaagaatgttaatcatttattagatttattttgtttctttctaaaaaggatattttttgggtgaattatttctttctaaaaaggatatgatataattggtttggtttaagggaaatacttaatgatatgaaaaaatactgcacgattttgacgaaaaccattttttagtaacatattgcgtgaattccgtcaaaaacttattttttgttattttttgaattaatatatcaaccaatgagatttaaatatgtcatttctttttgggttcgtgtggaaaaccttgcactatatagcaatgctatttctttaataaagatttaatgtacaaatatatttattttatcaacagagaaatgagtagacacaaacccaatattaaatattaattaaatatatacattaatactatttgatacgttaattatatatgtttgtattaaatacatacattaatggtatagtactttataacaaaatattaattatatgggtatgaataaaaaaagaaaatatttatagtgaaaattataataatacgtaaaaaaagaagtcatagtagcttaattttgtacatcccgataatttttttaatttcttaatcaatattttaaaaacactgattaacacttacctaattatataatattatttaataaatacttattaaatacatactaattgtatttaataagatttattattttcttaaaatttattattaaatatatacattaaataatacatatgtacaagtgtcaccatctatttatctattctgttcaacatatttatttttacttcaaaatatcattaataaacacaatatatagatgtaatcaggggagtgtcaataaaatgtggattagcaaaaaactgagcagcccttccaagaatataaacaacttaattgacttgtttacgaatcaaactcatggatgaattgcttacaaaaccaagtttctaattacatacattcaaaatgaagcccagttctgatatcatgtttgtgctgttgtgaacgttgtcgaagac

SEQ ID NO: 289 - DNA, 1600 bp, Glycine max
  Soy_ogl_5486 Gm17:3564701..3566300 Cluster 1
tctaaatttcaattggatgtaattatttaatataagccatattttaaaaaggtagcatttgaaaacttgttttgtaataaagatcttataaaacattaaaaaccctatatattcttagcaaacctaattaaggagttgagctaaattggttgaatatacttacgtgtaaattttctgatatgtttaatttttacaaataaaaaaaaatcctagcaaaccaaagttttttttttttggtagaaataaaaaaaatatttttttagaaatcacaaatatatttttttggaagcaattctactgaaatcaaataagatgattagaagtgataaaactcttcatctaaatatttaacataattgaatataattaggacttaaatttgaggttactaattaaattataacaactctacacattcaaagttgaaacctaaacttaagaagacattatttatgtaatttaaaaattaatggtgtgtttagatgggtaaatttaagtgggtaatttaatacaagtgaaaaattgttatttttttattttaatatgaaaacattagtaagattttttattttattttatcttttgcacactcccttttcttctaacttttttatttatttgttcacatgaccgatgaaaattgaattgtaactaagaataaatttctaaatttcattatctaccaatattatgttttttaatggaacctatcaatattatgttagtctatgtgcaattgagattaaattcttaaagtgatgtttcgaatttgtatcttgcaaataataaattttattaaaattagtaaactcaattctttgataaatattaatcgtgaataaggtatttctaatattctctgaatcttaaaattctttatcgaaatacaacatagttttatgtaatattttgtctgttacatttatccatgattaaaatcaactttgcagtcgaggccgagaagcagctctttacacagcggtcggagttgatcgacctcacttcactctttcttcctttaccagattctctgctgccacctatctatcttttttaccttttagtatcgtcttcatctttctgtcttgtttacaattcatcccattcaattttttttcattctactttccaacaaattttaccatacattttattatgggtaaattatgctttaaactataaattttctctgccaaataatcaaataattttcatctcctctcctcctcctatttatttattttacctaacaaagcataagcgaaatgaaaaagacaaataagtgaacaaaaaataagtgaaaaatactaaaatagtgcgaacatacttgaaatccttttatttctctcatctctcagtcctccttaaccaaacactgatacctttttatttttcacatatttttctattctacaccttatttctcttttatcaaagatagtgatttttctccttccacatttcaccaaaaaaaattgtgacgttttttcttcttctaaaaaagtatgtaaatgttaaccttattagtttattaattaatggttaaatttttcttatcgaagtaatattttataattaaaaagaaaaaaaataacaagat

SEQ ID NO: 290 - DNA, 1796 bp, Glycine max
  Soy_ogl_196 Gm01:48212600..48214395 Cluster 1
ggatcttttagaattattttatattgaacttaagcttctatccgattaactagctacttcagtctagaaaaagaatcagcttaaattaagtgttaaacaaagtcaacattcaaatacgtctagaacaactaatgacaagatatttacaatgtatttaagtacagaggaaacaacctcaattcgattttgatagagtaacattataaaaggtctgagaagatggtatctatatgagaagggaaatcttgatattcatagacaaggatgattgcgctaaagacataagttattgatactaactttggtaggttagtatctatttatagtcacatctagacatgaaatacaaaaatccatttaaagtaagctactctaatcaaaatcaattgtcaagtttaacttaacaattttttagggaactcaataacaagacaaagctaatgtgatgggagggtgtgtggaatttcttaaaaggacactacctcttaaatgcgattagtattttatcacaaaatgtgtgttaaagtggatttgagaattttattttattattgaaagttggtaattacatagacaaatatgtaataaactttttaatcattaccttttaaaaaattattgacaatacttaaaaagttattactaaactagttaccaagaataaaacccaaagtctttgactgctggatagattattgcataatcaccattatgcatatataaatattttcttcagtatttttttttatttttatagatagcacataaattttataagtataataatactaatgattatattaaaaaaattgttttttataggcaaattgaaataattagttaactaaccatggcataagatataagatatgacgacgacgacaacccataatgaaaacatattttaaaacgtttacaatataagtgatatttattgaaacatatctaattacaatttaaaattttatttatttatcaattgaaaagtataaaaacaatgttgattatcatttctttaatatttgacatacttactaaaaataattttaatttctataacactctgcaattttagacttctatcatgattttttattgattaattaacaatgtaaaatttgttacactaacaataatataaagaacttaaattatgaactaagagtaaatagcacatgctagtaaaatatttttatattatattcaattcaattataaatttttatatgatttaatttgtcggtttttatatgaaaagtgttttttttaaggaagttatgaaaggtgtttatgttcttgaattacggttggcacgtggctcgtcgttaaattttcgtgtctttgtgctcttggtgagaccctgcgattggtccttttggtttatataattttaaagacaaaactgtgttgaaatttcataacttttaagatatgactataccaagttagttcttgagaaagaagggaagaaacactaagaaattaaaaatgagatggttttctttattatataaaatgatatttttttattaaatgaaatgttaaacaacaagaattaactcgttttctctcgtaatacataacatatatttatatttcagcaagagtccagcataaaatttccaggtacgaaaaatagtaatgataataaaaatagcttaaatctttcaagtacaatcaaattttcagtgtcttcttccatttaaagatgaaaaaaagcttaattaatgttaatttttttcattatattttactttgctacattaagttttaaaaaatttattttgattctttat

SEQ ID NO: 291 - DNA, 1780 bp, Glycine max
  Soy_ogl_316 Gm02:1603901..1605680 Cluster 1
aatatttttaaaaataggcttctctaataaatttcacgtaaaatattatcataaaatattattatttttatttatttatagaaatcgaagacggatatcaataattttataataaatcaataactcacacacactaaatttaatcaattgaattatacttccttattaaattataatgttttatgaagatatcattatacttatttatgtaaaggcgagttgattaagtatacacattatttcgtattcataaaagaaagtatacacattatttcgtattcataaaagaataatattataagggatgccatcttgtatgcaatcaatcaactcattctttgttctgataagtttaataacaatttcattgaagaataatattttatgtgaaatttattttaaaccataagaatttttaaaatctattaaaaattagattgcaattttaacaattaattataagtccttagtactagattaaaagatttaaaaagggagaacaaaacttaaaccctaataagatagtactgaatcattagctagcttagaattgcaattagtttaaaatataatttgtattgatgcgacattcatgtatacatgtaagaattaattaaaagattgtttaactcgttccttcactctagtatattatttttcaaatttcttcacatatgactactccacatggtgatagattgagttttgtctatacagtaatgtagtcaaaccttattgtcctttaaaattgatcaatcaaattttgttgacttattcattaccattctaacataaatttttcatatctttagatcgtattcttaacattgaaatcaataatattgtagaaaaaaacatgcatgattgtttcgaggaaagaggccagcttgcaaacatgatgaaatgatgaataaagttctacatgtatggaaaaaataaataattcgttggtttaaaacgtgtcatatttacagtcaaagtcaaaataaatatataattgattggtttgaaaatatagagaaatttttaaacaaataattactaattttttaattgactgatttaatttatttctgtatttgtatataacagtacatgttcttaatgctttatataaacaagtaaattacactaattacatataagattttatgaaattaaataaactcttcctgcttttatctcttctacactcttctttattttattttttttaaaatatactgcaaattgacacttcttataaattacactaataacttcttttttttttaaaaaaaaactttacaccattctccctatataaaagatgttattgtaaatgctaaaaaataggagatatttgtataattttacaaaattttaaaaatgattagtgtaatttactctagaagaaatattaaataaaaataaatatttttttatgtttaaataattcatgtgttcattttgatatatttttaaaaaaattattatcaaatgttttaaagaaattttataaaattattaatttctcaacaaacatgtacttaattgttcgtttcatttaaaagaatgagaaagaagtgaaagtttcatcaatttttgagatgaaaatatgtgatatatttggattaaagtagagtataaaggtatgaaatccacattatttaaatcaaaattaaagccctcgaagctcgaaatagtagcttcttatattttctttaatcaattaacgattttttttcatactttgatattcgtaaatctaactaattttttttatagttttataaccaat

SEQ ID NO: 292 - DNA, 1684 bp, Glycine max
  Soy_ogl_428 Gm02:7004601..7006284 Cluster 1
ttatatatcttcatctgtgatcagataactgtttaggaaaatctttagatgtattctttcatgcatttattatttattctaaagattttaatttggtgtagtgcttaccattaatgattatagtaaatgtttgattttaagtggcgaattcccgcatcgcatgccaataggagttgcattactcttcttcgcaaggacaaatccatcccatcaattttggcactattaagtaagcactatgatagttgagtcgatatgcactaaaactgtgttttcctttcgaatttcactcatataaaggaaacagtatatttagagagtaaaaatctcaaattataatgtttggtagaaaaaaaataataaattatattattgatataattagtttatacaataatttttacactattttttttcttgcatttaagcatttatattcatatctcacttttctttttccttatttcagtctttcattaaatctcgttatgatacaaaacttggatactcctcaaatatttaatgtataaatacaatttctcaaaagcaattattaaatttgagagaatatcccctctctatctacacacacgtgctaattgaattggattggtcagtcagattagttaaataaaaaaatcggtaaagtaactgacttagaaaacttaagaaattgaaggaccaaaatgttggttaaaatgaagtaaaaaattggtttgtatgagatatcagaaaaaatacctttttattaactttttaaaaaatttaatttttaaaatattttaagcaaataaaaatttatgtatgtgaattgctactttttttttagaagaatgtgaatggctactatttaaaacatttattataaattttgttaaaatatgttttaggtatttcataaatgaccaatttttgttttaagcccctaataaaaaaaaattgttgcattggatctttcatctatttataaagtatcacattatcatttaattaattataggaactcaacaaaaattttgatatatcaagttttaaagtaaccaaaaaatttgtcaagcaccgttacaaaaatcagaatttatccgttatagttagtgatagacatgcatgtgtaataaatcgtgaagatattaaatatgcctctttaagtttcctattaaaacttgagatacacaagttttcaattcaagtgcagtcctcactttaggtaaacctttactttcaatttagacatggaaaaatctccatcgatcaataaataaaaaatgttagacacttagacagaaaatggagtcgcgtggaatatctcaaaaatatgattctataaaaaaatgtacatgggctatatgaataaaaaaaatcattttgaggttttcggggtcagtctgctctatcttttgttagcagaactcatgtaccaaatattgatacgctccctcaaagagaagcgaaaatgattgctagtttgaattagtgaaatagtgtgcaaaaaatatatataagaaaattgaaaacttgtattatattatttggatgaataaaaataataaagaaaaataaaattatttatttatttatttagatgagtggaaaaaagagtgaaaataataagtaaattatataaaaaaattatattgattataaatagacttaacacaaacaaatttagaccatttactatatc

SEQ ID NO: 293 - DNA, 1400 bp, Glycine max
  Soy_ogl_991 Gm03:39905201..39906600 Cluster 1
aataaatacattgtttacttaaaaaataatttaaatattttttatatgttaatgtaattactaatcatcatatgataagcttgttaatttttataataattatttaaaaaattacgttatagatgaattataatatcagaaaatctaacttaattgatggtgtaatatgcttaagttgttgtaaaaaaatttataccaaagtttgacttctctctatgaaaaatataaaaagatgaactccaacatgataacttttgtctttttatactaataacatcaaaatttcagaataaattataattttagttcctatttaattcatcatccacaatattactcacattttttctagtgattttactttccatatttaagaaaatatgcaacttttgtcctttattttaatgattattaataatgtgtcaggattatgatgagggggaaataacacttaaaaattaacaaatattttaattaattaaaatgtaaaaagaaagtaaaatttaggttgggttgaatttggatttttattttactttaaaataaaaaaagatgtaaagggataagttgggttggatttgtgattattattattttttatcttaaacccaactcaatcacaaactaattgatttggttaattcaactgggtcttaacatttaaatttattctaaatttttcaaaactatagttgtaataaggactcttaaaaaaagttgtaaaaaggaaagaaaaacaaacgctgcatcacatgcaccatacttagatgaagataaatacaatgtactcaaataataataatagtaatagtatgttatatcaataggtcaatggattgagtttatggattcaaaaattcaaaacatgtaaccaaacctatacacaagaaccggtttgctaagctgagtttgacccaaaactagaaaaaccaaccaaaataattcagttgatttagataattaaatcaagtttgtcagttattcagattcattaatccatccattaatacccctataattataatttgttcgcttgatattgtagttgaaaaattacttgaaactacacatactttcacgtaagtgtatcgtgacaggatccacatccattagaaatattctgtcaatgtaacagcagataatggtgacagatgtgcatgtggggctttgaattgactctgaagggtcgaatgtgggtctttttttttaacactctcttcatattcttttaaaaaaaattatgatgaaagtacacgacaaaatttccatctgaattattttaaaagaaaatctacaccttattttcagatgcattgaagtgaagagaagagataaatattaaaaacataaagaaagatataatataatatgatagaaaaataagaaaacaaaaataaaaa

SEQ ID NO: 294 - DNA, 1657 bp, Glycine max
  Soy_ogl_1415 Gm04:45440844..45442500 Cluster 1
tatttaataatctttactacctatcatttgatatgcttctaagtgaaaatatgtaagatttttttatataatggtgacattgaaattaaaatttataattttatatgtattgcgtatacttattaccattaggtcaatcttaatagttttgtatgatgtgaagttaatattaactatccagtcatatataagtatatagctacatcggcttgctaaaatctaatgttaatcattttatcatgttcaatacacacatgcatacacatatataatctcaataaaagtagcatattttaattttggtttttaaaaatatattatttttttgtccctccaaaaatatgaaattattcttttaaaccctaacattcatttttagataaataaataatatttattttaagattaaaaaaattgagaatcacatgttgacgtgataatacatattattgagagtcatatgatgatggtctcgtaacttttcattagacacataagcattactaatgttatgatgactgatgagaatagggaagtattgatattagattttacaaagacaaaactagaaaaaaaaagttttatattaaccaaaaccaaatcaaatttactgatataaaactagagaaaaactttttccttgctaactcaagactgcaaaattttagtggtggatttttttaaaaaattacattagattgtttggttactatttttttaatttattaaaggaaacttaattcatttaaatgaaattggttagttagttcgttaatttttagttaccacttcaaactagctctataaaagcattgtaaacgatccaattttgtacattattcaatcaaagaatcatttttttaatctctatattttaagtcaaacatggtcaagatctctatttttatattgagaaattttatccttaaactttaatatatatatatatatcgatttagtatctcctctcaaagaattcatcatattttttcaaaattaggatggtttaaactcatatgttgttttaaattacacattaaaaaaatatacttaacaaagatggattgagggatgagaataagctcagtccctcccctttttttttcattttcttctttaagttttagactcttgttgttgggaagtcactttaaatcctaggtaatttaagttgatttaaataaactcatttaagggcgtaaaattttctcaacaccattttttttcaattcacaagtaaaaccacttgttgatcatgactttagtggctccattttcaattttttgtaagtgaattataacaattttctcttataagaaaatttactaattttttttttggaaggcaaatttactaatgttattatatatgttaaaattgatttattttgtataccttcttatatactactatcttattgatttaaaaagttatatttacaaagattatttatttttatactcttaacgggggaggggatgcatagtgtataccttacaagaaataggaaataagaagaaaaaaagttgaaaaacgagagatgtgatgatgagaagaagaaaactagagaaaaatatcgtgtgaaaaattagatattaaaaaaaacaacattttaagttttatttatttatttatgaaaatcaacactgtgagtta

SEQ ID NO: 295 - DNA, 1331 bp, Glycine max
  Soy_ogl_2645 Gm08:12999001..13000331 Cluster 1
attttaaaacttttaaaatatagattaacttaaaactaaaaaataatttaaaagatcaaacatatattttattcttattttataagtactaacattttcatgaattctgaatgttattaacatttgttgttaatcaacttaagttatgttttcattttgttaagtattttttgttctcaaatgtatatatgtaaaaaagttttttttttcttactaaaatatgtagaattaaatgtatattgaaataacaatttcaacattttaaaacaaaataacatgttcatgcatcctaccagtcgccatactaatttaaatgaaagatacatgtatttttatttttcatcattttacgtacttatttttcattcaaccatgtcggatgaaatgataaaaaataaaaaataatcaaattattctttagtgcatatttatttcatttaattttaaataaataattgccttttatagatatttcaagaagctataaataaattattatttttgtaaaataatttaataaatcaatatgaacacaaacttaatccgaaaaattcagcaaaaaaaaaaaacaaaacttaatccggaattcagaacatcattctgacaacaatattcgctttttgcttcttgaaagaatttaaaacattatttttcagaatttagacgtccccatgcaagccagctttctaccactctaattttaccaaagaaattgacaaacaatataaaatgtttcttctcgaaatgaaataaatttacaccgttaaaagattatgctgaacgaaatttagcgaaaaaattagctgaaatttaaaaagttattggaaggttgaaatttaaaaaattaaccgaggaaggtgaaaactaaaaattcaaaaatctagtttattaaattatgattatgtttaataagataattaagttaatttttaatttttttactaactgaaaactcatttgacaatttaataaacaagttttttttagtaatttttaacattttttaaaacattatttaaaataatatttttaaaaatattaatttctagctttctatattttttttattcttaatataattatcactcattatcctttttaaataaatcaatattttaatattattttacttgatcatacatttaatgtattagtgttaacccatcttttttttcctccaacctgtaaaccctcgttttgtttctcaatgtgtacactaacctctttttttttttccaggtaatgatattacatttttaatttaacgactgcacttttttttaataatttagcattataaatcaaaatattgataatgatagatgatagct

SEQ ID NO: 296 - DNA, 1520 bp, Glycine max
  Soy_ogl_4675 Gm14:5393968..5395487 Cluster 1
tttcgacggattagaaaccctaatagggccatgtcttttaaagtcgaattgatttgttttccgaataattgcatcctatatcagcatacatacatgatgatgccttatgttcacatctggaaagcgaaaaggactggttaaagttttgaaaacaaaagaagatgccacacaaaactttgcctcctaatactacatccaggatggagcaccctgtacaaatttcgcacgtgtcaacattttaacatgatattatacccaggatgacacttcttgcaagaggacaaaagataaaagcaagacatcactcaagatgattttcttgaatctggtgtaacaaaaataactactacaccgtaaatagttttgatactactctagttttgtaaataatttttttattactattattgtataaaagtcaacaaaataagatatgcactaataatgtacaatattttaatattataatctaattaaaaatatgatataaaataagtttatttaattttataataattatacggcatatcaattcttatttttaataagttgataacataaaactttaatgttaataataaatattcattaaatttttacataattaaaatttaaattcacatttttaatatttaacggtttaaagttaattttattaaaaatagttatatacttaactttaaaataaacaatgacaaaaattatactattgattttggatataaaataagcaatctcttaataatagttatatatttcatcatgattctcaatatattttattatatttttaataattttttatcaatttttaaccaatattattaaaatacgtgatagcaagactatttttaaaaaatacataaaaataatttttctatcaaaattatgttaaagaataaagtttaccaaacattattttaaatttaatgaatataacgtcatgatcaaataaaataattggtttcagaattaattttagatatatttttatatatttaatttcatgttaaagaaaaatttaaaattaattgagttgaaataaatttgagtaattttatgttggattcaaaattctatattaaatttgacctctaacttaattttatattaaaaatccaaacataaatcacattttaaataatttcttttatttgcatttttaacgtacattctattctacaatttacaattcttagtattccctttcttctatattgtctaaattctttcaaagttgacttctttaattaatttctttacttttcggagcatttgcagttctttgtttaattattttcaagtcaatattttttcaaatgtttaagttccgtcactatttgtcttttatgttaaattgatctataattcagttgaatgtgatatgatttttcataagtttacttacatatcaaatttacatacgaaacaaatatattttaagtttattaattaattatagataatattaaatataatttttaatgtgattattacaaattacaaagtcaataatctta

SEQ ID NO: 297 - DNA, 1983 bp, Glycine max
  Soy_ogl_6350 Gm19:2642918..2644900 Cluster 1
cttgtgtaatgtacaaactaaattactagtgtgttaccgaaaaactaaaatactagtataaaaaagggaaaaaataaaaataatcactgtttttgcctagaattgatcggatatttatttcttcattggggctttggtgccttctagatggctggatacttctaaaaacatttcaaagtttaagtgagatttcaacctaaagtcataaatgagatcatatataaatataaatgatcaataacttatcttgagattctcatatttagtaatccaatttttaccaaaattatacatcttaatcacatcttcccactactttattatatgagcttatgagaagtagttctcattgtcagactaagtattcggccggatacctatcccatataatcacattaatcaaccactaacattttacatgcaattaatattcataggaagagaaaaaaaaaattacaacagaaagggagacttactgtatttaattgtttttaatagattaatattatttattaaataattaataattctgttaaaatttctacaaatatattattgatcagtttaaaaattacaatttaaagcacgggttttaactaatttagatctgggtcgaccctgttgtatctctttgttttttctaaaaattaaaataaatttgttgagatgaaaaaataaatatgcagcttattcatatttaaccattgtgtgttggttgatattgagacacgcgttttatttggaaagaccaatgcaacgtggcacgaaattgaagtttcatgaaatacttgggaaaatacgtgactgtatttgaagtctggaataaacggtggggttaaataattttcattgtgatgaataactaaataaaagatttaattagaatattttttttatataattatctaatcgcatattttcatacgtaaaagtgttttataaaggtttaaatagttttagcgttttttgggtgtacataaaagctaaaactagtttaaatagtatttatagaagaatgtaacgtttatgtactatagtgtgtgaaaatataaatttttttacatgattaatatataatttttttctttgtaaaggaggaaaaactagtttaaatataagacataaaatcagacatttcaaaactagaggaatgaaaaacggataattattttagaaggattaaaaataaactttgaaagttttgtagaaataaaaacatattatatcctctattttatcaataattcattaaaaattccaacttaggtttcaaattttcttaaaatttaacactgggcaggctaagcctagcagctcatgggttgaacttggacaattttgattgggcaattacataacgcaccttatgtttttgcttggtacacctcctaaatttttaaagtccccatcttacccttctcaccttactcactctcttctcttcaccgtgggcaacaccatcaccaaatagatcctgtcctctgagagcatcaaagttggactcagtaggaggcccaggcctacttatactcgtagtcatattgaataacatgtcgtaaattttcaataggaactcagttggtaattttttaaaaaataatcataggtaccaaatacaaagtcaaaattttcaatagataatacaattagttcatttaatgcattttattacatgatttatgtattttaaatatttctaattttgaaaattttatttatataacaaaatttacagttttatgaataatattctataagtaatatgtgcgtttaaaaaattgaatctaacattttaatatagtttaatatttctgatgaaaaaattatttttttgatatttctttctatattttcaaatctaaaaataaatcaagatcatccatgtgctgaaagttggtaattattttaaatcttaaaagatttaatacattctgatctattcagttaaattaaatgtttaattcaattctttaaatgaataag

SEQ ID NO: 298 - DNA, 1454 bp, Glycine max
  Soy_ogl_6756 Gm20:34750252..34751705 Cluster 1
tatgcaaaaaaaattataatactgttttcaatatagaattaatttatccgaaattttcatttagtttaaatatacaataacttacatgttaaattgagtttagatcattaataaatttaatctaaccttacgtatttaatagataaaaaagaaataactaaaaagttttctcataaaagggagatcaaattcattctccttacgttacatatgccgcccaaaggcgtatgtcacattcttgcaattaatttgatttagttgtgatgaatgctttgactgttctcagaaattcgtacaaaaagaagatggaattgcatgtaacattaacttgaagaaaggaatcttaaaaaaagcagattttatttcacacactctttaaggaagtttttgttgctgtgtagttgttgtcaaacaatcaaattatcctagtcgtgttcatacttaattagagcatctccaaccgactattttataagtagtttagtaatattacttaataaatttttatcattaaaataaatggcttaataatacattgtttatataaatagtctataaacaataatcgttgtttaatttatttttgtcaattaaaaaatcattttttaattacaaaattttaatgtgactcaaattaaacacttattttatcaattttagtaattgagtaaaaatttatgtaatattatagcttcacaaatttaagatagataactcatttaagcaagtattataaatactcttattctaatcgtgtttatacatagtaattgaattatagtaattaatgttatgttatcagaaaaaaatggcacgaacttggtaaattttaaaagtaattattgggtaagagaaaatgacaattttgtttttggaccgacaaaatgataaggctaacaaatatgcttttatgcccaccgtgtgttgagcatatgaagtattcatataaacttttgttatttattagttatgagattaattttaagactcagtaatatttaaagttcttaatcttattcgattttaccaactaaactacttcaaaaatattttaatgctttttcatttttcttaataacatataaataatttgttgtttatgttttcttttcttcataaataaatgaaatgcatttgtaattttgcctctacgtaaataaaattttgtcaaaaatattatttttgttccttaaacttccattcaaacttagttttgatcactatatttttcaatcgatgaatgtagtttaactattgtaaatatgtgaatttagtatcttcttataaggacgaatgcagaaatttagtaaagggagactgattttttttttctttacagttttttaaatatgtaattttaataaataataatttttaaaaaatatttactattttcacgcaagatccgtcactgcctccttatattaaaatttatcatttagcgaggaaccatt

SEQ ID NO: 299 - DNA, 1897 bp, Glycine max
  Soy_ogl_1034 Gm03:42081201..42083097 Cluster 1
caaagttcaaaccgcaaatgctatagctcacgagagcatgatgagtgatgatcctaaaatgctacccagtgaccatcgagattgaagcccagccactgagtgtcggtgagtttctaacctataataacaaagaaagaataagagggtattttggggctttaactttgttttaaaattaaaatggggtgcaggaagcaattggcaattgtgaatgatgtaaacccagtatagttttcaggtagggtcaacacagtccgtgatgatgtcgatctcatagcccaaacataagaactaccaaagataattcagcatccgtatatagctagataagataggggaaagagtcgctatttaagccatgtttgtttttggcttaaattgaccggagttcttattcaccaaaaaaaaaataaaaaataccagagttcagtttcctgtatcacaattaacttttagtttacaaataatgaagatagaatggattgagcaggtgtaactgacaactgctaactttgaaactttcagcaaatcaaaactgtgttaaacctgatttgaaatttttaactgtgtgagttattataaattttggtatttatcttctatgcctataaataaataaataaatcaatctatcaaattgaaagtaagataaaaaaaaaagatcagattatatctgtccaagtgagaaaagaattggttgatgctttttttttttaaggcaaaatagtatatatatattaaacgagaaggaccctgtaagtcactaggttattgaggcaataattttcggtttccaatttttttttatatattttttaataaatatttttttataaattatgttacagaatgatatattatttattgttgtttttattaacaaagacaacaaataatttttttagggcttcaatttttttatagatgtaagtattactataaataatttaagtgtaagtattatttattttaaaaagttaaaaaaattattttacatctattttgaatcctacctctttattctctaaaaatatattattaaaattaatatagagtttaaatttaatgaataaatctataattgatatatatgaagaagaaaaaatgttttggtgcaaatgttgatatcaaaatcatatatttaactaaaattctattggtatcaaccattttgtatttatattagattaatgtacatctttaatggaaagaaaatatgaaatcatgcttgatttttatttaaattctaaaaattgaaaaatattagataagaataaattgaaaaaaatagtatattacactttgatttattttttaaaataaaaatatttcaaaatgcatactaaaaaaattatactctgactaaaatattacattatattgaaattttattttaaaaaaaatacatcgtttctaaaataatattaataacacttgtgacaataattattgttaaaaaaattaaaactaaaatgatttaaatcttatatgacattacctatgtgaaaaataagttgattgaattttccgttttatatattacaaataaaatattataagtatttaaatattaaattttgatgaacataaaaatttgaccttaggtctcctgacgtctagacacgaccctctaaacgagatatgggaatcaatcacaagtagtgacaagatccccaacccaaagcagtacatagaaacaaggcaaagcccaaagcaaaagataaaccacaccacataacatgtcagggaccataaccagttatcctctacaccatacacgagatcaaagatgcagcaacctgtcaagcagcagatctgagacacagaagagcttgctttttccaattccaagatcaaacacttcttggactgatagactgcaatcataaaagaggta

SEQ ID NO: 300 - DNA, 1263 bp, Glycine max
  Soy_ogl_681 Gm02:45806438..45807700 Cluster 1
gctcaaatttataatttagagacagaaaagctataaatttatactattaatatgcatttatcaatgtgcacaataaagtatgtatatcatacaaaatttcttaaccaatgccgcttaaggttttcaaaccataataatctaaaaatataatgtgcaaaacccatgccggaaaaaatgtccaatttcagtgtataaataaaataaaaaggagtattttttttttcaaataaacttttccgaaaggttagtaatataatctttaaaaaacacttatcaaaatttcaatctgtaataattgtacccaattcgaattagattaactaaaacataatcctataaaaggaaaaaaaaacacttatcgatgcaaataaatatttgcgatggctgctgctggtcgtgattcggttcatctggacacctaaacctgtgaacctttgtcttttagtggggaagggtagtccccatatgggtcagcaaaatgacactggtttcgtttttttctctcctaataattaggtaacccaattaatttgattcacgaaatatatgttttaagtattttgtattatataattattccgtcacaaaaatatttttgtatttattttttaaaattattatacataatggtaaaaaaaagaagaagttatacataaattaaaaataattatttacttcctttatattgaaattattcatagttactaatttattatcagttatatatttcacaaactatattcttttataagagatgattgagaatatagtaattaataataatttgaaacttaaaagtaacggataaataaattttttcttttgaaattgataaataaaaataaaaaacttaaattaatttgcaagttcataaattatttgacaaaatttaattaggtgtctggactatttttttttaactgggtcatgcacttgtatttttttaattagttctatgcttgagacctaattaaaaaaataaatataagttgaagggaccatttaaaaaaaagtttctgaaacttatttgaaatttgacataatttagatattcaattaaaactactaattctcaattctctacggactaatatttttaactctacaatcaagtactctcacctttccagttctgcaggtcctaaacttagtattttcattattttcaatctacaaaagtgtgaatactgacatgcaaaagaaagaattataggttgtagagacttgtaaattttgaattaaatttaaactattagtcaatgt

SEQ ID NO: 301 - DNA, 1358 bp, Glycine max
  Soy_ogl_1171 Gm04:2039701..2041058 Cluster 1
atgggtcatatgatgatagatactttttttttattttgttttattgttattatttgtttgtaatgtggttgtcttgattttgaaaatatgcgttgcaacaacatacttagttatacttgtattctcacgtgattgggggaaatgtgaaggaaagaaaaaattacagatttaaattttccaattgacatttttaacaaaattaaccaattaatgtttactaataaaaaaaaataatagttgtattcctattttgtttaccttgctttgagttgttcttgttatcaatttatataacaacatatacttttaaatctatttaaacatgccaacctatactaaaataggaaatatcttagaagcatttttttttcctctaaaatttaatggaatttaagaaaaaggtgatatatattatgtggccatataagtttataggattcaatcttggtactctaacaacaacaacttagtaattgtgccactcttcaaacgtgtttacttttgcatcctgatatgttatacgtgcgtttaagcagatgcgacaattacaagcttctgcgtaattgaaacataatggcgtgattttattaataaacatgtgtgttggatgtgtacccaaacatacttaatcatcgaacacacagcgcggtaatggaaataattattcaaaaatactttgatacacaataagcttcatgtttaaacttaagaaaagagaatgtaccttaagagtaaagacccaatatagagggagtgattggaacaagtgagaaaaacatattatttcaataattgattatatgcttaattaattattcttaaaataaattataattagaaccaagttttgattaagtaagtttgctgaaaagtagtttaaaaataattagaagaagaatatataatggttggtcacctactatcaactaagaagtaagtgagatgtaacttgtaagcttgtaatagatttgaagtcaaaatgcaattccaaagcagtatcatttaaaatatttaacaaaaaatattattaaatgagctaattaagatattaatataaaataataatgaaaaaatcttgctttctaattttacgacaatttaaaaaattataataagtaaaatataagtcgcatatataatttaataaactattaatttggcctttttaaatatttatttgacattgattttgcttttaatttttagtgagatggagtgagtcttttaaacattgaaaagtattaaaatctttttgtgatatggagtaagtcttttattttaattatgtaagtttgctccttacatataatagaaatgttttttctcatatattttttttatgaaatgcgagatgagtg

SEQ ID NO: 302 - DNA, 1100 bp, Glycine max
  Soy_ogl_1380 Gm04:43952001..43953100 Cluster 1
ttcctcttgattccattgttgttttgtaaaagtagtatcccatgcaaaacccttgcaagatagatcaccaaattgagtttaacgagggacattttcttttcaaatctgacacaagtttgtgaaggataattaatttgtcttgtaaacccctcgtacatgtagaatctaaaaattgtaatttatcaaggggatattttcccttgcaattccttctctattcaattatgacaaaaaaataattaaagtttaaaatgaatttaaatcatttagttgataacataatttaggagatgaattgaaattttaaaataagttaaagtataacataaatttatatgtgtatctattagtgatatgaaaatttaaaagtggagtggtatttcttaacggttacttaacgtgtgcaacattgtacacaataagaaaaattaattacttatgtttacataatttagatcaatatattattaatgattctttcaaaatttaatatatttttcttatttagatcaatagaatcactttcaatcaaaataaatcatctctcttatttattaaaaagattcattttttcattaaaaaaaaaagataatatatctttcttatttgttaaatatattcaattccacaaaaaaggtattgttatttttatttcttataatataatttattctctttaatagcattcttactatgttccgatagatttattttattgagtgcgttgaagtcaaatattcctacttgagtatggtatcatttttattttttttggatatgattatgatatccattgatccatagtgattagtgactagtgatgagtaacgtgatacattattgatggaaaaatatatttattatgttgattaaaaaaattcagaaagagaaaaataggaattgaatttatttaacaaatgaaaaagagatattatctttttattggaaggctaaccagtaacatattgtttgaaagatactttacatagacaactaatacatctctacattttaccacgtcatgtaacactgttttaattaaataacaactaattaaaaactttaattgcgtcatgttctctacttttcacgctctcgac

SEQ ID NO: 303 - DNA, 1213 bp, Glycine max
  Soy_ogl_1131 Gm04:253573..254785 Cluster 1
gttgtgaatgatataaaactgaaaatgtaagcttgattaccctctggaatactgaattttctggaaaatttcgaaaccagtgaaaacctatcaagaatcagtcatcctggtctaaaataggtaaagaacgggtagagaaaattggtttgaatctacattttttaattttttattttctttggaaaaaaaatatttcgagtgtaataaacatacattgttaatataaaatataattataaattatttttaatatcatttttaggttattattataagagttaacaaatataacatacatggttatcgatcattcattatttattttaatatttttttatatattttcagtgcatgcattatttattataacattttttataattaccgaataaaaaaatcagtaaaagaatattatacttgattactttcctctaagtaaatgtttacttgatattgtaattaatacatgtataaaaaattcaatacagtaatcgattatcttatatataatcaattactttagctacaaaacataacttaggtaatctattatagtgatgtgttacttatagattactcaaagattagtagcaacttatctaaatgacaagtttgattcatgagtatgcaggtactaaatatttagaaagaaaattttatcacttataatatatgatatgaatttaaaaatacttctcacaaaaaaatattaaatatattttttaatgaaatttcatgccaaaattatcataaataattaaagataagattctaaaatttatattacaaatattataaattttaattctcatgtttttttaaaaaatatccagcttcttatttattaaatgaagaaagtcttaaatattttttttatacttttaagacgttaagtgtatttctttttacatttaatatttaaataaaatattagggtgattaataagaaaatattgtaagaggttataatattatttgtattttataaagaaattattaaatagaaaatgaatgtattttatgtctttgaaacataaaatacttaatactatgagtctaataaatatttattgttgcagtaaaataaaatatttattgtcattgtaaaaaattttaattttttttggattaactttattatcttgttaactaattagaaatcatctttaatatttattataaaataaaaacgtttagtgtcaattttaaggta

SEQ ID NO: 304 - DNA, 1282 bp, Glycine max
  Soy_ogl_4701 Gm14:5954919..5956200 Cluster 1
actaaatcttaatcttaatataagaaaaataatataataaaatatttaaaagaagaagactcactacaaacactaactagaaaaaagaaaataaattgcttaacttgctttgttttttacctcttaatatctttgaggataaaaaatgattttaatgactcaaaattgaagtaaaggaaaataaaagaaaagaaaaggaatacaatatgtaataacattacttagttatgcctaaatatttttagtagataacatttattatatattttacatgttttgagttttttcactaaccataaaatatataaaataaactaataaaatatattaatatttttaaacactaaaattgtgaaaatctaaaaaggggtgcactaattggaaggagatgacacatatttgttaatttttataataattattttaaaaactgtattatcattcatttattatggatttatagtgtaaaataactttacatttttattgcatgaacatttaactcttattcaaatattatgaaaaatattattttttagtttgtttaaatatcgtgggttctccgtttgatatgcaatttaaagggagtaattgaaaacatgtgatatttagaagtatcgaatgataactcagcaaaaggaagaaaaaaaaaaggcatcgactgagaaaattttaaaaggaaactaggtaacaaaaaatatttattaagaaattattcaaaaaaaataaaagaaattaagtgataaaaacaaaaatattttttaagaaataaaaatctaattaatgttgcgtatgaagtaaaggtctagttcactgtataccctgaaaaggcccaaaaaagtcaacacaagcattgggctgatggatatccttgtttagtattccacatgctcattctctatgtttgttcgtctcatacacatgaggagttgcagaataatattttgttttagtgatcaacttgtatttttttttatcaataaatgttcattctattagaaatattagtggaaaagattcaaatccatagctcttctctccctcctttctctctttatctttttccaacggatcaatcaatcttatatctcttaactagcatttgttcctaactcatctttgaggagaaagtattatgtgatgcagaccatgacatatttctttagagtgaaaaatatagttatgtatataacgtaagtggagagtgatcgaaacctcacaatggtatactatataataatttctttcctcaaacttataaaaggttcattcacaaagacaa

SEQ ID NO: 305 - DNA, 1405 bp, Glycine max
  Soy_ogl_4915 Gm15:8407001..8408405 Cluster 1
tagctttcatcatcatcaacaagtgggtagctaatcgagtgggacttaacttagtaatgctatgaaaagacagagaaataatttatttagaggagatgactattgtattactccaacgtataagcaacactacaatattttttcatttattattattactgacgtattaaactaatcccctaaaaatatgtattttgaataaattctttaatgacttgtttttattatcaaattatatgatacttaaagtgagtcaagtgacattatcaaaatagtccttgtttcaaatattttaaaaaaataaaaggaaaagaaattaaaaacagaatttatgattatttcgaagaaattaattcttgttttttttattgaaatgtcaacattaattagcattggtgagaagtgtaaatgaatttctctttataatatgttaaagttgaagtacaagttgtaatgttgaattgctgagtcttagtcaatcaatttaaacttcaacttcatgttgtgaagtcaatttttaattaggtgtgtttgtttcatgaataactttttagtcccaaaaatattagtcttaaaaataaatcactaggatgttatttttatgaattttaaaaaaaatgtgtttgattaattattaaaaatgattaggaattttttttatatgctacatgtgtttgattgatatttttctagaaatatatattataattattaaaatattcttattgttaaagtttgttaaaaaattacaaatgtgtctaagtataaacgtaacaatccacacgaaaattccaaaaaatagtgaacatttattacaaacaagacaaaataatatatgtgcataaggtcaccgctatcctttttttttaatgtctcacaccaaagaaataaaacactttcataactacacaaaatttgtgagaatgaaattggcgcaacatgcaggaacgaaatttgtaaggaaaagaaaaacatagcccgtaatatgaaggtagcattgaaggatagtggaatagtgggccgtaaggagtatatatctagatttttactcacatgaaaataatttttttctatttcctccgccgggatgattaaatattgaaggtgaaattatgattatgtttaataaaattaattaataaactagctgaatgtttataagttataagatatatatgagttagttgaaagcttataaattaactaatttaattgaaagtgtttaataaaattaactgataaatgttagataacataaagaaataaatttaatattttacatttgaatttatctttaataacatatattcttagaaagtaagataataattttaaaattttgtattataagaaaatggtaatgatttggtgattttaaactcaaatttttctttttctaaaacag

SEQ ID NO: 306 - DNA, 1200 bp, Glycine max
  Soy_ogl_5793 Gm17:39661001..39662200 Cluster 1
acttttatagtcatagatgtgttggtaaaataattagttcatgcatgtgtataaacagtgccatgatttttaattctagatcccacctaaatttcacatttttattagaataaatttatgtttgcagttgatataaaattttgaaaagtattaattttgtcctcataaatctttttgtgttaatttaattccaataaaaataaaacatattttattaatcatcagcactacttctattaaacgattctatgacatgactaacaaatttattttttctttttatcttttcaagtacattcaaaaaacaccaaaagttattgttacttcatttttttccccttgatcttactagtaagtgtgagaaaatcacacaagagatgaaaaattgtaattttttggaagttttagttttcagaaattgtttaatttattttgagaaatttaactgtcataaattatttaatttatttgtaacaaaattgcatgtataaatttgttagttatggtagattaccgtttcatagaactacaagtgaggatcaataaaaatatattttatttttacatagactaaattaatatgacaaaatttatgaggaaaaaattaatatttttaaaattttataggattccaaacatattttatccttttattttaactatattttgcactccattaattttttttattaacaatcacttttatatttattggtacatcctatatactaagtttattctttcattatatgaaattaattaatataatatggaaacaattttatttttagagatacttcaaaaattgatatttatgcagttattagtaaatttaataataatatctagggataagagtaaaaaaaagaagaagcaaatattactatattttcaattaatagaaaaactgttgcaagcttaacttttaattggagcatctttaaccttagttgcttgttggaattcttattctaaaataaggttgcttttttttttttcattgaaacatgttatgtgacacgaaaaatttctttaaaaaaaaaagtgtcttggatccctccattgtttggtactattaaatgcaatatggatggttggcgaggggttctcctgggcatgctgctgctggaggtatttttcgtaatcatcttggtggcgtgttggcatgcttctcttattatgttggtattcaataagctt

SEQ ID NO: 307 - DNA, 1370 bp, Glycine max
  Soy_ogl_2417 Gm07:38289531..38290900 Cluster 1
cacccattgtttgggccataaggtgaactaggcttgaagatgatgtggccttatttattggctaagttaatgcagactttgggccttatatggttggaccaagacaaagctttgggcttgatacaaacttctgagttaaattaagattttttttttgagaggtagttaaattaagaatttacaacatacttttattatattaaattgtactgaacatacttttttgacagccatttattctgatagtgaagttgcttttataaccagttcaaagtttaagttgacattttctcttaatagcacaaagtgacataactaatcaaatttaaaattaatgaaaaatatactttaacatatatccgggatcaataatgtcatcaaaataaagtttaacatatttagaaaatggttcctaaatattattatatctcttcttcatctctaaacacgtgacatttagaatagaatttgaagatgtattcgatcaagattttaaaatatatttttttttataaaaaagttaatgtcgtattccatcaagatatttaaacaagataaataattttatgatatttaattaagatttttaacattatttttttatgacaataaaatcaagtaatattcaattaaaattgtttacaacttaaaaaaaaattctgatatttaaaatcatacaaatttttatggatcatttttagatggattttaataaatttcatataattttttaatataaaatataaatattacatccattaaataatcttactcaactttcttttttttgccatcagttttcacatataatctcttctctcttcgttgcacttaataacttcacaacagacgcattctcataaatttccacttattgacaaagacccagcaggtgtgaacaactttgttcttttaccgtattaatctatgatgggcatcaaattccaagtcctaggacgttacaagtgaatttgaggagcaaatagcaagctatatgctgctgcttctattctgtactagggcttgttcgtgagttcattcattaaaaataatttcttttgtttgatttttcttaaaaaaagtattattggacaaaaaaattataattttgcatctattcttcaaacttaagaagaagaacgagaagatggtgatggatgaaagaataatataggtggacataaatcaattaactatttaaagatttaaacttcaaactaaaaatcttaatcataatttttttttaaatcttataaattataatattcttacaaaatcttttaaaatcacatattttttatatcaaaatagtgtttcaaaatcctaatcgtatgtgtcccgttagtgttcataaattattatctcagctc

SEQ ID NO: 308 - DNA, 1500 bp, Glycine max
  Soy_ogl_3825 Gm11:10394501..10396000 Cluster 1
tacctctctttgattttttttctctctattttggtattgatgtgcaatatatagttcaatttctatttaaaattcacaaattcaaggctagcatgaggaatcaattcattgacttgcaaggatctactttagttaaatagtaggtagtgactattaactgcaacctgctgaccatttactaacgtagttaaatggtcataaatgaggtcatgtggaaagaaggaaaaaaaatgtcatgcatcaatttggaacacaatatagaaccatatttgaattggatattaatcttctgagctatatttttaacaaaaattaataaattaatatttatcgataataaaaaacatctaccattaatcatcttttgttctggtttagcagtacggaagcagtgtgtaattaattacaccctgctaacatatgcacgttactgtgttagcatatgaaattggagaaggggaagctttcttttacaatatctaaacaaaacaatgaaaaataacaaaaaagataaactcgacgaattacaatctcctttactttataaattaaatttatgcaattatatatgtgatacaaataattttcaattttaaatttataacttttcatattttcacgtgtatatgtttttaagataatcatattcaaaacattattagaccctaaatataaattatttttcaggagatattcaatctttagtttacaactttatggagagccaatctcctctaatagatcaaatacagttaattctacctattatataattaattatacagtacacaatcatataaaatttgtcattttatcaaatatataagaattgaaactgtgataaatttaaattaatttcataaaaaaacatttttgtataacactaataatagagtgctaacaacatatttcttgtaagttataacacactctaactttattattggattaacatttattattggtttaacatttcaattgcatgtaatcaaaattcaaaataaaaaatataaacaacacttggatatatccatacgtgggatagtagagcacaccacacattttttttaaggtttatcatgtcataaaataaaactagaaatagaaacaacatccctaagcataatcaacttaacaataggtgagacttaaagtaatttttaagaaaaatattttactttaaatgagataattacgtagttattttttgtcaacatttgtgtatttttggtcaaaaatatgagattcttttgctttataaaaactaacaagaataattttttttttcatagactcaaagctttaatttgttttatctttataccgtccttcaaggaagaaataacatctctaaaaaatagctttcaatatgtaggatggagaagtttgagtgtataaataagatagtcataaccatgaactgagccactagccgttaaattaactcagaagctcctgatattagaaaagtcgtaagaaaacaatgttgttgctattcta

SEQ ID NO: 309 - DNA, 1998 bp, Glycine max
  Soy_ogl_1009 Gm03:41126255..41128252 Cluster 1
tataagtactgagtttggattttttaaataaaatttaaagtttaaattttgtaaatagaaaaaaattatacatacaggaattttcactgtgctgcctactacaaaatcttggaaactggccctattcatattcatcctatatacggggagattgacgaaggagctgggagcacgaaacatcatgcctataatttttcttggatgataatctgattagtgtaggagctttctcgttcgttagggtataagaaattagtttggtaaaaaaattaaaccaaattaattttaaagtattttaatcggttcaggtttatatcaaataatcaactcaatctaaaaattggtttaaaattaaatttgttttaaaagttgatttgaaaataaattaatttttaatttattttaaacaagagtcgaatttttaaactattttttaaatgaaaatatatttaaataaaaatcaatttaattaatcgagctgattttataaaaaaaattatggaatttattttataaaatagtatactcaaatttttaaattagttaaaaaaattaatttgatttagattcaaagttagagtacgattcaatccatttttttcacacccctgtccatgagtaatagctctccaaaattaaacaagtttaaaaaatgaaaagcataagaagcaatccaataataaatttattttgattgactgagtggactggattgtctgaaacacttgtatcctgagtactactttctttctttcttataactttctagtttttttcctggatcccgactgtcccattgcataatgcacgtattttagaagataatattcatccatcaatctacacctatcaaagcaaaccgtgtgtctcaagtccagaatagttgcctcgtaatcgtaacatgacataagaaaaaatatatttttaaaataaaaaattctacgataaagaaaaaaataattaaaagtaaattttacgtacggaaactatttaagatttcataagagtcttcataagattgcacactctcaccgtctcttttatcttcataacatgtggaaacctcattttatgtatatttttgggtattttcttaatatctaaatatagcataattgaaaaataatgtgattgcttaccgtcaacaacaatacaaattcagaaaaaaaaaaataaaagaagacaaatagtaatcataaagaaaacaataaactaactaattaagagtgctttttaggggttaatttaaaatgctgagataaatatatcatgatttttttggtataaaaaagttgtactcaaattataacttccttttttttttttgcagaaactaaaattagaattaatgatctagtttatactacctaaacctcttaccactatgccactaagcaaaccctaattatttctttgctttaaagttttaaaaaatcatataaaatatatgctctgcaatcttttttggcatctttaatatcaggtcataatcgtaagggtagttttaaaatattttattatcataaaaacggcttaattaaagtcttacaaggtgactgataacaggtatcgtgaatatacaatatagtataaaaaatgtcgtataactaatgatttaattttagattgatttctattatctacttagctatcaaatggggtggagtaatttcaatttaacaaattatcttgagttattgtgacatgcccataattacgttagatattcagaaaaagaaagaggaataattttattgtttataatgattttatctaatttgaaaataaaaaaatctattaatataattatattacgagttaataataatataatgcattatattactagaaaaaactattttcatttcaatagaaataggtaaatcaatatatatttagttctatgtacgtagtattttttatcacacgccataaacataaatattatacagaatttgaattatggctcttaatttttttaatatttaatagatgcta

SEQ ID NO: 310 - DNA, 2442 bp, Glycine max
  Soy_ogl_1095 Gm03:451859..45413100 Cluster 1
cgaggattgattcaaattggttactatcatttataaatctagactgtaatactattattatatatttgttaagacaggtgttgcatataactttggttcggaattgaataaaatgtttaaagtataatcacatgaaatattttagtcaactatgattatgagtgttttgatctatataattataaaatggcacaccacacccactatgtggtgcaacttgcctctttaaggtgctcccatttccagaagtggcctcctaattaataatagtatttataacagtaaagttgtaaaggacaaactattaagtttctaaataggatattagggctttaaagttttagctaagtagtgttttggttcacacgtagaagatattgccgtacccccacagcgtcctcttaatattctttaagaagaatcttggtcgaccacctgtcgaatctgtaatccactacaggatctacccataatttcccccattatatatatagcacaaatttgataaattaatccaaagctccaatgaaattggctaattaaatgaataaaatttaaactcaaataagaagttgacagctaaagtcataaaagtcttcatgattaattaatagctataatgttaactaaatctcgtctccattcactcacgggagggatgtagagtggaataagggggactttagctcttaaccttcatctttttaaattatactttcattattatttttttatctgtactatactacataaatttaaaacaattaattttcttatttttattaaaattgtttgtaatttttatcttttttatttttctcatttataattttgacattttatatattattataattgagaaaaatactaattagtttaattacctgcagaataaaacatgcatggtaaataaataaattgtacggaagtaatataaaattggtgtgaaaaggggaaattattaaacaatataaattatcagtatatttatcgcacaagtggttcagtaaaaatgtcaacttaaagaacaagatacgcatactctgtaagaaaagttgtaatgatcgttctagattaaaaaaaattaataatttaaatgtgttagcacataacacaattaatattaaatatttagtttaggtgatgttttgtaaaagagatggaattaactctaaatgctaatgttaacaaattaagctctttctcctaaaagtgattaatacaatttttttacgaactaagtcctataaaattttaagagttcatattaagtagatcaaataaataaaattccatgtaatttaaaaaatatttaacatttcataaatcagctacatttgatggtacaaaccattttttataaatataagtaaatgttaattataaaattacatatttatgaatatttaatttataaaaaaattgcatgcataaacattaaggtgttatatatcacacgattcaactgttgaatctgcaaattctagaaattgccggcaaatactatttgaagaacaactcaatggagactgaaggatattatcagagcaattaaacagcatgactgtgttttgtgtagatatattgaagggcaagctttcatcaagcaacaagcctcccataaagagatcagaagaataacaagtgtttttcagtataggaggtgtgctgatgacaagcttgttagaacttggctcaattctaaggatcttatagtaagtccctgttgctgacaagaactcttaagtttccatcattgcaatagactttgtacctatagtctccacaattcgaacaagcactaaaggttgatgcattgattactagaccaagactagtttgtagaaagagtagaaaggctaccatctttgtttgaatatggaactagctaggaagatttagttcacatttacataaattttcaaacttactattttttacaaaaaaaaaaaatcaacatagttaatcaaatatatgatgcatcaaataaaaatagtggctggaaggataaaagttattagtttcattcttataataattaagaaggaaataaagaaagacatgttgaattaggatttggaataattaattgtaaggctataaaattataatttttgttcctctatttttttaaatataacactttaattttttatttttcaattgagaatttaattttttatttttaaaattttaataattttagtcccttatttttaaatgagacatattgtctcccacttttaaaaaattcataattttagttattgctaccaatttcaagaattaattcatgtattatgtaaatattgattgacatgtttattattcacttgataaatattttttaaaattcattaattgctaacaattttattaaaaaataattaaaaagtacataatcaaatctaaaattgaaaaaagaaattaaaattatagaat

SEQ ID NO: 311 - DNA, 2355 bp, Glycine max
  Soy_ogl_2867 Gm08:43278401..43280755 Cluster 1
cataagttagacaaattaggaagacattctcatgattcaaagttcaaacatttcgaaaaattataaaatatatatttgtcatgtaaaactgcagtgtacgcaatcaattaacatgttggagaaatacaccacagcttttcaatagccaaaatatatatgttgtgtactttaatttgtattatatagcattgattcccatataatacgatcgcagcatatatgtgatatgaattaaataatccgcaaaaagaagtacaaaatcataagtgctatacatagatttttatattatacgctaaacactactatgttatacacataggcttttcaccctatatataaaaaaaaagaaacttggctcaatgcatcatgatacaagtataattagttatggaggctacaattaattaaaaatatgatggtagagatatctttagtttaacgtagtaaaaattattgagtaatgatacatataaaggaatcaattggtctaattcgttcaatattctttgtaaagttgtctctccccttgagtattatttgagtctctattcttatttttttaatggatctgtcacctatgttttttttttttgcgccatcactattcaatttcttattaagacttagttttggagttctgttataagaattttaaaacttttagctttgctcctatttattgagaaataataaaactttaaaacctacctagatatcatataagtgatttcctatcctcttcttatagttttatttttatttcaagagatgcatataataaagttaaacacagttgacataatcgatgagtcttttaagtatgataaccagggttccattggttgattatatgtatgaaaaataaaaagattttgttgagaaaagtaaaatccacctcaatattctttttaagtctaaaaaagtaaattaattactgactatcgactaagaaatacttttgttaaatataatattgcatagtcatttatattctataatgatttaaaaatataaattatgagttaattttaaataaaatttatatctattttttttatatttattgttttatatgaaaatgtaaacatcattgggcttttgcttgaatgaatttcagattaaataataacgataaaccgactaactagctaattggtgaaaaacatgacaacaattatgaatccaaaatctatgctactttataagggagaaaaggaaaatacttattcattagacataatgcctctctcatctcactttcacgctcacgaagaaatacatgatttttaaataaaaaaaagaaataggagtatattaaagaaggtgattgagggagtataaattaaatgttagctaattatagggataataaatcaagtagctcgtgaagcattttaacttggccctgcaataaatatagatagattagccatgtttatttattaattaatttatgttatggttttataaaaaaatattcaattattttttaaagattgcatttcaagaaattgatttcttcgaaaaaaataatatttcctttttattttaaaatataattaaaaaatattgtctaggtcttactttattttctgcttcaaatatttgtataagaatgggaaaaaataaaagaaaaatatatattttcactattttttatataaatatttggaaactgaaatcaaagtaaaaaaaaaaaatgaagttttttttttttttttttatctataagatcgatcgaagacaggtaccagagttttcttaaaaataaaggtttaactcacaaatcctcttaggagcctatttacaaggttttatcattggtatataataataacattgagttttaacttaggacctcatatagattatatttctatctaaattttgtactaccaaaccgaccctagcgaattaacttaattacaaggtttattgcaaaatgaaattcttaattcttttaagtaagtctggtttttaattaaaacaactagtttattcattaaaaaatcgtattttaaaataagttaaatttaagtcttaattttagaacatatatagattaaaccttttcaacctaggcaaaactttatcttacctaactcatcagatccgcattaaaactcataatttttaagaaaaaaatgtttacttttatataattaacctctaggcaggaacttcactaatctaaagttcgaagataagtaaaccaaaccaaaacacaagttaaaaccaaaaggttttttttatagatgtatacccaccaatagatagatattatttacagaacattaaataccttttattactcattttttattaaagtaactctaactcgtggtaaatgaa

SEQ ID NO: 312 - DNA, 1538 bp, Glycine max
  Soy_ogl_6967 Gm20:416889..43995426 Cluster 1
ataactaataagtattttatttcattgtatgaatatcttaaaatttaaataatattatataaaaataatcaatttataaagcgaaatattcatagttcaatgtcttcaccaagcctttccatacacactccttgtatttaccatgtaaggcgtttgtgatgttcgcagtccaacttgtggggaggattagcatgtgttaagtccaccgttattctatttgttaattacttaaccgaccagcaagatttagttaattaagagattaaactcctttgcctttattgactcctgtatgtaaatcacgccaacatgttaatttatgtaaataagatttgaaattattgtcaacgacattcacatttttttttttgaaggacctagctagccacatcttaaaattataaatacttaaaaagttaaatatttgaagttaactttctttctcaaattatagaaacgaatatatatagcattcttacatcacgataaaggaaagaataattcttatttgctataaaatttaaaactcacattctgacatcatcccctacaattctatattacctagttattacttattaccaagttatttttaggactatgcaatacatcatttttttttgttactatgtaatatatcaggttgatttgcatcattcccccactaagaaaagtgccttagatgaagttgctgattaatggaaattaatatgaactattgcggatgtgattcacttgacctcaagtggtttatacctaattaagttcaaataaaaaacctcattgaaaaaagtaaatcaagcaaacctcattaaataaaaaaatataaattttcaaataaaaaatagcgcaaatatttttccaatcctttgacatcttctctctctctcttttttttagaagtgacgaggttttaatatatacaagcaggaaggattaacttatttcaaaaataatttttgttttttttaatttaataattataatagataattaatcttaacaattaaattttaagaaaataaattacaaaaataaagaataattcttttaaagttattcttcaaatttaattcctcttcatatatatagtacggatgcaaaaattttatttagtgaagacaaaaaatgtttgcaataattttatagaaaaaattattatatttttttacaaaatacatatatcataacaaaaaaattcaaaatatctatacttttatagattataattatttacacattttaatattataaaaaatattatatgattttttcattgtcaaattataaaaaaattataaaattaataccagtttattctctcttttattttttataacttttttcattcatttataaaataattatcttatagttataacactaaattgtttatgggaacaaaataaaaattattatatatactcttataaaaaaattgtgggagtaattacgtccgtaccctctaaagtatatatatataaataaataaataaaaggaggaatcaaataatattaatataaatttgataattatt

SEQ ID NO: 313 - DNA, 2140 bp, Glycine max
  Soy_ogl_610 Gm02:42539501..42541640 Cluster 1
gattctattctattgatttagggatgcgttcgattcgtaaaaattatgataaatatttttgttttatatttagtttgaaaaaaatcaggaaacaatacatattaagcagacaataacattataaaatatttaagttttacatgtaataattttttgccccaaagtattaaaatgaaacatatatgatatatctatatttgcattttttttaataaacaaataaatagtaactaagtaattattttaaaaaggaaacaacatattttttttcccattctaatctttgtctctcttttttatttcgataaatatattaaatatgatataaattatactaagataattaatattaggtattttagtaaattttttattattttacttttcttattcattattcatccaacaatatataagataaaaaaattttcctagcgtatattattttttcctttattattttttttatgtcgagtatcatatttttaacaaattaaacgaatgctggaattgtgcaattatccttttagtaaataagtttttttattatgtaattatttgttttttcttacgaaatattgtgcaattatttgttagtttaaataattttaaaaaaaatatcattattgtttaacaaaactaactataaaaaactaagttgtagttgatatctttttttgatacatacttttagttgatatatgaaagctattgaattagttaattcattgtatcttttaatattcatcatatactgtatattaaaatattttcaatcagacttaaaataaagtaaaaatagcatactttatgtagatattgcactctcattaagttaattagtttaatggttaaaatatcttgaaatataatattaaaaataatagaaaaaaatgtaaatagagtaatggttaaaataaatagtttaatattaaaatattaaaagtaaaaaattagatataaacctatcatctaattcatatttaaggaagacaaaagaataaatagaaaaggttaaaaaattgaattcagcgctttagaaaaagctatttgaagtattatgtaaaaaattattaaaaaaatatttatcagtcaaataaattttttaactaataaaaaaaataaaaattaactaaaatatctgattgttaaattatataattttagaaatgcttaattgatattaattttttgtgttcaatattgtgataataagatttaaacctaacacttcatttatattatctaaaaccgcttacactatgtcttggtattatttttaatatgttaaacatgatgatataaatatgtgaatgtcaaataatttcaaagatccttcacaatggatgaaagatggaaggcttattgacaaaaacaagagctaaaagaaggaaaaaggattttgatagtttaatcatgaacgtgaaagctaaatatgacttagctaaattagagtttaattgaagaattgtctatctcatttctacaacttgacttgaagataaattcaacaaatttaaagagcaaaacaaactcaataaattgagtatagtctcaacatacttctctaaaagaaagttacaaataaagaaaaccaattcctgcgctgtggtctcggcaatatggaaagaagtgaactcatggagtgcagatggctttgctacggtactccctctgtctattcatgatttattttggcaaaatacaagcatgggttcaactagatcaaataatgtttggtggctgactatttggtgttcggtgtttttttgtgtgtggaggaaaaggaatgccatcatgcatctttaaacaagaacagtttgattgatgatattatcttcacggtgtggtcatgactcactcaacatgtttcctcgttcaagttctcttatgtacaatggacgagcaacattagcacatgcctaaatgggccatcaacttaattccctggcttgtaggaatgatcacgtgggattcatatttgtttctgctaagttaattagctatgcatgatttttgcagcaagtatggtttactccttaggtgtaggcatttggctggtatgtattgttttactgttcctgtttgtaacttactccagctgatggatctgatttgtgggtttatctagtatttatag

SEQ ID NO: 314 - DNA, 2100 bp, Glycine max
  Soy_ogl_736 Gm02:48438001..48440100 Cluster 1
tacccaatacgaacatgctcataacatctatttgtggtccaaaactatctgtttaccaaaaaaacaaaacttacttgtgatttatacatagtacagatagattaattttaaattcaatgcttaagcctggataatataaaagattaaataaaattaaactgcttatataaacaaaagttaatttatgtgttttgatattttttagaaattctctgatctattgtttttttttttcaaaaattgaattgtttaaattgattttaatttgtaaaagaagtttagttcatcttccttattttctttgtttgcaagtgtgcattaaaaagtttattcgatttgggattttttttgttgttggaaaaagaggttaattttgtagaagatgtagactactagtactcatccttgtactttcataaaagaaattaggaggagagggagggggttaaaatcagtattttttcttattggcaaatatcaaaatcagtatcttattatgcaagaaaacaattattttattttttatgacgctcatcaataatgtgcgtgcgcaactaactttataatcagtcaagtctcatgcactgaactagtaagttaatttatttattcagtgtaaagtatccatatcaagacttaagttatgtcatttacacgtaagtagttaattaagatggcccgaaatctatagtaagttaatttatttgtgcagtgcaaagtgtccatatcaagagacttaatttgtacgtgtacaccatttagacgtagttaagatggcgcgcgagaatgtagtttgtatcagaacagctgtaactagctagtaatagggataattacgtacgtaaagaatattgtcatggtgaaagcttaagggtttatttatggttacgtagtttatatcttgaactattcaatacatcattgagaaattgtatttagtatcaaaacagagatgagaaaatgtatttgtattattattttttacaaaaagttgtttggtaaaaaaagagatatgaagagaagaaaagtatataataagataagaatttttgtttttgttagataatacgataaagaatgtaataaataataaataataaataatataaaaatattataaaagttaatgaatgaatactactatatcttcacgtcaacctttcatccatgcatgggaataaaattagcactagctgagtaagttttacttgtattttctctgttttccttttgtataagagaagtgctaccttacccctgtaaattaagagaaatgttaattaaatccttgtcattcatatagacaataactattggtagcttcctaaaaaaaaaacacaattagtagcaatatttttttaccttttaggtactaatattttagggagtagagtcggatatatgggtgatggctagacgtttagtttagctcttgatttgtgtgaactgcgagttccgtaaattacagtccattcttttttcacaaaatacattacagtccatttaaaatgtagtttatttttatctgcctaactatattttaaaaaaaaaaaacataaaattactagacattttcaactttgagttcctttcgcaatattggattatttaatttacatttataataaggtgttttttttctccaattatttcactccattttattttacagattctagttaaaagttttttatttgtttttatttccaccccttctcttaaatatttaaaaaccaggattttgcctgaatatacatttgattagttaacattaatgactatatagttggtgtttggctaccaattttgattagttatttgatgtatgctttatttttatatttatcatattataaaatctaattaattattaacaagtaaaaactcacacaagaaaaataaaagaaatcacaattcagattctttttttctagattttttagttattttttaataatcggtctgtagggccaaactatatttaatcggaagctatactgcttataaaagatagatgcaagacaaaaaaatggagtccattttttttgagtctatcaacttgttaaaaatgagagtcaataattaatgcagacaaacttc

SEQ ID NO: 315 - DNA, 2100 bp, Glycine max
  Soy_ogl_989 Gm03:39900401..39902500 Cluster 1
gattacaagtccctttgtcaaatgttttgcaaaattaacaacctcgtttataatattttgatttattcttagtataaaattgaatttataatatcatttgcgcatgaattttgccacatcataaaaaattgactatgtttcattaaaaaaattgactaggtaacaattattaaaatgaaatgctataacagaagaggaagatgtgaatcatgcatgcaaactagagggggaccaagctagtgaagctaccatccccttttcctgcttgttagcaatagtttcattctttcaataatggagtttgaaaacgacgctagagaataaagaaatgcctgcagattgtcatttttgtttacgtacaaaaagggtaacttttatcaaacgcgtgtgtgttttggagggaggacttttcccatatctctcttatatatgtaaagaagagtagcccctacggccttaactatttgtccttcacgaaacgagtataacaagtacgtgaagtgaaagttggtaaacatacaagttgtgttatatcttttttatgaatgaattttaattgttaattttataaattatgattaacaaggaaattgaatccgtcatctttatttttattttttaatcacttaattaatcttatatctcatgtaaatgacacacagtaaaatgattttagtttttatgtatatttaaatgaagaagaaaaaagcaagtaataaaagataaaataatatataaaatttatcataatgtcaaaaaattatactagtatttaaataatgtaactgtaacaaaaatctcacttccgaacagatgtaatatgactcgtgacaatctaaaggctgcgaggattcaagcgtactatacgcttttttaactagtagatttgcttgagattgtttttctttaaaaagaacccttttgccaggagttgagtagtaatttcatttttttcattttcttaaaaaaaatattagccagtctttaattagtgggcaattgctttctcttctacaatcttaaacacattacaatgccctaattaattaattagttttaaagtatcgtgttctttgtagcaacaacattaatgatgattttcttccaattgtggggattgttatcatcatgtaattattaagcatcattgagactggaaaataatctggtatacaataattaagtctatttggttaattagttggaaatcagacactttttttttcagtccttcgatctgatggatgtcatggaactgattaatgtacgatcgatccttggttgtgcattaaagacagtaagtcaatatataggtttttcttactcatttttcccattgttggtgtgtcgatcctaagatataatatttgtgttttgtcagatttagtttaaatgtgagtgtgtgttgttttgcaaaagcagttgttcaggaatatattgggtgagataaacaaatcggtaaattggtgcttttgttgataggtctgggtggattaattattatggcttgagttgtgatatgtgaatactccagtactgctctcaatatctcattaaccattgttcatagtatctgcatcttttttgttatccctcctgatgtcaaccagagaagtgtccactcatctttatccctgtggttttttttttttttttacttataacattattgatacaaaatatctattaactctgatgattaatttttgtttaaaaatttaactaactatttttagtagaatcatttttttccatcgtcatgatttatatagaactgatatgtaagctgttttgcataatataaatggaaatgtctacttttcaaagaacaaaaataaacattgaatagaagttaatttgaaggttcgtaactataaatcaaacacactatatgtaattcatccccatcgatcgcaccacagttgcacagcatgcatcccgtccagtgtccacctgttgtttgttcgttcagccaccttcctgtccatacatcacgagtcacaaccattccttcgtctacacagccatgtgtaccttctctccacccgattcaccatatcatttttttttagcctaaccaactcaataatttgattaatt

SEQ ID NO: 316 - DNA, 2400 bp, Glycine max
  Soy_ogl_2572 Gm08:9033201..9035600 Cluster 1
agtcaacaatcaatgataattacatgaacaagttttataagttaaagatttataatatgttaataatcaaacaaatatttagaatatattatcaacatacttttgaacaaaaaattcacaaacataaatcagtaaactcattttcctttttatcgaacttaagtttacaatattcttttaatttaaatttatatatacaaactttaatctatatactttcttagtggattgaaatgagtgaccatataatgtggacgattctaatgattatttgaaattaatgtatcttgtccggttgttccttagacctcaattagtcagtgccatatgcttggatccttctccaattgatccattaagatagtgtgtcattttgaattggggcttccttcctgtattcacaaatgggcctcttacgatggttttaatttgaaggcccacacagcaaacaatgttgggtattctgtagcagaagtcatttaatttatttttttgtgatatggttagttcttgtccaactgctatcacattttaacttttaaggttaaactatttatttggtcatatagttgttttaattttaagctttaatttctatatgagaaaaatacaagttttagtatctaacatgcgtgtaagttttggtgctgttgagaacattaattattatttcaatatatcaattgaaaagtcttgtttcgtttttgaaaattataaacagatttgtatcttctttatctttactgaaaaaaattgttgaagaaataaataaagaactaaaatttcatgaaaaacttaacataaggatacatttgatgagagtgctaatgaataaaatgaatttatctgcatgatcaagattaatcttatagaataaagtatttcaattatttagtaatcgatctctcacaatatttaattacctagagcccaaaaacgagtcagtaccaaagtgctagtctacattataaggaacgatatattttagaggttaaaaaataatttgatcttatcgttttgagtagatcttaaattttagttcttataaaaaaaattcttagatattgagttttatatataatgttatttatttaaatttaaactcagtctatcaaaagaggagaaaagagaataaacttaaacatatataaatgattgtattaatacattgcaaaacaataattttttatataaagaataaagtccgcatatataaattttaaaaaagaaaaactgaagaggaggggagggggtcgtaactcgtgtgaagtttgcctcctaaattcatccctgcgaataacgagacatcaatattatatagaactatatattgacaaatcattcacgaaatatattaaataatagtatagactaatatatatcctaaaaagttaatataaaaataaagctaaataagtaaaatatatataggaacatatgcctagatcataaaagtaaaattcaaaactagaagtataaggttgatattaaaaaaatactacacgaacttactaaatagattcaaattgtatatagttttaatataattaaaaggaaagcagagacattagcagatcctcgtatatgcttacttgaatattctattagtcgatgacattttggtcagcattcacatttaactccatgaattcgtcagccactttgctttctttgtttaattaggcccatcaaaaagagaaaaagcgaaagtatgttaatgtaatctatgattttgtttttgtgccttaatgactagatgattcttggttgtcgatcggaatatacgtaggaattgtgcctttagagataacttgggagtatcattttggtcccatacacttttcattatctgacatggaaacgcattacggttaccatgacattgtctttatcttcctaatgttccttcttcagtcaaattttcttttctctttctttaaaaagcacatcaattgtaccttgaattaatataagttgcggcggataaattatatatacacgtgcaaatttaaatttcaattatgtgttttaattgtttctcatttcattattactctctcttctcgatgtataattgtatatgtaaggtttttgttatattaagagtttaattcatcataatatatattttttatttttatgtataaaaaaattaggattctgctatggctttataactactattgtaattttaactgtaattacagtcacattggtcacatttatccatatataattttttgcaataacaaaaattgcgataaagttataatctcaactgcaatttaaaatcttagacatcctcatgaggtgagattacgttcttgtgacctgctgctacttactgctagaagttgaagatttagatctttctctcttatcatccattgcatttcatga

SEQ ID NO: 317 - DNA, 2069 bp, Glycine max
  Soy_ogl_2713 Gm08:15802901..15804969 Cluster 1
ttttgcgtcttaaatttggtaatccgttgatttgtatattagaagagattatatattaccattagttggtgatgacaaaacaggggacccgacatgcatgttgtttttgtacgcgattgtagtagtgtttgtttgcatcagcattttgattaaattcattttgaccaaattgattttacagtaaaataatttatgtttggatatttttattttaaaaataattattcgatgattttataactaaaaattacattaactatatttcaacgtgattttaactaatttaatgtgaattcaaatatacacgtgcattatcgattttgattttttattaaattaatttttacattcttgtttttttatattgtgtatcatcaaccgtgactgttatccattgcatagtacttgcatattattgacttcaatcgtcacttgttgcatgaattgaatttgtaactcgtgactagtattctagattattttgtagaaacaaaagcaatcttctgaaacatggtattcaaatagtttttcagttcctgactcaaaaaaaggatcaacttgcgttattccattctcatgagtattctatcaatataagtatgagttaagggattacataatcgcttgaattttaaaactgattttcgaaaactcagttaagctctggttggaagctaggagactcttctgttgctgattaatttatcatgaagggaatattcttaaatttttttattaagtaaaatttgcataagagttgttaattgcgaattcagtttaacttattttgagagaataattatttgtttatttaaaattttaagaaaacttaaaaagacattaaatttatttaataataaaaattatattaaaaaatgtttcaaaagaaattgtggacagtcacttcttttaacaacagaaaaaaaaaaactgatttatgcgcatagcctacttttgggcttgcaattttacattgttagttctcccctccctcaagtgaaattattaggtagttttgagattattacatgtctataatttccactaatcttaatttgcatgatacatattgattgtttttttcaatttataagaaaaactaataacctcaactatatgttatgtaataattccagaccaccgaataatattttattcctcctttagtctatggtgcaatttgagtaattttcttcccttaaagttatcatatgtatttttttatatatatgttttaaactttactcaaattataatgttttttaaaatctaatagcccatttaacttgttaatacatttcctattttttcatttttcgaatatttcaactattgtattaattttatatttattttaaagtatttaaaacaagtaaaaaatcaaaatgtattgagtttaattaaattaaaaagtgcatactttattacacacacatatcaataaaatatccgtaaagtattgtttttatttatgtaaaaaattattagttttcaatcttattcttacaagttttattcaataaaatttgaacatttatttattttattttattttgtattagttaaaatttatttggaacaaagacaatatattaaaaatatatccacagaaatttaacataatatcaaaagatttataatactcacacatcttacttcaattcaactaaaccattactatatatcaaatcttttaagcacaataaacacccaactcgatactctcaatcttatatatagtttacacgacgttataagcattgttattatattatgggaaaactgaaacattaataatatttaattaaaattaaaattaaataaatttcaacaaaaaaaactagagtacatgtgtgagtggcactttaatatatatatacaaagcatttatgctaatgtcccccaaagaataaaagtctgttttgtatcggaaaaaaaagaagaagaataaaagtctgtcacatggagatggtaacgatctgaaaagaagaagaaacattcctcccttctcaaaatcattataatcatgtacaattagaaaatatagttttagttttaagttgtttgtg

SEQ ID NO: 318 - DNA, 3070 bp, Glycine max
  Soy_ogl_2725 Gm08:16306531..16309600 Cluster 1
tcaaaagaaaaagaaattttattattataagccggtattgatttcgttatgtaaataatcgagcttgttagaagctacggttaactattcaactcctgtacattgttgtcacaaaatatctattatagctacaccattaatttcgccattaaaacaaagcaaaaccaaatatcctttctgctgtaaggaatgctaaatatacaggacaaagttttcacgcaatggtgaggggcattcgcagacaagatccaagtgttgtgggggaccttataataaccaagaaaagaattatgggtgagagaaactgtattaaatagtggaattgcaaaccttgattgaagcatgttattgtgcacataacgaaaattcaatagtttttgctcaatttatttattagttattacgatgaagcgtagataatgagttggtgtatgatgattgttctttcgatacacatgctctgccttagcttgtggacaatgatttaagctttggaagggtttcacatgcaactgacgtaactatgggcccaacttattttgccgaaacattgatttcgtattatgttccacggattaggttgattaggtattaattcaatcatacatctaagtttcttatcctcggttaacatattttatgaatacttgaaaaccattccctttcatgatgatatgctgcatctattgcactgtccccctctctctttttcatatttttattacatattatacccgatggttatgtctaaaagtgaatgaaaatgatcttgaaacaatttttgctattgggtatactttcatacttttaatgtagatggcatttcatcgttattatataaactaaaactgtttcatgttttcgtcttccaaaatcaaagagtactttctttttgcttcttaacgtaagtgatattacttttgattttcagttttcaatattaatttagcttattgtaaagtatcattaataaaatatttataattctataaaatattaattagttcataaattatacactaaaaatctgccaaaaaaatgaatttaaacaaaatcgttttaagtacaaaataaagatacttatattgaaaatgaaagtgttttattagttatgaatatgaatatgatatcaactctctgatctcgcaatcctgcaaacattctttttataaggagcagaaatatgtgaacagtttatttattattttttaaacctttacgccagtattggtagtttaaacgtatagcgcgctactgtatttgtctaattataattagggcatttgattttttaaaaagttattataacttaaaaatacgaaatatttaccacattatcgtcattttttgtgtctatttttttttttgtataataacaataattaagtttgaatttaatattccgtataaagtacccaaactcctatatatgttttaagtctaatcttttaggttttcaaaatcaattttgtttattatattttgtcgtaattaagatttaagatgctggctgagatatatgtgtgtcccatagataatacagttgtcttgagtccacgtgcgggtctcacacaagtcccccatttttatttctattgtgtcatctttgtgccaaccttactccaacatcgatcactttagtttatactcaattattattattcttacattagtcaagaatatactggataaattataataaattcaaaatgaatgattaaattggacgaaacagtatctaagaaaagaaaatctcaaaaaaaaaaaaatatatcactcggctttcttgtttagtactacattttagttcgtttgtcactgtcattgaacctccctttcaaagcgcttataatggtacctcatatcatttatatcttgggaaactagtttagaataaaggaattgcatttaagattagctttctaaaatcatatttgagatataaaaaaaagtacattgtctgagacttgaagtctactcacacacgcacttgagagatagtgaggtccttgtagttcaaagaatcacaaatgtattttttagggattataaaggttgatttaattgtaaaagaaaaaaaaaagttgtaggttacaatattctccaacaattaacatttatcggataaaaatttttaaaaatatatttttgtaatatggttacatttgtttttaggaataagttcacttgtaataattttaatcaaatttattgttaatagtacacttgagtaggaattgaaaaaatataactttgaattaaaattaattttatataattgagattattagaagttaagtttgtaaattcgaacatgctaacaattatatggtgcaagtaactagctagataacattatttttttatataagagaacttttttagatcacagatataaaaataattttatttgaattaagtagaactattgcgagattattttagtttaattgatatcgttaaatttaaattcaaacaatataatgcgttaaaatttttaaagaaattttttatcacttataataattctggtaaaagaaaatacagtattattttttaaaaagattatgttgtaagtatatagcaaaaaattaacaatatgacatcactaacttcaattgaaaggggtgattatgatggtgggtctagttacagaagtagagacgatcagtatttcatcttccactagagagtcgcgtgcttttttaggcattccctatttaatggcaacagctagtatttaaatgtattttctttactttctctgcacttcaacaatgaaatttacgtccttagttttattgcctcattcggtcaagaggcaaagtgagacttcaaactagtcttttttttttttaccgttcttcctccttccattttctttaagggtttttatgcgtcgagttgatttgagattagagaaaataaaatttaaatagatgaattttaatttatttagtttaatttggattttaattttttttacctaatcctaactcaatcaaattgatgttaaacgaattggttcaattcgaatcatcatatatacgataaaagaaacaataaaata

SEQ ID NO: 319 - DNA, 3567 bp, Glycine max
  Soy_ogl_4341 Gm13:29220501..29224067 Cluster 1
aggtacggtcattgcctttaagatctgaaatctcataccttcttgaatgcggtttaaacaatgttatgttgttttccatattcaaaattatttaaattaatttaatttcacataattaacgtagaatgagaaaaataagtccccagctgggtaaataattaaaataaattttgatcaatgtgtttttgattgaaagtaaattaatgatggtaatctttataaacacaagcaaattagtatattttcagttgaaaattaatttatcaacatatacttgatgtttttttattaataatacaaatatatcgaagtagaagccgacgtgccgttgacagtgagacccagatcggatcttactttatttttaatcaagaaattcatactgtccgtttgtgactaatttatcaaatttaatgtgttccatcatataatagctagccggctagagctccacatggcactaatccctcttttgacatatatatactagcaaattattaaattccttttttcgtttgcaacactaagcatcgttcgaacacaagaaatagaatctacaaaagtggaacaaggtagtgtgagggaattagataggaacattaattagaagggtaacattataattaattgttattattagaagcattagagattagagaatatggcaattagtgttatgaagcagggcaacatgatagggcgtatggaacgagatgaggacctaactctattcagggaattgaggaagcaccagaatgaacgtgtctctagtctcttctattgtgttaattctgaagagttcgaatgtggcactaatactcatagtggtaggttacttactcatgaatcataggctttcttagatttggtattaattacaatcgtgtgtttatgttttgcttaatagagatttcacatgagtttaaagtctttcggcttttaattagctaggattattttaaatcctcctacagtatttatttgtcaacttttggttgcatgtgtagtactaaatattgaatgcatattgtatatttttaagatattatattaatttacttttttatctcatgttctttgtaaaataataggaagatttttttatgggaaaatatagcattactcttttagcttggatattgcaatggtactcatgttgtgtacttggtataatggaccataatttatatgattttaactctttacatcctagatttggagtttttgattagtttgtttggtatgaatgaagaacaggggaagcagaaaatatttccccccaaataatccattattgattttcacatatgtatttttaatattcatttgttcagacttattaaatttgaatattcttacttaaaagtaatttaattttttattatgttttctctaaaataatattaagtaaatttaacttttattttaattaaattttaagtttaaattatcttattataatcaaattaagtacattatctttttcaacttaaacatgttctttttatttatttattttctgtacaaagtacatgatattcactaatttaataatattttgttccatttagatccaaggtatttttttatttctaattttcaatgcagtaatataactttcattttcccctacaattttgctcagggttactgcttaattagaactaacggaagaaaaaaaaaattcaggaaaattttcactctattgaattccgtcagggaagaaagaatatgggctagagtttctggaaacaaacaaaaatgattatgattggtatgtttggtacatatactttattgaatgagcatgattatttgatttatcaaatacatgcatggaaaataacttagtcattgcatcatgcatgggctaaaaaggttgaaaacaccaccagcaacttctctcttgaagtggaacccagtcctcaacttgtccttcaaaaggagttaccaatccctcaggccatctcaagagtgcgtcactgaacttttatgttaatttccaaataatgagtacagaaattatgtgaattatgtaatataatatgcaaatcttattgctacattatactccaaaataaatgtatcattaaattctaatggaatcatattcagtactttatattaatattaaacaatagaggatacaccattactttagatgcaaacttacttttaagaactttatttatgaactaaacataaattattatctgtccaaagttttgaaaaagaaatttactttaaaaaataagtttttcttgaaccaaaaaaaaaaaaaactataagacatataagcatttctgcatctgctcgtagaatattttagaaaaaccaactgtcgtcacattttggatagagcttagcgtgggtcccacccatcttatttttaccctcaaatggacttggtgccttcagttatgcagagaaagtcataatgaccaaaaaatagagaggaagaggagtcacatggacaaaaaaaaaaaaaaaaagaattccagacaccctaaaaaaaatttctatttatcaaaacattattttttttattattatgataatcttcataattaattgtagcttttggattttgtttgtacctaagcaagactattctagcttgtttgttcctctaaagttcaaatcaatgacataaagttggttttgccacacatgcagtgatggaaagacaaataccaaatcaactaaagcaaaacttccaacaagatcaatgactcaaggtcacaacaagcaaagaccaagcatcatcaagaacacaaatgaacaacaacaaacaagccctacccctcctaccattattaacaacaaaggcagtaatgcaaaaattgaacatgatgcagccaacaacactagatccactccccaaaagcaaaccaacaatgctcatttccttgctttgaatatcaagaaaagcatagaaacaaatgaatcagaaagaaagccaagatcatctagaggtgtttctctatcagtgaagtcaagggttgtaaatctaagtagcattgtagaactctcaaatgagacaccaccaaatctaagcacggatcagaggtcgagttccacgacacggggacgaagcacaacttgatcttctactattctaggatttcaaaatcgtgatcctactccgcgaacttgtagacagtcaagatcaccatcgccaagcatggctaatggtggcttgaaccagttagatagaaccccccaaaaattgagggaacaaaaagaaacatacactctagcagcaggcactaatgaaaatagagcacattttaagggaagtaagatggtagagaaagtagtgaatgctagaaaatcaggtgtgaatcaaatggacagagaaaccaaagcaaaagctttcaaatatagggtatgattctttctttcctttttaattgtctaagttaaattctaggaaatagaagctacttattcactagctaatgaaagttaaaccaaactttaattcttttatgtattgtttcatgttatgacacaggaaaaatgaatcaagaaagcgttgcacaagggtatactccagcaatgttc

SEQ ID NO: 320 - DNA, 2800 bp, Glycine max
  Soy_ogl_4399 Gm13:31919601..31922400 Cluster 1
caatctcacctaagttaatgtacaaactcagttttcccactttgttccaaccattttcaactcatggcatattcctctagacaaaagcaaatgtggtatttcccttcccgttaaccgcatttttattaattattagtgggtaataagaattagatagatagatatataatgcgcgtgatatatgtttgggggatgtgaatgtcaatgtctgaacactggcatgatgttagttcatgactagtacacatacttaaggctaatgaatgttttttctttttcaaaagcgagagagaatcgaatcggagtagagtgattcactagcatagttttcaaatttcaactttggagatggagaagaaagtgagagggcgtaaagcactgcaaaccgtttattaaggatgacatggccacccatgaaagcaaaaactaaaaagaaatgtgttggctttgaagattatgtgtcacggccacaatgcacgaatcagttggggcaggcaggaccaaaagcatatatttaatttggtacatatggcccgtcagttttatatttatattaaagtttaaaaaaaagaaaaaggacagatagagatgcaagactgaagtagttgagtgaagctaccatgtccacgtgtccgcacgtgggtgagggactgtgtggagatagttggaaaattgggcacgtgtcggggaatttgtaatttctaaagcaaagttgggttgagggggaatctgaaagtgattgagaggggagggcacccccacagggaatggtgttgtaataacaactgcaccttgctgtgctcctcaataagggccatcaaatgccccaacaatatctacatactttgtcttcgcctgtcggataagaggaccaacacccttctcaagggtcaattttaagtctacctgtcatatgtgctactatctaaccaagtatttatcaacttttttttatccctccaagtcatcttcaactaaaaaatataacattaattaagtgattaagaaggaaagaaaaggaaaaaaaagaaagtctcaaatttgatctcttactaacaaaactaataattaacatttattaataaaaaaatcttcaacttcaatgaaggcatatcaatttcacatggagaaattgctaatcatatgctaatagtatatattttcattattgagtggagattaagacattttgtgagtctttaagatttttatttaatgaaattacatttttttatatataataatattagtgtgaagtattcattatttttatcaataactaatttttatcaaagaatccaattggttatttagtgaatttttttctcaattatattttttatttataatattagaatatgagattttgtttggaggaactgagcacaattacttgttgattttaaataattcaaaacttgactaacttctccaataaaaaaaaaagctattaaatagttttaccatagcttattttagtagcttatgtgagttaggctttaacgaacaactagaattattgtgatatacctattcataatttaaaacttgttgaacattcacttttattatttgaacatcaaaaaataatattttttatttctgccttttgtatttttcatgtacacgcatcttaaaaatatcatcttctccattttattatacacaggacacttccctcaaaaagtccatatgaaacatttagttgatggttttaattagtgtgactttgataaattaattcaaccaataatttgaaaagacttattaatataaaaaaaattatgatatcaatacaaaatattttaatgattaatttttattataaaaaacacaagcgtatgtaaggtaaatgtttcatttttggcataatttattgtatacttagatgagaatttgaatcataaattatttgaaaaagaaatataagtagtggtggtggcttatccctagttaataggacgaaattatcaagtgaaataaagtaacaaacatgcctgactttgtcattaaactgtcattttctctccgttgattgcactagctaggagcaagtttgttggccatcaaatccatcaaatccatcgtccttggtcagtttgtccactactacttacatttctttgcactaattagaactttcttccttcgtgtcagtcaatgtggccgcagtgcacttcacttgttttttatgctataccctttgcctaaattaaacatgacgactctccccggctacaagagccaacatgaaccagtcacagctttttctttttctttttaagaatagagactgatttcttgataaatattattagataacaaatgtattattaaatgtttaagagacaaaattattgatgaattatgttacagtattctgttgataggaagttgtgtgacacatctgaggagtttttttcctaaatatacataaaaaaaattaattaaatactaaaacatatatgtttattattccacatccaagacggcaacaaagagaaaaggctctcacactcgatgagcattttactgttacgttgcctctagctaggtaggaacacacgtttgtctgcctagtaagtgatgcagaaactgtgctgcgcatataaaaaatggtagtaaaagtttgccataaagctgcacctcaccgctcatgatgtgggaacaggaacaatttctgaattattactggtttcctcaacttgccattgtaatttcaaatattactacgaattagattaatagaatcatggatgcaatcttaaatggattaagaggaagagacatttataaatta

SEQ ID NO: 321 - DNA, 3200 bp, Glycine max
  Soy_ogl_5142 Gm15:47783701..47786900 Cluster 1
gtactccactaaataaaaagaaaatatattgtaattttgtactttttttactatatttttttttctcaactaaacatattattaataatattgtctaatttaagcttaaataaagtaaaataataagttattaaacatactgattaatatattgaaattaaagttaaatataattcttaatgagactttatttatcttccactaaattttgaattaattaacatccatttttcctgatcatttgaagggttaacaaaaaaataagaaggtgaaataatattttttttataaaaatacatatatagcaaatgaagtgaaaatataagaaaaaaattgttaaggtgcatctgcacagatataggatttgattaacatttggcttcttgtagtgcttaagccacgagatggtgtatttgttttatgataagacttatttaaaagtatttttattctattttttcattaaaattgaattttaaccaatcttcagtaacttttagtgtcggtttttattttataaattattaaaaacaactccattttgtataaaaaataatataaaaaacatttataacacttcacctaaatttgaattccactttttgtagttatttcatcaatttgcactcgaactgttatggcaaatctaaatttaactcatttttatccaagctctgatcaacttacctatcctactatgtactaagaacaatacgttgttggttgaaatttttatatcctcccacatggttgcactattgatcctctttatcatttttgagttatactacctacaagacttttttgtaatgatgaatggtattaaaggtttttaattttctctcatcccgaaatatgtcttacttattgtatcattttaaatttaatataatttatatattttttaaaaaaaaagtaagtgaaacccaaaaaaacaaattagagtatatattagacaataaatgtatgtagggaaacttcactatcgcaaaagagtcaagaaatggtatagacaacaccgccccgccccccaattgcaaatgcaaactcataatcctcaccagcaaatgtggttcctctagaataagcatattttcttcaatacagtatgtgagaactgaaaaaataaatgtgaaatgacttgtcgtattttgtgggaaggagaatcacattaatgcacatggaattatgaaacctgacaaaaaaaaataaaaataaattaggccatgtgttgggaaatgtactcttcagtttgaggcatgggatttggccaagtacatatatatataatgtttactcatacatgtttggtttaatttttaaattaaaaaaaaatatttttccttggaataagtttttactcaaatttctattatccagatcttactagaaattagtaatatatttagataacacacaagaataaattctactccataaaattatgataatatcatacaaaaataaaaacaactatttgttaatatgtttttactataaaaaattgattatttttttgccattaaactaatctaaatacactataaaacaaacatgtatgatgtaaataactaattaaatgtgtgtttggacaggcatataatcaattttggatctggctagacacataataatcaattttgggccaaaaaatcgtgtataatataatcataaattttgagaagtaactgtgtgttattgtggcttcaccaagattagacacaattttttttttaccttgctatcattacaaacatgtattaaatgaaaagtttataaaaaaaatatttatattataagtaaagaaagaaaaagaatcaagtagtaaatacttcaactttgcttaagaggggggtccacacaaaaaccctacggatgagtgcatgcaatacagtttctctgaaattcactccttccaacctaacggtcaaatttttttgttgcccgtagatagatataaaagctaccctctttcaagaatccgagcacaagtaaggtatgtttccaatacaagatatactgatagctcaacacacacacccatttcagaagaaaaaaaataaaaatccctcgagtttgatataaaaacaaacgtattactaacaagtgtttttgagacattacttaaaaaaattttaaaaaatattgattgtgtaacatataaaagaatggaaacaaattatgagaaatataattttatgtatcccaataaaatatttctcattttaattttttaattaatacctcaagaacaataatcaatattcgtctacaaataaaaatacttttaattaaagaaaacttcgtaaaacaaaacaataaaacaaaagaaaaagagaagtgttctttcatttccactttgtcatgcagaagatcctccctcattaattaccaacctttgttttttttttttctccctctctctctcacacactctgactgacagagagaaattgagagacagaggcttgacatgttcaaggattagtttttatatgcttgtattgtggaggtgaaagatgagattcccaaataaagaaaacaaagggtatggagagagagagagagagtataggagattctctcaatgcaagaaatagtaaagggtggagatcacatgtagaatataaaaaactttaggttgaatggggaaaagagaaaaaggatcccatactaaagaaactattttcacaagtcaagatgcaaaaaacgattttcccttgaaagaagggcaagcacaaacacacatgatatatcccccttattattatccatcatcctccactaaagtaattactagcactaatcaaaatgtagttgttttgtgacccctcttttttttctcccccaacttttggttacttttttttctctctcccttttcatattcatttcgttggtggttaaaataaagtagggtcaatgtggttgggagtatatatgtgcaataatggagctacaatattgaaagagaaatgtgaagagagttgacaaggtggaatcaatctagcagctacttctcatctactcatcttccaatggattctttatctgtctaattcatctcactttttcaagaaacttgataaggttggcaattagtactaattgtttaaacctcaaattctttggctaattaattgggttaaattgaatgttctcttactttccgtcttattaatgccgagggccatgccata

SEQ ID NO: 322 - DNA, 2200 bp, Glycine max
  Soy_ogl_5761 Gm17:382201..38491000 Cluster 1
attttgttcattttaaattagtccctagggactaaaagcaatttatttacatattataggaactaaaacaaaaaataaatatactttaaggactaaaacaaaataataggaaccaaaccccccaaaaaaaaaaactatagggactaaacgccaaaaaaatttatagggacaaaaacaaaatactatattttaagaattaaaaacatatttaagattaaaatatttcatatatattaacaaaaatatttttagcatattaacaaaaatgaagccattaaaatcacacaattgtaatattttaaaggaaccaattgactcaatattcttaataaggttaagcaaaccttttaactagtaaaaataaaaaactaaaaattattaagaagtgcttatcaaatatacactaaattaacactgactatagtatatcccatataacacaacatattaagtgatataagggtgttatatgtaagaatttttcacacaattgcaatatcttgaaggaaccaattgacttaatattcttaatatggttaagcaaaccttttaactagtagaaaaaagaaactaaaaattatttagaagtgtttatcaaatatatactaaattaacaccgattatagtatattctatataacaaaacctattaagtaatataaagacgtgatatgtatgatttttttttaatcataggaattaaataagttatatgtatcatattcaatcaaatgaatcaaatgagttagactcattatattatatgtatgaattgatcgtatagccaatggatttttattttttttagaggaagccaatgaattattgtaccatacgtttaccaactttaaataaagcagaatatagttttagtcctcttaaagaaagaaaggttatggatttccgagatgataaaaaagacaaggtgatatttttttggtgttgaaagacaaggggatatgatcacaccaatgtgatttttttttaaaaaaaaatttccatcaaatgatgtttactcaataatttaatttgaagccataaaaacaactttgatattaatgtcaatttataatgtcgatttccttcaaaaattattatagtgttgatttccttcgaaaaaaacaactctgttatataatttattggtgtaatttttttatctaaataattatcattatatatctttatttttaaatttaagaggtgaaggacgagagataggaaaataaataaataaaagatgtgatgaaaaattttatataaagaaataaattattttgaatgcgtaaatatgaacatccttattttattttattaaaaattggaacatagccatgttgtctgaaatttgttttgtcaaccatggaggatccatttttgtcatatttgcaacttttccaaagtaacggagtgttgacttctttttaaaaatgcaggagcggaaagcatctatggttcaatgtagctttttttacaggaaaaaacataactaacatatttttaattttaatttttgtatcattaatcttatttattattaaaaaatagacttaagttatttagtaaaatctacttaagacttaatcaatataaaaaatgtgctgttaaaaaagaaaagctacaagtttagaccttctcttttcatctccatttctttccccttcaactcctaaactcaagcaatcatattcggtcttcttcaaccagaccaatggaaaacaaaattagctttacatttgatttcataataaagttattaaactttttctataggaaatttttttctataggaaaatttccagtatcacaatagtcccttgaacatttgccaagaaacaagttattattatcatcattgtacaaggggaaagcataaaacatagtgatagtggtagaagaaatcatcacatagatccaattccaaagttatgggaagaagagtccctaatgagaataacaacatcatattgcattgatagacccatttctttattttccattttgcatggtaggatttgtcacaaccattgttataatcgcagctttgtgcactgaggtttcgaaaaaaatcatcatcagcagcagcagcacctgccccagtttctaaccatgattaagtgacaaatattttgaatattgaatctactaccccaccaacaacatcagcattgttagaacatgaacaacatcctagtacctc

SEQ ID NO: 323 - DNA, 2913 bp, Glycine max
  Soy_ogl_6158 Gm18:53657888..53660800 Cluster 1
gtatgaagatcataaagaaacccgatctagagggtaaaggaaccaaaatcaaatttggatgataatatataggatgacaaaaattaagcatgcatttaaacttattatatataatatcttaacatatatagcagattttaatcacgcgctcaaacatacaattgtatagagtttttacattaattttaaatttagttatcatttaatcattaattgtcatgataaatttgtactttttatcataattatttttaaaaagttatagtttaaaaatctttatgtagacatataaaattaaacttttcttttccaatcttttttttatagggaacgaaaaatataaccttgtgtatatatataaacttgtatgtatcaaagtgcatacaatgatgtaaactttgcttgaaagctttgggaattgctttaggaagtgggggcaagcaattgaggagcatttttcaattttaagaatgaattaagatcaccttcaacaaacagtttagacactacgtagcacatcaacatgttggttgattaatgtatgtatatatatatatcttttcttcttgttaagctaactctatgcttttggttagtttcttctttgactcacacataactaatagctagtttattagtggagttcggttatacagcaactgctctctttcccttttgtgtcccacaaatctccggttggtgaccttcaatgtggtgttttcacctgcctaagactgaattaagatttttggacccaccaaatgaactactcttgttatgtgttacacacactacttattttaccttcacttgataatctaagtttttcaactctaaaatcataaaatgttagaccttaagttggtaattaattaatgttatcagtttgtgtaatgcgagacaataggggaaattattagatagtttagaactattatattatatagtcttattaaatgcatgatgtggccgtgtattagatgtaaaaatcgttcataatttgcagtaaaaaaagatcgttcatcatttttcaccaaataacttggtgaatctttggatagcgagcaagtgaattaatcacgtttcagttggcaaaaaagagcttggacagtacttatattattcacattttgtgagtaattaaaaaattatttatcaatgaaatagattttgaatgaattaaagaatttaagcttttttttttattgaattaaagaaagtcggttcttttaaacctactatctaaacaattaaagaattatttatcaaaagtaattatactatactatctaaacaaagtcggttcttttaaacttacttttaaaatatcattcttaaatataaattaatttttaacaccaattattttaatattaacagataaaaaaacaattccacgtaattctaaactatacacatcctttatctgttgaaacagtgagttcttgactatcttgttataaaaaattgtgctgatatagtgtgtacctaactttgtaccatcgaggatactactaagaatacatggtatagttcctttccttccctttcccacatgctcatggcacatatagtaaagcagtagttttatcaactaggaagaaaaaggataaaaataatattcatggataggaatgagcttctagaagctcgtgatcagctatagttgaagccaaaagccaattaatgaatttgatatttaaagtaaacactaaaagcttagtttatcttcagtaattacactcaattctttctttgtattcactcttcattaccttcttaaaaatgacaaaattacttctaataattgcaaatgagaaaactacaacctattatagaaaggcatgtactgaaaactgcatgcaagaaatccgttgttaaaaatgaaataaatccccaaaggcaagtggtcaagatttgtaatctcttccatcttttatttcaaaacataagaagaaatttatcaacattttattttgaatgcattattattaaagaatacatggtatagctcttttccttccctttcccacatgctcacagcacatatatagttcttttaagtagttctgggtccttctctagaaaattccgacctaagattatgaatcaagtcaatgtatattagtccaatactttcaaactcaatagctaatccataaaaccgatagctttctaatagtgcacaaactaaatataatcacagagcacgaaatcatacccccaaagttttttttttttttttaattacaagaaaatttactggattcatctttggagccattttttacttctcatcacataacactgccatagtccatataggaataatataaataagtcatatatgtcttagatattgtctcttaaacttttatatataatcattctcctcctatgaacactgacttaagcattagaatgcagatatagtactgaaattcggctgctacttacctaagaagattctattcaaatattaatttttcctctctaaaccggtgttgaataaaacatatatttgaatttagtaactacaatatatatgaaatggtgggctaaaaattattgttgctataaataaaaatggatatataaagaataagagaaccaaaagtagaatatatatccttgctcaaaaagttaaagatgaaaataaagtatctctctcttttttggtcaatgatgaacgaatcaagatgtagaaaattaataatggacctctctgcttggggacctcacagggtgggtaggctataaggaagggagtagctattctcactcccaaaatttctattctcatctctcatgtgggtgaaatttctctaaattcctaaaatacccttttgacagaagtatgattttgtttcatacctacccaacaaaatcatactttcattgtaaattttgggt

SEQ ID NO: 324 - DNA, 2798 bp, Glycine max
  Soy_ogl_669 Gm02:45169203..45172000 Cluster 1
ctttaattttcattggctattaatgtgaagaattatattctccaaaaatgttttgcgtggagacaaagttttttttgacagggcgtagagataaagttagcctcccattgaaccttaaacaataatatatttttcatattatttattgaactcaaagaaataaatataattaaggatattgttgtaaaaaaattaatgcaagacgtcataatttggttcttaaaagaatttagttcttaaaaaaaggactagaaggagtatctactaatatatttatttcctaaggatagtgttaaaaaaatatttgtacttttttatattgtaaaatgaaaaatattttgaaaaattaaaacccacggtgacaagtaaaatgacatgtgggcagtatttttataaactttacatctttgttaattaatttaatcatttataaaaattataatttgattaaataagtgttataataaatacattaaagtgatgatgacaataataataataacaaattcaaattaattatatttgattgagattagtttcctttttcaaaattgtttagttgatattgaaacaaatcagcccaattttgattggtataatttggactgatcgagttattgaaggaagctaaaaaaacaaattattatattttataagttttttatcttattttttatataaaaaattgaattatttattaatacaaattaaaaaagttctttataattcaataacaacgccaattctaagaattaagttttttttaattaatcataatttttatacaatgataaaaaaatttcatttgaccaaccacacttaataacaacaaataaagtcgatgtgaatgaacataaagggcaaacttagaggatttttttttttggtgaacacttggaggaaaagttaaagactaattaaagtgtaaaataattaatttaaaagttaaaaaaaaattggccgagtgatggaattagtttgaattggaaaagataaagtaatccaataattgaccaagacctcaagttagaattaattcagatttatcaattgtagtttacttttttgagtcgctgtgattattaagtcaagccatcttgataggaacacccgaaatatatgtaatttggccagtatatatatataaactgaagaagtccatctatcccatgcaagtgttacctaattacaaacatgaaatttttttggtttcttcaaatcctgttctgcctggccatggttctcatcaatccctcggttgctcccaggtaatacccttttgctttcagtaaattttcattttagttcttgaatttgagacactgtgaagtagttgttgaaattaggaaatattaataaatccctaaaactaaaattaaaattgctgtcattttagtttcagaaatatacaacttatttattatttattattattatagtttctaagttttaaccactccatccaccgctacctaaggtctccgattcacggccatgaagattttcttgattagcttatatatataaagtttggttcttcaatatataactatatatgtagtatcccttttcttctaaacctctttaatttctgcttgggatcaccagaaataagcatagtcctagctagctactccaatgtttttggctatatttgtttaattaatactttgatctttcttgttgcgcgtaatatataatacctccagttaataaagaatgctgtttgtgaatattgaaaatcctcgagatagcaacggaattaaaactattctagtacatgaataccagttcgcaagtgatgattacactgttaccttcaagaacaccaaattatttataataccttttttactgtgaatgtatttatttgtaggaaaaatgtgtttaacgtagttacaataaaatctttgacttttatattaaatgaattttatcgtcaaactttaaaaaatatatgaatttagtccttctaaattttgatgaatttttaaataagatggactaagttcacatgttttttaaacagtataatatgaagtcttaattaagttgaattttcagtattgctattgaaaaaaaaaatctgaaaaactcacttggacagtaccttcttaaatagagacgactgactcagggactgaatatatttggtcacatcctcactttaccttattttgaattattcaaattggatagatgtattatagtatgtgcatgtaacatacggtataatctagaaattaaagttggaatcagccataccattcttgagggcaatgaagtgacacattggcttgtacatggcctttcgttcatcccattgcatttaaaaggaaattagctagcatttggcaattgaaaacaaaacttctctctctctctctatatatatatatatagaagtttaattgacttgtagccgtgttcaattgacttgactttaaatgttgcatgattttcattccctacacaccttagcaaataataaggattaaggacacccttcaatgatatgaatatgatcaggcaagcagaacaagagaaggggaactttgacacttcaggcaacagccatgtagaactcataaactgctttgagaatttgttctgatgattcaaccatagacatcgtttcttgccgcgtacagttgccatctcttgatctcattttgaaattaagcttggagagtgacaacaaaatgatgtcattttgctatctgatttgtactgaaaaggtaccaaaatatacattagtaacatattagtaaaaccaagaaattcaacagtgaatgagg

SEQ ID NO: 325 - DNA, 1783 bp, Glycine max
  Soy_ogl_317 Gm02:1621918..1623700 Cluster 1
gacaaataatgtaacgaaaagtaaagagacaaaaaatgagatataaataagaagaaagaaaaagtaattatattttttataacaattatagagtacgtatgtgtttggtgaaagtaagatatactcataattggaaattatgagactatttcttgatcaaggcataaagatcaacaaatttagttgtatgttctaataaaaaaatttctatacataggttagagaattaaacctcatcactatataattgtttaattatgagcgacaattattataaaagaaaacgcttttcaagatgatgaataaaaataactaattaaattataatgttattatttaattatggattttcatataattgaaatacgttttataatgagtatgttaaaagtcacttctaactgtgtgaaccttgacaatatataaaattaaactaaaaactattattatttaatgaaaataatgtatattgaaccattcacgtatagggttgaaaattactaattaaagttaatgattttaatttgattttgataaggtataagtacatatatatgataaattaatttgttaaaatatataatacatttgattaaaggatatatatttctaaaacttattttttatgagaaggtaatctaaccctaactaaatattattggacaagtttacacatttaattaaacttcaaagaaaactttaatcattatggcataagatcttttgaattcataaatatactaattgtttttttaagaccacagatattcttaatagaagacagttctccttgaaatagataaaattattatgggaaataaaattttctctttataattaatatattatttattttttaaaaccaaaagtatttttaatgaaagacaatcctgttagaaatagataaaattatgaatgataatttttttctctttataattaatacgctattgggattcattatttaggacgaattggtcactatttttggagtgaaaaaaattatgtaaaatgagaagtaattaagaatatatctattattaatacaaataaaaaaacccaataaactcaacccaattaaatttaaaaataaatgcacctttcttttcactttttacacgcacgcttttcacctttgacagcaaaataaaaatctaaaataaatttaggttgaaaatatattgaggtaattcctatttaaattcagtgatatttaaagtgataaagttaatctgtcgtttacctaaatatacatgcatcagcaacaaaaaagacgtgctaatgttacagtttttgatgcccagacaggcagacataacgagatgacacgtgacattgtgggtgctatgtgctacgtacccaataggaagaagaaaagaaatactactacatagcaaaactgtggtatacccatttgcagtgtaataataaccataattagcaaccaaattaataacgtgaattgtggagtacgtcgtagagagactggtcaacaatttcacctctaatttggaggggtgaaacttttgagaaatatccaaatcaagacaaaagccaaaacaacaaagttaagtcactgcttcactgcttgctggagaggcagccagagccggtagcatagccacttgtttgatgctcccaactcccaagttaaggtcttgcagcaggctcaaggggcacagtaatgttgttctaggcaggtctaatcctaaagttttcaattttcttttgtctttgctaagtgattatcatacatgaatatgaagactaaatctcacttgtc

SEQ ID NO: 326 - DNA, 2538 bp, Glycine max
  Soy_ogl_412 Gm02:6075901..6078438 Cluster 1
tcttctacgtttttgcaactacagggactagattgataagttttaaactatagtgaataaaatgaaaagtaattataactataaggatcaaaagatatttaaatttaaaataatactaattttatatccttaattattataaaagtatacagtagtttatataaaatcttttaccctctaagtatatgtattattttctcataaattttactgaacatatctattatctaaacgaaaattcgtgccccatgtggataaaagaatgaagttacattgcaatagtttaaggctataggcaggatgcattaatcgttacagcaatggaaccttctcaaagaattatctcactaattttttaaaaactaattaatatttttcacaattttgatccaactaaaaaacttatattacgtaattattactcatttgcttgatgtaagagttacgtcagataattcttttttttttttacacagttttattgttgtataatactattatgtaattcgaaaacaagaagtaagaacactgctagctgcaaaggtactttgacaagggataagtgcgattctttctttggattaggtaaggtgcacgtggaaaactacatgagtgtggaaggtcaagattttaaggctgattggactaacctaataccatgaatttcgattattaattggaattggaacggtgcccatatatgtcccttgactagtttggagcatataattttcagaatgtgatacagtcaaactttctaacaaactcactgtttcatcgaaggaattcttttcatgttgcccgaagtcgtgtagagatggacaagaagagtgagaacgaatcagggtctgaggcatttgaatatttgatgtatatccaaaatttaaattaagtgtcattttcatatttattattcgtctatgtttatacatcttggaggagaagtgaaaattgggaaactttgagcccttgtttagtataatggagtagaaaggaatcaaataaaattgagaataaatatttaaattaaaatagtataataaatgtgtaagtctcactaattttaaaattttctttttagttctctggtgtaacttctaattgaagggtaagtgagtctaaattttgtacggaagattaattttataaaatatttaaaagatcaaaatttgtgagatatctcaatgattttttaaggaattaaaggttttaattataatagttaaaaaaattattatttatcctattcttttaaaaatttaagacaattcacatttagagaaatgatcaataatgaatatggtgttgagaagataaaaataattttaatatcaatcaggatttcaattatattcttaattcttgtgttacttttaaaatagacatataaaaagttatttaatatcactcgggactttatgagtatttaatgaatacttgtcttggttcttgtccgtttagataatatggattgcaactttaatagccagcgtggacgctaaggaaagcgactaacaattgatatgcaattaagctttaagcaaattaaatctcattctcatggtgcacagtccacacaaagttgaaactttagaatggtcgtacttgctagctcgcatattatgagctctatccactccaattctttttagataaagagaatgtagtgtagattttgagtgaaagaggttttgctatcttttccaccaaattcatgtatccaattattattttaacatactataaactgatttgctagttgctgtcttcctttagtaaaaacttatttgatatttatttattctagcaactacaagtagtaggaataaaaagtaccaaagaattttataacaattttgattgtgacgcatgatattcaatcaattgagttatattccttatcaattatttattgtaaaatatacatatatctataacaactagtagtttaaatatacaagctaacttgttaaattttgaatcaaagatattcaactggatgctttgacattcctttcaataatgtaagacatgtattttttattgtttatctgttgtcgtgtagttcttttttcttctttgtgaacgaaaaattaatgttaccggactacacgggaagaaaaaccaacaagctagggttgtgtgtgtatccaccaatatataaaaatgaaacatgtaaagtaaggaacatattcggtcacaacaaatcttctaaatccaatattcttaattaatagtttttgcatatatataattttcttaccctttctttatctttagcaataaggttaccccacatctaatatattctctttattaaattctacaatattaattatccaatttaaagtgaggctctagtactataataattcttttttctaataaaaagtgagattctactattaatttaattaacaatattatccagttttgtctttaagatatttattgccattgttttattatttagcacaacatttttttaactaacatgaaaattaaactgatgattttctcacattccatcaaagagtg

SEQ ID NO: 327 - DNA, 1712 bp, Glycine max
  Soy_ogl_697 Gm02:46347435..46349146 Cluster 1
aaattatttatacagtgttagtttacaaacaaattatttaatttttttgtaccacacaattattttgtttaaaattataaactaatctcacgatttatgtagcatacaagaaacatgtttcatgagatttcatgtagctatacctcaacacttggaatcaaattagataaatttcacaaaaaatactttttttaaaggcaaaatcagattgttgttaataaaaactgatcaataacacaagaagcgtctaaaaccagggataaatttcagccaaggaatacaattcctatcggattattatatatacaattcaacacaggcggcacaaaagtcccttggttacctataaatttagggtatatgtttggataaatttttcataaatatttttagcaaaagaaaaaagaaaatgaaaaaatttattcataaactaaaattagtcaatacatggattaatttaatttgtagaaattttttcatataattttctataaaaaaaacttatgtatacaaattaattttaacttgaagttcatttttttctctagaagtatttctggatatgtttatttaagtagaccctcaaaagaaaataaaatagatcaaatgcataagttattcaatttttcaacttttatattatcattctcgtctaaccttttcgtaaacatcataaaatttataggtctagaaaattttagtaccaacaaatagatcatacattaagaaatactaaataccagcaataatgaatgagaaaaataaatttataaatgtaagatgttcttcaatgtaggagaagtcacaaaaacgttgagaaagataatcatagaagaaaaaaaaggttaagtagccatcaaatttaggaaccgaattgaaattattattattattatcagtgactcatttaaccattagtcacatagataaatctgtgaccgaactgatttttttttttttttacttaaataactttttagtctatataaaacaggaggctactgatattattactatttctaaaaaaatgggggcgatgcgttaaaatgattaggaacaaaatccatgaaaaagtgataagttaggataaaaaagtgtaatcaatccttttatatttttaaaccagcaaatgaatcgagaagaaaaactagagaaaaattactttggaaaaatctatgcagcttttttaaagaaatattcaatttttcgtgcagatttaaatatgcaagaaaatttacaaaatgtaaaaaatttctagaaatttttttgtcaataatcaataataaaacatacagtacacgtctgtagcaaaattaatttacaggaaactcgagctaaaaattttgcaaaaaaaaaaaaaccatgaatccctagtagtgtaatttgtataattagtaatttgaaaaatacattactttaatgtgagatagaagaagaaaattctgtaaatgattaggtaagcttaataaggatattgtccgagcaagttcattagttcttaccgtgtaaaacttgtcttatagtttgtgattggtgtgtgaagcatttccaacgaggtcataattaaactattaagcagttgttagatggtcaattcatagatccctacgattgcacattatttccaatatctacattcattgtaatcccttggtagatcctaatttcattcatacattaaaaagccaataggaaatcgtcattttaagttc

SEQ ID NO: 328 - DNA, 2200 bp, Glycine max
  Soy_ogl_772 Gm03:595801..598000 Cluster 1
tatctatgacaggaagttgagttgagactctcacgacagttttgtcaaacaggtcatgtgcatgttacagtattggagaatggagatccactaggttggtgttggaagactcgtgattatgcatgttacagtatgttatgttgaagatttatatcagatttattagcagacacaaacaataagattttatatcagatttattagcagatacaagcaacaagattttatagcagatttggtagctagttgaattttatttgtactcttgaggaacgttttgtatcttttgttctagttttagtacaccttgtactgaaactaattgttttgttttaataatattttcttttggtcttaaaaaaaatagttataagtttaatgagtattaaaatcaattgtaaaacgtgatggttagataagaaaggctaaaaataaaataaaattttagctttactgattaataattaacaggtgtcattttataaataaataacaatacatattaataaaaaaataaaataaacttcatttcatgtaatataaaatcaagatcctatgatatatggaatggaattgtctttccatgtgtttcatttaatttgctaattgctaacaaggctcattttttacagagcaaaatgtatgtgaaacaagataatcgttccacgtactaacaatttaatagtattatatgtttaatgacgatttggactttaaattatataaatgatactttcacatcaatagtgaaaggtgcgacctatttggacgtttaattttttttaaaaaagtttaaagttgaaacttgaaaatgagatccagttgctatctaattaatgttatctaacgactgattcaaaatgtgagaagaatatgtgattagcattagtctagttgatattagtactgtgatttttttttagaatattatatatactttttcttcttgtttgaaaacctttcagcaacatctctttaaattatagtcacctctttttattttattttataatacatatggttttttttcagacacaaatattcattctttgtacaaaacttttcttcaagtgaaataatgtaattaaaagaggtcagaaaaatatctacatagagattgtcttcatgtaagtttttcagacatgagaagactttttttttagtgaaaatttagggaagggatggcatcccattacaaagtaggaaaaatctcttatgatgccaaggagataagtgggatatataaaacctgtaatatatccaatatgaaatcttgttttgcttaactctactaatttcttgagattaggcataattaacaagacattgatataacctattcagtattcttatataagacaagaatattatcttctttttttttttctttccgaagagaaagacaagtattgttaatatatatatctggttaagaaatatcaaataattaaacataatcactataaacaataaataatatttttattgtttgacttatacaccttaagaaaagtcgtaacatcataaagtacatatattatgatgattttgcaactgctatttcttttcttctaatgttacaatattggattaccactaggctgtgctaccatatgctagtattcacctaatcggtccacaagcagagtttgcgtgtatgacctgtttagagaaatgttatcacttatcacaagcaaattttcctttcacaatcaatattcactattattctttaccttattctgcaattataaacaataggctgtaccatgtatggaagacagagatatagaaaaagaaagcgaaagagaaagagtaaggagataaaaaaaaaaaagtgtatatttataattttattggttacgtaaaaaaaagtaaatatattttttacccttttttagatttgagataagtttatttttgctacctaaatttaaaatcacaccaattaattcatgctctcgatagtagtatgataattaactttaattttacattcttattatggaataccttataatcagtgtgttcctttcaagtattcattttgatgacatttgggtaaaagacgtttgggtagagaaattaaaataagttttttcaaattagaagaactaaaaacatcaattttcattgactaaaaataaagttatttcaaatctaagagactaaaaaaatattaaaaatcctcttaaactaa

SEQ ID NO: 329 - DNA, 2000 bp, Glycine max
  Soy_ogl_1096 Gm03:45431301..45433300 Cluster 1
tgtctttgttactttttcaattttgctacttccccataacgcacgcataatttattttggctcaaaactcttttgctcccctttaatataagtattacctgcattcacaataaacgagacttttcttcccattttaaaaatataaaaaaaacgttataaaagtaatattcttaataaaattacaggtcatgtttagtaaatgtaatgatagacaaaacaacacaaatacatatacaaattaaatagtaatagataataaaaaaattattttattagtttatatatcataattataatatagttgaaaaatatcattattgaaaaatttattcatcctgatcttctaatattaatttttctactaaaaagacaaaaaacaaaaacatattacttagagaaaaatgcatttccctttcttgaagatgtgtaaattatatccccctccttttattttattttatttaaatattaaaatcaattttttttgaagaaaaattaaaaatttcttagagatcaatatatattatactttaatccattttaatgcaaacaaatatgttagtaattaatgacaagcaacgatgtaaaaaagccttataacatcaatatcttcctttcttttttcgacgtttaaggttacgaataactaatttttaatattatattatcatttttcaatcagtaaacaaaaggtctttttcaaataatttattttaacttatgacacaagtatttgtgtaatttcacaagagaaggaaaatattttatgataagtcaataagttgttttcagcttatttcaataagctatttactataacttacaaaaacaacttacaatacatataaaccaatttaacctatttaattaagtatgtatgtgttagcatatgcttgtgggttagcaaaaatttgattttaatacgagtgcgctaataaattataactatattattatgtgagtactacatgtttatatttattcaataagcattttattattttttttcatcccaaaaaaaaaatattttgatatataattatattaagttattaaggattttaaaacttaacttaaaatctccattttatttttataaatcccaaagctaatatattaagaattttaaaaaataattattaataatgttgaacgctatataaaaagagaaaatctaaccttaaaaggtttatttacattcaaataaattcaattataacacattaattttttaagagaaaaaaatataatttcagaatcataaataatactataatttaagtatttttaaagaaaagaaagaaaattttactaattacttaatgtatatagccacttttgagtgaacttaaggcatctataataaaaaaaaaaaaatcaaagatcatttaaaaggttcacaactccaataaaatagtagtaaatatttttacacaaacttaaaaattgttagaggataaaaaaatgaaacataagattttttaaaattaaaatagatggtaaaaaatatataaaaaaaacatgagtctcacattagatttataaaaaaaaaaaaaaaatccttttcccgtgaatcaaacacagtttaagagacagtatcattacccacataatcctcaccaaccaaattaagtgctaaaaaagtgtaaagtaaacagagttgaatctgtggtgaatgaaagtttgagtccatttgtggcgttattacactctgtggtctattcgaggctggattaattccaacatcaacatctaaccaaactcatcaaaagatccacgtctctccctttaatctttatacacggattcttctgccccagagctccacaaattacaactaccaaaaaaacccaatttctatacccaaacaatctacatttgcctgtctgtttcccattctaattccatcaatcatgccaaatattcgcaattattagtagtatttttgaaaatacctaggcaacgtgtcgagtcttccaaccaggccttcagattaattt

SEQ ID NO: 330 - DNA, 2400 bp, Glycine max
  Soy_ogl_1185 Gm04:2393801..2396200 Cluster 1
tgtgctcttctttctgcattctcttattcatagcgatgaattcctcaaccgcgcggttgaactcgtcttcactcaactgttccacgcaccgcaattgcctctgcaacgatggcggagccaccgccatccgccgctcataactctccgactgaactctccggtaacacttcttctccgacaccgaaaccgtctctccctccgtcgtcgtcacagtcgtgcaacaacacgtcgtggtagtggtggtctcagtaaccgccctgacagtttcctcgaaaaccggagacgatgaaccacaaatagtggtggtgatttttttgtgggaagaatcaacggtccgaggttgttcctgcggtgcggttacgatgaggcgagactggttgagggcgtctttggaggcaccaacgttgttggagagtgtgaatagtaagaggatgatggcgtttaggagaagaaatgcgtaaaaagagttgcggaaaagtggtagtaaaaaatggtagagataagggaatgtttggagggtgatattggggaagaaagaggagcagtgggagaagagcaagattgcggcacagagtttgaacaagtggaagatggtttccagagttcgttttctttggaaccttctcatggcattggctttgtcgttttcaagttgccagaaagccatattcaaagggggatctgaagcaattctaggttgcatctctaactcgtttatatagctaggcacaatgccatagggtggtgttgctcatataataatgttaggaaattcatgaatcctaaggtgaaaatttgtaactctcgtgctggtatgtaattaatataaaaatcattttccacaattttacttacatattttacataaattttaatttttaagaaatataataaaactaatcaagtatatttttaagaatcatatttttttataatgaaaaaactacttccctaacaaacaccctatatgattgttactttgtttcctaactaaaaattaggaacatgccctcactaaaatggaaacgaaatagagagaagaaagaaactttatgtaaaaatagaaaacagatctagaattaatggacttctcagttttttttccttctaactatagtccttttacttttttggacattttagagaagtattttcttacttaacttcttgttataattacatttcgaatttcaaagaatatagataaaataagtaatttcaaccattcataacaaaatacataatatcaactaatgtagcttaattagtaatacacattggatttgtgaggaaaaaaatatgtttgattctcatataatactaatggattatgtgattaatctcgactgaaccaatgaatcataatcccatcgacaaataaaaaattccaattatcatagttaaaaaaatagtatcaaatagttaaaaaaatccttaaatgacatatgttacttatattatctaaattaaactgagttatccactttagaacatgagtatctttatttttataatatgatacatttgaatttgaattttttataacaaaaacatattatattatattgaactaatgttgtttttaacttatccaaattaattatcaacaaaactaataaatattttagcacatgtatcatggtaacaaaagaatattaaattaatatttttctctttagttgattattcaataaaattttgaatttaattaatttttctaattaatgcatatttttaattcacataaaatataataaaatatttattcattattatcaataaaaagtatttaatgaattaaaacaatttatgatattcaaaaaaattaaatgcctatattttattgtaattcatgtttcttattaatactataacaaatttttactaaatatttttaaattaaaatatttcaactttttatccgtatatatttcatatttagcatgcacttaaaagtaatcatgtattaatgtacaacatacttattagtgtaatcaaaatataaagataaaaccaaccgccaatcactctaaataatacttgtctaattttctttaaacaagattttaagttttaatcttttgaataattttgtttttcatttaatggtcacacactcttaaaacagttttacactatagactagtaaacaaattagaagtgacatagcttttaagataataattataataaaagtcaataaatttatcataaataataagttataataaaatataatataatccatcactatcagtgcataatatattttctcattttttttatacttaaaaggttaatactatatactttggtcgataaaagtttaggtcaagggatagtacctaattgtccgatgcaatacctttttttttaattccacttgactatatatattta

SEQ ID NO: 331 - DNA, 2900 bp, Glycine max
  Soy_ogl_2217 Gm07:5439401..5442300 Cluster 1
gcagacatatttaatactttttcctttctctctcgtgccactactttgaataatgatgtgatttttgttatttgaaaataataataataagtcatatttgatgtaggttttattaatctctataaattataaatttaagtttttttttcatcatgaaaatatttatactatgttattttttttgtgatacgcaagcttcagtattattttatacttgtttttataactttttaaattctcaatttattaattattttcacattatctcgttatgattcacttttatattaaaatttctctttaatcaagatttaaaactctcaactctatttttaatttttttgtttttatttttaaaaactatttttttatctcaaatgtcaattacctatattctgaattttttttctattttttagtttttcttttgacttaaaggtaaacgatacctttttggcttttttttactcaaatttcgagcaaaaaaaataatccactgtaattcacgaaacagtatttggaaattacgttaccagatatgaaatggatttaaaattaattatctagaaagtaacatataaaaaacaccatatatcaaaattttatactattttggcttttaatgtctgcaatgtgagattaatccaaaggtcatctttgttgtcggagacagaaagcggatggagagtcttaattatatataaagaccgaggtagtataattgagatagagataaagttatttacatctaatcaagatataaatgaaagttattgtttttatcttcgttcacacatgcatgcatgttagttttattattaaaagtgttagttgagggtttgaattcactatctttctttcctctaatggcgaatttatgtaatagcggggagccttggccccccattttttaaaattgtcaataccctaataaatattaatataagattgtccttttgcccccaccgaattattttaatatagagaaacataggcatgatagttaaatttgaacccatcttggccaacaccacatccacgacctgttctataacaaaacaatgatgtgaaattaatggttcttcctcacagcaactttcatgaattttctttctcgcttaccgtgcaccgattgtctgtgcaaggaaaatgccgagaaaagttataacataatacaaatatttttaatttatttaaaaattttaaaaaatatatataacagaagtttaattatttttttataataacaatgaaatcataaatttttagataataaaagatgagttccttgttagtaatagctagatattttattttataggataatttaaagagaaaattaaaagttttgaaattaaagaaaatttaattatgaagataaatttaaattgagagttggatgaaattaaaggaattaactctttatatcataatgaatatgtaattaaaggagctaactctttatatcataataatagctgtgctggaaaacccataagagttggatgtaattaaaggagtttactttttatatcaaaattttatattgaaacagatatttattgaaattgtttttttgttatcctttctaaactgtttccgtgttattcgttttgataaactgaattcacaattaaatattaacacttgacttctatgttgttttgaatggcggcacaacgacaccagaaaaactatatcatgttcattacgtcttactacagtaagattatcttaaaattatttaagagaaaaacgaatggggaacctgactcgtaattaatatggtagcgatcgaggaagtcgttatgctgagctgtcacagttcaaatatttttgtcatatgagaagtaaacaaaggcaataatagcttaattttgtttctgcatgtggttccaaacagggccccccaacaatacaccataaagacttttagatgatcctccaaagctttcttcagtagatacttctctacctaagtaccgactactgtgttatctttctgttactgtcttcctagcttgagcagatacctctgtcctttctgttactttgtcttcaaactcattcttgctttatttattgtttattcattatatgtttaaagttgtttaatttttactaaatttgccgtaaattaattaaaacaatacatatatacttataatttaatagtagttaattatattgataaaatttattaatagtataataatcaacgaaacttataactattgctttttaatgcaaaatattcaaattgtacgaattataattcaaaactcattatttctcttaattatcagattttaaaaaaaaatacagataagccaattatattacaatatttgtttcataaatttattttgattgaaccgaatattaatttcataatcagctaaaaaaattaaagtttatagtaatatcacgacaaagaatcaaagatccaaactacgttagttataaaaaaaaaaggttttcgcacaatgatctccctccgtgtgtttctttataaggatagagtgagagagaggaggaggaagagaccaagactcgcatgagttggactaagaaaaagtacttctgattctgaaagcgcgatcagcgatggaatttatagtcttagtgcttatgagaacagctaaaagaagcgagaaattaaagctagagatgagagtatctatagatgactaaggaatggggttgtgaacgttcttatgctagccagattccatcatatatattccgggttatttgtagtcaccgacagtcttttattgctgtgtttacttttggaaagcacatagtcaatgtacatattttcattttcttaatatattttttgacatggatctcaaaactgtatatcaaatacaaatcatttaaatagttacgcaatt

SEQ ID NO: 332 - DNA, 2749 bp, Glycine max
  Soy_ogl_3589 Gm10:46725152..46727900 Cluster 1
attaaggatgattaagaatctcaatcaagtcaagtaaataaaatggtttccgttttgtacatttaatttactattttttcaaatatatatatttttttagtaaaacaggattagataaaaaatatatataatacatccacctagtaagaacaagaagtagttgtcatgatacttaattagataaatttcagactcgttattatgataatttttttaatgctttcgtcatattttaaccggtaattttttatgttagatcacatgtatcttttgttataaataattatattcgagcggataaaacctgcgaattttaactgctaatatgcatggacaacagcacatttcaataagtatgagactactagctgctatatatattgcattaaatcagcttatgacaaaaccaaatctaaaagtttaatttatacggcctaatatcaaaattgatgaacaataataagaaggaattgttactatgaaggttgctggaaagaatgctatgtgactatttgatattcatttctgcaagctccttggggttgagctcatacgcaggagatggaaacaagtcatacagcccggggacagcgcatcttggtagattcatcagattcttctcatcgcaactattcatttctatctttctaactttattctcttctctatattgtaattattttttcgagacgtactatatgattccacccactaaaaaagtgaaagacataattaagaggaagaaagtgcatgatgaaatgtgtaagaaaaggggagggacacaggaaatgaattgggataaatgaggaatttgtacttgatttttagatgtatatacattctcatttaaaaagtaaattactcaagagacaaagttaatccataacgaagataaaataaagtttattgcaccttttattcaaataatgatactgttatgcctaataatatgagccataaaatatgtcatcctttggtactagaaacgtaatcactactaaacaactagaaattaatttttttaatagacataattatgtttaaatgaacaataaaaaatattttatacaattacatatttaagatttgaatccgaaattttcttaattatttagattttagttactattgttttaggtatatgaaataaattaggaacatagatatgaaaataatcgaagataaataatggcggtggtatataatttggatccaacgcgttgctagccgaaacagaagggagggagtgatgactgatgagtgatctgtatccatctggagaatttaatgagatgggccctaacgtttgggaagaaaccttcgaaagagataaagccatgaattgaaattcatcaatgattaggagtcacaatctccacatatatggccatggagcctccgtccatcaaatttctcactcgttaccaactttactccaagattttttttgccataaaattacttggagataaaaattcacccaggattctcacacattgccctaaattttttttgccatcaaatttctcattctcatacataatgttctaatgattctattatttttgttctttttataagataagtatatgtttctactaaaactatatatgtaattaccatgtgactcatattaggtctattttttttgttgtttttctctttctgatgtataataaaaaatcttcaaaaaaagggtaacataatagacaattaaatttccaattcgtcacattcaaattttgaaaactcacactagtctagatttactgaaaatggaaactcattgggaaaatagttgtcctacattagtgttaatgcaacacacaaacatgtttcaaggttgttttcttttgtgtgtgaaatgaaatcttgaaaaccgttaccatatttgtttgattgagaaattcatttttctctagagaggtcttttttaaaggatattttgtatagagaggttaaaaatacaataacactaatttttattagtttaagaaaatgaaaaattatatatatattttttataaatattctaatttaccaaagaacattttactgtgtgtttgttaaaagtcatgggaaaccatttaaattactaaaatgtgaaataaattttttcagtaaagaatacttatggtccgagaaaaaaaatataaaactcaatcaaattaaactagaacgtaatattcattatttagcatttttcttttaaatgattcgaatatccttttgccttaaattcattccaaaacaattcctcaagggtcctttttaaatataatttgtaaattataaacatgactcaatggaattacacgagtgcccttttgaagtgatatgtgtcatatactcatgtgtgtactgctacgcacttaataccaaaagtaaaagatcgtcacccacactatacaactacctatatatatgcaccaacttcatccaaaactgaaaaaccatctaatatcgaacttctgatagactaatacattaaaaacggagacaaattatctatttcattctaatttagacgatttagatcagttttatattccattatatcaactgaatagaaataaaatattaattcatttataatatgttaaaatatattaaaaaaataatctatcagtggcttgtaaaaagaaaaaaattaattcatttattaattatttttataaatatttaaaaatatattaaaacaactattgtttttagtagtcaataaaagttctctgtctaaaaaatttct

SEQ ID NO: 333 - DNA, 1766 bp, Glycine max
  Soy_ogl_3625 Gm10:48551614..48553379 Cluster 1
gtacaggtgtaaatagatattttgtataccatataatataaagtctcaaaggaaaatttgaaaatcatggtccgaaaaatattaagtttgattctgttaaataaaattttaagttcaagtagattaaaaaaatatgactaaaaaaagagattttacaaaaaaataatcacttagattactcggtgattaatcactgagatgtcatcttgtaatttttttgttatatatttttacggaaatttattggttagcagaataatataatgtttcaatcaataaatgacggggaaattgaatattattgtagtattctttcttttcttaattaaaaatctttatttccctaatcatatcctatggcagacttcataattttctaaacacacagcacgttttcgctttccacgtcacgagaagcctttttgttttctttactaaatatctaaagatcaaaagtggaaagtactcttaacagtttgaaaaatatgcaaataattttgtaacgagataattgacaatagaagttgaatggaccaaaatcgattgacgatggcttatggaaaataaaagaagtcaaaagaattgaagtcttgtttagataaaaaaaacgaattatttttatataaattaaaattagtttatattaacttttatgaaatgttttcatttattttttgaaaaaaattaagatgcataagttgattttaatttataaaaaaaatgttttatttttaattataagctttatgaatattttttatttttatctaaagcagatctaaaatgtagaagacaactagtacaatatgatacgaacttaatttaaacgacgggaagacattttaaatgactaaaaagcttggtatgagggagaaggatggaattggatacgtagctagctgttttgattatgataagattgtgataacaacatcgatgattaataatgtcacatgggttttaatttgagagtataagaaagtaacaacgacttgaagactccacaaaaaaaaaaaactcctcaacaaaaatgttaaaaagtaaaaaaaaaaaaaaagtgaaatacgcgatgtagttttttttttttttgttacatcatttcacgttaaagaattacttctatatttaaaaagtattatttttaaaggtttttcatgcatttatttcaatttttaaaaataaaaaatttaattaaaaccacaagctattttcaacaactcttcataaaataatctgctttttattttttaaaaataaatttatgattataaataaatataaattaacttttttaaatttttagagaaaatttagtagattattatttacattgagtcacttgtttttaattaatagcaaataacaaatttgctcataaatcataattctatggcatgagtccatgaccaagatgaagacttgggtgaaaaaaaggtaagatgaggattcggcactttcggctgtgaggacctttccattttgagtaatactattttcaaaatatatttttataataagttccataaataatataaaataaaataggcgatgtgatcaagataaataaaaaaaaaagttgccaaaaatacagtaaaaaataataaaagcaacaatatttttaaatttataacaatttattactcgattaaatgagttaaatcccttaaaatttgtaatctatggttatttgagctaacaaaagaaaatgattactaagttaaaagtagtgataatatgtatcatccataattttataacacttctta

SEQ ID NO: 334 - DNA, 2198 bp, Glycine max
  Soy_ogl_3746 Gm11:5197203..5199400 Cluster 1
aaaaactcatgattttgtctagttatattttttgatatagatcacaaatattctcttcaagagataatcctcatccagtcttgtgaaattattataaatgaataataaattcttcctttaaattcatccagtcttgatcggtacactctggttggtgctatacttgtattttgctccataaaaataataaaattaatgatatatggccaattttagatatataggaaaaaccgaaaaagctcattgtttaagaaatgtatggcacttgcttccaaaaaaaaaagaaagaaatatatggcactggtttttgaattattttccccagttggcagggagaagttctaacatctgcaacaaatttctttgctaaatgcgttcaaacggatgtcataacagctcggcagacttttctctcatgcacagtttgaagattgtagactctagcaagtggtctcagtttttgttctttggttcactctccacgtatttttcaataaagtagctgataagataagcttgcagatttagctttttcttataaagaaacatattggatagaggaagagttctccaccaaatttcttctctgattgtctattttgaataaatatcagactattgaatcttaatatatatttattgttttggtgcaaaattataaatatcttttttcacataaaacaattatcctcaaattggatgagggcactataaatgtaagaactcttccactgattaaaatagaaaaactcgtatcaattgataagagttcaaatttttaataaaaaaaaaactatttatgtaaaagaaaactacaaaataaaaatatcatttatataaaaaatcatataaacacattttttatatcattgaatatttaccaattaattcaataattgatttcacttgaaaattaactaagtttaggtataattatatttttaccaaacaactaattcaatcagtttagtaatttttgttgtatgttcttttttaccggacaaaaaaacatgcagtctagtaatttttagttaaaaattagcttttcaaagttttgaatacatagcagcaacagagacagtcctggatttggtcacttacagggtcatggtcatgcgcgatcgaatggatggttaaaaaccagcaacatctatttctatgactgctggaatacaaatctcttactgtgtctgtgtctcaactctgaaccatctatttttcctggaacaggcaattagttgaataacatataatagatgacatttctttctatcaatgatttttcatcatttttttaaatcaaaattttcacatgccaaatagatctgaccagtgacaaattaaatatttgctaaaaaaaattagaatttgcacttaattaaatagcgtgagagctaggtgggcctcacgagtaacttcaaaatacatatttttttccaatggtctttcatatggtgtcaccagccaacataccaacggagagtgaaaaataacaaaagagggcagcttaaacaaatacaaagaaatcgacgcaagtaatgtgcagactttcctctcattttctttggtcttaatccaattgttaatattaatatagttaacaagtgggctcatatgtgagacacatcaaacaaaacaatattggctcgaactggatattttcctttaccttttgcttattatagaaaagaacaagtttaagccctcttagtaaatcagcttaatataatccttttaattaaataacgaaaaatatcaaatacttttatgatatcaagtttggttcgatttgtttgaaaaaccttaaatatttttttaatcaattttctgtgtaagtttttgaaaaataaacaattatttatgataaattaatctctctcaaatatacactaatatttcaagttcttttgcattcaacttaaatatttatttgatgttttgtgttctaaatagttaaaattaagaagttttcaactaattattcacaatgattaaccataaataattctcctcaaaattcaaaattcgcaattaattaatttaaacctatgatatacgtgtacttttcaaccacttcgaacattaatataaaatttgtaagaaaattaataatttaatcaataaaaaataaaaatcattttatgcaaaaagacatgaaaaaaaatatagattagcaaatcaaattatttttcaagtga

SEQ ID NO: 335 - DNA, 2500 bp, Glycine max
  Soy_ogl_4094 Gm12:35498301..35500800 Cluster 1
ggaccgttgcatgtatacaatcaacctcaagtctaatgcattattaagctcaccacatatccaaggtattgtcagctttaaatcttgtgtggacctcataattatatccttaaaagacattttagtaggttaaaaaatgatatatttataaaatatgcatgacctttattcctaagtaatgcaaaaaaaaaaaaatgtgtacaagaacttgatgcatatagttttatatttacctaaaacaactacagtccaaaaatatgtatttagtttttaataaaaataataatatagcatatttataatttcagttgataatgttttctttttaaaatttcacaatgtaacttacataggaaaagaaaaagaaaaagaaaaggaagagaagataaaaagatttttttttcaaaaaagttgaagaaatagagttggatgttctcacaataaaaaaaggttagggtgatgctcaatgtatcaaggaggtgatgttaattgtgcttgctgtaatttacattaggaatctgcaaatcacatgtttttcaggtgtaacaaagcacaagacatatggagcagatgttatcaatggattggagagacaagagcactaccagcagatttggaaagccatttctggcaacacgaagggaccagatgctagactagcatggtggggggtttggatctcaacaatctggaacatatggaaattaaaataggaacaatatagtgtttaataaagggaaatgggaagcagaaattgtttttgatggaatcaggttctgggcgtggtaccggtgcaaagcaaacataaaggatttcaatttctctttgcatgtgtggcacctggatccggtttactgcttgtctcagatttagcaaattatgcaaatgttgattgatgtggggagtggagcttttacggaaaagaaggttctatggggtgtttatacagtgagagaataatgttattatacatatattgcaggtggatatataggaatggggcagtgatattaattatcaaaggacttgcgggtgaaattttcgaatttagtcttgatcctatcttgtaagttgtatacgtattgtatctattcttgagtgctgtgtgatctttaacagattgtgttttttctgttatgatacaaagcatttgtaggatgactcggttacggtttagcgatgtgttacaacttgtggcatatcctaaactttattatacataatgtatatacatactttggttggttgttaaataaaaattatgtaagagaatatcaagtgtcactaacattgatagccagaatcatggtcttgctctgtttacgtaattaatatattatccatttccgtcttggagcaaagaaatcacaagtaatggagccataacaatgataagagaaatatggggcacaccactaattttcataaacatctgctatctattttctaatacgtgatgttcgctaaatcaccattgatcatacaaataaaagacagtgcggcaatttatttttatgtatcactcatgttctacaaactccacaaccatatatagagagagagagaaaatgcaaattgattccatatatttgaagataaatagatacacttaagttaaaaaatgaatttataatatcggtgaaaaggagatattgtcaatgcttgaagtatatattaatttgaggaagaacaccaacaattatcaacacgtgaagtcttcgatggagtagttaattaacctcactgaaaagaaaaatttagaacgagataaaatgcgaaaaagcacatgaattttgaaagtgactctaatctctaaactataaatttgacaaaacacaagaacaattgaataataattaaacctcaattactagctagagttgagtcgaggacgacgaatgatattcaaggtgaccaattagtgcttcgtgacaagggagatgagtgttgtccaaataaaagcagtgttatatatatatatgatttctagccttctaataacaagttcctcaagaggaggtaattgcccaaatcttcaacaaacaatatttacaatcactaatattgagaattgtccaacaaggaattataagattggatttgatgagaaaaaaaaaaggatataagtatcaattttatctgaatttttcttattaacattttaacaaaaattaataattaatattttttgataaaaaaataaattatccaaccaatttggaaatcaagtttgtatcactatagaatttaacgctgagtttctttaattttgttgaaggttgcatgttgttgagtacattttttacaatttggaatattgtgggttactgtcccactccaacataatcttaatcaactattctaaaaaaatttacattgtcaaccactaattaattactatatcattgaattttttttaatttttctaataattattttaaactcatatttatgattttatttatttggctgaaaatatatcaaaattaattaaaatttt

SEQ ID NO: 336 - DNA, 2055 bp, Glycine max
  Soy_ogl_4107 Gm12:35983001..35985055 Cluster 1
attgctgaaacttgggtggacatgtctaaaatctttgccttcttttggaatagcttatctctaaaagtttttgcagtcaaatcaacatatggcttctctattaactagaatcagcagctagttttcttttcaacaatttgtgccaactcttcccacataagccacaggtcccttagggcagaatccagcaaaataaccctaggccttggggcttcttcggagatttcaattgtgttaagagctcatgaaaaaagaggtctcttatgtagacttcaggtcttggactgaccaaaattctctagttcacattcctgccaaagggtccctctttacttgacgaatggcaaaggggaaaataacagaacagacatgagactggataggctgatttgtaataattcaggggtgaattttttagattctatatcttttatagctctccctaaaagcagctctgatcatcaccccctgttgcttgcttttgaaaaggaccaacatcaccacccatcctcttttaaatttcttaaatgtggtctgatcattcaatgtgcaaaaaggtttggttcaacaagctggtttggttcaaattatttaataaattttgaaaaaaaattgaaccaaacttattgagttaaatttgattggtttgaattttatttttaaagaaaaatttaaaataaataagtaaattccatacttttttattatttaaaaataaataaatttaacaagaaatttaaactctttactttattgtttttcttcataaagtaaaattgtttattattttttgttatataaactaaaacaagtaaggaattttctgcctccccaatttgacatgtcaatctcattgttatatatataaaaaaaaaacataacaaaatatatgaagcaataaaaattctcataaaaatatgctatgaatcggttgaagtctgagttgcttgaagcggagtgcaatgagatttgttatcaaccaagaaagagaaaagcgtgtgagaaaatgcgatgacccagggtttgacacgcagctgaacctgtggcactggaaagcaaaaattctgctctctctttcattcaaagctgtgaggaagttgcttcgatatagcaatttgtgctaatgcgttacgacctatcaacaagtatatgaattaacaaattaataagaatctcccagtttcaaattaccatgccatgcttcatgtgtcacgtttttaagttgtaccatgttatttatttataaattatcattaggatcttttgtttaatttactttttgttagattatcacaatcttgagtttttggtagatatattatgagtatttcggacttcaaaacttaattttacttgaagtcctttatttttttcaaagattttattttatttgcaccaaagatattcccttaatatagtcgaaaattaatttcttttgaaatatagagacaactaaaataaattttcttttttctaacaattttttttttcatacatatatgacaagaactaaaactcattcgagatgttttcagaagctttcaccttttgatggttatggactaattcttttagttgttggcttttcggtaaagagagataacattgcactaaaaaaccaaaaaagggaattacattctaacaaaaggtgcccctctgcattagctaagaggtggtaagtcaactcgtttgttttttttactttaagttctttacttttttgtaataaaaaaaattattattatttgcatcaaagatagtaggagattaacttcttttaagatgtaaagattattaaaattgaatttatctcttttaacttattctattgaaaaatgctaaaagttaaaaaaaaattgtcaaaaacgcaggaaggttgattttcgtgaaattcttctttaattttataattatcttcaccaagatttgttttaaaaaatcaccaccagagatgttataattcttatgattcatcccaaaaaaaaatcatactaaataatactgctctattttgatacacataataagaaatcaaatcctcagtaaagaactgaa

SEQ ID NO: 337 - DNA, 1700 bp, Glycine max
  Soy_ogl_5212 Gm16:751501..753200 Cluster 1
acaaattttacataacaatataacaccacgatcggaaaatgttaataaaaatgaaatgtattaaaaaaatgaaaaaaatacatgataactctaactatgaatttggttactgataatgatggttgggggatataaaccaagaaccataattgaaatcagagaaatatcgaaagacagagagaaaaaaaaaaaacagagaaacaaaatcccattttccaagtggcggcatttgagagtttcatccctcatgtttaattaacatccaaagaactcaagacattcttcaagaatggcttagaatggttataggatggggaaaaaacgagggaaatgaatttggaacgcacgtataatgtctagctatgaatagaatcgttcccaatgcagaaactttaggacacgatactgagcctagaagatggcttaagacaagctacaaattgctccctctcaaaaaaataaaaaaagagccaagctacaaattgcaggtttcaaagttagtataggcatatgatcatgttaaaattaggcacaagttatatacttggccccactgatagcaggcatagccatgttaaagatctaggaattgacaatagtgttaagaaccaaaacaactaaaattgtattaactaatgactagttatttcacatagcaatgtagcatataatttatttgatatatacaagcctatttgaccaaagtagacatgtgattttaacttttttctctctctatttttaccattaatattttaataaaattcctcccttgcataatgaaagtataagagtaatgtttttctttataaaaagaaatatttttttcaaaaaccgttttttattcatttggtttatgtgaagaatttttaaattgtgtggagagagataaagacatacgcaatgtcaaatacaaagtcgagaatttgatgttcaaatagtagaattcaaactatatataattccctagtcttccttaagaaatgagaaagaaattaaaatatttaacaaatgataagagtttaaaattaacttaaaagtatataaaaatagttttatctagaaaagaaaacaaaaatatatgaacataattttacatttaccaattagattaatatctaactttgtcaaatacttataatttaataaattaacttagtgagttttaagtaaaaatattttttctaacttttggctagagtctcagttttcaattaatttgctagttgtttttgtcaaacaaatcctagtagttgtcaaaattcgaattcagcttctaaaattattaatattggagataagataaatcactagagtcgatttagtggtgaaagatttagataatctgtataagctagattttagattctgattttattattgacattttatacaaaaacaaaaaacaggaatgatctatactttacaattttaagaactatgtttttattcataagtaaactacatttttttcatatatgattgcataaactaaaataacaggttattataattttattaaactaaattaatgatttagttatgccatttaatttgactgcattgatcgacgtcatgaagttgatgttttttagcagccaagcaagcctttttctccatatgtaatttcctgctttctttcttcttggccttcttatctcataaaacactcttccatatatgcaattaataagcaattg

SEQ ID NO: 338 - DNA, 1509 bp, Glycine max
  Soy_ogl_5249 Gm16:2217892..2219400 Cluster 1
aataatgactacagcttatctgtttgttgaaataacttgtgcttggtgacaatattttccagcatgaattgaccattgaatcattgatttcatggtcgattcttttaaattccattaggacaaaaatcgtttcctaataagtcaaaataaataaatgctgtacaaatttggaagcacggaacctacttcaggcttccaaaaagttctgaaattaacttatgttaaaagacgttgtatatatattatttagtcctaaaatgaaataatttttgttgttttgattcttgaaagagcacatttatatggtctccaaaagtgtaaaattactaacaagttttttctatcaagttgcttccttgtaaacaattttatttgatgaagaactaatttgtataaaaaaaaaaacttttatgaacagaaaaagctgacttgttgatggacaaaattctatattaattctttaaaagtgaaaagttaatcttttaactaaatcattcgcatgttgatcatattttcctaaataattaaaataaatttttgaataagacaacatatttgtgttagtttcatacttagaattgatgcttgaaattgaatttagtctcattagtcttaatttttctatttgaaaatcttttaaaaattctagtcataattatataaaaattttatgggattacaaaataattagcttaagccatttctaacttctaaccaacacaataaaaattgtcttcttcagtcaccaattcattaaaaactatcaattcctcactcatattccacaaatgctgtgcttactttaattgtggctgctgttgtctctctaactggatagatcagttgttttccaaactcgatccatccaacggacttatgtacgctccaattagaagtttcaaaatgtacgcttttcttttacatattcaaaatgtaattcttttcaaattgtacttatagttatagctaaccaaatcaagttgtttttaaaataataattatactgttatacttaagctatttaataataatatatttttttcaacgataaatactctatactaacatcatgatcaataaaataaaaatgatttaataattagcatataaaatattttttaataagagatttataattcaattcctctaaagtgaccaactcataaaaaacaaggtaaataatcttggtcattgacaagaaaatcaattgatgttgaatgtacgtaagcaggaccgtgttagaattttttaggccttaggtaaattttatatttaaaaaattattaattaaaatttaataatcaaacaatttaaacatctcattcaataataatttattcaaatcaatatctttgtaatataatttatctcaagttaatttaaaaactaatttttattttctttcaagaatgacatgaattactaatattattaataatattatgtaaatattacctgcatgtaaaattaattatttttaatataatttaattaatatttttaagatta

SEQ ID NO: 339 - DNA, 3108 bp, Glycine max
  Soy_ogl_5255 Gm16:2399893..2403000 Cluster 1
gtactatattaattcataatagctttaggaaattattaaataagtttaaatgtataattcaatataacttaatgctacgttatcaaaacaaaatgcagtgaaccaattgaatagaataattcttcatcctccttaaatatttttttatttttcttatatggtaagtattaaacgtgttttatattttcatgaaattaaatttttattttcttatttcatattttttttatgagggagtaagaagattagtagtagaatacatataacattatgcaattgcattttttttattactatataagttaattgattttttttctttcaaaaacctaacatgcatttgataaataaaatctgcaacagttataattagaaagaaacaaggttcattaatttttttttataataaatattcaaattgtggttttcatttcttgttatttttgtttttattattatattatattttgaaatgggagcttttggcgcgcctataaaaggagggaattgagctcacaagaaaccgttgtgtttcgtttcagagttgagagtgggttgttgtttccccgctagtttcatttcagattgaaaaaaaaaaaaactaatctcagattcccgaggcagcagcatgggaaagcgcctccaaaacgctacttcctccggcggcgagattccgccggaaaagcggatccgccggagcaaaaccatttgctcttgcaactctcctcgccctccgtttctctctgctcactccactttctcctggttatctctctctctctctgaaaatcttattgcaaatttgatttaaatttcaagcactttactcgtatatatgaatgctggttttaattaaacgcggtcttatgcttagtatgcaattacgcattgcttagtcacggatttgaactcggttcggattttcatttagatctgatttctgaattgtgctccgtgcgatccagctatttttctcaatgatttgtgtgtttacgcttgaacgagtaagcggaatctatgtttacttgttccgagactcgtcaaaaagaaccggtttatgatttatttattcgttttgtgggagatctccgtgctcgtgcgatcttatagaatttttgcttgtgaatgaacttcgaatttgatttaacgagttcaatttttaaatcgcgcgctgaatcatgttatgtggcatatttttacataagaggaaacgagtaaagcttcatcagctgttaatttgtgatttcaaacacttgcttcttacggaatgtttagatcgtctcattcaatgagttccttagctatctgcataaaattgagaggagcatttccgaatttaaactgcaaaacagcttaatcactcttcgaactctgttctgtcttctttgaagtgtgttcggtttctaattacttcttaaataaataaaaaatgttaaaactactaagctcgtcgttttctatagcttcaatatgtggatgcatctttgttttatgttttgccttttcatttatagttagaaaatattgaaatgtttcaaatcgtcgttttctgtagtttctatctgtagaaaagctcaattaattggcggaatctatgtttatttatttaatgtttctaattttgtctgaacaacgtgtaaattgtgaatgataaacgagaaggttcgaagaagacatttggacagagattgctaagtttctggatggaaaatctctggtgatgctggcagccacaagccgatggttccgccgtgctattatggatgacggcatatggaagttcgtgtgtctgcgtgatcttcaggtcccacccccggaatgcgtggcattcagatggtgcaagctgtacacgtcaacctttggtaagacctcacccttattcaatgttgttcaatcaatcaacaagttttaccggttaacttcgatttttgaaattcaaatgaaatttcagatggaagccactcctacatgttccgtcaacaagagaaacacattggttagttggttcttttgttagccacgcatggttcctatcaggcctaatttattttaaacaataaaattagaggtttgaattttcttaactggatggtaaactcttatattctaactaaggaaaaaagattgttagtcattacttggagagataccagagataaatgatcggagaaaagaaataagtgatttatatgttagttatttgatgtaatggaaaagaaaatcaattagaaaggaaaaaaagtataatgagtgtgactattatttatttttttattcttattttgtttgactttttagtaaaaaatatattctatttagatttttattttataatatgaagtcttaaatatgaaatgattaatatgtagtataatgaaagagaatttaataaagaagagatatattaataaattctcttattaaataaattttatggaagaatattgtttcccttaatatttaagggaaatcttaaataacagtagtttttatgaaatcttaaatattaagggaaataatattgtttaattggtgaggaactcatagttctctaattaattaaaagcaaatttatggaagtggtgggcaattgggtatagtcgttagtcataacatgtgaaattcatactaaattttaacataccccacgcacaattattaccgtatccacattccaaattttgtgaaactcataataaattttagagtaacattattttcaaatattttctataacagagataagaaatatgaaaaaagtagaaaaaaagattagaaatagataaaaaagtatggtaaaattgttaagtaaaaataatattattctaaattttaattattattgttatcaacaacgtcagtgaccactaaccacttctagcccctattcttcctcccctgtttgtgattgtttagctatgatgcaaattcgtcgtgtaaatctttttaaaatttttaattttttccaaccactgattgagtcattcttatacatatattgttgaactaaaacaaagtccacttgactaaaaatgtgctacaggcaatatgtgcagctttaactagaaagttattgatgttataactttttttttttatgtattatgt

SEQ ID NO: 340 - DNA, 2735 bp, Glycine max
  Soy_ogl_5637 Gm17:11849725..11852459 Cluster 1
atctctctaaatcttaataaaaaaataattttaaaataataatataaataattaataaatttaatacgataactattttttatcctgtaactatattgataattactttacctatttagtactataagcatagactgcatagtctctacatataaaaagagaaagaaataatcatataaaaattcattgttgtgtactttaatcatttgccatctgacaagttgccgttccgcaattatatcggtcattacagatcatgctgagataagagtatctagtaaataaaattagatattgcatttatatataaacaaatagaaaacgatggaaagttggtgggtcaatgagaaattgatatttcatggaatgcataacttgtattattgccatgtttgcgaatcctcgtaactgcttgatcaacgccggcaagtgcaattaataaataaatggtgcagaaaaaaaaataactatgaggtttgttcaattgaattaaacacaatagatatgcaacttgtaccaaaattcttagtttttccaagactggtaaacgaattgtggtgacttgtgggtttgtcaatgaggacatgaagatagccttggaaagtttggcagaactcggcacctcatccttgcgggtgttgctcaagttttataattatttaatgctggtgttctaaaaaagttagaatatatttttatacctataaatataaaaatgttcaaaacttattctataaatttttactattatcattataaaattaaaatgtatcatttttaagtttaggataagatttgaatatctcaaattacgtgtgttactttgttacatagttataacataatcaataaaaaaaatattactttaagtttggatttaattatcacctgtgtttagaaaaaaaataacattctaattttgtgaggataaaaaatatattaaaaagtacaaaaaaaaaattttaaacatttatatatttatgacaacaaaaatcatattttaaccttaaaaaaataaaatataaaatatcatacttattttacagcttaaaaccttataatttattttagagtggggtaataagtcaaatcaaaactttccggataggtcagttgcattgacatttcatccatttgagaattgagactagactttgaagaaacttttgaaatgaacttggaaatgatgacaaaaagatgttgtattaattcagcttgaaatttttgacttggttttgataagttacatcgtaaaatactttgacataatactccgagagtgaatgatattgtgcaaaaaatgcacatggagtgttaaaacaaattctgtgctttgagtagcctaataacttttgtgacttgtcattagcatcgaagccctgcacatggaaactgcagaaaagagggcatcttaaagctatatcacaaatggcaaaaatcatgttgaaatgaccacgccatacattggaactctaataaaaaaaaaagcaaaagagaagccataactccttactaaagagacgagcagataaagttggcacattatggccgttggcgtcttaataataataaatggaaaatatatctacttttaaccaagtactaaccattaacaaagcgatagttataatttctctttgaatagaggggaaatcaatgatcaataatactatctataaaaaaatgaaagaatatgccagaagatattatgtgcatttttttctctgagatacataaactgacggaagatacttgtatttataagcggaacttaaaaagagactctagaacctctaattaatgtctgaccgcaaaaactttctccttccaagttccaacatttattggtagcaaaaacgtaggaaacttgcaccattcatttgctacttgtgtttgattagtactgtggagtactagtattaattagtacttcagtgactttttcatgccccaaaaagtggctttaccacttgtagaatctactgtacctattaaagttattttagtcaactttcaaaacctctcttatcttagtaacgacttgttatttatgcatctgcagacataggccatacgaaaatatacaccatataaacttgttggtattgattgatttcgtcatggcatttattaagttctcaatcttttgcatgttcattcttctttcttctactatttcttaacaaaaaaatatcaaactcttacatattttgggttaaataaaagttaggtatgtgtttatatgtgtgttaatagaattaattttatatcgacatgattttataaaattgattttaagtaataatttttatttggataatgcatactaaaaagtatttttttaaaatgttatttagatattttgaatatttttttatcggcaattgattttgaatgtataattatcaaaataaagtttaatgtctatatgtatatttcttttccattataattatttttttttccactgttaattattaaattaaaaaatatgtatataatatttttacttttgaaataaaaaccacagccctaataaaaattaaaaacattaaaattaaatgaaaatataataaaagtattaaattatcataagaattaaacacaaagtatctaaattaaaacataatatacaatgcaacataacttttacatatggggatataaacatgaggtaatttagaaaagatataactaaaacttcaaaattaattttgaataaaacaaaagggcat

SEQ ID NO: 341 - DNA, 2300 bp, Glycine max
  Soy_ogl_5853 Gm18:987301..989600 Cluster 1
aacatttgccgtgaactggagttacagggataatatccacagattttgctcataattatgttgttaggttattgctattacttaaagagtacgataaaattttaaattaatttatttctttgttgtttttaataaagtcaagtgaatgctaactaatagtgtctttaggacattaattacaaaattaaaaataaaaaataatttattgaaatatgtaaacttatattattcataacatttttttataattattataataaatatatttttgttttttaaagtaatattttaggatattgattaacaaaacccataaagttagtaatgcttttatggtcatggaccataactgttgattgtggatgtaatgtgtttagcagaaaattaaagtgggaagagactaggaaacatcatctaaggaataaggagactgggtctgggagaagtgggcgtctatttcaaacccaaactggccaagaaatttcaacatgtgggctttgatagtgatccatgccattcaagtcaaagtcaattatatatataacaccatcattattatataaagacaaacttttttttagtaatttcttttttcctttgaagtatatccttcaaccattttcaaaacacctattaaaattaagcactatcttgttacattttttttctatttttttatttaatttctactctagctgcttctcttttcccctttcttcctatttcatttttctattttataaaaaatgaacaccgacagaatgcctcttttttctcatagtatatatttaaaagaatggagtgaagaggttagtccaacatttcattaccctgtattcctttcgatctttattataaaatataaattaaaagtatgatttgattcttattataaagttgactttaaaatttttttgcattatttttttaaaaaaaatactctcaattaaagttagttctaaaatgataaaaaaaaccacaactcataaatatttgtatattttgttcaaaggattaattttagaagaaaaaaaatactaactaatgatagtttaatattcataactaaattaatcaattttttagttttaataaattagttaaatgaactttataataacagttaaaaggaatacttttttttcaaaacatcgtcatcattaagtaaaggcgatatttttttattaactttcttttgtcttccatttaaaagaaatttttttattctccactactattggaccattataccctttaaccgttttcaaattacctgtaaaaactgctatgctttgttacatcacttctaattgtctatttaatttttactctctcttcctatttcattttattttttgttttataaaaaatacatgagacatggaatgcttgtatttcatgtaatatatatttaaaagaatggcagggtgaagatgccatttccattctcttgatattactttttttttcaaaatacatatgatgatgctagcacgcattttttagcattttaaatacattttttcttattaaattctttagagtactgtttttcttagcgtgacttctttttattaaccatatctccaacacggtttcatatgaacaatgaaacacacgctcacacaactgatttacttgattagaattagatgctatttttttcttttatttaaagaggtatgaatagttcagttaaaacattttatatcttattttaaatttacatagatgcaatttttttggttcaagtgattgtgtgtgtgtatatatatataaagtgtgagtatgttgaggaaagtgttattgtatgaatttctatattaagtgcttatttgggcctcacaaattttattcaaactccatgaagaaacttttgttcatatccgaaagttcaacttgggctaagctttagggaaggagaaaggcgttttggtgtgtgctgttgggtcattctggtagtaggaggaaaaagggtagtttggggatattaaaaaattaaggggagtataagcaaaagtggaggctttgtttcgtggcttgtgaaccttcgttttcttattaaaaaataactgcagaagtatttttgtaagaaaaataaaaaaaaatcaactgaacaaaaaaccacacaaaaacgaaacaaatgagggtaaaaattcgcaaacacataaacaccttacaataataataaaaagattgaattggttcaacacttgggccaatcacgtacctacataagatattgttctttataatgaaagaaactctaaaaaaagtattcgctgattaaattttttatt

SEQ ID NO: 342 - DNA, 2770 bp, Glycine max
  Soy_ogl_6246 Gm18:58185231..58188000 Cluster 1
ggtacacctacttaggtcatataattaatttgtatgagatttcaaatttaaactttaatgtgtgtacaaaacacatgagaattttttgtcaaaaaaacacacacacattagaaatgaaatcaattaattaatcttgagtatactaaattcaaggttacttatcccctatgttaaatagggaaggctgacattcctatgttaacgaagatctcacaagagtactgcctatacttatttcataaatagggttgggatggatcataataccatctcattcattcctgcaaattaatatattttttgttataatatttgatacatattttgtctttgtcttttttaaagttgggataaaaatttatattttattattattttattaatatcttgtggtgaataagcccatgattaatgataaaaaaatatgaaaaataattataacatttaaataatgattattagtgtgaatagcatattacataatgaaaaatactgaatccttatggctactttaatttgaaaaaaaattctaattctaatttttataaataattataaaatatcatttttttttacttccctttaaaagtttaaataaaaaaaataaaaacaggtgtacggattaaagaatctgtgacaaagaaagaaaaaatggtccaaaacacttattttatttatttacaaattttgatcgagtttgagatctaagaaaaaccaagttctttatcccttaaaataacatgaattaattactatgacacaccaagattatcaattatatattcattattatttggaaatacaatttgaagatttctataggaaagaaagaaaaaaagagaggcatattcaaggtcatttactacctttagaccattaatcaagttggttcatctaaaactctcaattacttaaggctcgcataaaacatttgttattaattcagatgaaaattttattatgattgtttttttaatatattttttgtcatttttaaataaattcatcattagcatgataattattatcactttccaatcttatattgggtgactgttataattttcgtaatagttctatctattagtaattgtattattgattacttttttattctaactatatatttatccataactttgttatctatttaacgttttaacttttaattggtctatctctccccttttggaattttatttgaatctaaaaaatttaaactttggatgaagatgaattgaaaacatattatttaaatcttgaaaagccttcaagtttttaattttggagaattttgacaataatgatcttgactaatttttaacatcgtaggtattgaaagaagtgcgaacaatacaaattaatatcctattaaaaatattaaattatatcaaaaggttatattcttttttatttccaaatgaataaaaaaagattgcattcttttatgaatgcatgcattctttataaaatattattaataatatttgaccattgatgaaagatgttttctaaattaaatttatttaatcgtatataaaattatctatattgcaagatgattgaatatattagacatcttatttatcgagaatcaagtgtttgaattttttgatgataaaaccttgattaataatttataattcaaaaggcgaaaaggataaactcaagatggatgacttatttaactaaatgtcaaaaatccattttggttaaaatcctaaacatgacattgacttactctatcattcatctcactgaaaagttggtattaaagaacataaactcttggtattgaagttactttttattttgcttcatttaaatgctagatgcttttttatatacatatatacaacaaggatattattagccgatagttgaacactaatcctttttaaggcataaatattttaagtaaattttacctcaacaattttttaaagcatacagcctctcccatcaagtaggcttcagtgatagatatacttgagtgctaaaattaatttttcatttatttagatggaatggcagagccgaatggatagacctattgttgttaggaagggcatttctttcaagtcatgctcatggctaacgttggatttttcattgttgactaaaacaacatcaaagcagaatgatactattataaaagctctggctatgtgagggactagggaaggtcaaacctattctgagtctacaatatgcaaccttgccttagcgttttatgacgccatgagaccttacatgttgctaaaattgaaatgcaacaattgtgtactttatccaaaattatcactttcaagaattatattatatattgataagtttgctaagggtcgctagaagaaatagtaatatattgttgactcaaagttgtcctctacttttatggattgaactaattttcttatgtgcttatttgcaagtttgaattaatatctatcaattattaagttttttttgcctgttagtaggtttgtttgctttaatataaatttttggtaagcatttagttgaagagaaactatgagatgttcatagagtattgaatctgggtacccattaaaaaaatcatgttttagggtcaaaatgctggaagaggtatcattttcatttgatcaagcatcttacaaatttttggcttcgaattttgaaaatcaccctttgggagaactattggcttaattgctacatatttaatactcagattttcaaatccttaatgcttataggccacaaacctctccacaaaggtttcagt

SEQ ID NO: 343 - DNA, 2637 bp, Glycine max
  Soy_ogl_6821 Gm20:37924464..37927100 Cluster 1
aattgagatttgtgcaaattaattaacttttttatttagcatgaaataattttttcttatattttagatcaaaaatatttttttcttatatggtaatgattttttttatctttaaaacttaaaaaaatttaatttttgggtcttattaatcattacacttaaaacattggttaagatattaaaatgagaaaatattaattatgaaaattataatagaacgtaaaaaaaagttacaaacaatgtaatttaaaaaatattttaataattccttaattaatgtcgtaagatattatttaacatttgtcttttttttttttcactgagatgtatataataattgtggtatccgtagtaaaatggtcggccaacaactaagctttgtaattgctttgactgaggtgatttttcagttcatcatcatcatatttccttttagagatactaagtgaagtgaaaagaaatcattaccaaaagcatccaccattataatcaatcaattataattataaatatattgatttttacttaaaataatttaaaattaaatgacagtttaaacttattttataaacattaaaatcatttaaaaaacgatctgttgatggttgatacaaaacgatacttagttttaatttgatcttgtaataataattactttttaataactgtttttaagtgaagaagtatctttagcagataaagtattataaaattataactgtttataataagttaatattttcataatttatcatatacattaacatagtattatgaaattattgttgcaagaaatattgcatctttgaccccgagcatttacagacgacattgttgcttgaggccagtgaacccaacacaaacaaggaccactcactgaattctcccacacaagcggggtcttcttcagataatttcggttttgcattgctcataatgttgcatgtcacatttaatgcactaaatcatttgagagacaaggacgaccctgggttattgagatttgtttttctaaggaggcatgggcatgttttgttccggcacgtagacacatggttaattattttcatcgcatagtggattgattaaggacaaggatgaggatgatgggcaagagtcgttccttttatgggctttgggatttgtttttgtcactaaaggacttaaataatgtgggtgtgtttcacttgtgctcgtggttgtggacaaggaaggggcatgtttgagattcatgatgcttggtagtgggggagaagtgcgtgtggtggggccatattttccaatgacataacacatcccaatattgcacattttccactgttgcattgcagtctatgattcttctccacccatttcaatgttaggttcttttagtgttagagtacaaataagttgatgtgaaattttatatcgaatcaattaaatattaaataagtggaaaaaaaactcttaaaagattttaaattaaaatataatattaaatttatttgtgtaatttggtgtacatcttgatcatccttttgtgttagcaagcatgcactgagtggtggtgcccattgtgttgtgtgtatagatgacccaccatagccttgaactttcatataaacaatgaaccttggtaacctatatatgaactttcaattttttacattttccaccatcgcgtgaaaggcataccaagacatcaccattctcggcaaagcactactcatttatcccccatagagtgacaagggattgtttaacgtttggtatgctaaaaggtggctaccaagttaaagccatcatttagttagaaatgtcatggtacaaagctttattcaataatgccatattgatatgatatgcgcattaaaaaaattaaaagaagttagcatcattaaaatgcgcgtgttctcgtccttgcaatgaaaataaactttatagcaaatatgatccaaagcatacacacgagttgatccccctttttaaagggccaaaatgatggaaagaaaaagaatcacgactatgaaacatagaatcgccattaattgtactttgcctaaggaaagtaaaaatacatcttactgtacattaaagtcccttatctctaccaccaaaccaaccaatagattaactggttcagagttattctaatttaattaataattttagtttgagtttaagtatttaactatgctcggaaagagaacattatgtccatagtatagtcctaactcgagtaaaattgttgcaaatgaaagatacttgtaaattgtaatcttaaaaagagagagagagtgagagatacttgtaaattgtgaaatatgactagaattattcatatggatgctacaacagcccagaggaaatataaaaaaaaataaaaaaaaaatgaaatgcctgctttacttcatgggcattattattggcctattgttgggacatatgcgacaaaacaatccagacatatattttttttaattgctactagtctgcttttgagattggttattattacccacatatagtgttacacctgaagattaaaattgaataaaatatgtcgtaattctaacctatatctctctgtagtgcaatatatatgtgtatataataacattaggttgcaaaataaaattaatagaggcagagtca

SEQ ID NO: 344 - DNA, 1765 bp, Glycine max
  Soy_ogl_6923 Gm20:42019401..42021165 Cluster 1
tgaccctggatcgagcacggtcgggtcattatgtaaataacctaacatgtatattctattattagtttcttgttttggtcacattgccacctcctcatccttttctttttctttctttctatcacggatacagaaggggtgagagaggcaagtgagtatcgggtttttatttatttatcaagtaacgatgtttggatatttactttctatacatttcagtaacatcttttttttttttcctacaacacttctcctgttatagctatatgtatcgaatatgttattggctgtacaagaaccatgcatttttgtttttcaagtacagcaattaatgagcaacctcacctcactagcacgtacactttttctctcacccggacatgattttctctgtctctcttgcttctattttctcacaaacagaatgacattagtattatatcacattacatacaacactcacagtcacaaagaacacatgaatgtgaagactgaagaacttatgcattgagctggcatgcatggccctgcatcgcatctttttgttttcttcatttggttaaataccacattgtgtgttccaaggccctgcaagtcattaggatcattttataataaagcctgaattatgtcatttgaattaactagcgaggataaatgactcttatatgaaaatgtgtgctttctatatataatacgtgttcttgtgcgcagctgagtttccatgccacttctttgtttctttcatttcacatgatgatgatgatgttagttttattcgtttattcactgtgtgaggtctcatgcatcctttatttggttaatgtttgtcatatatatgcgtcatgtgtcttctctatttactttgtttcatcaatgccctcagtcctgttcgtcttggatagaaccttctttattatttttttttactgtagttgctttcattttcttaattatgcttagtgaatacaagaataaatcatcaactttgtatttaaagtattattctctcgaataaatatttaaatgttaaaaatcatcttcactaatctaatattaagaaaatggtccttgaacattagtaaaaaatgatattttttgaaattttgtttatatatatacatacatattattaagttaattaatataaaattatataaattaattttacatataaattatgtaaaattagttgcatttatgattttattgtaatgattaaagtgataactaatataaaattgtataaaattacttgtatgtttgtcatttttataataataattaaggttatcatcaattaatatgaaaattagttttaatttatgtaaaagtaataatttttttaaaaataattatttattaaaaattagacatttaaataattacaaaagaagaaaaaaaatttcagtctcctttataaggtttggatccgtcatccctgagtaaattaataaataaacttagatattagattgatgaatattcaacgatctagagacattttataaatcaaacgtggttcattggtaacaaacgtggaactttctcccttcccttccggtgtgtatgacgtgaaagcaatacgagtgtataataaacattttgttgttattttatttttatttaatattattttataatgttaaatactaaattgaatctgtttttgttatcatgttgtatgtgtgcagaaattactaaaagaaataagaaaaatatgaatcaacataataaaaatttaaaaccatttttaagaatgctt

SEQ ID NO: 345 - DNA, 1945 bp, Glycine max
  Soy_ogl_6949 Gm20:43265323..43267267 Cluster 1
ccaaacgaaaaaaggacggagaagaagtagatttgtccctatctgaatgtaatatatcatagcaagttaaaatatgatagatcaaactatatcaactagctccctatataccgtgacattttctaagtcctttagttgtttcgacctccagagctagaaagtgttttgactttctaagttcttttacctgaaagtgtatagacaaattacttcttagatgcacttcctcttctactttatttcaatgttgaagatttaggtaattaaatctttattcttaattaataacagtaggcaaattacagtaaaaaaaaaactcagccaaattactttttagatgtacttgctcttcctcttctctctttgcctgaaagtacgacatttattctatagccattacttctaagtacacacagggttgatcctgatattttagaggccgatgacaaaactataaataaggaccccttaaatatttaagtgttttaaaatatgaatatatatttaagaaataaacatgtaatttcattaaaaataatatattttattacattgagtaaatagcctaatttagacaaatcttttttaaaaaaatgtattttaatcaactccattgctatcctttatcatcaatcttttttaattaatttaaattcttatttttattatagtattaccaccacacttttgtagttttgttattaatttttaaaataaataatgaattatttctcttttttatgaaaataagttttttaatttatctaataccaacttcaacagctacagactagattaacttcttttgtatctgtacttgtctatcagtatcattttttttctttggcttccatattatccaatcttcatgttgggaaaaaatcacgttgctattacaaaggcacagacctagagaatagtgaaattattttaatgttttaataaaatttgaatcttcaaatagttgaaaagttgaaatgagattaagtcattaattgagaattgaataagataagttgaagaaacaaaaggtcacagagatttttatttgaaaatattaaagctggaacttttttgggtcccttttccaacatgggccaatgcaccaaaccatgctctgggtcggacctgagtacacatgcaatgatgcaaaatttagataactttaattttattactattttttaaattaatttttatttaaaagactctttcgataatcaaatagaaagtgaatctaaaacgattatcattgaatattttaaagcttttgcaataactaaatagaaataacatctaaaatgaatgttattaaacttttagttttaaatttttatattttaatttaagaattaaactctcaattaattctcttacacacaataaacaaaattaaatgaaataaaattttgaaaatagatacaagaaaattctatttttatattgtattttttaatcatttttttttggattaattcgttgacatttttattacagactcaaactcaaattaactgtaaaaataaaaaagcaattcagtgcggatctaaaatatttatacaaaaagatgaaagtgaaaagaaaccaacaagcccaataaacttggagcagtagctttgcttcggaaaaaccaaataagggaattactactcccttcttctttccctttccctcactcctcacttcccagcacctcaccttccctcttttcctatttcttttctttgatatattttgttatatatctttattttattaataatttaattaatgattatacaaattatcggaatgatgaaaaattacctttataatagtaatacaattaattgtggtataaattacttttttaattaaaatttgaattaattattacacaagtttccttttttaatcgaattaattagataaattaatattataattaatttgattgatattaata

SEQ ID NO: 346 - DNA, 2309 bp, Glycine max
  Soy_ogl_4281 Gm13:26512362..26514670 Cluster 1
gcattttgccagtcttatatccaaagtctctaagtaaaagattttataattaatattaaacaaaattacaactaacttatgcaattttaattctattttaattttagatattaaaataggtttcaattatttattttatatataaccatgattcagtttaacttattgtttaatattaaatgcattaagtatagtttaaaataaaaggaataatatttttaaataaaaagatgaaaaaatattacttttaaattaatcaaaatatgcaataagtgtcaaattaagaaaataaaattgttttatcaattaaatattatttgattcttgaatgtttaaataaatttatttctaagaaattcttttaactttgaaatgaaactttcacagaaaaaaaaaaacgagcaatcattaaacttctaagtaaggtttacatatatatgtccgtatgattcgtacgaggagaataatagaaatgctaatatattctttctagtttttcgtcttttattgattaatattttattaaaaaaatacaactactgagagaaaattttgtgtgtgtgtttaattaggcttatttatagaagagatggtgatgtctaagctgtcaaaatatccatacttagggtttgtttaggcttatttatagagatcttcatgagctaagattgtgttccttgatggtgtgtgtatggtgcctctgaacaaaatctcttgatttgtggtgtcttttattaacggattgttgccatatgatctaatgtttggcgtttatacaaactttggtacatgatcagcaggaaggttcttgagatttaaagggtattaagttgtggttggataagtaagtcggataacatggactaccatgtttggtttatttaattcaataggtcgagaagagcctaacaagagtctagaagatgtagaatattaatcaataaaacgataaagtagaagtaaataggggttaattagtaccatttattaattagttcataaaaatatataatagtaagttctttttttttttcaggatatattcgcatgtgatttggtatgttttttggataaaaaattatccaaaccaaacataaataatatgtggttcaatttactttgatttaaatataatgtcaaagttaaaacttcaaattaaattaaactaattttttacggtaaatattttactggtttggtggtttgttaatattttttaattaactttttaaatggaatttaaaattatttttaatttgagatataacaataaattgatataatgtaaaatttaataactaattaaatcataatcaacatttgaaaatgatgtttatataacaaaaagcaatagacaataaaaaatcacacatgatagtaacagcgtagcaaacctattataaaaggaagtaaattacaaactattggtagttaattagtcatgcattattaatatcataaatttataaaaaaaaatgtatgaaaatcataaatttataacttaacataactaaaaaatgtccatcattaaataaaacttatttattacttaagaatacctttttatttttaatgaactaaattgtgttttttttttagttttatattaacacattttttcaatttttagaacctcaagataacatgtaatatcatttataaagtattatctaaatgactttaaggacttaaaataatacatttcaaaattaaagggatgaaagtaggaccaacaattttagaggaaccaaaacattattttaaccaaaaattaatatattgttaatgtaaaattttataaaatcaaacataaaaaaaaatcattatagttgaagaatatgttttgttcatagtaaaaggtttattattttttgggtaggcaatgtcgaattataattccgagataatgagtaataaaaatttcactaatgtgtggccatatatatgctaagctttgacatccactgttgtttgtcgtatatctcaattctccttgtattggcatggattctacagaagccttgaagtgagaaaggagcataaaagtgggctattacgtactattaaaatgacattatctcttttaccccccttagggttcataccagatctgagaattctagagttatgaatcataccatagcaggcatagcttagtctagttttgtaaccaacagcgaaaagtgatgatcatgttatacttctaaagaatcacccatcaacctttgaatctgggattaaattaggtagggggcatactgtactcgtgctcctttttctttctgatgaaaggatttagacgggcatta

SEQ ID NO: 347 - DNA, 2353 bp, Glycine max
  Soy_ogl_3645 Gm10:49136701..49139053 Cluster 1
tgtaggtttgactctttggataaattatatcggtatttttatttcatgcaacaagatagtctctactacaaggcaaactggtctagctagttactggttttgccaatttcagtgtcggttcaacattttagacattgattcttgaatcattggttatacatgcttgctaggactagtcacaagttttgttcactgttgaactggttcatcatcgatcaattcagttttgacatccatggtttgtaaaaaaaattggcatgtttctatagttgtttctcactctcttaaccatttgaatttgaaaataatatcttatcaaaattgaatgctttttgctatttataatattatgatgatttatttcgatcgatgtgcgcgcatacaagaaagtacacacttgaacattcagtgattgaaaaaaaaattaacaaaatatttaggaacacatgcctgtttagaataaatccacatcctttgaataactaatattgtcacaccatggaagtcaccaagaaacaagtcaattaccacctcatcagttcatatttatttcataaatgggtagaccaaaaagtaagtcatctgattatttatgtaaccaatattatgattcttagtcttaatcaaacattgttatgcatatggtttattagttatacaaaaagaaaagttaatcatacgaaaatatgattctttaacatctgaaaaaacactctcatattcttttttttatccgtaaaatttaaatacagtgttaaaaaatttaaacatttacatatcctttaattagtcaatgatagaacttatataaaaatatttcaaaattaacgtaaacacgataatgaaaaataatctgtattcgtggatccagtttcatggctaacaattatcatataaatgatagtaaattagtagtcccttttaattatttcttagtttgtatttatcttagttaatttcttcttgagagaatctaacatttatatttaacgttttcgttttctaacaatgaattatatataagagtataagacttattaacaaaaatgattgaattttaaaactactttttatttataataattataaaatttacattataaactaatataattttaacaatcaccattaaaaaaacacaaataatgattgaatttagtgaccaaataatatatatttgtcacttatagtaacaacattgtgaccaataaactttttttgttgcttgtaacaatttaacgattgcttcaacaattgataaagacgatagcaacacaaacgatagctgaacgtgtcgttgaatgaaaaaccttagtcaaaattgttgatcatttaacaacctcttttttgcagccgaacgtttaaaccaatatacattctaaatgtacttttgtaatgctggttatttcttatgcccaactattatttataatagatatatttttgctgataaaaaaaattctaaataaatgaagttatggggtttggtcatttgaatcaaaatagaatatatgctggattgtctaattttactattctgatcgagttatatattcaattattattgttggtctctcattttgtttaatttattttaatttatgctctttatatttttaactttttgcttattgtttctatttttaatttgttgctttctatttaattcctttagttaagtgattaaatataagtgactaatatattaaagttaagattgaatctttgggatatattatctaaatttaatttttttttaaaatattttttttatcagattttacttttttttatcgaactttagattaattagagacatttttctctaataaattagggatttaagacaaaaaaataattcagtctgcttattttttttaaaaggagtttacttttgtttctgtataattctttttgttttttttaagcgatgggaatatttaacttttgatagaggaacctgattccccttctatagtgttgtgtctatcgttaataaatcacagctaagaaagataggcagttagagaggaaaaaatgggggaacatcaaactttaatacgtagacagttagagatgaaaagaccaacaaaataagtgtaagaatgaaaagaaacagaaagaaataaagaaatacttaagatgaaatcattatagtgtacaatatatagaggtatttatatattgtcactcttgctagattcagttttatatgtggtataattctcaatttaatattctagaagcatgatgggatcgagggctggtatttgctataaagaggtgacctattacattatagtcttttcttcttacaccacaacaatttcaccctagacaaccacccctttaa

SEQ ID NO: 348 - DNA, 1800 bp, Glycine max
  Soy_ogl_2695 Gm08:14986801..14988600 Cluster 1
aatatggtttggtcccctgggcccccttaatgcaaatgctgcaaactgcaatgcattcaattcaagctcgtgctgcccaatgctgtcgcctcacgtggatcagtccggtcctttcaatgtcgttgacttcactgctctgtgtttggaggctgtcatctactacactttttgtcctgtcctcacaccaccaccatagtatattgtttagaccaaatactaacgagtgatattgaatattgatttttttaaaaaaaataattcttttttatgtataaaattgtcctgtttataactttttatgattttataataactttttttacatttttaattattgttataaaaatacggattaaaataaatgttaactgttttaaggatactagttaatgaatttaaaatataatttttttattgaaagataaaatattatagtatttatgaatttttttactagtataatttttacattaaacatttttttagtttcttaaccattttattttcccacaaattaattatactcttctttcttccaaacttcaacgttttttagagggaagtttaacgctattatattggattttctttaatttataaactattaggagaaatctatgttaagaatgatcttttataatgagtcccattgtgacgctttatatttggatgatgaatccaatggaaagaaagaaaatagtactaatattatattttttttatattctcttttcaatacttgttttattattagatcattggataaagttcacacgagacttattaaactaaaacttccatcctcagatcctctttagtgtgttattaatatttatcttatttgtttaaccaattttgtatcttttcacactagttccataagttaacgaacaacaaaaaaaaagaagtctctattgaaaaaaacatttatcatatcataaaaaacaaaaaaatatatttcatatgcttgctttttaaactattcctcaattcctttatatctatcatctacgctgtttatttcaagagaaaaataggaacagagaatttaggtcgatcaaaataaaataaaacatattatttcttgtatagttgtggaagaaaaagaagtgtaatactctccttcatccttccatatattatatttcaatttcaattttatcaatctttttattttggttgtacattttattgtatgatactaatacgggagaccaataaaatgtcacatcaattacgtaatttaatgaaatattacataatcacttaatagacaaattctcattaatgacaagtaccaaaattcaacataacaaaatgttaagttgtaaaataagaaaaaaagttttgataataaaatcaaaataaattattttataggtataaaaaatatatttgagtcaaaaaatttaaacattaatagaattcttaaataacactagttctttatgaaaatttatatgacaaaaaagtttcattattatacgcaaactcaatatagttatttatgagaaaaaaaaagcctcaagtatttgagtagataaaatattctctcaattccattacttaagactttattaatagacatttttgcacatgtattttgatttcatgatattttggtccaaattttaaaaactaaaaaacttaattaattgtatattttgtttttcaactattttaattatatattttgacatcaaatttttaaaattttatacattatgtcatcttatttgttgatattgtgaagccgttaattgaagattgatgtgtatgaatgatgtggcatgacaatgc

SEQ ID NO: 349 - DNA, 2300 bp, Glycine max
  Soy_ogl_2249 Gm07:7453001..7455300 Cluster 1
cattacctaataaaaatagtactaatattttatataaaaatatatttaattttaaatattttgtatatacacattcatacataaacatacatatcattttatatgtataatttaattgacaaattaattttacccaacacttagtttaatcagttaactcccctgtttttcaattatgaaataatttttaattagatatagtaccaaacatagtaattgtcattgttatctttttttgacaggattggatcattatccatttgcactcgtatcatgagacatataaatgtgctcttttaatcttcatcagttgtatcgagcctctttcccttattcaacttctcaggcaggacttgacgggtgtttcccaccctacaatcatctgctaataatgttctccttaagttttatgatcttctactaatgaaaaaataaatattttgtggtgtttctatgtagtgtaagcctaactttcgtataaattttaaaaactttttttaagatgaaacattttttagtttataaaaataatttattaaatgaatggtgattttatttgaaatttaattaattttgagtttccagatacgtaaagtactattgcataaaaatagagttgcacaaggataaatatacccaatacagtagcacttaggtcttagcctatttttatcctggtgttcgatcttcaactcaaagacacgctcttttcttaacaaagaatgttgagatcctattaataaatcatctcaaattgagatattttgatgggaaaacatttttgcatcttctatagtatttggtttagcgtcgatcatgtggatgctaatttcatcgtcaaccttgtgtattggccatactacttaattagggttggctgccgagaaattgacacacttataattaacttcaataactaaatttgtgttagtcacgtcccaacgctaatgttaaagttgcattttgcattgatttttgttagttagcattgagagctcaagagttaccttttactcttaacatacgtaaaactgtgaatgaaacagaaaatggtagaaggaaaatgaaagataatttaattaatagaattgtcatttttttatcagagaattgccatttactctacttggtcaacatacgcacacgagaggacttcatattttttttttaaaattcaactcgacaagcttttcattttaaatatgattatttttcatgttaacatagcaaagtttgtgtacgtagataatcgaagtgcaaaacatgaaccaaaccatataaagacaaacagtaacaacacagacggtgacttttggagtggcttgttgttctttttccattaaagaagaataattttaaaccaatgattagatttaaattctctttaattagtcacaagaaaagaaaatagattcttctcttaattgaataagaaccctgggagatttggtgccactagctagccctatgcagtagttaagattttatatgagattttttttttcagtaattaaaattaaaatttgagcatttgaaatatcgatacttttttactgtagttttgtcttaaaaaatatttaataaaataaatgagagaagtcaaagtagttcaaaaaataacacgaataatagaaaatttaatgttgaaaaattaaagaaattaaaatagcctaattttttaattttaaaaactttaaaaatatatattttaaaaactatctttatcaaacatgttttttatttgtgaaaatagaaaatatttttgaaaatgagaaacaaaagagtacataaatattgtacaaacaaaaaatataaaaaaaaatcttaatacagttttttaacacattaacttataaattaaaaaataaaaataaaaacaaatgtgaattaacgatgatatgatacgtcgctaaaagaaagaaaaagtataataaaaacttgtcttcacagttatgcataatataggacttacttttgcattgacctccttagagatttcaaacagtagggactcaggggtgattgaggaatgtcatgtttacttaaaaagaaaattaacttcatttaagatttttatatagaaatattttgggacatatctggagaatgaaaaaaaaaaaaaaaactagagatttcgtcttagtcccttttccctttaaacgtatcccatatctttgaaagcgagactaatatccaaatttttaatctctcatatatagtgatgttcagtatttataaagcatttctgcttttcaaaagttaaatcctaattcaataattagtgagaaattgtttcgatc

SEQ ID NO: 350 - DNA, 1761 bp, Glycine max
  Soy_ogl_3189 Gm09:39215369..39217129 Cluster 1
aaagtcattgtattataacaaagtaaaatatttatacaaaacaaagttcttcacagatattcaatataaatgaatacatatgattcaaactcaatttatgtattaatgtttgatttataagcttgatagcaaacatataatatgttcaatttaagtttagtgtataatcaaactaacaaaacgaaatcactttcttaaaaaaagtaagatatcatgatagctcaaagtcatgagactatataatcttaagctttagagattatttaaataagttttatctctcccaacaaaaaaatttctatatgcataatcaagaaattaaacttctgtcaagatattaaaagaacttagtcatctaacaatgttggcaaccaatgaaaccacattctctttcttttgttttgattaacaattaaatgaagccacatacgaattgaatggatacatattatgatcgcgaaatctcgtgtaactgtgttgtattgtatgtatcatagttaactgctactacatacatatgcatcaccgggttgggccattagcattttttcccataacttccagaaagtccaacagaacctttatggcccgtgcaaacaataaagacggtgttaattgtgaaaggaactacacagaacttgattcatctagaaaatattttttcttcatattgattattagaatataaattcattaaaatgatataaatatctttaataaaaaaaataacatttcagacaagaatttaataactattacattatcaatcaattaaaaattcttattaataatactataatataaatacataaactattttctcttaaaacaattgaaagccaatcacttttgcggagaaaactatgtgtggcatgcaccgtacgtagagtactgtacaaatgtattgaggaatcgtaactgacaacaagactaattctaattccatcaagtgccctattgagatttattaattactagtagtcctataagtttttggaacctgacattttgttgtagtaaaattacaattctatagtatacaaataaacaattacaatttcataggtggacaaaaaggatagaaaccctatattatacaaataaaaatattatttattatgagtgtaagtacacaagttaatgttaaaaatttgtaaggccggggattgttcgatttttgctggtagtttttctttgacgatatacattatataggcttaaataaccttttatccttctaaaatagagtatttttgtacgataatgtgatgtacgaatatcattatcctttcagcagcttatgacactcaaaatttgcaatgaagcagctgtttcccaaaatatttttttatgtaacaatagaaacaatgatatttaaacctaaaacttcatgtaaattatccaagatttcactaccatttaattttttttttttatattttatcagtgatatgttcattttttacatgttcatatattataaaaatttattattaaatctaataatttggtggcatcgatgtaaagaacaaataaatataaataactgatcgttttatatttttggggtttgacttcccatattcaaactcaagtaagactcataattaagttttaatataattacattgttaaaatcacaattttaaaaatctgactcgtaatctataaaaataaatggagcgataagtaaatcaatgaaaacactagtttaccggtttattggtctaattgcaattaaattgtgatttgaatcagtag

SEQ ID NO: 351 - DNA, 2300 bp, Glycine max
  Soy_ogl_4445 Gm13:34171501..34173800 Cluster 1
ttgaaatcataagatattctaaatagacatttgcctatttacaaactttgtccattgtttttgattttggttcaaactcatctatcatatatgtaaatataatatagccattattctttttgttcgcaccacggtaccttatagtaatgcaaatactttctttgtcaatttaaaattcattatttagttcatatacaacatatataaccgtcggcgacaccctgcgtatcgacatgtatcgtactagtatatataaatggcatgagatgaaagctataattgggttatacaatatacataagtatgaaacttgggcagagatttcttcactttagtccacttaaatctacggcacgttattttaatgtgctactatatatatgatgaagaaacgaaaagtcgatgaggatttttttttctatcaacaaacaaatttcattgagaaagatgaagggtagaaggggtacccgactctaacagcaaactaagcaaagaaaaccagtaccaaaaaactatctgttgattatattatatcctctatcccaacatgtaataattgtaataattaagagagaaatgatatttatacaattaaatatatgactaagagagaaaaaaagggatttttttttactttaaattataataaaagatgggattgataatatacacataaaatatgatattgtataaattattgtacaatttattatgtgtgtatcatatctctaattagaaatatttggcttaagacttgccaacttttcattccccaaaaccaaatctaaaatcgggctgaatcatcctatattcctataccaaggcctgctagctgctggtaacttaaatctgataccaaaaactgaaataggtcagcctatgaaacaaatcaccagatctcaacaaaattcaaacaatctcccgggttcaaaaatcataatgcaagagagtagcttaagtactcaataaggaaataatggctgtgttgacctaatgaatgatttttttaagtaattaatgtatgcatatacacttagatttaataaatatctacttttttggtacattaattatagtttcaatttataatttcatgtaacctatccaaatcttttctaactatctcactgtacacgactgcaacaaatttcattaattatttacgtagagtttttgaaaagttgaaatatatattaattaatgtttttttatacatgggaaattaagaaagaaataaaaaaacctataaatatcagatagtgagacatgttgatgatatatattaggttagctacctcgctttgacgtgttcatgtttttcaaaataagaaaaattatgaaattttcaatgtttttgtctattttgtcttctttcattacgtaacacgtgagatgtcctagtttaataatttgaagtgtgcatggttggataccttcaaataaaataaaataaaaaacttttttaacataaattttggtaaggttggatacagatgttttttttttgttgtttcatgaatagtcccgtcttttatactattctttaaaagatagtcttatgcgtttgcaatatataaaaaaagatagtcttatacgaatttgatccttttctgtttttttatttataattataatgttaatagaatctcctaatccaattggatgacctatcgttgatcgaacttaaaataaattactcaaaatgtttacagctccattagcacgcagcaaaaataataataataacagtaacagaatgtgcgatctacaccaacagttttatatcaacagttctctttcataatgcattttgattatttttaaagaagagttttttttttttgtgtgtgtgtgtttggggaatcttaacttttattcatatcaatattttatattttataagaataatggctttgttattactttttcttgttgactctgacttcttgaagctgtaaagtaatacagggatttttttgccaccaatactgctgatattggataggaatgtgaatggctaggggtcagacataagattatttgttattggtgtgttggaaaaaaaaaattagatttaggaattagtgttatttcctttgtaatatataaatataatatgatccttttataactttaagggcagtaggtatctgtattatgatatccgtactctactcattaacaagtggataaaaaatatcgtatactcatttaaagaatcaaccggcagattttatttgcagatattcctgggtataaatttttttgcccatccttgatattcgaagaccaatttttac

SEQ ID NO: 352 - DNA, 1996 bp, Glycine max
  Soy_ogl_4534 Gm13:38057501..38059496 Cluster 1
aaaagatatttcttatttttataactttaaaaattatagatgacattaattattatatttttaataatattttgatcatcaaaaaataaaacaaaattacaaagacataaaatgtcaaaataatattaagaggtataaaatttatcaaaaaatttaaaattttctacacataaattttcctggcacaccttgtgctttaatctagatacctgtgcttaataaaatttatttttgcctcccaaaaaaataggaatttactaattatatttttaatcatgttatatattattgaataataaataaaactaaagagataaatgtagcatttatttagttttttaaatttttattagtctttttttcttagaaaaagttgtcattttaaaagttaaaataatgagtttcatattttgaatggctttcttaatatgaatttaacttattaagttccgctgacacattttcatcttattattttcatttccatgagatgaatggaacctattttaggggattttctatgtaattttttaatagacaatttttaatctaaaataaaaataatcatttttaatatggttggttaatttttttaaagatttcaaaactaaaaaaaaaatacttattttactagtactttgctataaaaaaaaagtagtttttttttaaaaacctacaaaattatttgatttaataatttttttttaaaaaatatctaaatgctgtaaaaaattatctaaataaaatatttagatataagatatggattaagaaaaagctaacaacatattttgtcgcacattatttattattaaacaaaaaaaaaaatatcatgagtcttactatggattaattaagcacatgctgggcttcgaactaaagttctaacagtaaggcccaatctagacagtttatagcccataaacaagaacctagttgggtcttaacggatcactcaacctattaaggccatacaaatgggtacctattctttggacttcaagcaggatggactgagcatgaccaggaagctatacatctgataaattgattaagatattttctttcgttgtttttttagtgcacatttggtgactgtatactaataattatcaaaagtaactagtttttcttagaaaaagtaataattttcttaaaatatttcttttaggttgattctttaactctttttttttgttgcaatttaattctttatctctttttgaagtttcatttaatttgtttttgtctcaccaaaaaagaataatttctttttgtcaaattcttagtttcatttcataacttaattctttcttatttaagatatagtagatcttccattagtcagtcaattctgcatatatctaccaatttgttaataagttaataaattgctgtgaatatagactattctaattcttagtcgaagaaagttgtggaattataaatagacacacatcaaatgaagaaagagagaggcatcttaactttatatatacttgcttctacagtagccaaacttttttcgtggtccttaaagtatatcacccttttccaactattgccaagttgtatgtataatttcctttagggtaaaggataactcaaataagaccacacccaattagaactcccccacttactacactgtcgttttctctctctcacacaccccccaaaaaaaatgcaatattccattatctactttcttacctgctagaaatgctaaacattttactattagctagattcatagtttgtttctcatttttataagtaactttattttgtcaacctattttttgaattgatcaatatgcctttatgtattcaatatttttgtgttcaatttttagcaaaagcagtatcttttctaaattttcaaacagcaaaaggagggaaattaaagaaattaaaacaattttaaatgtatagaacaatatatatttcacaccaggaaaatggagagccttgctgtatacaaattgttcttgct

SEQ ID NO: 353 - DNA, 2272 bp, Glycine max
  Soy_ogl_4291 Gm13:26942029..26944300 Cluster 1
aattaaaatctaataatttttatctatgtacatatattttaaatatatagcaaaaggaaataccaaagtatataatttaaaccttatatatatatggggtgtgtgctaacatattcacacttcaattttagttggagaatgttaacaacctacaccaaaatatgttggacaagaaaatggttatattttctaattacaattcatttattttagggacagttttgaaatttaaccaaatgtatataattaaataaataatcaatataaattaatttttttgatttaaaagtgatgtgagttgataccaaaaagaagtaacatgagtagctgtaggatacttgagtttataatttgataattaaaaattaattttgatattcttatacatgttttttaatactcgattctccaattataattaatgtttctgtaacttaatataaatataaataataattatggtagcttttggattttgcaccatttttttttataaaaacattttatgctaggttttggcactatcactgatgattcctccatttctctctttctttaacatataattttaagcttagcaaaatcttacgtataagtaaatagtttataatgagtttgatttttttatatttaatttgtgttattttctcacattttttcctttcttcctcttcttttaattgtgtttgtaaaaaatattgcattaattacaatttaggtgagtttattttttcttccggttgcaattgttagatttagtttgttttacaaatgagtttagtttgggttctatatacattaatttttgtttttttattattgatttcatttatgttttcatcatgtttttttaaatctcatataatattatttatatttcttatatatagtagaatcgcatatatttcttctatagtctcactttatttcaaaagtgttaacgtcttttatttggtaggggtgatattttttattggaggaaaaattcaagtaaaaaattacatactaacaaatatttttagttatatgtatacttctaatataatattgaattattttttttatcagatatttgagacatgtgaagaatagttgaagaattacatatctatttcaacaatttacatatacatgtacaacaacaataattactttatagtaaacatatgttgtcttactcttattaaattaaattagtttttaatatttttcttattatatgtcaaaacataattcaatcaaaaaaaccttgcacaggtaaaaaattagcacttaataataatagcaaaaattgggtataaataattaacggaaatatatatctttggttgattcaaagaacatattaggttcttttttatattttgttcataatgagttttcctttttataaaacaaaaatctagcatataattataattaaaagaaagctacatttataataattatttttcttaaatgattgtcaaagaatattgacttgaataattagcctaacgcttataataaatacacgagttcaattttaagaatcattcattgaaatggatattcatataaggatgtgtttactagtgagtgagttgaatgttgtaaattttctggtttatgtcttcgttcatatgggaaaaaaatatattaggatgtgttttgcaacaaaatgatgttatgcacagcaactgacggcaatgccattataccaaaagtttagtgagtgtttgcttttggtgagtaagagtgggggaagtggaaggcgcgtccactgcacacttcaagctacattctaaattctaattattcaatgtactgaagattcggttcacaatggataacttgtctcagtttgattgtttaagacattgaattttatttttatagcgttaactatttaatatattgtaaactataatattaatttaattgatattgttcagattattgtaaaatttaaaattataatttgtttgagaatattaatttacatgttcatttttattgagatgattattttgttttcttaaattaatatgatatatataagttattcaacaaattaaatttacccacttcaactttgagtatcttcaatacaggtgcgtacaagaaattatttatacaattattgttgcttaatcaaatttatacaacaaaaaaattattattttaagcattataagattcacaaattatgttaaatattcattttaataatcttaatatttgagtaaattttatgtaaaatatttaaaatttatataaaattgtaagacgt

SEQ ID NO: 354 - DNA, 1297 bp, Glycine max
  Soy_ogl_357 Gm02:3624804..3626100 Cluster 1
attatttttatacactaaaaaatataaataataaaattatgagaaccaaacgaagaattaaatattttttaatctatatcaatgtgtcataacttaacaataataaaactaaaatgaaacatttttctataagaaacgaaatagattttttaaaagaaaattaaaaaagaattacagtttaaacaacaatagttctatattatgataaattaaaatttatctacgcaaaaaacatcatacgtagtatttctttttgtatattttatcaatcgttagcataattaagaaaattaaggggaaaaaatgataatgtataagattgatggagatttgatagtaaaaatctttggatgagactagtatcaccatgcctgtcggtttcagtttcagaattcaaataatgcggaaaaaaataagtgctttctcgaaactataactgtgacaaattgacaatgacctacctttatctccctagtatactatctctgctactgctagcacgtggctttcagaaatatgatccagctttatgatatcatgcgacgttatgcaagttttttattttaataaattgactttctcactttctctttataatatttttctatttatgaaataaataaaattgtaagttttttaattattttaaagatactaaacacatattactatttttctacataacacttactttataaaacattaaaataaataatgaaaacgttttaaaaatatacatagaatgaacaaaggaatcgatcgggatataaccgaaatgtcactccataaaaaaacataaaaaagtatttggtagtgtaaaatggaatgaaataaaaagaaagttttgattaaagttgaatataaaattgtaagtttcactttattatagagtatttacatgatatcaaaccaaaaaaatttctataaataaaaaaatcaaaaactttattttagagtataatattgttgttcaactctaataaattaaaatattatatttaatcagttttttatacataataatcattctgtaatttaagtttaggatcttatacgtattactgtaaatttcctatcattagactaatcctagtgattatttatattatcatagaggatgtttaatactaatactatactaataagatggtacattgaagtacaagctatctatcaaatgaatttttaacaagagataataaacacatataaaataaatatctctcttttaatatgatatattttatatttaatagttaattaagatttgatttttgaatcattttattaagaaata

SEQ ID NO: 355 - DNA, 1500 bp, Glycine max
  Soy_ogl_1704 Gm05:37353001..37354500 Cluster 1
tgttgttgtaatttttcacttaatcacaagttatattacataataaaagaacgctggcctataattttttttcaccagtaatatacctctcaacgagaaagaaaaatattttttcattattagttgggaattaaaaaaagagacgaaaaagaaaattcttccattggtgagatgtcatcttgcattgagaaaattgacaaattgtgaggaacacatttataactattagttaaaatttattcaaaagtgaaaaaattataagcaaaatttattaaataaaaagtgaagcttatataaatttattaaatagatgttgctaaatttttttatctaaatattactcttgctaggccaactcatctctttttttagtaagaatgacaaatgcgtcatttcatattataacagttttttgtttgaaataaataagaggaaaaacaatgttttgtttcttaaattaaagaaaattaaaaattcattttctcttctaattttctttcttttttctctgtctcttttttcttctttgcgtcaactgattaattagttcgatgattgttattaaaaaggaaaaaatagtggtgaccagatcatgccatcctggaggctagcaagtgtgcactgttgacgacatctaaactgataaatggtaataatataaaaacttggtttggttttggtagacaaaaacaaaacaagaaaaatctaaggactaggaaatccatctacactcgtgctaacaaattcagtttacaagaaaacaaataaattaccattggtttatttcaaaagagagtaaaattaattttacaaggtttttttacagcattaattttacatagttgaaagcaattaaaatttatatttaaattaattttaattataaatttcatattaaagcgtatgtgaactaaataaattatttttataactaaaaaaaatagaccctaaaatcactccgagtcactacattttatgtgttcttcttttaggtgacactttaaataatataatactctctccgtcctaaaatagctattctcttaggttattttacataaataaaaaacaataataaatagataaaaaaataattttataaaactaatctcatatcatcaatatattttgttatttatcattaatattataacaactatgactaaaatcagataattaatattatattgaaagacaaaaaatgataattattttgagataaaatatttttaattataatgaaacggaggaataccttaaacaattaatttatgcaaaagtttcattaacgcgtaatcacttcaatattatgagttcttcaactataatgattaagggttaattaagtttttaagtctcaaatgatgtggttttgaattttttattcctaaactatttaaaaaaaaaattgattcctaaagattttgccattattaaaaaatataatctctaccattaatatatgttatttattaagtgatgaaatattatgaaataaga

SEQ ID NO: 356 - DNA, 1300 bp, Glycine max
  Soy_ogl_1808 Gm06:6669501..6670800 Cluster 1
atataagccagttccctcttcaacctttcaagtttcaatttggattttggaacacagtttatctgttgagacttcagcaattaagtccaaaaatatgtcttaggtattactgtggaaaacaacttcgtattaaatccacaaaaacaatttatttgtatcaatacagggataagataaaaacaggccgagcaaaaaaccatttaattaagtccttttttcactgggaccatttaattaagtcctaacaagcccaaattaattgtcgtatcttgtaattaattaagcattcccgttgaagagacaatattttacatgattattttcttaatttttttatcccaatagataaacctagctacctgtaacagtgcagaagggcacgtgctctcaatttttttaatattattatagcattatattttcaattaagttttgttcttttttactttaatttttcatcattcttattttttgagtaaattacattttatctttatgtaatttctcattttctccaaatatatatccctatactttttggtctcaattctattgtactttcttttatatacctattatttttatagatcatgtatttattcatacaagttaacttctatactaactttagatgaatttgtttaaacttaaaaaacataattttaaaataatttttttgtatataagtaatttttataaaataaataagatttattttttaaaataaatagaaaattattttttaagtataaacaacttatacaaacacactaattgcttatttattaaaataaatatgtatttcaataaataaatttaaacaaattattatttaatttatttttttgtattaagttgatttgacgaatagctgctcaatcgtgttccatgcgattcttagctgctcattatataattggatatctctcgagttcctgttaccttattataacacttgtttgatgtattaacttattttagttgtttctaatttatttccataatttacttaaactattatagcttatatgaaaaaaaaattctttacatttttatgctcatcaatttactcaaaatttattcctactttttaatttagaattataaataaaagtgaaataacctttttattttaactagtattattaaaaaaatatacatatattttcaaattttaaaaatattaatttatttcaatatattatcattttttgtgagaaaaaaaagtaaaaaaatacaattataattaacttaaacaacagatttatgagttttaaatctgatgaactcaacttcatat

SEQ ID NO: 357 - DNA, 1579 bp, Glycine max
  Soy_ogl_2251 Gm07:7517145..7518723 Cluster 1
tttaattttttcattgttaatttctaatttgaaatcaaattttttaatccataaagaattatgatttattttcaatttctttgttaaataacgagtagtaatgcatgtgacaaaattcagtaaatgattttgtaggattgttcatgtgtagttgttgagtttgtagtgttatttgttattatttttgctctttccaaaaagattctcaatttaaataagatgtttttatagaatatatactttcaagtgaaagaatatatattttttaaaattgaaaaccttttttttatataaaaaaaaacttatgtgttactctagaaatagttgtttccaattcaatttcctgaaagtttttcaatttcttcaacatttttttctaattatttgtttctcttgagtctctttagaaaaataataaagataactaattttaaattgacttttttctacgtactgttttcagaattgtaagtggtcaaaaaataaatcaaaaaaataataattaaaagaaacaaaatgaattaaatcaaataataaaattaacacatacatcaatacataataatatgttaatttcagcacatgaaaacaccgtaacaacacacaaaaatgcagacgcatagactctatgatctatgaggccatgtttccgctagtatatttcatagtaatctgttattaaaatattgtttgtgtacatcctattttttatttttaatatatattttcttaaattttatttttaattattattaaataatatgataagtgtggattttatttagtttgctttcgagaaataagtttaaaaacactcttttagaaaattgacaaaaataaattaatattactttgtaaataggtagttccaagttccaagtatacattaaatattttcataagataggttttactgtgacataaataaagaaatattattaatttttttcttttcaatatttttatttattggaagataaagcccccattgttcgagttattattggtgaaaccaatatgaaagtttttttttaatgcaatatcaaatatcaattttttcatggatataaaataaaaaagttacctataacaaaaaaaaatattaacaactcaaactatatactacaaaattggaggagaagtttggtaatcgactcgtaagactgactttttattctaaaaaaaaagattgaatttataaagttgtggaaagtttggatcgtacgaggtatggaatggtgtatttaaatataagatttggaaaaaaaaaaataattttagttaaaattaattttgatgtgaaatgatttatatttagatatttttattataaaattaagttataaataaaattaaatacaaaattttggattcaacacaaaaattatttaaaattattttaattttagataaatttcgaacctataattaattctaaatttttgtccaatataaaattaaacatataaaaatatatctaaaactaattttagattcaaaattaattctccaacataaaatcaaacactcaaaaataataatacatccacattttctaattccccaataatacttataa

SEQ ID NO: 358 - DNA, 1348 bp, Glycine max
  Soy_ogl_2253 Gm07:7544853..7546200 Cluster 1
atagcgtataaatttaaaaatataattattattttatcttatatgattttttttatttttaaaactatttctctctttattatccgtgatagatgtatgtgtaacatatttaagaatttgaaaattataataatatattttaaaatattattaatagtttataaaacttataaatagacatgtaaataaaactattttttctataaaaaagatatacacataaaaaataaatggaagttagaccaactaagggtgttttcatttataaaagatattttatattaaccacctacattgcctgccatctttccacataataatattttaccttaagaacattttaaagttcgctaaataataatagacatgattgtactttgatttcatgattgttctctttcgatttttttcaagataattaagttcatatatttctcaaattaagtaaatttagttatatcgacaatttctgttacttgaaaattttatattcttattttctacacaaaataaacatatttgaacatctttttttttttttctttcgattcacatatttaaacatctactatgatttatctcttcaaaccccaattacttgtctttgtaaaatcctttaaaatttatcattttttttttacttttttggcctataatttttagtagtagtcttccatgtttcaaatccatcataaagtcctaaatatttaaataaaaatgataattttatatttgtagaaaaaacatagtagcataataaaattttcataattttaaaaataaaaaaatttaattaaatatataattaaaataaaaaatatagacacacgatttaaattataaagaatgtcaacattatgcgacatcaatattaataacattccaccaatggtgaaattgcaatataataaatggtatcgcctttgtgccgttataattgtgaatctaggatattttaaacatatgaagaaaaaataataaaataaatgaagaaaaataacaactttataaaattaagtttataattattaattgttttttaatttttgtagtccatattatcaatattataaaaaataataaaaaataatttatattatattaaaaactaataattattttaggacaatattttgtttttccataagtgatcatcatcattattattattatgagacgggttttgaatctgagtggattacaattttaaaacccctttgtccttaaaacgagcgtagcttaaagaatgttgggacaagtatgcgacgaacgaagccaacgcataatccaattcactttaatgtgaaaggtattgtggcaaaggttttcgagaacaacaaaaaataaa

SEQ ID NO: 359 - DNA, 1627 bp, Glycine max
  Soy_ogl_2295 Gm07:8586751..8588377 Cluster 1
taggtcaaccaaatgagtaatcttatttgtacattttaatttataatattagtgtagatacatggagtataaatttaaattaccattattaaatgtaaacattgtattatgataatcagttttaatttattacacctaattttattattatttaatacttaattatataatattagaaatgttagtaatacttttttatactttacttctaatagtgtgtttggattagtgttcaacctttaagaatatggatcaaatacctaatcatctgaaattacagagagtaatttcttctttaacgtgagaattggatatgaatcttgtgggacacgaccccgaaccaaacactctataacactttctgttattgatttctttttatttttaactcattaattaagatcgtaaaatgaataaataaaaatacatataataggtggatgggacccgggcacaattatggaagacagattgatgatcagccggcggttcaaactcagttgggacattcaacggctgtgattaattagacgaaacctggaagtatcatgggacccacatgcacgtcgtgtagacgcgtgcaagttggtcaaaactaatgggctcgaagccacagacatagaaagtactattcaatttgaaaacaaaaatttattttaaaattcacctacttatcttgaccaatatatttgttactttaatctttatgatttaataaataataatataaaattatcatttttagattcttaaattaataaagacaatggttaatatattaaataattaacccatttattgagtttgattacaaacataacttaaattgatcctcttcaaaaaaaaaaatacttaaattgatcgtaaatttgatgctttaaaatatttataatttgtggttttatataaatattatttttacaatataatggaaactattataaattaaaatatatgttatttactcattatatggatatttttacttcaaaacaattttagtttagtttttaattacggtttgttgtgtattaaggttagaaactgagataataaataaaaaatattaatcattaataataatacattaaaaaaacacccacatgttatgcatagtaacaaattttctcaagagtactcgtcaaactaaaataacgttttaaaatgatttatattgaagagtactccaaaattacccatgaattaattgatggtttatattgaatgaattagaaaaaatttaagtttgacattaactagaaatagttttaaaatagaatttataagacaagaataaccagaactaacttttaagatcgagttaagtttaaatttgttgttagtatcagaatttatctagatttatttaaaaggatcggataccaagtccaaggagtactatcgtcctacgcaccaacagcagcctattagcgttttatcattaaatatataatatatttttttatattcttatttttaataaccattatatttaaatctaatggtcaatatcactgctgcagaggcagcatagctgcaggcaatccataaacgactaccacagcacagtatcggttagaatgtgcgttgatttttcttttttaaaagaaaaaaatatttatttaat

SEQ ID NO: 360 - DNA, 1400 bp, Glycine max
  Soy_ogl_2934 Gm09:1580301..1581700 Cluster 1
taattgaacgtatcttttactatgacaattgattgcgaaaataaatccttaaataacataaataacaatagaaattgttccgcaagcacgagaatcttgacagtttttggagaaagcgtctgttaaccttatgttgaaaagtatttcatataattagggatgaagatggactaaattaagctaagcttttataaagtttgaacttggttagtttcctaaatttaaggtcatttttccaatataattctttctaaaagtttataaagtgtacttaatagtaagacatcttaaataagttgaaaaaaccatcctaaacttattaaggagtactatcaagtatctaacatatcatttgatttttttttaacattttccttttattggttgaattcatgtaaatttccctagtttgagaataaaacttgtatattttgtaaaacccacatgaatttcacctaataagaaacactatgttagaaagagactgcttgagaatgtgttttaacattcgtcaaacttctacatatgtcaacgagattacgtttcaattaaatcaaccaattaaatacacgatactgagatattataatgtaaatttaatacaatgttatttatttctgttgttgtttagataaatagatcaaccatcaaaatctaaaagatttttttaaagaacataaagcttgaccttttaacaaaatggactttaaaaaaacttcaacttcctttaaacaaaacttcaacttaactcatttataaatagatttagtttgacatatacttgagttaagtcacatatacttgtgtttatatattttttggccataggaaaaattagtacgtgagtcttctttttttttaattcttccaccttttttgtgtaaaaattgttaattaaaatttaatattcaagcaatattttcacatttcattcaatagtattttattctactctatcttacaatataaatgatctcaaattaaatctaaaaaaattaattttgaaaattcttttgacaatgacaacaattgtaagtattattaattatattttataaacattatatgcatataaaaaggattaattctttaatatactttaatgttttaagaagacattgatttttctgtcaatatttcttttaataccttcagtctagggagaaaagttaagaccaataatatcaaattaatgttcactaaaacttaaatttagtttaagataaatataatatttttttttcaattcactatcttttacaattctcaattattatgattcaaataaaatgtacaaagtaatcttatattttacaataaaaaaatatgtaatctcaccactctcattttcatcaaaatatacatcatattctttttatataatttaatcactacattca

SEQ ID NO: 361 - DNA, 1600 bp, Glycine max
  Soy_ogl_3542 Gm10:45166401..45168000 Cluster 1
ttcattatataattttatgaaacacttatagtttaataagataattttttttattttccaactaattttcttaaacatattcttagttgtttggttgattatccattctacttttcattctctaattttaaaatattatattttctataatttaaaccgtgtatctccattactgatttaatacatgataaaaaacagtctattgttttttaaaaataaaaaataaaaattaagaactatatattttggttttaaaaataattatttttaattttaattacaataatatttattttctattttttattttctgattttaaatctttgcctagaaaaacaatgaaaataagtttttattatttttaccattttatatataatcatttgttaatataaaataaaataaaaagtgctacttttataattttttctgagttaagtgctacttttgtaattaaaaatataatagaagttattttctcaaaccaaacaaccttttactttttcctcttattttctttataccttagggaatgcagaattcaactttcaatgttatttatacctgcttaaaataatgaaacctttggggaggaccaatctaatggacttaatcgcaaaaacaataaagactatgtgatttgacattcacctaggtcaagatggccatcacaccatctcaaaagaaaacctttgggcttgttagagacaccaagacataacctttctaaggttagcaccctatgtctcgacctcaaaccacttatagaaccatgcatgaatgtgcattaagaaaataatatgcttacacttaagaagtaatgaccccttaaaatttcccatgcattccaccccatcacgtcaattgtgctttatcacacaaagtactcttagaagaatataaaatcactcctatctatcgatattgatcgaaacaaaaatcaatgtatgattttcaacatttcgtgttgataactaccaactcaccaaagttgataattgccacatgcttgaaggtcaagcacacccatctataaatactaaaactcaatatctgtcttatgcaaatatcttgctttaccatttcatattattctatcaaaaaaccctacttaatttgagtgtcagagtcttataggagtcatcacatcttttgttgtgctccactattaatagagtagcaattcacctaaaaaaatcccaattaatttgaacgtgaatcgacttcttttaaaacaattaaaatcattaaatgatagtctaatcttacgtgacaatgattaatttcagttattatgaaaatactataattttatttttattacgatttcagtcatatgacatctttacatatctaattgctttgctatatggtgctcataacacatgggttgtcgcatttttttttagtgttacttaacaattaatttatatattttttatagtaatttagtcacttcgtattaaagtgttagagctgtttcagatgtatttatttattagataaatattcattgaaaaaaaataattaaaatcgtaaaatcattattattttgaaataaaagcataaatcatgcccactttgttgaccgcacaactt

SEQ ID NO: 362 - DNA, 1637 bp, Glycine max
  Soy_ogl_4581 Gm13:39742901..39744537 Cluster 1
tgattcagattgcagtttgattgaaatttgatatgaatttttttattttttgtttgaatttcattcgattcaaactcgcgtatagttaggtttaactcgattaactagatttaaaattataattattttacatacttttattgattgatttatttattttgtataataatattaatataaaattaattatatcaatttaataatgtaaaatactatatatttgattcatgaatcaatcaaactgagttatacatagcttaagtttaactaatttatttaacgaactcaaattcaattcacttgattcataaattaaaattaatttttaaatcaagttttaaattatattcgacaacgcataagctacatctaatagcttgtgttgagacttaaaaatcatattaaatatcttgtgagatgcatatacaaatatatattattagtactcttttttaaaacaaaataagtataatttaattttatagaacttattttatatcattaaatgtaattggaatgtttcttcaaaactattttgagtataaattttaccaaaaggtatatgtacctatgatggtcgacaaaaaaaattgacattataaagtgaacaccaggtgaccaataatggtgacatggatctgtactaaaatggttaactaatttaccagccaattgtcatctgatatcgtatattcggtaaaatttaattagatgttagagacatgtccgtatttcacccaaatatggttgggatatataataaaattattaacttttgaaataatacttgtcataagttatacttagaacaatttttaattagatgaataaataagagtattgactttttaaataataatttccaaatttatatatatttagaataatattttgatgagtgacattctatcatgactgtaattatgtgtgcttttttaataacttattttaaaaaaaaataattataactttctaaaataaattcaaagaaaagcatcttttagaatatatagtcaattgtcaaacatgtcagtggcgggaaaaaagtaaatgtataaatttgttatgtttttacattcaatgaaacctctattaatggagtcaatttcgtttatttggaacaagttttaaacttgaatataatgggtcagatatagtttgcaggggccggctttgacattactgtaccgactttcatccatgttgacataaacaccagtgatccattaaacacttatagattagtttattttttggggtctaacactatcaaaatttgaatattacattaaacaccgatcaattaagttaagtcaattaacaccactatcactagttttatcttaaataataatttgtgataagataaaagtataaataaataatatgaagtattattaaataaataatgtgaagtatatatattattataaaatcaaccaaacaataacatgtatttattattattaataataagagaaataattaatgattttattaaattatatttatattatcaattattacattaatcaaaattctttaactagtatactaatttcttcaacaaaaaaactactatactaatgtataaatttattaattatatttgctaattaatgtattaaattgtgtgc

SEQ ID NO: 363 - DNA, 1500 bp, Glycine max
  Soy_ogl_5261 Gm16:3014401..3015900 Cluster 1
ctttttatttttaaaatacttaaagtaacatttattaaaaaaatatttttcgtgatcatattttcatttctagtaattaaaaagttgcacaaaaaattggtaaataataataactgttaagttttagtgaccaatcttaacttttccccctaaattgaaggtattaaaagaaatactgataaaaaattaatgtgttgttaaaaatattaaagtatattaaaaaattaatcctttttatatgcatctaatgtttataaaatataattaataatatttacaattgttgttattataaaaaaattcaaaattaattttttctacattcaatttgagatcatttatattgtaagatatagtagaatagattactattgaatgaaatgtaaaaatactgcttgaatattaaattttaattaacaatttttatccaaaaaaatgaaagaataacatcaaaatagataagactcacgtacaaaatttgtctaagaccaaaaattatataggcatggcctgtgaaggacatatttgaaaatttgtgaacctcttgaacattctctggtaagacaagttgtaacaaattttttaatttgtcataataaaatagtcatataatgtcttttaagacgatttataaaattgatttagtagatgatgaaaaaattataatttaaatctttttcattaataaaatctaacaaataaataattagcattgatgataaaagatgtaatatcttttaagataatcggtaatcaattttctcctttcttgctatatacatgcccaagaagcgagggagaaggatgtagtattgtttacttaaccccttaatttgaaccaaatagtactcaactttctattttaattagccagttacatgtaggagaagcgaaaaatcacatgtatattgtccttctttttcaaagctaggccatgccattggaggcattctgaagttttcagttaagcatttataccgtaatcagtgacataatccacacttcacacttttgaagtaatatattagtgtattacgttacgatgatggaaggaattaacgaatgccaacaatcttacttagttgaccgcacagtgcatgccactttctccaccgttatagttgacgttggtctttttagtagagttgccatgccatcatctactactatcattcaaacaaacacattataaaattataatgcatgaatactaaaaaaaatatactttttaggttgttcacactcttaaaaaaaaaggtgttcacactcgtgcatgcatacaaaatgttactcagcaacatttttctttgtcttaaaatgctagttatatatctaaaatatccaaatatattaattatattttaatatacatttacttattaatatattccacttaaaataaaattatagttgtattctgtttcttcataaatataatgttataaaagttatatatcttatcttatattttttaaatgaattacttttcaattgacatta

SEQ ID NO: 364 - DNA, 1600 bp, Glycine max
  Soy_ogl_6977 Gm20:44167401..44169000 Cluster 1
cctaccattaaataaggtgataacattttcatgatcatacatgtcaaattatatattaatatgtatttaatatcataattaatttgcttatattctgaaaattatattgtaaactaaaatgaaattaattgatgaaatatcatataattttaaaactatatgcatttttttatacttaactgactgaatgtaatctctcgaattaactgttgggttaatgaaattaaatgtctataagaagttattaaaaaaataagttaagcatgatttactcctaaaaagtaaattaatctctcccctctctctcactataaatgtatgtaccaattttagagtattgtttattgagttgcttaaatgagtcttgtatatattttttattgtttgaaattggctcagcaatgttgcttatataagcaacaattattttttttataatatataagcaacaatatttgtataagcaatgccacaccatttgttccaatgctaaaaaaattattaaacaatgtttcttatggtgtttgatagagataaaatggagtaattttatttttttaaagttagcgtgaatctcacatcactattacactactttatttcaattatttatttttctcaattttattctactctactctaccgaacacaccattaaaattaagccactcatatgagtaacaactcttagtgcaaaaataactcaaggtaaagttattaatttctctttattcatgcttataatttcgagcagttcaatctaaattagcgacgcttgtatgtacacatgtgtacttttttcactatgatttttttttttcaatcgacaattgtaaattaatttttaatggcaaatataatcactaaaacgtatatactcacttccttttaaaaacctttttttatacacatttgtttattaagtattttttttaacaaattaatatttttaaattgaaaaataaaataaaaaatatatttaaaattgtgaaaatacacaattgatttaagttacatttaaaaaatatatattaaaaaaatttatatatttgatccaacgtaatttgaattaaatacccaccgacatggccatggtatgtctttttgttttccctaattaactgcaggtgcaaaagaaaaaaaaatgcagcatgtagcttaagactatttttttcatatttgtcggtatgcttgctacacaaatattaatattaatatatagtatgacggaacaagtttgccatcctatgcaatatagcccaaagaagttgtctttagatttggtttttatggaacattgaagtaaatggaaattataagaaaagaaagaagcaaagtagcttttgcttgcgctgaatcagtaaattcatatattttagttttaggaacttttcgtgaacatattttgaactattagaatagaatctcttttagtttgtacgagctaatttttggtagtttgtttacatggacttaatcaactaagtgtttgcaagaggatgttagtgtagaaattaagagaatctacttcaatttattggatagtgtatataagagttattgtaagtttattgttacttgagtttgattcttataggta

SEQ ID NO: 365 - DNA, 1700 bp, Glycine max
  Soy_ogl_6990 Gm20:44600101..44601800 Cluster 1
attcaccatttactaagtacttatatggactacatcacaatatcacatcactgcatacatacgccattccattctcaagcacattcatactttcatacttttcacatatgtctaccccttagtcataaggaacactttatatcacttttttttttttaaaaaaattattattaattaaaacttatttaaattataaaattaaacgaaatttattaactaagaaactaaacttataaattgtattatttaaaatatatttcttttaataacaaaaaatatgttaggtaatatgttattaatatttcttatcatcatcattatttgggttattattagttagtaaattaaagatattaattaaaaaagtgaattaatttatttttaatttttttattaatacatctaagatactggtcaacaacattgtatttttttaagtgaacaatattatcattaagttctgtttggtataatgaaaaaagttgagataaaattttaaaattaaaataaaatataaaatataaattccacctcattttactattttctttcttttatattctctttttctgcaaacaaatattgtcattaagttctgttaaaatgaacattgtcattaagttaacgtgtcttcgaagtaaacttcgtagtcattattttctccccattcaaatgaatctctgtatagaattatgaaatatatgaagtttgactggaagtgcatgacccatggccaatttcttgtattcaacctatcaacacatacggcaatttttaatccattcttttttcgttcaagaaaattaagataaatcataattgcaattaaactaatttgctttaatggagtactggctactgagtataattgactaactttttagtgttatatggtataatataattatgaaatatctaaagatttgaccggaagtacgtcatgagtcatgatccatggccaatttcatgttttcaaatttccacctatcgaaacacacggcaagattttagttcattctcactgttaaggggaatatgacaaaccatgcttccatttgaattaaataatctaattgaatgaaatattaaatatagttcaaaactttcgaatgttacattttttttttgcgcgtaaaataattttaatcactacaccaaagcataacttctttcgaatgttagtatgttgcgttttttttaatcggcaatcaaaagtatatatatatacttcctcaaaacgcaaaactacacgttataaaaaagtaacccaaacaaaccccgaaccttagtatgttacaagatactaatatatcctgtgcccctactataccaaacaaactatatatatgtacttacgtaaatttttatataacagttcggatcattagactcagttttaaaacctggacataccactaatctgatcgagttgtgttgaatattaaaccaatcatgtaatcaatcaatgcgtaattaatccattgacccaggttcggtgtttatttttcttcatattactcaaaatgacattattttgttgttacagtgtgattattaatttattttttatattacctgtccaatttattgtgtttaaagaatgtttatgctttaattgttttaggtacttaacattatcattgtgttctaaagtaatgattctttttagacatttttttaagatatgtataaaaaaattt

SEQ ID NO: 366 - DNA, 1875 bp, Glycine max
  Soy_ogl_1474 Gm04:47670343..47672217 Cluster 1
caaatcgagctttttatgaagacagatgaatataatttatattattgtcatactaaggagtacagacattccgtgactaactggtttttcatatatattttttaaataaaaagaaagataagaaaaattagtcggtgatttgtgaaagtagttatagaataaaataacaactcatgaatgtagtaatagaaataaaataataatttatgaatgtagtaataacaatgtgtacactaaaacacgttattctttttatatataattatagattatagatatatcattattggtacatatcttgcttattaataataataataataagttggttatttttttaaactaaataattggttatttacatcacttaatattttttttaattaatgttttcatttgaatacgtattttttggtaaaaatgataattacttgtaattaatgatatctcaaatgttttattttgtcttttttgaacgtaatatacttaaattgttgtaagttagtgatatagaatttttttatggaagttagtgctatagaatatgaaaattctgtaattgcaatatacgtgtttaattttctaagcgttttgtagtccgtataactgaattttatttttttatcattctattctatgtataatttaaaaaaaagataattgtgatgaaattttaatcaaaataataaatgcaaaccagtagggcaaagtaaaaatctcatccgattagtagggcaaagtaaaaatttcatcctattagtcattcagttcatttttttgttacacaatattcattggcacatgcaaaagactgaaaattatgaaggattctagtttaggtatgtattctctgcatcgactcattttacattcactcattatacctgtgaacgaatgacacacatcatttaagaacgataacgtgtcgcaaattatgatattgtcacttgaatctagacaaagcatattatgatacaatatattactggccattcaaaggtttgattctgaggtcttccacaaacttgcaagtataatatggaggtggggttcgttgttaatatattgtattgcttttcttttaactctcttaaaatgttaagaaaatatttgtcgccatatataaaaaacacgtgaagtgtgatcgtgggcgttattttttgccgtttgcaggtcaacaaattacatggagatcgtaaagtggagatgaactacacacaattacctttagtgtcgatgtaacggatgtttgagacgaagaagaagttttttgaagtttcatttcgagacagaaatattataaccgagacgcagcataaatgtgagtatcaccttttatcccatttacttccaacgcacggaccaatacagaccaattttccacgtcccacagcctcacaagggtgcctctcgccccaaaggagctcagagaagaaaatctacttaagcaagctaaggtacattatttgaagtttataagatacaaagttattagtgatcttgccattagttcataggaaacaccaagttttaaagttaccagaaatctttttttgagacctttcacaaagttgcaagcatattatgtcaatcattctgcacctgctcattcttagagaaagataacattagtcttaaatataatatttgttagtataattaatagttttttaaaagataattaaaagaaaatttaacgtagattaaaacagtataagaagcaagtaaattttattttatacacaaaagttatgttctatgtacattgtttctgttgttggaccagcactaaataataataacagcaaatctgattttagtatttccattatattttagtgggaccatgagagtgtgggcaacaaaagaaaattc

SEQ ID NO: 367 - DNA, 1309 bp, Glycine max
  Soy_ogl_2124 Gm07:2130287..2131595 Cluster 1
tccttgtaggttctggaaaaaaaatcaattattgctttgcgttttcatccatcgaaagaagcccacacctcatgcgtgaacagaactcagaactcggagataatccgttttgtccttttgcaaatgaagggaccattaattaggatttaggcgatcaagttcatgtccttcagtttttcttttattttttttatttggaaccatatcatgctatttgattccttcagagtgagagatatgaatattagaggataaagaataatatttgttgattaaaaaattaatgattataattataattatttttatatttattctgattacaaatttaaatatatggttggtttacttattaaatgattgtaagtgtattttactgttccatattaactttaaggttttggctgaattaaaaaatataattaatatcttgaatttcataaaaaaaaaatactcatgtaagtttctaatatatcttttatatttctaattaattatctagtaacaattaatttcactaaggtatttcacgaagaaaaaaaattaatattatgttaattttgtaaaatgacaattagtttaaaatattttttttttctaaaacatcatataaagtgaagcgaatagaatattttcttatttcagaagagtcagattaattcttttttacctatttataatattccctgcaaatattgatgtggatataaaatattttataattatttcttatacatgaaaaaaaaagtggtattcgatcatgtatataaaataaggtataaaatttatgaatatttcttaagaatgatttacggtttacagttacttccttaaaatttataccaaatttattttttaactgattggtaaagttaaaaaaattacataaatagtgcctagattttaaattcattattttttaatgaaaattataatatttattgttattaatcattcctactgtgatttttaataaaaataataatttaatgaatacttaactaatattcttaaaacacggattgacaaggctaaaattcaaaaatagaatatacacttattaaatgcatggatgcaaataaatgataaattttaataaaaataaaaatattaaataactaactatatttctcaatcatcatattgtatttcaatgtaagaaaaataaagattatgtcaaaaataaaaaatattatcattttcaaaaatcttatcttattttaaaaataaaaaattgttccccaaacaaatgtcgggcagtgcaccttttgttgacacggatccgatctaatcaagcaatcaatgtgtt

SEQ ID NO: 368 - DNA, 1377 bp, Glycine max
  Soy_ogl_2160 Gm07:3366801..3368177 Cluster 1
gtttaaaggttagcctagtctagcctatttaagaaaaagcctatgtccaaacttttttagcagtgtttttaattaagtaggtcaagttgcatgtgcttttaggaaaatatattagaataattttttaataaaatactaatatataatactacataagaaatatttatttcttaattataagagacatgaactcattttatttagtatgtaaaaatcatgaaatgtaataaattttattaattctcgtaaagttaaaaaaaacattaattttagtgacaaattaatttacacgtaatttttattcgttactaaaattttgctaacgctaatattagtgaagaaaattgcatttttcactaataaattattttctcttagcgggttgtgaggttttttattttatctttttttttcttgaactttagaaacgatacatatctgaaaacaaaaatctttcaagaatccaaaattaaaaagaaaattaaaaccaacagttaaattgccttaaacctatgtataaaaaactgccttaaacataacaataaatgtacaaagttttactaataattaaaaagttaataatattcttaattagttttactaataattataaagttaataatattcttaattagttatatcaccatttttttactagctatttcataaagccattgaaatacttgaacaaataactataaaagattaacagaaaacaaattaacacatgtttagcaatatagtgtgacgtatattaattacgcaatacaataattgaatgaaatttacttgtaatatgaatcccaatctcacttaacagcaatagaaaattttaactgctgcatggaaactgtttgttaatgtttacaaacacttctttagctgggagtatttagtttgagaaaaagggacaaaataaaataattattgaaagagaatgataagaggaaagagaaagtacaattagtcaacactggtccctttcgtacacgcgttgatccgacagaagctgatgggaatagcgctatttctgtgcatgtccttcctaatccttttctaacctagaattaagtcaaaacaaataggattttcaaatgcttaataataaccttaaaattttaatgttagtaataagctattttctagtattttttatttctatgaaatattagttaaaaaaatttaaaatgcatatataattatgtaagtgcgtatccattgctctaaaaataaatgaaaaacaattcgtgttgtgtgtgctgttatgaggacactgtcaagtgccagtcttatcaagagtttaggatattttcactctgtcgttaataatatttgacaattttgctgtcaagttcaacaaaaggttttttttttgga

SEQ ID NO: 369 - DNA, 1400 bp, Glycine max
  Soy_ogl_6199 Gm18:56439201..56440600 Cluster 1
gaccaaaataaatctccaaacggcaaaatcatacccctaattggtgtagaaaaaaaaatacaacgtaaattagtttatctagacaaaaaataaattaaaaaaaaaagttaccagaggtttcttctccaatattaaaagaaagacaaagatggaaggttaaatttagttcccttacttttactcttcctccttttaaatcttttaatcaattttttttttaaatctctcctttgatatattttatatataaaaaagaaaattggacttctttaaatccatgactgcactttataattaataactatagttataatgacttcatagttttttatcaatatcttcatggattgtagtgttggccacttttaaccgaatatgttagaggtagacctgtgattgattacaagacaatatcataatgaaatgcaacaagaaagaagagtataaaaaaactgtaatttttttcctttaaagttaaatgattctgtttaaaagtgaagacacgaaatcatgtctacacctaagacaataagagtaaacaatcatataacaatattactatcatacgtacaatttgcaaataataataataaagtgctgagtaaattttatagaaaatgaattattatgcaataaattgaaaaaataaaataaaggaatgccggtctcatatcttccaattcaaacaagattcctaataaccaatttgttataaaaaaaaatcatctagcaaattttgaacagtgttcacaaattttttccccattcttatccatttttaaattgttacataattgaaattattatttttataataattattttaaaaagtatatttactataatttttaattaacagtgtgtgtatatatagaatgattgagcctctttttttacccgatgactttcgtcgtcttcgccattatgataatcataatgatgaagttcttaaatctaagtttgcacatcatcgtgccaaagctttaaaggcaaaatttaataaaacacttttgtattttttttattttttattttgatcagaaagcacttctgtatatagtttgagattatttacatgggtatcttttatcatatagaaatttatagtggattttttattttgatcagaaaacacttctgtatttcttattttttgttttgatcagaaagtgcgtcttagaatattattaaacacaaaaggttttagctaagtcattacttcatgaagagtattgtaattaaatattaaagtgatgctatatcatatgaaaactttttttacaaattagattgaaaaaactgcatgtcaagagcatgacaaatttggttgcgacccaactatattgcagaagtcaactttttatgaagcactaaaaatataagatgtcacgagatcaata

SEQ ID NO: 370 - DNA, 1292 bp, Glycine max
  Soy_ogl_6205 Gm18:56681282..56682573 Cluster 1
cttttatgtgtagaattagaagaaaattaaacatatatcaactcaaaaattcaaaaatataattttcttatatattttcgttatttgtgtttttaaattttaattttccttttttttctcttatatatacgtaaaggtttccaaagaacgagtagcaagatcccatgtcctcccttggatccgtcacttaagttaccataatgattatctaaaatctttcacactaaaaatatacatctattaaattaacacattctatatatcaaatcactctatgagtacaggttacataaaatctttttctattaagacccaccacataaattataatccaaacacacccatttatatacttcttgctcgttgcgtgaaaagtttacaaacaaataaaaatacacacaaatacaaaatgatgttatttcatcaaaatatttttgcttggcataatatattaatattttttgtaattaatataaataatgtttttttatatgggttgtagtactccttatattcctgttggtaaatactttctttaaacaaagaagaagaaaatatcccttaataaaatcttgttaaaattttaccaataagggttaattaagtgtaaggaatcatttgttttcgcaaaataacaaactacttattcttatgagaaattcacctatttaatatttgttcttacaagttttccaaagaccctgaattagttttcttacaagaactgtaattaattttattagccaaaaatatatgatgaaaaaataattttacttataattgattggtgacattatatataactctcatcattctattcatcctagtgtaacacaatttgctaatatatattattttaatacactcgttttatcaattgtcatttattgcaaatcatataattctcactttctatttaataaattttcacttataattttaataaactttaactaataaaaaaatatgttaaaaataactctcctcgaataaaacatattccctcatggcacatgtttccattgcacttgacacttgttttcagtatcaacagttcaacaccgatggggtaaaatctaggtcaaactgttctttggaaggattgcgtatagactagaaaatcaattacgcgtcaaacgttcaaacttggtcaaacaagtttactcggcgatatccgttggatcaggctaacatggacttacaaagtgagagtttttgttaattagtgttattaggatattagttaagaaattaaaacataatatatttattgtgtaaattatagaagagtg

SEQ ID NO: 371 - DNA, 1700 bp, Glycine max
  Soy_ogl_6622 Gm19:49311501..49313200 Cluster 1
tagcaaataaaacgttcaaggcaaccctatccgcgcagggtttggtgggggctccaaccacatttattaatactaaaggctagtttgtacctacttcataaaagaaaattctcttgtactaacaatttaacgttgaataattttttgttactatagttttttataaaaagtaaatcataataaacattatgaatttatattccaactttattagagtaaaaattaattcagattattagtaaattaaatattaagcctatcttttattgttaatgtaattacagaatgtatacattattctatgtgaaggctaagctcatcctattctgttaattttgttcatctgttgtttttatttttctcctttcttcatatttctcttctctccatctctcattttcatttcattccacctcataatggagtgtttgtttttttttttttttgttaaatctgatttaactaacgggaaattgcctttagcctaggtaagttgtgtatgctacgacggtggcacctttaattttaggaattttctcggaagacactttagaattttgtatgttattaatgtgagacgttttctacagtcagactagatagatatgccaaacaacatttcaacatgcttcttgacttcttgtttagtaatgggccaggtgtctgctttttacaaaacatcaagttattgtttttatgctttggtttcactttttttcttctttttgaaaaattgtatttatatgttttcataataaagaggcataaacataaataagtaggtgcaataaaaatgattaattaaaaaacaagatattttttttctgaattataaataatatgaatagacttatatatagacgtataaaaaagattagtaatctaattgtctagttaatatatatgaaagaattaataatataataccaaataatataaaatctattgtttaattatttaaatagtaagttacatgcgggggtaattgggcaaagtaaatttcctcacacttaatcttttaactatatatgtatataagtaattacaaataagtgcagaactataaatccaaaaacattataaatatatagttgagtcattttttgtttttaaacaaagttattcgttaaaattacaaattgtagtttttttactctcaaagttattccagaaaattataaatttagcaaattttagagtttgataaaaaaattctagcattcttaatttttttatcagtagcattatttcaattattatataaaaacaatcagcgacgttaaaattataacttattagcataaatatttaaaaggacacttattcaaatataaaatatttgaatacaaaagaaaaatataaagcattgcttataaaactatatttaaaacatttgactgtagatatgaaatatttcaacaaatagtttcacttttaaaaaataatcataatgttaattaacattgaaacaaaatgatgttttaaaatattgtgtctcagtaaaaaaaataatataatgtgtcatttaaaaaatcctcacctcatacatagagtgataatttacttaacagttaaaatttttcatgcaataatagagaaacttcagagcattcacgtttatgtgaagaaaatacaaaagtttatttggtaaagaaaaaaattaccaaaaatattaacagaagttgtagacttatcccttt

SEQ ID NO: 372 - DNA, 1624 bp, Glycine max
  Soy_ogl_5239 Gm16:1917501..1919124 Cluster 1
agatttgagtcatagagaggaggaaggatcacgcagtgtctctttccttctggttcgcacgcagaggttttgcactagtggcaattccagcaatgctgtcaaaggaatgaacactggtggcaaagggggtggttcaacaaggggaagttctgttgcccaccaagtcaaagaagcagatctaaaaaaatgattgagaggagaggccatgcattgaatctgtaaaaaagtcctaaagaaggatgaagagaatcacattaaaaaaaaatttagtaagtttttttttctctgacaaggatattataaatattttattatttttaaattgtactttatactctattcaaataccaaattgtgttctacgggtggacaacctattctctttgtccaccctagaatcctccatcaaatcatatctaaaatactgctatgctacgtaattctcaatggtgaatagagagagagatatgagataaatatacagaagagaggcagtgactagtcgatagcattgcatttacatcatcacatgccattcgccaaccagctccttaatttcatcaacattcttattttttaaattttactattgctggttaatgaagaaatagagaaattgtgtttgagtgtgtatgaaaattaaaagtttattttagagaagaaagtgggactgcagaaacatagaatgaaagaaagagtaagacaaaggaaaaaaattatagaccgatgatgattttgtaagttatttagtttaaaagaaagtaaaaaaaaaatattaataaaattaattgatctcttttatatttatctgctttatctattacagtgctttgataccatacatattattgtttctccttttttttttttataaaggtataataattaatatcatcccttagtttgataactcctatactattcttaataatctgagttggtcctgtggtctgactattttaaatttttaatcatgctgattaaaaatagatttctggtcttgtgtatataaaattattgaaaaaaagtaaagtttactttaataatttttgtcttaaaagaaataaatctaagatttttcatttttttgctgaatggaaataaacctatgataatatattacagaaaattataataaatattattattagaatagaaattgtgaagtcggataattgttaagcattgtgagagctaaattttattaaaagaaatattatacattgcagcttatttataagaaaaactatattttatgcaataaacttcgccgcttccagaacacatatgacatgtatcatgcatggttgatatatgatatgcattctttaaaattcaattatttttttaaaataaattaagccacaaaattattcaagatattttctattattatttttatttttgaaaaatattgataaggttagttgtcattctttaaaaaaataagtaatataaatatttaagtccctctcaactaaatatatttaatagttaaaagtaaatttaatatgatgatactacctactttggcgcactgggagtctaagcacggttgtttaacaaattgacaattatggattttttttactaagatataatgatgttttcttttactgcaata

SEQ ID NO: 373 - DNA, 1490 bp, Glycine max
  Soy_ogl_5481 Gm17:3544811..3546300 Cluster 1
agagaaacaaattttcatttacactcttctatgatttagatattaaatttttttaatttaattctttaacaaatatccataaaatactagttaagaagatcctaaatataaagctttgtgcgaggcttgcacatctcgatttgaacgtgtagtcaacagactcaacacgtgacatataacaacaagcacgtgtaatttaaatatttgaaaaggtcaaattatttcttttattattatcttaattaattaataatactgttttaatgaatgtactatttaacttttaatattaattaattaaacaatatgacaaataaaaaaagaaaaacatacaataactagtctctcgtcttacttttaattagtttttaaaattattgaattttttaaattataagagtatgtgaatgtaatttatcttgactttgatatatgattttaattaatttttaaaacgctcctatgttaaagtttatttaaagcttaaatatagactgtgccaaccttggacgatacatgttaactaaattaatttgagtaagaaaaatgttaactaaattaatgattaaatgatagactaaaatagatattaattttttaataaattttcgaaatgccctgttgtgttagagaaactttgatgggattaaatgtaatttactcattaatatataataataaaaaatcaccagcaatattaagctacatacaataattagtgatatattagactgtaagttaagaaaattaacaattgattaaataaaataagtaaattattataaattttttgatattatcttatatttgtacagataaaaaatatttaatggtaaaaagttgagcgtgatgatttgatttttgatagaaaaagttgcatgggcttaaatgcattcaattgaatctaaactatcaaatataaacaacaattgggtacttaatcaattctttgagaaatttcatcgtagatgaaagaaggggttgttttgaatttgttccccttttcttacggactgagaaaaagtaataagaagaagggggttggttgaatgacataagtcaagaacaggtaagccgaacatgaatccccttatttcccattatcacacaaacaacactagcttcattattccgtctgcaattgcaaccaacttcccaattgcctaagaaaacaacatgcaaccactcactctacccacagaactttatctcacccaattttaaggttgttacttcaaaaatcttaatcttactttttctctatctgtgaacctaatatagaagcagacctttcgtgtatccgcagtctgccagctccaatcatacttttattaactagaaaatttatatactatgggaaattccacatgtctaatattttggtgcaaaatacaaatatttttgttacaataaaaaaaatctcttcataaaagtttcctttatattttattggtcgggttgagcatgtaaagagtttcataaagcccaat

SEQ ID NO: 374 - DNA, 1800 bp, Glycine max
  Soy_ogl_6901 Gm20:40872701..40874500 Cluster 1
atgaaaaaaaaaagatattaatggattcaaattagaaagaagaaaactttaagtaaggtgaattgaatgggtgtcgtgagataaaggaaaatttgaggaggagtagtttatgcggttaggtttggagagatgatgtatttgggtcttctctagtaaggaaaaagagagtgaaaagttatgggaaaataaaggttaataaatcaaaaaattacttattgtatcatattcattttttgtgtttacattctttttcccatgttatcctctaactaagaatatgggtttatttatgaaaataattataaatagatatatatgtcttgtaaaaagagagacaaggaaacggtatttttttttatctattgttatagatgcaagaaaataattataattattttttttatctattggtcgatatgagataagaaaatataacttagttggttgaacatattggtccgttatcaataaagtgtatatctatcaattatgttaagtaaaaaagatattgcgtgaaacatgaacaagtttaccactaacggcaattaataaagtcaaacgaaattacgtgaaacatggataagtttacctccaagctaagacatattaatatagcagcataattttaaaaagttttaaattcaatcaataaaaatcaccactaatatattttttaaattataaaatcaactaatgttagtatcatacataacaattttttgacagaagtgtcatatataataattaatcatttatttaaaataatataaaacccaaaacagtcatgtacatattttatcatacataataaagtgtatagttgtcaattatgttaagtaaaaaagatattgcgtgaaacatagacaagtttaccattgacgacagttaataaagtcaaaagaaattgcgtgaaacatggataagtttaccaccaagggcatattagtataggagcataattttaaaatgttttaaattcaatcaataaaattcacctttaatatattttttaaattataaaaaacaacaaatgtcagtatcatgcataaatttttttttgacataagtgtcatagaaaataattaatcatttatttataatgatatagaactcaaaacagtcatgtacatatttccatatatatatatggaaatcatccacattgttgataagatatgcttgtcatacttctgaattatttgtatatattgatcactcacaaatttatggatctttatttttattgtgccaataatattaatatggtagctggatcaatgtcacaacagtctatctttgtctcgtattacgtgtatttcggatatgttaagcccaaacacatacattctatactatactgtgtcaaatatggaattaatttttcaaatctccaattatttaaatcattagcatcaattatttataaacagatctttgtttctaatacataatatggtagctacactggactctggaagattcagtgccacgtaatgttacattgaacatggacatcatcatgttcgcaaaaaactcaggctgctaaaaaatatatcctttatggtttctagcgaattctttttttttttttttgtttaagagctagtgaattcttttgtttatatataggcaaatgaaaacattttttttttacttaattcccacgtcatctttttagataaattcccacgcctattattatacgggactaattgagatattttaatttatctcaaaatgtttatcatttttacaaaccaataaatatcatttttgataatatcattattaatatatcat

SEQ ID NO: 375 - DNA, 1417 bp, Glycine max
  Soy_ogl_676 Gm02:45338101..45339517 Cluster 1
tatttatactgtaaagtgctgtatatattgaattattttccagtgacaatcacattaaattatatgtgtcctatttttggataactggatagcttcatccatctatttggagcaggtgagaacattaatgctttgccatcgctgcattggggacggggggtacactgggcagaaaatggaaatctatggatctagtggcccggaatctaattggataatggatatattcattactacatacatatacctaaatgtaattaatatgaaagtactttatcttcctattaattactgtcttacaaaacattatttgatctcaacttttttactttttttttaaaagaaaaatatatatccctacaatcaattaaacacatataataaaaatcaacaagcagcatgattaatttgtgtgaagttttttttcttaccaataatttaagttcaatcaagttttaaatatataattaactatcttaaatattaaaattaaaattttattattcataaggatcttatattaaactcaaaagaaattatctcttataaaagatattttttatcatttatctttatattagatatatattaatcgagttcaaaattatatatttttaaaaaagagagggataacatcattaaaaaaatgaataatagaattataattgctttcaattcaactcaattatttaatgaagcgagtaagcgcacctataaaccacacaataactgaaatttgattgatatatcatttatgaacgccactctttagtcaaagaggtgtgctaattaactgaacagtgcacactctccaaatcatttattttaagaaaatatgatcagttgttgaaagccatacacattaacacattaattttttaaaataacttttgcttcatccttaattataaaatccttttaattaattcacgttttttaagaagaaaaaaaataattattatattaaaattttcaattatttatactatatttccaaaattacccatttgttctctttctattcacttacttatttttcattaatatttaaagaaagcataattaaataaggatatatagggaaaaaataattaatatatctaaaaattacaatttcttttataaaaaagacaaataaatttttaaaaaatatcttataattaaagacaaaggaaaacttaagagattttggatgagaagttaattgttgaatagggtaaatttttttaaaaaattcttttaaattattactaacaatttaatgacgtaatttgattcgtttattccttataaagtgaattttacaaaaagggcttaaaatggtgcaatggatagggattgacacatgtaaaaacttacttttcacgtgactcctcttagtgtgttttatttaatgaattttcataactctcacatc

SEQ ID NO: 376 - DNA, 1705 bp, Glycine max
  Soy_ogl_1445 Gm04:46796601..46798305 Cluster 1
aaaacaacgatgttatttaatactaatgtccttatacgataagagacagaaaataaatagtagtaactcttttttttaatgtcgctatatgtttcgacggatttttttaacatatgaaaagaaaaaagttgaagtttattaaaaattagaacaaaattttgtagatttcattcttttgcttaatgaatattattcatgattttgtagctttcagttaattttaactaatagtaataggtacgtaagaagaagaaaaaaagacatctccaatggagatttgtctactgattaaaagcaactaagtataaaataaaatattaaatctccaaaaaaaaaacacagaaaattatatatttaaaaataagaaagagaatatttaatatttaaattacacaaaatatgttagagatgctctaaaaaaaagttttctgatatactaatctctagtatatcggataataaaaaatattaggacatctccaatgtatatcttcgcactcatatttcgagtaatttaatattacattttctcttttcttattttaaaatatacaattttctattttaacagataaaaatgtaccatactttcaccatttttaaattttgtataaaaaaaatataataatttaattatattgtggaacaatatttgactttaaaaatcttttactcatatatttgtgcatttgttttcttatattttctaaattattttttatcataatttttttctctattacttatcttttctagcttttaatatacaacaaacaacaaatttgttactcccgaagcatctacttgctaaataaaatggccataataaatagatggaaaatgaaatacaaattatgaggaagtataggatgaatacttctaagtgatctttggtggaccactttcaccggtcttcatattaagtttattgtgtaccttttcacatcaacactctgtacgcttcctcccggagtctctcagtctcacggcgccactatctgccacgcgccgttgtcatcagtgatttctctggcgccgacaccataatcaaattcaccaatcaacacaaaatgcatctcaagcttttccaatcagctttgttataaccaaatcgtcataaaaatcaagaagcgggaataaaaacatggattcaatgatgaaatgatcacaaatctaaaaaaaaagatatgaaacacacatcctcttcctcttcgtgtggttttacgaagtcgagggaaattggaaatttggcagagtagtgtgtgctgagtgagagatgaccgtggagagagaaactataagatacggagggtgtagcgtattaagatgaagacaagattaatccaacagttactaattatggtccattgcagacctcatgagagcctttttcacgctagaagttgtcacaaattaaactacttaacctatactttagttgaagagatgataagagataaagaaatgactgagaataggtaagaaaagtataataaatttctacttttaaaaatatttttcagtttgttccctccgcccaaacaataaaaatcaccttcctctttcttctaatttttctgcaaccaaaccgagatttagatattttttattacattaaaaatacacgatgaaacagaaatcgtaacaaagtgatttttcattaccccaatctttattcaatcatcaatactagtgagagagagag

SEQ ID NO: 377 - DNA, 1800 bp, Glycine max
  Soy_ogl_3757 Gm11:5794601..5796400 Cluster 1
taaatgggtcaagcccagcagcattcgaatatcaggaaaaaaaatctcaattgggccaagtacaacaagacagaaatgagataaaaagagaaacaaacaaaatattttggtaccagatcaaggcaaaaacttaaagcaactaatttttgcttagtgcatcccataattttgaacattcccaaaatactcttatttattataacttgatagtatgtaaactttctctgtgtgtggacgcatccaactttctcatgtgggcatatgtatatatagaaaaggaaaagggtctctctttaacaggagaattggatatatgatcactcttgtccgtgcttcaaattattttttttccattaagtgtgaaacattaaatttaatttataaatctgattcatgaactcttttgttattaaattataatgtttaaaaattagttaacaataaattatagttttttataattaatttgatattgacgtttcatacttaatggtgagatgttttttgacacattttctacattttcaatgactattcaaaatctttattcttttaaaaactaaagtgtaagtattttatattttcaggacaaaagtaatcatgtatcctaatagaattgtattgatagtttcagaactgttaatatgattagcttaatgatccttaaacaaaaaagaatgtgacaacttaaaaaaggcacctaggagtgtagtggttaggaagcctgttttgctagtgatgcagaaaattgggagaaatgatgtccgccaagctgtggtgtccggacataactgggaagatgcaagggacaaagaaggggaacttggagcatacttagaatagtcaatgaccatttttcttaaagtgtatgtggtgcattaagatatgttaactatttcatatgaataatcaaaactagttttttaataaaaattaattttaattattctagatagaatcttctcgctcttcatataatatatgtcttatactatgtaactgcaatttttctcttgtttgatatacgcaccataatgggacgggtttagtctctttgttttttacgtccttcttgttttcacctttaatttttgtttagggtccaaaaattaaatccatccttgtatggtctatgatcttatcttttttttttttataatgaaaaatataagataatatttttttaattagattgaatctattacaaaattgttcggtcttatttattttttaatagtttaaaaaaagaatcatcatgatatcttgtttatcaaaattgaaatttcaaatgtttaacaacaaattaaataaaaagtatacataattataagaaaaaaatattttaatacataaaacaataattaattcattaaaattataagattataaatatttattgtatctgagtggggcatgggtgagagcgagaaataacatagccaagcccatcccaaattcaactttttgaatgggaaaaaattgaaacccaattccattcccattttcattcgttaaaattagaatggtaggaacgtatacacttggagtttgaaaatattgatatatgtttttggaatattccattggggtggcaaatcaatatgcctttgcgtaaattgaccattaagatcaaagacgaaaaatacatgttgtaccactcgacgctctgatgcaactgctagtaaccacatatagggaccttcaaaaaacaaaacacttctagaagataagaaccattcatcaagtaatggaattttgaatataacgtttgacacagaccagtcttggacaaaatattca

SEQ ID NO: 378 - DNA, 1533 bp, Glycine max
  Soy_ogl_5251 Gm16:2283668..2285200 Cluster 1
gagtattaaattttacaggtaagtttctagtcccatgttctatctccattaaacaggtattaatatgttatatctattatggatttttgtacgggtacatttaagacatgcatggatagaattgtgtgatcctgtcaacaggtgaattttggcaatatatgcagactcaacaatgatatattttttacattatctaagtgtacgtgcaggattaattcaagcttttgatataggctttaatcctccttataagattattttttttcaaaatattcatacctgacatataaaacccgctcacatgaaagtaagtttgtcatatttaaatgaaagatttatatagccaccagtatgcttccactagaatgaatatttacaaaagcaaagtgacatatacaggctgtattataagttgatgagatgatgccgaaacatctaagcactatatattttatcattatcttactcatgacagacaactaaacaaagctttatatgatagtgtactaatgaaagagcctagattttttttctgaatataatattatattattaaagttaaaacaagccctccaaagaagtgtgcgtgattgtgtgtgttttttttaatgtgaattacacaattgttatattcgcatatatctcacatatttccggtacatgtttataaaatatgcatgcgtaaaaaataaataaactcaatcttatgaccgataatattagtgctcactcggagttataagattagttggataataaaaacaatcacgaatttaaatttttttcgcttaaaaaaaataaacaattaattaatattattgataaaaaaatattaatactcactcaatctaattagatattgctaggttatatgtttaatgagatattttgagactgattaattattctaaaacaaatcactagtccagtccacatagtattaattaactcataaatgaaagtatatatgtagattaatttattatgctcttagaaaatctataaaaaaaaatcttatgagtgaaataaatcttaaccttaacttaacagatcttaattgggtcggattcgaattcaaaaagcaaataatcctaataaatttttaggtccagtagggataataataaaccattcctacactcacttccaatccaaactactccattattataaagacaatggataaaagagccaaaatctaaaacttttattatgcctgtttttttaggtttattatcctgttagtaatgtctatttagttattgggaccagtgaaaatgtttttgtacaaatgaaattgaaactgtgggcaaaagaatgcttcgcaaggaccataaaccaaaaataatttaatatcacacaaaaacatgaaagaaaaaaaaaatggaaacatgaagaagacaaggagcaaagtttacgataattgccttccgccaaatgattaacgaacggcgcacacatattatttaacgagaaaacattattattttttcacttgaattgaaacaatgacaattcacgttgtgtgcttcc

SEQ ID NO: 379 - DNA, 1200 bp, Glycine max
  Soy_ogl_6575 Gm19:44793901..44795100 Cluster 1
gttttgatacgttcatatcttcttgctgctgtgatttgaacccctttgtttatggttcaacaatttttggattatcaagtttaaaagaaaaaggatataactcctcaaaacttcagaatgtattttagaaaaatttaaaattaagataaaatataagtatatatacacaaacataacatacatattatacaaatattcgatttgccttcccaaaaaaaaacataacatactaaattatgaaattatatattaaaaaaactcaattatgaatttttcaattaataataattattccacacctgaccttacaaagtgcaccagtatatcaccatcataagtgttttttttataaaactactacctctaaattatgaatttttcaatttataattattattccacatcaactatatatataataggtggtgcatcaatatatcaccgtcatatagtgttcttttataaaactattatctctaaattagactattgaggttattttaaaatgatgtgtcatacttgttttgtttatagctgaggcataatagttacttttctttcttgatcatcacattgaaactttcatattcatgaaatcgtttttgatctttcttatttattagttgtaaaacttgaaatattataataatatctaaatttcttgctttgtaggaaaatggttattctattcgatttggtacttgctcaggcaagattgtacttgtagctccctgatgcattccatagttgaattgaacatagtcaaacaagtataacaaagttgtgtaagactctggatgatttagtttgaatatgatttgtcaccaattaaagtacacatattttggtataatgaaagtttgatacaaaagtgaagatatttaactattggagaaaatattgtatttggattggtgtaatgaaactatacatatatgtgtttaattctaatatattttttgtcactctaatttttataattatgattttgactcctatacttttaaagtttgatttttagtgtcataggtttatttattttaaataattatatactactggattgaaattatacatgttcaaggattttaatttataaggtggttttagaatattaggatgttatttttgtttttgttttaattccctaaaatgagatgagacttgtaggattatattcaattgttggcgatcaatatt

SEQ ID NO: 380 - DNA, 1273 bp, Glycine max
  Soy_ogl_1428 Gm04:46037428..46038700 Cluster 1
tagacgcattggatgagatgattttttttgcatgagaacaaaatgaaaaaaaatgattgttaaattttattatgaatatttaaaatcaaaacacataatgtaagtgtatttttatgaaagtcacaatttttttttaagaaactatgcaattttagaaaaactttttaattttcaccatccaacaacagtctacgacaaaggtgagattattatttattgattcattcttgtactgttaatacttgatatttgatcctgtgaagtctcatactggcgcttagggtcttagactcttatgtattaggtaagaggttaagaaatggagagtccaattttggttacatcacatagttaagtcagttttgaacactagatgtctataaaaattaatgacattacttcaatcttaacacgttactttttggccccattacgagaaggggaatacagtgtgataggtcactttcagaaaaaaatgtagtagattttagattcaagatacatcaacattcatattttttatacacataataaacatattttttttttatttctcttcatatgtcaaatcatattacttataaaatttttaatttttattttatctccctcattacatgtccattagcggcgttcatttatagtttttttagactgtaaactgtatgaaaagtttacaaggtagagtataattactttttatattcacgccttactcaataatttcaaaacataagtgaaatatcaaataaaaacataaatttttgaaatatttgataaaaactagtagtaacaattattattgataaaaataatcaaaatgaaaaatgtttaaaaatttgacttaatctaaaagaaaaataaaaaactttttttaatctaaaattaacttacgcataaattaatatcatttcttttggagaaactaaataatttaattttagtttttcaaaaatttatttgaacttatacgtatataaactaattttagcttttttgttttttattttctctttctataaatatttataaagaaacttatctaaacacacaaaaactcctgcactctatctcttgatcattgtactgttttctatcaacactcaatataattgcgtaaaagtaggctcttatgggctcttgtccacagttggtttaaagcacatataagacagttattttttatatgagattgaaaataaaattacacaaaatgaaaaatatattaatcactgaatcttattaaatggcaaatactaaagcacacatatta

SEQ ID NO: 381 - DNA, 1600 bp, Glycine max
  Soy_ogl_6834 Gm20:38125801..38127400 Cluster 1
taaccattacattcataacttaagattatgtagtcttattaatgaaaaaatgattacaaataataaatcatatcttaacaaaatttaccacttaataatttaaatttacaaaaaaatattaaaaatgtaaaaaaaaaatgaaactctagggggcctaaaacaaatgcctcattgaccttatgatttccacggccctgcttctttccataggagtggatcgagttgagaaaaaaaaagaactagatttaagaatagtgataacgaaaatatagtaaagttatcgttaattttatacacatgtaaatgatttttaattcttttatttaataattaatatataaatatttttagttttttcttaatacaacttgatcttttaatttattttttcctatagaaacttaaatttattacttattgtgattgattgactgtttcttgaatggtccccgtaatagacacctaactctatctttggattcttcaaaaaaaaaaaaaaaagaattctatctttggatgtaaagacatcatgtgagcatatgctaaggacataaggcctctagaaattaaacatgtttatttatttatatatttattcaaaagataaagcgtaattagatacaattttttatgttctttaactgtttctacatatatatttaaactaaaattagagttttatatctgatgagttaggtgaaaaatattgtattaaagattaatatagattactgaaattaaactttgatattaattaaaaaaataacactaaaaacacttagagccgcatctaagttttgttggtaaacaaagtagtatatgatagtatgttgaacttgcctattaaaatgtccgtgatcacaaaaatagatactatatagtctcaaagtgagtcagttaatttgtcatcgaagggatatatacaaagataaagtttaatttctacacattatcaaccgaaagtccacttcaccttataaaaaaaaaatagcgattgggactcgagagaacagagataagaaattaattaaatacaaatatgatattgaaatttccaccagctaaccataattcctagactacaatgcattcagaatataaaagaatctttcaacaaaaataaaagcttatctgattattaactgaggtcggtacatataatcagcaaatttctagacattgttcaaattaagaatcattaccgattaaaattaagtcgttttaataatctcactgataataagtacttgtgcaggcttaagctcatcgaaatctaaagttagaatcacgcattattcagtagatcgagtaatttgcttttaattaatttgttcttggcaaatgcgatgcgccttttctagtttcgctatcatgcacaaactataataaagtgacacataaaatcgcagttcgagtggcaaatggggttggccatgattttccttgcaattacagaggagcagaggctggattagttctgtccaagacaaacaatgcaagttgcccccaacaagcagaaccgatcatgttgggcctaactattacaagtagaaagtggtttccattaaattttgaagacaacagggttcatatatattct

SEQ ID NO: 382 - DNA, 1300 bp, Glycine max
  Soy_ogl_6871 Gm20:39568001..39569300 Cluster 1
ctgatatttgaaggagaatttattttatttcgttgcttttacttagactttagaagcctagaaggtaagtagaaaaacaagacctggtcaaataatcctgacgaaaaagaaaaatcaaaataggcaccacaaatttccaaactgaaaaaacggtgaaaaagagaaggaaaacgtagccaaaaataaaatattaaaaaaaataggtacgtaggtctctcaaaaaaaataaagttttttttttttacttgctaaaaggagagataattttgaaacgtgggagaacatgaaattggaaaaggacccgaactccatggaaattttggactgggctgaattgggatggggaaagagctatttggactgggctaaatttgaataatgaaggggatgatttctaaatttaaaaacatttattatttaattgaagggaaaatataagtaaacataggagattaaaaatagaaatatttgttttattttttttaaaattaattttcctttttatacttcatcaaagaaatagtaagtaattgaaggttgagggtcgtgtgattgactgaaaatttataaacaatttaaataatttaagataaaaatagtttgaaattaagtgattcaaattcaaactttttatcttataagtaaccttataataattttgtaatataatattgaaattatattttcacttttaataaaaatgatttttaagaacaaaaactacattttccttagtttttaaaatatagctaaaaatttcaaaattaaataagaaactcatttaattccaatttggtcaaacaatttttattttgaaatttatatatttttaaaaaaattaaaaaaattacaaccactccaatgatactccaaaaattctgttttaattacccaaatgaacttgtttatactctataaaaggcaatcctaatctctcctgtccacacaccccagcgttctgcattttcatgtaggatatatcttcaaatcttataagctgaacgtatataattgatgattcccacttatgcattttttttttacacatgttattattgatacgtgaaattttttatatctctttatttctcatcaaatgaatgacatattcttttgaaaattctagttattcttagcatgatattagaaaaatttattgttattacccaaacaagcataaattgtatcatagattaaatcagacatataattattgaaacaattgttgaagattcaaataatgaacatgtaaatataataacttatacattattctatatcccgatgattcagaaacttt

SEQ ID NO: 383 - DNA, 1300 bp, Glycine max
  Soy_ogl_98 Gm01:3922101..3923400 Cluster 1
ttcatttggcaatttctataggaaaaacacagattccattttgttgggagtgggacttttgttttgttgctgatgttacactttggatttctgtgagttttatttcaacattgtctacttgcaaagtcatgcattcatgaaaattaaaaaaatggggtgggttatttatgttactgttggccggtgcaatttgtatgaatcaaaacattcatttgggttttgagtgggcatatcttgtacttaaatttaagcctgattttcttattggcaaagttattttagcttatataaaaaatattatcattgggcatagttgattcgctattaaaaaacacactagaagttattcaagtgattttatactgattaatgtgcaaaaagtaattcaatttttgacaaaaataattattaattgaattttatatatttatttttcgatcaaactaaattaattagaatatctttctttcttcagaatattaaaacaaaaaaaaaaatactttgatagttgaacatgacctccttcacagcgacattgccgctggtgattaaaaaagttaaaatttggaattaaatgatcagaaattgaagagataattaaacgtagaaactttcttagttttgaaatatcaaaggtgatagtgggaagcatttcgaatcagattggtgagacgtatcatttattatttcttaatttttatttttttttggtctggtttgtcataaactgctaaccaagtactctgttgttcattacttcatttcagccagagaaaaaaaatttgtggtgcttaatttcttagaatggaacacttgaatcatcttttaattatctttttaggatttagttatagtgagagaatgagtaaaaaaaatattaaaaagataagtgtttttattatcgatttcagttaaagtatttcataaataaaatttattttgaattaatggctttgtagattttttattttttttcaaaactatgtaaatttaaatttaaatatctccccttctgacaaacttgaacttaaaaaagaaaaaaacttgaacttgttttttaacaagcaatagtggccataccctaactcgataatacgactgaatagtttttttttttaacttgaagattaatatggatatttgcatttgatatagttatttatgtttcataaatcaaaatcagtcaacactcacatatcgaaaagctaataatcaatacaaataaataatttaaaataattaagtctcttaataaataaaattagtgttcaataatatagaaaatcattaaagaaaataa

SEQ ID NO: 384 - DNA, 2100 bp, Glycine max
  Soy_ogl_100 Gm01:4057801..4059900 Cluster 1
attgtgatggccaacaaggaagcaatttgtggaaaaaggaagagggagaatgttttctcaaagtcaatattactgtgattttcttataacaatcaattatctttatttttagctgtgctattcaatttgtttttaattttttcattggagtgtatcatttattaaacaaaattcaaaaaattataattaaaacaaacataatcaaaaaaaagaaaaagaaaagccattgccccacctgcacacaaaatctaatcacccgattttaattccaatcaaccttccacccttcacatacaaaaaaaaaaaacaacgttgaattgaaaatcccagaaacattcacctggcctccaatggacatgaaggctttgtaaaatcatagaaaagccacacgcatgcaacaccacaacaaaaaatctcaccatagccacaatccctaagccccatcatcatcgtctccttctgtgggcccgaatgatgttgtggagatcccattgccgaagcagcaagtgaacaacaagaagaaaagccaccattcgacgaggaattggattcagggtctagaattgcgagcaaaaccacgtcgttgtagatctgctgcgaagtagaacgaagaggtattggtgcattgttgttgtcgcagtacaccaacacttagaatcgcaaataaaagggtctgttgttgggtggaatctacgaggaacgaagatgaagctgaaagggaactagttgaaaatcatttactggcgattttttaaccgctagaaagtataaaaatgacaagtatttctgtcacggtcacgccggaggcttcagtttggaccgaaatacttaattggattgtttttaagaattaaaaaactaaattaaaccattagatgaccatatcaaacttcaaaaattagaaaattaaaataataatttaaccaaaaaaatgatacaaagtaccaatacaaagacttttcctatattcatggtccttttttcctaaatatacttccctttattttcttgcctgcttctatcatcacatatatctttatacccataaataataacattgatacataattattattctgaaatgtatttttcaagaacaatattttgttttctacatttcaaatattgttcttctacatttcaaaattactttctagaacacaattttagtttttaacattctaaaaagtaatttttagaatacaaaaagtattcccaaaagtacttttctgaatgttaagaaaaacatgcaaaaatattcaaccagaacattgggtccattggaaaccctatatagaaaaaaataataaataatggagcaatgaattggagaaaacatatgcagcaatgtacgaccagattagtatcaatttggaaatttgaatattttttgtcaatggaatttggaagttttattttggaaaaagttttaatttgaatttgctgcataaaacttttcgcacttccaaattccattgacaaaaaatattcaaatttcattgtccaaagcacatacatataaacaattatgtttcgataaacttataatgtttgaaggaggaaaaaaattaagcatatctcaagagttaaaatcaaattatatacttaacttctataaattaaagatttttttttcaaaatttaaagtaggtaaattatttttaatttatgaaaaaaactcaatttattttttaattttttgaaagaaatttatttactttatcttataaatatttacagaaaactttatctaaacagggccacgcacattttctagtttggtaggaaaggcaaaccattctaccatacaaatctgttttattttacgttttagtaagtgtttttaagtgttaaaaatctttaattttgatatagtatttattagtgtaaatgttttatactgttaatcacttgaaatataacttttaaagtaattggatcagtttgtttaaatttaaaaaaaaaaaactttttgtaaaaacgtttatttaagaaatagatatgatttatttcttaaaaaatagaaaattggttagtttaaataatttttttaaataaacatattaaaaaattatttattttattattatttttaaaata

SEQ ID NO: 385 - DNA, 2300 bp, Glycine max
  Soy_ogl_321 Gm02:2217601..2219900 Cluster 1
tagattctttttttttttctttcggtctaaagaattaaggattatgccaactaaacacacttgcagaatatgcttgtctcgtatgctttgttaggtcatttaacgtctcaaccacaacttgattcattgagtgtggatccaagttaacgttcttcgtacaaagtcttaattaaggatcttaatcgtattaaaaaaaaataagagtcttattactactaattagtactgtatctagaaaaacgttgattatataatacccaaaaaaaatacgaaatttattatacctttttattgcaaattaaagcgtgttgaaatggtaataatatgcttctcgatcttcaaacggggaaccaggtgcattggctcactgatgattcttctccttattcaaacggaaatgttagttgggaatgatatttttttatcaattaggtattaggtgcataacttcagaaatattaaacatattacttttaattacttaaaaatgagtattaattaatttctatttcaatactatataataattaaatttttaataaaaatatttttttattttattaatcatttacattgtagtgcaaatgatagaaaaatcattattatataatgtccaaagctccgttttaaatttgaaacagggtttggatggattttttttttgtaatgaaaaattaaaatgattaaagaatatgtctaaaattcctctcaaatttcctacaaatttcatatggatatagaaaaacaagttgaaaaaaaatatataattttgttcgcattccttttgaaattcgtctgaattgtttttggtgccaggatcatgatgaaaatattcaaactaaataaaaacagatttgaagaacaactttttttaacatgtaatatgtctcaaaatcgtcctaagatatattttaaattttggtggttggctgaaaaatattttgttaaaaaattcggtctaaaatttccaattttgaatgatgttacaagtatatcaacagttgtaaatcatcgtacaacattttttttccttttttttttaaaaaaaacagattatttttcctaatactcatacatactatctttactctttcatatttgtttatttttttaaaataacttatagattaataaatattttcatttctattaaaattatcacttgttatctaacatgagctttttccaattttggcatttataataagtgttaaaatatgttaaattggatgaaaatatgggtataattgaaaatatagtaaataatattattttgaaatctataaaggacaagtaaatatgaacactttctttatttccatgaacacataattagaaacaaaaaacaaaacttttttattacaaagcaatggccactttattttttatgataaaaaaatgatttttttaagaatacataagagttgatttttttaaaaggaaaaaattaaaataatttatacaaatacataaagaacataaaatataaaaggcaaaaataacaaaatattttaaaaggaaaattatttttttaaaaataacaaattggccaatataaatataaaaggcaaaaacacaaaatttactcaatgctcgtttgcttacttttataagcaaaataatttttggatgaatcgaatgattaaaaagaagtaaaatatttttaaatacaaaaaatttatacataatactattacattcaaaagatgtgaaaggatgttaaaataaacttttaatttttaaaattttgtattatatttaatttgaataatggcggatccataatattttttagtggaaataatgaaataatttataatattttcatccataaaaaatataataagttttcaaaaaaaattaggaatggtccaaatttaaaagataaaattgataaaattaatattaaattatttttctatcgataaaattattacaaatttattttttctgcggactaaattaatactaatttattttttcttttataaccttttatattcatttataaaataattatcttatgagtcacacatatttttttatgatcaaccactaaatttcgtctgttattctttaaaaagattaattatttttttatatttttgaagttaatcaaaatgatcaatgtttgaaaagaaaaattgggcgaattctggcacgaaagacattcgcaagtctctcacattgggagagtaacttcgtgatcattaaatctttgttttttaattgatgaatgtgatttattctctgttttcccactttacccctttatttattctctattctcactgtttcat

SEQ ID NO: 386 - DNA, 3100 bp, Glycine max
  Soy_ogl_472 Gm02:10308501..10311600 Cluster 1
ataaaaaaaatcctaattagaactttttagttttctagtgatattttaaaatatctctacaatttaatttcttaggtccattacagaactaatccttagtcaaagttttagtgatatttaaagttcactgattctattcaaaggagtattatgtataaatttatattaatcaaactcatatttttcccaaaaaatttaatgtgtttagggttgtgcacaattcatatatatttttcaaaattcaaaaccggaattgatgaactttataaaaattattcaattaatcaaattattttataaaatggttcagtttgatttttttataggaacaatttattttttatagattaggtttagtttaattcaattattcactttacactcatatatagtccaattgttttttttttaaccaatattccgattgttttccaaaaactaaaggtgaccgaatcactttataataatggtttggttactgaaccatttttataaaatgattttgatttgattttggataggtcataagtttgatttgattgtacacccttatatgtgttgctaactaagttaaactcattaaattcttcaccttaatcaacgcagcataacatcatcttcaccagtacttttaaaggaaacaataaatctgaaattgtggaataacttattcatcttaaaagacaccatgacctcgccctcttccattcacttgctgctcaccactacctacttagccatcacaaattcataatcacgataaaccccaaaccaaattctcaaagaatgaaacaataccatgggtttctttgccataatattgaagtccttaataacaaatactacctcccattttatttataagaaatattataacttttttataaatagaatcaaattaagatagtatgttagaagaatataaattataaaaacccaaaacttaatatactactaggtacaaaaagttggttcatccatgattcaataatttacttgactaatttgattaatatatacaaattatataacttaagtatatacaagtgaacttaatatcatatattagtttaataatatataggagtcttttttatttatatgttactcaatttatttattcctatttaacatgagatttccttacatttttttttttacttattagttattacatttgttacttcaaaaatatttgaatttatttgtttgacaactaatttaatttgtatttctacctcctaaaatacacaactgttcagattatatatagcaaagcagaactcaaaaagagaaaagaaactttgtaggttttcacttgtgtggataaactcgaataattgtgacaaaagttcaaacatatagttgatagcatccaaaacaggaaaaacaacataaagccatcaaactttatacgcaccctctttactttttttcatcttttatgtgtgtgagccaagccaggtccggctaacgagaaatcgttaaaagccaacatttaattattatatcttgtatttatttaattatttatatgataggcaaatgtcacgttcagataattaacctacacatgtcacttaaatatatgagtcggggaatttagaaacacagagatatttcgttgttgccgtcaagtttgggtggccacaagttttaggcatatatggttgttaaatgttaagggacactttgtgtattggcattactcagtctagctagtggtccttaattaatctctccctttttatgatctgcttttctggttgttcattccttctcgatcttttataagaaagggcctgtttggtccctatttctatcggcatatcttggtttggcatcatcaagtcagaacaaataggggacatgagcttgccaattcagatgttgagaaaccaaacaagatacctaactcctagggtcgatttagtgatcaaaagttgagataatacgtatgaagtcataaccttattctgatcattatatatagtcaaataaacaaacaaataaataatataatatttaagagaaatgttaatgatactttctgctattttttttctaacattttatttataattgattgaaatctattaaaattaaaagttatcaattttgataggttttattttttatttaatgattatttctcttgatttgaaagagagatcatgaaaatttataatttttaataaattttaagtcaatcataaaaagaatgtaagggaaagagtgtgtgaaaatgtgttgttagcatttctctatgcctaatatttttctacctaaattcttttaggtaagttgacccaaaatgagattgagtatatataaccgtaaaacaaagtttaagttttaggtctatcaaaaaaaaattgttcttaatttttatataacaaaaatatcacgtatgaagaccaaaaattacatatattagcaaataggcccaacatatataactctgttgtttaaaagaaaataaattctcaaaaaacatacaaagagtttataatttcacctggtaatattttatcaagtatgtgcgtggcatatctttcgtaccatcaagagatcgtgaattttcgaattatttcaagtgacatttctaaccaaattaaaaaaaataaatcatataagagcataaaaaagataattatactaaaccggaactaaatcaaaagaaaccaaaccgttttgagaaaaaagcaaatcaaatccctctttaaaaacatataagcccaaactaaaaactaaattgcttttataaaatacttggttcaatttttgaaacaactgttttttttttcatagccctactcaaaaactataaattcctattaaaaatttaataacactactagaaactgcgaaataatttaatctattatttttacactagtttttttttaaaagaaaaaatgtgttggaatatactatttgttttactatattatacgaaccagaaatagcgtaagaatgatagcgccatttttacgtaagaatatctttttgtaactcattgaattatttcctgtctcagcctgtgcctagatgtccttatatatacaaactagggcttaggtatagagtggaattgaag

SEQ ID NO: 387 - DNA, 3545 bp, Glycine max
  Soy_ogl_497 Gm02:11628401..11631945 Cluster 1
cttagccgaataacttgaatgggggggcatgcgcacttaattggctgccctacacaaagtcaacagggcacacacttgatagattcataaaccttctcatggtattcagtaaaggagcaaggtggttggtgtttacgttagcattgaactcgaatcctttttaaagtgtaaaggtatactgtatgataaatgctattattatactttaaattaaacacactctttaatttgtatatattttctaaattatttactagaatttataaaaaaaaaatcactaatataaaataacataattaacaaataattttgtctcttagacatatgatttgaaattgatcacaaatccatacaaatggaagaatatcttttgaaattgatcgatcaattccttatgtagattttggcatctcaagagattagttattaagctcccctatggaaaaatatcccaagttcaccattgtttcattgggtggtatcactcaagctgattttgtagtatacatatttatgtattcatttatttatttctcatggtatcattcttcaaaagtaatcttgtttgaggtataatggtacattaaatttaaaccttgatttgtcatgtgaggatgatcatttatttatttctcatggtatcatccctcactagtaatatatatgatataagaagaatgctagtaataaattctctatcattaatcaaaatttattgataagtacaaaattatgaataaaatacatcaaatgagaagtgaaatttatatttttttatttatcgataaattttagtcattaataatgagtttattcaaaatggtgtgttgtaaatgaaattttctcataatacaatacattttacaaaatggagtttcataaaataataattacattaattttggtacaatgtacttataaataattatcacttttaaaattttgaaatatatcctatatattcatagaatctcatttcacacggattcctaccaattaagttcattaatcacaaggaaaacacttctgtcttagtcataagtagcacccacaataaacatgaaatatttcatattaacatgtctaacattgttgaaaaccagatttgactagagttgatatttttttcctaacatgtaaatagaaggaatgagaatggttttaaaagtatcaatactcaccctgaattcaaacttactcttacttctataatatttaatatataacaaaattaaaccataaaaccaagcatatatgtttatactaactaatagtatgatttgattcttaaatttcctactttttaaaaaatttattattcatttttaagtattatttaatttacaatgtacttgacataatttatttaaataaaaatatatgaaagttagggataggtttccttaatccttgccgatggaatagggtattgtattaatttttcgtctgaggatatggaggtaaatttgaagtcaattttgaagaggttatgcccaggcccggctcggctcagtactatatctatatttcttcattatcatcttattcatataaaatatttattaattttatcgatctctatttttttaaaaaaaaattgactgattattttagtaatttttttctaatctcatttttttaattcacgatacttaaatctgaaatattatttgaaaaattaaattcagtatcattggatctattatttattaatattgcatatgtagctattatatatatgaaaatattatttggtacgaaaattattttcgtactgttgcatgttgcacgaccgatgatttttgtcataaattcattcacgtgttattaaaatttgttaaaaattatttatttaagaaaagttctttggtccaccttgttattcatgcatttcgtaccttgtattctaaaaaatgaatgataagaatagaatataattctaaaagatttacttttaatataattaacttaattcctcatatatatatatataaaggatgcaaataaatattgttatatgaaataaaaaatttcataagttttatgtcacattgttatgggatgcaattcatttttttcagtaaaattaatatttttataagcttataacatattttgttggtctcgataaatataatatggcaatgaaagtgtctgtctagtcaccagtaccagtagatccaaaattcatgaacaattattaaaataaaaaagtctcatttatatgtaaatttaacacgaaacaattcaattaaccaatttaaatataccaaattaatttaaatatgcatacaagtgaattgatttaaaatttagaagttgcgacattaatatcaatgtattgttattattattaattaattcaaaattttaagttttcggtagttaatttaaatgttgataaattttttttagaaatattttaattttatgaaaaaattaaatataattttagttttaaaatattatctgttgttacttagtaattacaggacatacatctacttatatcatatgagagtaaatatgttgaggtgacatatgacataacgtgtttaaatgtacgtaacatcatcaatagtagataatagaaactatttttaaaaattttaaattttatgaaaattaaaattaatattttttaacagaaaactaaaaccaaatttatttaactatattataagtaaattaacaaattaaacaggactaaaacgctgacttatatatgttatatgtgagcaggaatcatgcattaatcgaagatcctaattccattcatgtcaagagaagaactgtatattgcataacacatatacaagatttacctataaactgaacacatgtcttcctttttggcaaaagcctaaaacacaaacttccccatgcatgcttgttggatgcgacacaatgatgtttcgttatattattgagatagacactataggattattactgtagttataattaaataagtaatagacacataaattaagagataataaatataattttatattaaaatataaaaaaattacactgttatttttttttattgagtttatggtttttttttctatttttataattgaaggacaaccttggttgtatttttttttatcattagtactttgtatttgtgttctaattatatttttcatccatatctgattttgttagataagtagtatttggtttcattcattccattataattgtgatgtaagaaaatttttatctcaaaataattatcattttaatttttttaatataatattaattatttttttcacttatattttttattaaattaatataagtcaataaaatctaaaaataaattagtgatgatataaaattatcattctctttcatctatttattattattattttatatataaagcaacctaggacacctattactttggagggaggcattactaacttctattaattctttggaaaaaaaaatctgtaaaatgagctgtcactattatttttaaagatgcgactaaaagtataattactttaaaatttaatgattta

SEQ ID NO: 388 - DNA, 2376 bp, Glycine max
  Soy_ogl_831 Gm03:3604401..3606776 Cluster 1
gaattggacatttttgtaattctatttaagtaataaaaataataatagggacattttaggtgtacgcatgtgttgaaaagaaatacattaaacacttagttttaaaaattttggtcctctattttttcaatcctatattttttttgttttttattttaaaataaaaatatttaatctttaatttttttaaatttatgattttcatcatttcatcgaattaaaaacgttggccgttaaaaaattaatgttataaaacatgaattaaacaaataatatcatattattaaatttggaccacatcaaattaataatctcttggttaacccttcaaatttgatagaagaactaaagttatagattttataaaattgaaaaactaaatatttctattttaaaaaaataataattttaaaataaaataaaaagacaaaatgtctcgtagtttaaaatagggaccaaaaattcagattttataaaataagaaaaccaacaatgtatggagaaatttattatcctacttaatttgaaaaagattttatataaaagattaaaaaataagtgtaaataaatatttgttttttatttttttgacataaaacacaaatattatctattaaagttaaatattatttgagcggagtatgattattatatattataaaatttttctttggagtatttaatacaaccgaatactttgaattcaaacatgaaattaatttgtaactaccgcaagctatttgatccatacatttggtaagtataaaataatttaatttgattatatgtaattttaaatataacatcaattatttggtattgataatgtaattgtgtatgactgaactttcaacgagacgaacactgacattcgtgaatcatgttttaaaaatgactcatgtttaaaatatttgaccaattatttgatcaactcatgttactgtcgtttctttccccaaaaaatacaatattcaacactttattaaataattaaaaaaactatcaaatacttttcaaaagagtccttaaaaaatttatattcatattctaatgttgatattttataaaaaaaaaatatattgatgtcatcataaaaaaaggggtatttcaaacactacggtttttaaattatcaccgaactgttattaataatctcacttaataagtgtttggtttacttttctttttaaaaaaatatttttaaattttaattaaacaaaacaaatatcttcgaaaaaaaaataaactaaacatattttatctacatatttgattctacgtctaacaatatttgattacaagctatatataccatagcttttgcgttattccatcaatttgacgtgaaaatatgacaatatgcacattttcaatgtacaaataaacacatgcatatttgaaaatgaataaatatattctaaattttccattgactggctaaactaaaaacaaagtctaaatatattctaaatttttaaatcaaacaaaaataagtactaaaagtttaacatgtcaagcaaagtttcgagtggaactaagtttaaattttttaaataaaattttgatttcaagttttatatatataaaaaaaaacatttcaaatttataacatggtgacaacaaataatggaaaagatctcactcctgggcgtctattatagattgagcttttgatcattaaattataacgcccaagtatgagtactacttatcataaaaaataaaaaataaaaaataaacatcaattttaaaaataataatttctatttatattacagttttaaatttatgagtttttcttaaagtaactacttacaaaatttattatttttttaaagataaaattctctcagaatatttaatacacttacatattaaaagttcaaacttaaaaatattcttggattcttaacccgaattcgaattcgagatcaatgattaaagtaaattataaaactggcaccttagtaaggtaagtggttaaaaattagtttacaacgtgtatttaagttttttggtgatttgatctctattatcaattatgtactttaataaaaaattagtaattaaattagttagttagcatgctagtaatgctcatttgtctagttgacaagaaatttatttttcatatatatacgaaaaatttaagactcataaatgtttagagtttaatagatagtactaataatacaaaattttactttgtcaaaaaatcagaaataacttttaatatgactattaaaacacttattatattgttgtttatgattacaggatagtgttaaatttcaccaaaaagagaggatagtgctaaaaaaaaacatttacactgtctacgtatgtattatttatttatgtttgaatctgttttca

SEQ ID NO: 389 - DNA, 2200 bp, Glycine max
  Soy_ogl_858 Gm03:5286601..5288800 Cluster 1
gtacctaaggaatttttgggttttaatggaaacagaatggggccaatattatgttccaaaatgtcagtgataaaatgcatcttatctgaaagtggcataataattaagacaaataaatgaatgtaaacaatgtctgagatcatcagatgcctccatgatcgcatgtcttcttagatgctagctataagtgcaaacaaaatggacagtcccattgaaacaagatatcgaatcatttgcatgcctctatgtatttccaatgttttgattcataaagcaagtttgtgtgtggtcaattaattgaaggtcctgctaaaacatgttctaaaagtattaattaaggacaatttaaattgttgtgttcattatttttaattatttaaaatgtagatattaaatattttttaatttaattaacttaaatatgtttttctaatatatctcttttccaatttatcatctaatttctttttattacctgacatgtcaaatatttttgaaagtgagatatatggtgaaatcattctcttacacaaagttatgtgaattttatcataatttttttcttggaaaatatttaactgtatatttcataattttgtttatagagagatcattgttgattatcttccgtttgaaattacttccttgatcaataggtagaataaaattttgtgacataatgagttaaatattcaatctttattactcaatttccaatgatcattgttgattatcttccgtttgaaattacttccttgatcaataggtagaataaaattttgtgacataatgagttaaatattcaatctttattactcaatttccaataatctaattattaatgagtttaataattatgtattgataatataaaataattttcaattgttatttaattaaaaaatacttttaaaataattattataaaaaaataaaaaatttattatacatagtgattttgaaggtccataaaagtcaacactctttaaggttcataaaagtccaaaaaaccattttatattctctgtacataactttttttccttttctcattgtgaattacttcaactcttattcctaattatttacctatcaatgtcaatctaatatattttatgatatacacatttaaagaatttataatgaaaatttgaattaataatatatataatcatttataaaaaaggaattttttattcttaatttaaatattaaattatataagtacgtaattatttcaaaataaatcactacaaaagatattcttgtctgagttaagactattattttgaacaataaaactaatttcctactattttatatagctagagtaactcatctcagttaatttatgtgctcatttagtattggtatatagacctctttaatggtagtataatttcagttgtctttgcatatatgaaccttttggtttccgttttttctttagggaattttgattgcctattagtatcttgtttgagattgaagcattatcgaatattaaatatgtgtacctctcaattaaaatttcagtcttaatttagttagtttatttgttagtgagaaattaatccttcactaaacttaatttttgattgtatgtatgcttttaattattttttttattttgtaatataaaaatctttctttataagtatttttgaaataaaattcaataaatatttatacattttggaaggagaaaatgtaaaactggataaaatggaaatgttaaaataaatgaaattaaaaatagatatgaatatcatgattgaatttcttcttttaaaaaagccaatagtgtattttagtcttctttgtagaaagcgatgcatatagttgattcactttcttattcataaagccatatcatttttttccacatataaaatttgttcttttctcttaacaaaatttgattctgtatttcatactctctcaacagagtcatgataacttcgttagtcatattcaatttgagattatgcatagatcagcggatagaataagattgtacgtgcaacatatttaataatcagtaaaatactgtttttattcctcctaaatttcttttaatctaattcttaactatttttaatttaatttctaattccaatctaatatatttcattactataaatatttaaagattttaaaataaaacacccaattcataatatagtacataaatattcat

SEQ ID NO: 390 - DNA, 2000 bp, Glycine max
  Soy_ogl_1217 Gm04:4254101..4256100 Cluster 1
ttttgttggggatacttcacagcaagaaccatgatctatctcactgaacgactttctccgtttacaagaatcactggacatattattattgttatctaaaaagataatatttttttaaacatatgcttaatcagtcacaaaaaattgtagtactgttgatttgaaaagttttgaaccgatatgaaattgtagaccaagttcagacaatatataagagttttgaattccaacacccatcttaaaaaattagatgaaaactaatctttcacctcctccctcagtaaggactcgaaaattagtccccactctactcaatcccttacacatgcaaatataggatcaattatgtttaaacttaaaaaaataattttaaaataaatattttttataactattttttaataagtacataagatttatttattgaaaaaataaaaaatcatttataccttcgatattattctccaataataaattatgcattaaatatatataaaatcaaatactacttaaatgtattctcatttatatataccttcgatattattctccaataataaattgagtatcatctcgctaatatgcataataaaagttttcatattaacattgattatcaagatgaaattttaattctaaacagaacaacacaaaaagtacttacgaaattgcatgagttttgtctttcttttattgtggttggtaatattataattgttaataatttgtaaaaaaagactcaaaatcatccctatgtcagttaatgtaattagttatattgacagttttgttcctatagaggcttaccatttctctttccacctaattaattaatatggtagtcatccttccagattctcataaaagagagaataagtaattgattttattaacttatataattttttatagcattttttatttattgactacaatacttgcaaaataattaaggatattttgataaaaaataattaatacaaaagataatgaaaaaaaaagtctcgtaaagagactaaatgttttctcaagaaagccttatatattgaaatgaatgtaataatatatacatataaatgtgaagagcttaaaaaaaaagtaagaaaccaaagaaagacataactctagcttaaaaaatttatcagaaattatattagattaaagttttaaattatttattataaacatcaataaactaatatgataaattataattaaatgataatatatactaacaacttgttggtcaaagagaaattaaactcaaatctgttaagaaatattttaggttcgagtgttgtaattagatgacaaaaacataattgaaagaaatatttcactaaaaatgattaaaatttatcaaaaattataaaattataaaaagatttattaaacaagttacacttaccaaaatttatgattttaaataagttttaatcgattaaaaaaatgtactattagccttttctaaatttaaaatgagtatttatatctctaaataatccctatcattattgtttttatatgaggagaaaacttgattctaaccctttgaattcggtcaaattgagtttattttttggtcatgtttattcatagggaaatgcttttaacaactgttagagatgcggtatagagacacatgcaccatatagtggtccactttttacctttgtattgtgatacgaaagagaaaaatatataaaaatagacacagtataaaaacgattttaatgttatacggctaatttatcataatttaacctgctagtatgatttttaaagtagtcattgtatctcttaaaaaaatattattataaaaatcaataaatttataatactaattatttgtaattagatgatacaaatcagtatataacttatttttgttctctatgccctttttacggtaacaatacatgaacacttaattactttctatctctaattataatttttaaattaattcatgtgccttaaaaaaattaattttgttaatt

SEQ ID NO: 391 - DNA, 2600 bp, Glycine max
  Soy_ogl_1977 Gm06:15983201..15985800 Cluster 1
tatgactaaagtgcaaccccaataaataaaaatctctcttatattttaataaaaaaacaaaatttgtcctccttaatatttagctcatcacccattatttaaacacttgttattcatttacaataacccaaagctcttctttttactcttttatattactagtgttgtatatttgtatgcagtaaacccaattccttttttgtgcaaccatttctactttccaatttaatcaatcatagatagaatttttcagtaaccatttaaataagaatggctctttattggtactggacaatgaaacccatttgactattcttatcttatctatttgatgattgaagcaaagaccttacattatatacactagacatattgtcactcgtaagttgtgatttatctataacaaaatgaccttaaaaaaaggaattgttagaaaaataaaataaattgaacaaattttaattatatgaattgtattatgcatttgattcatgttacaaatttcaacagtctcattttctaaaagttgaattttattaaacttcttattcttgaatatcattttattatcatctattggttctctttagactaaaaatatttaatactattatattgtgacttactatattttttcatgtgatttttttttatgttcatgtgtttgaaaaaatccagttaaattgtagaagtatgacaacttaaaaaaaactttcttcaatattttttagtaaatgtatgaatataatccttgttgattttatttgtcatgtaataaagttttccccctaacgtttttttctggttccgttttactatcaacaccaactccttattaggttcatatactacaatattcgggccatgattcaacataacttgtgaagttatcttaatagactggattttgtgtggttgggtagtggtatacattttggtgataccaatgacaaataataaatttaagacatttatattctgcatctccattattacattggacacctttcattatattttggaaagtgtattctaaaatgtaaatttgtattttaaaatgaactttttaaaatataaggggtgtacatctgggaattcaccaaatagttgcaagattgtgcatgactgcatgttacgtacctgccagtgccgatggccgaagaaagcgttttcggcagattaagaatgtagtctgtagtcaactagtcatgcttgcttgtaactatttagcccattgttcagacttaattgctgtcatatactaaacaaatactattgattgaagcccagtgttaagtcttaaatgagatccctcgtttttttaccattagagggtattttttttttcaaaattattaaattggtgtactttttgaattaattcccccatttaggataaattgtaaaagtggttacaattttatacacaaaaattctaaatctttatatgacttttacaccgaagtagtaaaagtaattatgattttataaaaagtctataaagatttatgacttatttttaaatgagaattaattaaaaaaagtgtcccatttgataatttcttaaaaaattactccctccttggatcctaaacaatacctcggcccgaattgtgatcctgctatctccttttttgaaatcccttttctgccgttactaagttaggcatggttcattaactttaaaaaaataagtttatgctgatttttttttttattcttttacaatgatcatattatgatatcatgcatactactctaaccctccaccattaagttgattctagtggattttttttttttttttaaaagtttgcaccacagaattctaacgtttctcaccttttatttgggcttggcctatcaggttagaggaaaacctcatttggcacatgattaatttatttagaggaaatattacttgatgttgatcttatgtttttttttttatatgaagataatgttttatgtgaaatattcttatctttttggagaggtcgtttactaatcgttttccttaaaaaattctaagataataaatgaatgaacttgtttaaagaatatttgagaaaatgtgtagagtttattaacttgtatgatgttcatatcagatatataattttctccattgttaataactcattatctttgaacataattgatattttgttttcaataattaaactgatgttattctagtaggagtttgttggaattttgtggattaacattaattgtataattattggatttttttgttattaatatcaattatataaatattttttgtggtattctaattgattaattatttggttttattatttgaatgtgcctatcataggatgggcaccaaatgaacggtcattgctcttgtttgatttttttatagatgaatcaatctcgtttgatggttaaaaattatagcctcattagacagttattgacacacacatgtgagaaattctacccgcaggataaagggaaactctccctcattttcttgctcataattttggatcgaagtgataatcatgaaattaaggttctctttaatgttagatcaactttatggacatgaattaagagctttttaaagt

SEQ ID NO: 392 - DNA, 1255 bp, Glycine max
  Soy_ogl_2276 Gm07:8129366..8130620 Cluster 1
gcaggaccggcttaaggtccaagtagtccaagcaagagttttaggtctcaaattttttttagtactaatatacctcaaaaaaattattgtaaaattatatttgaaaatgaattttaattaaaatattataagtatctgttaattttttttattggtatcgtaagtaacaattaatgagtaacaactctttaccaatatcataattttatttaaaaaaaagatttaataattaatagctaaaaaaatctaaaagtttttctctttattgtctattgaaaaagaaatgttaaatgaaattaattatgacaatttaatcgataattttgcatcacaaaaagtctgaaaaattaatcttaaataaaataatgataattttaataaactattttatgagtaaataaaagacctcattcttaaatttgttttaggtctttcaagtccttgagtcgcccctatatatatgaaatatacaataaaaataattttcctttttgaatgaagatcaaattcgcaaccaaaattagttttattgtatagttaattgacataggaacgtcatgcaatatataatacatttttgttatgtaaattaattaaatacacaataaaaaccagcgaaaattaattttcattgtgtatttagtctccatacaaaaaagaaaacttgattctattgtatatttcctagcctccacatccagcataaatatatttttgtagtttagtcatatacaacaaaaacttatttctaaaaaaatatattttgtaaataaaaaataaaaccaaaaaaatagatcgcctcccatcataaccacttcgagtgggtcatcacattttagatagtaaagctagtgtcataaattcagtttggataattttttctattaatatttataaaaataaaaataaaataaatttatcttataaattaaaattaacttatgtatgtatgtatatataagtttaaataaaaattttgaagaagctaaatcacatacacctatacacctttttgttagcttctccaaaaacaacttattttaatttatagtacatcgtaaactaatttcaattttaaaaaaaaatcattttatgtttttatttattttcttataaacaagcttatccaacaaaatagtgcagcagattagctagtaacttttgaaaggtactaaactgaaatacatttaaggaaccacacactgtaccagtttaaatagtgcatacgcatgggttgaccacatttgagatagtt

SEQ ID NO: 393 - DNA, 2900 bp, Glycine max
  Soy_ogl_2379 Gm07:35596401..35599300 Cluster 1
aatatttgaatgaaaaattttatatcttatccgtctctatatggactgtttcctgttagacaaaaatactagaattgattgaaccatgtagtcagattaaaccaattaaatttgtaaaaaaatatttttaattaaatgcttttttataagtaagtataattaaattatgtgataatttttaaatatataagacaaaaaaaatgatatgatacattttaaatacaaatataaacctacctataaatttggtttggattgcattgaattgattttcaaaatcaaatccaaaataagatcccatccaatagattctttttttatttgattgtcagtttattcagtatttcatactttggatcaattttttttattgaatttattgaactatatctgtttataaataaccttaaatatgcatttacattttagataaagagactttatctattgttttgaccccagtccaaaaatgtgaggatcgatcctgcttttcattaggttgatctttggggttgaaatataaatttatattaaagatttttattcagttaattcaaatcagtaactaaacatgtaatatttatctagtttttttttaaataactatctaatccacagttttgttatttagttttttattgttatatttttttaatttctgaatgatgcatgaaatattttaccatcaagttattggttgaagtgaaatctaacttactccccttaattaaagtcttcagtttcctgatatcctaaaaaagaatgtgtccaacttgaaaaattgtgaagagtctaaaatttattttgtccttaattaggacagcatagcatcaccttcatatatagctaaaagatgcaacaaatccaaaattttgaaaaatatttcatcatcatatccctctaccaatttagattaaagaacaaaaagcttctggacagtgatgttttgctttgcctaatggcgtttattgattgagttcgacgttaatgatcacttcatgaacaatagttgttttgtttatgctatagtctttgtttttcactcagcactagcgaaaataaattttatcatcatttctcatcattattaattacttactgtctctctctgttctatgtttgttggattttttttataaataaataattatcggaaacgaaataatcctttaatttttttaagtctccttttattttacttgtacaaaaaagattaggataagaacgaaaaataaaagtattttcttttttcttttttgttctatattcatatttatggagataaaatttcatgtggaatatagtgtagtatttataataatttacctgttaaactaatcgagttagtttcctttgactttttgtttgttggatgaatatataaaataaaattccttgatgatcttgctcggaaaaagcttagtattggattcaccttgattggtaatttgcctgagtgcttataaaatggtttttttgaaatcaatcttggttaaaactaattttgaagtgatatatcatttatgttttgttagtagtaaaattcaatattttatccaacaatgcaaaagttgtcaaacatattgcttcaacttaaaatccaattactttgttcgaatcctagtacatagttgtcttaaatacttgaagggagagttttgctgtcaataatggtaatctgatttggaaattaaggattgcctcaagtggaagatacatgtgataaaaaaaaaaaaaacttaaaatctaattatatattcatatacagcatgacattaactggaatgacaagcaaaattttacaagacaggcgtactggatgaataaatgaaattccttgtcgatcttgcttgggaaaagcttagtattggattcactgtgactggtaatgttcaattgaaaggctgagaaagaaagaggtgtgatatgaatgatctggatgtaataagaaccggaaattagcgctggacaccatccataggagaaattaattttaaataggagactacagaaatttaattcattctatcccaattatttaatcctagattgataccggtgctttgtggaatttgtgtaatgtgttcattatctgttctataattgtacctgaaacatgttaatgttatatgatggaatggtagatatgtggaaaattcttttctaattctgtttatttttatgcagccaaggaggtttttagctcatgttaatgtataactactgttgcaattagatatggagctctgataagacgtgtgtggatctttaattcaggctatgatgaattgtgacaactgtgtttttcgtggaagcttttctttgttgaatggagcttaattccaggatgaaatttagaaggctaatatcccaaaacctagatgtgggataatgattctgttttggtgctgctcagattttgacatattcaaaatgatgttttaaggttctgatatgtggttctgaggatctaataagtatgttttattttacaaactttactggttttgctcataagagggagttttataaaatctttggtgtgctttctcttgagatgatggtcttcagcttgtgtcagtgctatatgtgctttcttaatttactcttttttttttactctgaaatttgttgaagagataaatttgttcatacttaaccattgtaagctaaaatgatattctttaatttcaaaatttaaatttaaatatctttaaaacaatatcatattaaagattattatctttttttaaagaaattttttaaagatccaaacatcttgtttattttatttttttgaaaaaaaatctctcttatccaccattttgttgatttttaaagattttttatgactcatggaatacttgttgatatattcttatctagttttatgttacaaa

SEQ ID NO: 394 - DNA, 2559 bp, Glycine max
  Soy_ogl_2540 Gm08:7367584..7370142 Cluster 1
taatttaagttttatacattttaattttaaaattgtgcattttgttagaaatgatatatatcaacaaattagattgacttgaccttatttaatttaatatgctattaggttttgattaaatcagaatcgaatttaaataaataaatctttcaaaattttagattaaaacagataaactcatcttttataaacattcctaattattgctgggttttttttctccatttccatattaagtatatccatgtgtatgttagtttgagaggcagtgagagagatggactgacgaactggctgatgtaaataattttgatgtaaataatttagtacatttatttttgctatctcgcttgtaaagataaaactaatttcagatatttgcaattgcatattttttatccgtataaattaaatatagtgtcatcaatttttaacattcacaatccgcaattgcatatatataacaatatacacccatttttatttccatatatttgcaattgtgcaatacaccttgtgctgtgggttgatctctatttaggaataaaattattatatataaaaaaataatataactaattagggagtgaggagatagcaatagccttccattacttttactaaattcagattattagtacgtattgtctctttagaataacataacttcacgtgttgccaacttagtatagaatcttgttatcaacttattaaaaattgctacaatgatgtttacccaagaaattgtgatgatgacttgaaccttttaacttcattattctttttttcctatgtcaaccatatataggaagttaactgaggccaatttagatgttggtatttatatacttccttatatgcacgttcaattgcatttctcaattgattgaatttaatttattgagttgtgaattgaaacgttgggagcagggagagtggccattctagccttgtccacttccaatggttgataggctgaaattaactttaatattgccttctaaggataataaaaaaaagtgtccgatccgctagttaatgcagaactttgcaaatattatatttgcgcttggatttgggggcatggacgaaataccaaggattatattaaccaaaaacaatgtccaaaagttgcgccccgtttctggtcggtcaaataatattatttttataatcattaagtgccttgtcccaccattttggtcatacatacaaaaacaaacaaaaatttgttatagggtttaagataattaactggtataaaataataagatataccaaggaaattggttttccaagtttaatttgtctggttctttccaaataattattgtgaataaattttagaggtaaaaatgagagtatgaaccatattaaataaacttaaggccgtagatataagaatgataatttaaatcttgttaataaaataaatgatatagagataagaataagggtccaaatcatgttaaataaagttgtaatttttttttcatttatactattatttattgttattaattgtctgatttttcatctttataagtaataaaggtatgagtgtgtttttttttcataaaatttaaactattaaatatctttataagtaataaaggtatgagtgtggaaccatctttctcatgcgtgtcataatccactatggaatgttctagaggcttcccctgcagcaaagaaaattgaaagcctctgtttcacatttaataagttgttatagttcttccactttgacaaatgatagagattatacaaaatgacacatacttcgagtcgatcaatagatttattgaagagtcaactgccacgggcaaagtaattacttagaaccgaaatgggtaattactaatgtgaacttttttttttctctccgactaatgtgaacatttttacattataatttttttattaatatctatgtattttctaaattatatcatttatcacaagtttctgtcttttcttttcttgtctttaattaaatatcgactagtatataatagtgtccaatacatcattttccaacctatattcttggggacggttcaagatcggaacgcactgtagatgcatgaaaaccttgtggaaggggcaattaatcaaatctaaaagattcgaggatatacttgagaggaaaaagaaaggaactaaacaatgaaggaataggaatagaactcatccataagtgaaaatattttgagctattatttttaaagaaaatattttggcttaatttccaaaatatagtattaaagctaatcaaacataatttcattattactatttttttatcttcattcaaaaaaaaaaaaaaaagaagagagaatacccgaagtaaacggtctagggtgttcaagtaacgttttgaattcagcccattggtatttcacttcatgcatgcaaacgtttattgattttttttcccaaacatacataaaaaataattaaataacaaaacatatgcatctcccattatttaacaaaacatacacatctcgttttatttttttttatttttaagaaaaaataattttttttaaaaga

SEQ ID NO: 395 - DNA, 3143 bp, Glycine max
  Soy_ogl_2636 Gm08:12630101..12633243 Cluster 1
ttattttttttccttttccctttctttttctttcatttttatgcatgtaaacaaagttttatttttcaattaagatacaacgatagtaagccttctaaaataggcaaaaaagtctaataacataaaagtttatgaaatatgtaagataattaacccaacttcccaacctccatatgtaagataattaacagccaatagatccaatattaatatgttaaaatattgaaataaactattgagaaattttagaatgtaaaaatgtttttattaattttatattggtcgtgattttataactacgtattaagttcggtactctctctctctctccatggagatcttattaaacctaacgaggaaaataaaaatagagctataaatcaactgttccacagcatacattttggtaaagatctttactagtaggcattactattaattgaaaatgtacgtgaactaaaaggagtatctcgaattagaatatcaagtcaaagcaataaatacgaatgataataatagagacatttcaatgtcaatatactataaacacagaatataatcagatataacgattttcaccgaatgtggcatcatataaatctttagtatacaaattccttgtctgaagtcaatgtgtatcaaaccaaaatagttccatacatgaatgtcaatgaattaaggattgaaaaagaaaaaatggattcacatgtatgccgtgaaaagtcagccatattaataagaatagtaaacgagcataataaaaatttcagccttttcacattattacatgaaaaaaataatgtaggaaattaatatacgtacagaaatagtagtgatggggtacaacaagttggaatttgcttgaacaaaacaaggcaacgccgttacttatgcccattatatgaccaaaaaagaatgtgtgagagagatagaggcaatggcatatagcctgagctggccagcacccacatctaggtttttggaaggtagaatttggctttttgtttttggagggtgacacacacacacactctaatttatactcatatttaattatttttaaaaaaacagtatattagtaagttataacacaaatatttgtgagatagatttgctaaattatacctacttatttgttttagaatgaatattttagcaaattaaaatttcaattttcttaatatatatttatatatatataataaaaaaaattctaaattactaatcaattggaaatttggacatgtatcacttttacgtgtaaaacttaataaacttattatacataaaaatttataattaaataataacgtaaaaattttgtatattgttagtgggtggaatattttctctctatatattttttattctttttactttaattcaccgcttaattttattcttatttaaaatattcttttgattaaaagttacaatcatttaagttaactccctacatatataacatataaactaaaatatgaaataaataaaataaaaataaattaaatttattttattttattcactcaaaatatctttaaatatgatgacataatttgtttgatgaattttttttaataatgtttacttaagaaaaattcttccatttataaaaatattgtatgtgtatgattttataattaaaataaaaaaattaattagttaaaaagaaaaaaaaaagagggaatgtaatgtctttcctctcttttttgttttacattgtatttatctataactctatatagaggcagtatcaactaatgcacaatgtttcgttttttttaattttatataaataaaataaataattattttctctcttcctctttatatcattttttattttattttattcatgttaaaaatattttaaaaatattttttatttttagttcccattttattgtcaaaattatacttaatattttataaataaaaagttaagtttaaattttataatgtgttcattaaatgcatttttatttatttattagacatgttattaaacttctctcatcattaataaaattttggcaccatatagtaggtattttttattttataaaatataaataattaaaataaaatatttttgcttcattttatttttactatgtcttcccaatttttcatatgacatacaatgatataaataattgaattttatttttttgaaaaattaaataatggtaaatttaaaaataatatgaacggagcgagagaattcatatttaagagtaacctttccaatacacaaaaggatatattagactaacttaagactttttcactattaaatacaaagttaagcagtaataaatatgaacagacatattaaaacattaaagaaaaaaatacagtatagttttagttcttattttttcaatacatgtaactaaggcccttgtacttttatattaatgaatttggattttaaactttaaaaaaatataaatttggtttctttgaaatttaaaaaatatgatgaattcaacataaaaaaaaatatgatgaatttttaaataagagagtctatataattaaattcacatgtttttaaaagtttaaagaccaaatttattaatataaattaaaaatatagaaaccttaaacacgtttaactgtaaatatagaaactaaaaataaatttttctcgaatatcaatggcttcattcttaaaatttgtatgtataatttcttcgcatatttatgggtaattatagtttttctctattaccggctgtgacgacgggctgcgttcaaagacaagtagggtgtatttaatggtgcaagactatcatactcattctacagtgagagatagcctctgaagttaattggtttaaagtcaaaggaattaatcaccgaaatcattgttatttttcatttttcactagtaaattctttgattcaacagaaagaatgaataagataaagagaaacgcttattttattttatttatttattagcggttaaagagaaatgttatcaacactatatttgtttcttttttataaaaaaaacaattacagttttttttctcctaatcatttttaaaatttttaattttgatcctcttaatttttagttataacatttagtctcctaattttataaatttgtgattttgatccccttc

SEQ ID NO: 396 - DNA, 2400 bp, Glycine max
  Soy_ogl_2662 Gm08:13531801..13534200 Cluster 1
tttcttttacctcttctaacaagggattaagatgcgtgaacttgcaagtaaccttttattttttatgatatttttgtcttccttttatgtagcttaacttggtccttaaccgacattgttgggtgtagtatctacccatgtctttattttatgtgctttagatttttctgttgacaccttgtgagatcttgatacgagctttataagcagagacagggatttgaatatatgtcattacgtacgaccaaggaaagaaaactagattcagatagtaacttccaagtaaaaagaaatagctgagaagacatgcactaagcaccaattagaaagaaaagttcgacgacaaacaaagatatgtatgcctggtgaaataattgatatgaactgacttttggaggcaaataatgtcatcacgagtattcacaacatttggcactaattgtattttttttttgtcagaaaaaaaaagtatataaatgcgtaggcacaaagggtgtccaaatcccatttacaattttttttttcatcagcaatcccatttacaagtgaagtataactggaaccccagtacatgttacctcatcatttgcactaattatattgtataatttataaatggaatactagttttaatttcaatggtaattaacgttaactaccaaagtagagatcgactaacaaaccaaaggatttatatatacgtgcgttagtgaagaaaattgccaagaacacaggaacataacggctaatcctcaaaaaatgatcatttgatttttttttcccataaatgtaatacatatgtcaaatataccaaaaaaaaaatgttgctgttcctgtttcttctggagctggtgtggcctgtttgttactggcatgagtgatttgaataactagatgctttgagctccatactacaaaatagagaaaaatacgcttgaaattttgaaccccagaactgagtttgtcttatgcgttctagggttttacattagattaccctccatcattatgactttttattatacggaaatcaaacttttaacatagatattgtatgaaaatttaaactgatataattctgctgataaaaaaaaactatgaaataattatctccatagaaaaaactgatatatattactaatatattaagcatgttaaatataatgtatagcattattgtcatatatctaaaaataattgtatattaattatttgattttaataaaaaattatattaattaacaaaagtgattcgaacatttaacatttttgtccttaaataaatatttaattacctaatgaaaagtttattcattattttcttcttcgttttgagttaacgtggataaaatctttctaatcagtgaggtgcagcccaccatgaattttggccattcattgactattttaatttttaacttataagcctatgaggcagcttcacaatatctatattgatatcgaaactatatatcatatccagccaaatcatcgactaatcgactccctagtgatgtgcacgtgctattagacacttgcacgccagcgcacatgttgagcataacattggttaccatcaaggaaaagggtaaaagaaaaaagtattagcaaaatttatatatatatatatgtgtgtgtgtgtgagagagagagagaagtaagaaattacaacaatgatttatttatacattcaaaattcatcacatcatatacttatatcattgaattcaacattcaagggattacgtgtaaatggctgaatgcccatctattgcttaattttcttttcaggctattaattgatgacacaacacaccttaatattgcttaattttcttttcaggctattaattgatgacacaacacaccttaaagttttagagagaactttatattttatgtttattaaaaaaagtgacttcacttttgttttgtattttttataatctgctttaaaactctctaattattaatgacttcaaaatttccatttttgttttaatatattttaaatcctcaataaatgtacaaactctcaaatatttattttaattttcatttttttatcttaatattttttataaataaaatcacaatggtttatactttttcaaatcttaaaaattattagtaaatttttttaacataatattaatttgaaatgttcattaacaatttttattaaaaaaaaatctgactaatcatatttaatatgatcttttcttttaattatattttttctttgataatgttcaaatctaagatataattacataaggggaataaattcaatttcacccacatcaataacttatttatgcttaaaataatattaaggcttaattatgtttttaccccctttaggaatttatcttttttagtctctcaaataaaaatttg

SEQ ID NO: 397 - DNA, 2104 bp, Glycine max
  Soy_ogl_3029 Gm09:6021301..6023404 Cluster 1
aagttctcttaattcttagcgcatattcgttacaataaatttaaaatataaatactatatttatataataaaaaatttaatatttcctcttcaaatttattggaagggaacactcttcatattgaattttttttctgccataatagatctttttattgacttgacacttgattgggatcatttttaccacataatttttttattaatttgaatccaaaaaaaaataggtgagtatgaattgaaaaatattatcttaattttggaaacaaatttagatatgatgttgattatcttcatttattttcaccataaaaaggtattgagagaagtgttaaaaagaaaaaaaagaaattgatactctaataaaaatattaaactatatataaatagaatatattaccttcatatcttaaaatatatgagtcttttaactttcataacgatatgaaagttgattatgattgaacttatttggatataaagatagaaatgcattttaaaggtttttctataggaaaaagttctataaaagctcttaaaaacacttatgacttgtattcaaataagtcctaatttatttaataacattaaattaatttgttaataattttatcaaaattattcttaaaattattgagacacatcatctcactcttttcatcaattactttctacctaattaattagtcatctttttcaatcctcataatagagagaataaatttatcttattagtagtaatttatagcatttatcataaagtaattagagcatctacaatggataattgtttagatgggttgttatcataattatgtggaccttacaatttcacataaatttaaattctttacataaaattcattataatgttaaggttattgaaatgagtggttaatttaattttgtgagtcctataatacttaaaaaatattctatttatgtataaatttgttaagtaatggttgcttatataagcaactatgcttatataagtaacactatgtcatttgctctagtgaaaaataaaaagattaagcaatctacttaaaaattaaacaactcatgtaagcactcttattggatatgcttttaaagcatctataatacataattgcttatcataactttgtgggtctttcaatgtcatataaatttaagtattttttaaaattttactctaatactaagattacgaaaatgagtacttaaattaattttgtggatcttatgatgcttgaaagtctcttatttatgatataatattattaagcaacaattacttatataaataacaatacttatataagcaagcaatttcatatcataagctccagtgaaagaaaaaaaaaacttaaacaacgttacttaaaattaaacaactcatgtaagcattttattggagatgttcttaagagtattttagtaaaaaataattaatgaaaaagacaactaaaaaaaatcttataaattggtaaaaaaatatcttataaaaaaagataaataaatttttaaaaagtcttatatttaagaacaaaaatagtatttttttaagtgtatgtattatatataaaatattattaataaattgcaatagttatacagtagctacctttgaaagaatattttcagaattaaaattactaaactcttatttaaaataaaaaattgttacatgataaatttaataaattaactatagagtaaaatgttagtattatttactatatacaattgttttaaacaaaatttactataaacaattatttatatgagcaatctgtataattacaatttttcattttgacgacatggaatgttttcaattcaatgaatttaaacccattacatcttgtacatacatacatacatttatatcatgctatattataatttaaacaagcaacacgtggctacgtgttaatgatgcatgttgaacactagcatcacgtgggttgattttctaccaaagaaactaaatctcatagccgccacgaagatggatctatctatgcaaaaatgatctaaaaaagatggttcaaggcatggcaacgacggtatattcttcttaaaataacgtttatttgttactgtaaaaaaatga

SEQ ID NO: 398 - DNA, 4684 bp, Glycine max
  Soy_ogl_4210 Gm13:22858017..22862700 Cluster 1
taatgactacttataagaaaagaaaataagaagataaaacaaattgaacttttataagttaaagctataatcattttttaaagaaggtaaatgaaagagtttttataaattaacctaactttatttgtatataattattgagtacggataaaaatatatatatacttatttagaagtatctaaacaggacccaactgcctttcaacttcaattcatttctataaatattcacaacgcattttctgtctatatatatatatatattattagagctcaatttcaatctcatatatattcccattcttttcaggcatttaatcattgtaaataataataataataattaaattttttaattttaattttaagagatatatatggcctagtgcaaaaaaaaaaggtttctatttaaaacggatactttatataattccagatggagtattagcagatatatccattccatcactgtgaattagaactataaaaaatttaaactataagtaaatcgagtcaattgaaatctatcttccaaataaagcaatatcttgaatagcttgatgtcatttaaaacttttaaaccgcacttgtaaggaattgaacttgtatatattacagtaaaatgtaagagaaatgtatataaatttatgaatttattgataatgttaggcgtaggattgtctgaactctggcgttttgatttggatgaaaataaacatattatgaaaagttgataatgtttatagtatgcatatgcaacatccttaaagcaaaagatagacaaaacaaagttaaatatataaattgtctgtgtgccatgtggttgagcaagcatttaagatggatagaggtgttaataaactgattcaattcagtggaaatcatcaaaattgaataaaaaaaataaaaatagaaaaccaataaaatgtctgtgtattattttttttcatctagatttgaaaatcagtctaatctaattaaaactaaatacataatctcattaataaaattctcattaataaaattctcattaattcatacttatataaataaaatttataaaattattacacaaatttatttatttcataattacattattttaattaaatctcattacattgtgcatttatttatatgttttctaaataaatataaattgcatattgactaatatttataatttaaatgtgatagttaacacgttacattgacctttattatcattattgtatacttttaggtagtattcgacctacttctatttatttttagtttttattcttttctaaaggaaaaatgatggctcaaacttttttatgaaaggtttttaaagatttagacaggttatttttctaaaagaaaagaaaaataagtatcttttttgaagaaaaaaattatttttctcttattttctctccttactattcagtgtctccctgttttctctctctcaaacactctcgtaacaggtattattcaaacactaccaataagtcgattttaatgattacattatgtgataaatgaaaattaaaaaaatacattatttttagagttcttattttaaatttttaacttaaattacattataaacacctatagtataatgtaactataggaagatatataactaataatagctattattttaaataatagacagttgtaaacttgaatcagttttgtgcacttctaaggcatacagatacactttgaatggagtagatgcgagagatgagaaggaaatttttttatacttgatgtgaagggaaggttatcctccctgaaaattttgtttatatatagaagtttcaaaagatttttaaatttccaggattattaaaaattttaaatatgtaaaaaaaaaaaagaatttgttgctaaatatcttattttcttttatccttcttgttttatgttttgttgacttttctaacacatacatcacatgatgtaacttataaaattgatataatgatataagattttgttatatttacatttaaaattaatttatttaattttgtgtaaaaaaacataaattaataattatacatattacaaataaaattaatctcaattcaattgattgaaagaaaacactgtaatcttgaaactcataaaaaaatacctccacgatggtctatatcaactttgaaatgtgataatagcatctcatttctggtttgggtagtacatcgtacggataaactacaagacacaccctctcctttataatattatcgaatatatggatgcactcttattataggtgataactgatacgttgatatctgttatgatgcaccacgtgtgcactacccacctttaaaattgagtttaatatacaagcttttgtcgagtaataatgcacatttccatattctacttaagtgggggagtagaatatgttttccaagatctagttgcatcccccttttctcaataattgcattaaagaaatggtcttatatcatcatcatgctttgtttcttctttcgtctcatcaacaatgccagatagtgaaaagtgtagctcctaatgagacgccacttgttctctctcccatccttaaagaaatggtcttatacgtttttccatttatatacaactattaactattaaggatgtgttgcagaaatatttttaaatttaataattacacacttaaaataattataaattatcatttaaagaatttattatataagttaacaaattttatgggttgtaattggatcagagtgtaaatatttttttaatgttagtgactaagtgcataacctattttctcatattttaaaataataagcaatgtaagaaaataaatatatcaaagatgtgttaatatgtaataatatgtgttattttatgaaaataaactaaaaaaaatcaaattacttaaaaaaagactttcaaagacagagatggttagtggcttgtttttttttttaataataaataaatacttcaattggatgataagttatagcattttagggaaaggacataattcgagtaacttacagtatatgaaaatatcacttatcaatgaatgtccactccacgtgcaaaaatcaaataaagactttctgccgacatcaagttaagccggttgcattttgcataagcaactaatgacttttttttttctttttaaactagaagaaagtttagacgaggaaaaggttcggttctatgccatggaatttacgacgacgagattaaaaaaaagttaatgttgtttatccaataactcataatatttttacctttaaaaaaactcataatattttatataataatgtttttatgtttattttttcatcacattatttattttattttatatttctctgtcctctctctctctctttttttatcggcgaaaaaacatatattaatattatcgggtataagagataccccaacaaacaacaaagagtccaaggaaggtgaaaaactggttacaccatattttacaatctatatgcaaatattaagtaaccattgtaacgaaataacaattaacatttttttgttcatctctactaacgacttggaagctcagataatttgataacgaaatcaaatttggacgggcgtaaaatgattctttgatgtgataaaattatatgctaattgagttttctttctgaatcaaattaatatatattttaattagttattttagtctaaggaaattattgttttttaatccatgctctttttttttcttcaattaacattagtcagaaataggatattagaaaattaccgttaaaatacttctctaataatttaataaaaaaattgatttttaaaaaactgaaagattcaactaaattgacattttcttaaacatttttatttactttatattttacttgtatttataaatacttgcaaaatatatgagatacttgctagtatcaaattaattgtgtgaattcattcttagataagaaattaaaattcttgttctttagaaagataatctctatttatactttttttctcacataattgcacatcttttttattttatattatagcacatgtttttttaacttttacatttaatcaaatccatgttttttcttcttcttttgttgtgctaggtaatcaaaataaattatgtttttcttcaatttgtaactaatattaatttcttaattaactttagggttataatgagatattattaaataatcatttcaacaatattttattaattaaattaattgttatacttttaaaactgaaagcttcaaagttcaaaatgttttttatacaatttatttataattgtaattactggtttataaaaatatatgaattagattaaattaaattatttgttaatttttattttatattttcagtattaattgtatttataataatcatacagtatatgagatacttattagtgtacttacaatttttttttgtgtgtttgataatgaaaaaccaacataaacaaatttattagtattttgttacaaaaaatctactttttattttatactacatattcaggtatctgaaatttgtaacaaataaaatttaaatttatttagattttaatatacataatggttaaaaataatatcaaataaaatttatatttcacaaaaagagttattaaataatatatataagtatctaaaatttaatc

SEQ ID NO: 399 - DNA, 2900 bp, Glycine max
  Soy_ogl_4339 Gm13:29124601..29127500 Cluster 1
tctgttatttcatcacgtacattatctaattcatccgtctcactttcttttatcaaagtgatggcattcgcattttgcattgggtttacaattggttgagagaccaattttccttgtgattccaaccaattgtaaattcactaaatctacttgatgagataatgtaaatacatgttttattcttagataacaatataagttcagggaaaaaaatcaagttgaaagtgagataactttatcatcttaaattgtaaggtgtaattatatttggtgtaaaaaagaaaaaaaatatttaaataaaacaattataagatataaaatgaatgttctcatatgagtgatatagtttaacggtaaaaacaaaaacaaataaacaaattaaatgacctgacagatcaatcaagtcatcagatcatcaaatcaagttgattcatatcaagtcagatacatacttgattcaaatggtgggttggatgctctattcttaggccaatgaattgatcttgttgagtcgagtctataattatgattttatgtatattttagtattagacttgtatttaaaacattttaaatattatattatacatccctttatctttaaatataaatcatgtatattaaaaaaattaattaatttagttaataatattaaatatatctataattctaataattttttgaaattatccttaaaatgattgggactaactatatcacttttttttacttaattacttttgacctgaattttaattttctaaagttaaattctttaattctccaatctcaaagaaagagcaatagataattcataacatttatgatttatataatagtgaaggatatttttggttaaaaaataattcttcaataaaaggtttaaaaatatttttattagtatgttactcttcttttaaattgaccaatatttggatttcttattttatctttccgttattttaataggtaaccaaaaaataattttaattgcataatatctgaccaaaaatcaaatataaaccaattttgaaatttttttctggaattattaactaatattttaaaaaataaattctgaaatatttaaaaaatattagttattttggaagacaactctctccaaggaactcagcaaaatagcccgtaacttcgggagaaggggtgcctcctcacaaaagaggtcgcagtgaccaggcccggacgactgtttaccaaaaacacaggtctccgcaaagtcgtaagaccatgtatggggctgacgcctgcctagtgccggaaggtcaagaaaattgatgacttaatgacaggggagccgacgaccgaagtcccagtgaacgacggtcgtaactctgaaatgtaatgaattttataatattctgcaattatttctagaatattataaagctaaattctagaaactaatttccaatcatttacatatttttaaatatacattctgaaaaaaattgttatcgagaaggatattattgatataaaaagaaattaaaacgcatgagaaatgcgaagaaaatataataaaagaacaaatagaatcccccaattctccattgccgtaagttcttttcaataggcctaaagcgtgctcccatttttgtcaatagaaacaacccagtccattttaagttccaaattcacgcttcattttgggcttcaaagcataaaattctaaggactaggactttacttcctgcaccctttttctttcctgtaccccaaattttataatatccccaaagtgtcattctgaaatgttatcaggcaaaaagatgattataaatcagttttattttttttaccaaagagatctagtttatttgattaaacatggcactcgagttgttgcatattaaaacaaacataattagccatttttatattctaaagaatgggagaaaatgtagccataattatcgtgaggagcattgtctctcatgcatgatatttgagggtttttttttatcataattaaaattgttttattttatgatattattaataaatatttgatatacaattgtgtgaaatacttgaagattttattaatttaaaaatattttataataaaatatatttaataaattaaatgattattattccatatcgatttttttatatgtagttgtgtaaattactcggataaaaaaaacattattgtccaaaatagtcttaagttggattgtgtcctgttaaccacaaataacaaaaactatttcaatttatgatattattattgagcctttgttatgtacttgtataaaataagagttttgtagcatataatggtttcaaatagaattgtctctcatgaataatatttggaatttttactataaaaataaaaactaattgattttttataatattgagaaaataatttaaaattatctattgataaaaaggtagggtttttttcataattatttttgtgtgaaatacttgaagaaatattttattgagaaagtaatttaaaaatattttatgataaaatatatttaataaattaaaatgaatattactttgtattgaatgtttgaagtatttaaagaaagaacattggtttctatttggggtgacaatcttgaaaaagattatctttcattggtttgaaaaatatttatagtctttactataaaaattaaaaatacagatcaattaagtataaataatgcaaattttattgcacataatgattttcaataaatacagatcaattaagcataaataatacatattttgttgcatataataattttcgttacgattatctcttgttaatgatatttatgatatttactataattttttttccaatttattttaatcaattatattattgaataattattttaaaaaatatatatgtaaatttatttttt

SEQ ID NO: 400 - DNA, 2564 bp, Glycine max
  Soy_ogl_4352 Gm13:29809817..29812380 Cluster 1
caaaattgaatgcatacttataataattgttgtgcaaggctcatactgaactggttttttcttaaaaatgctattgttccttacttgcaaaatttctcatatacaaaccatattaatgtttaaaaaaaaaaagacaaaccatattaatgttaaaaataaaaaaaagacaaaccatatctctgttccatccctatccgaagcaaaagaaaaatatcacaatccctatttgctacactccctttcactcttactatgagtcacttcttgagagaaaaaaaaaaaggtacacaattatatttttattcaaaaaattatataacatggaaatttgtaatcaaataaacttttagcgaataattggtaaaaaaaaaatcgagcttaaagaaaaaatatgatatatattctcattcaaccgtaaataattattttttgacaaatttattgattttaataataataattttaaatgttatacgaacaataatatgtgatttgattataatttttttttcatttttaatgcatagccattatacttgatattaaaaaagaaaaagaaaacaaaactatatataaatagcataaaattaattttacaatatatctaatcataaataatcatgtatcaaaattttattgaataataatataaaataatttttttacacggtcatgtatatatgaccattaaattcattttaaaaaaagtattatacaactctaatctaacaacttctctttggagtgacttgagaatccattactaaagcaaataagaacttaggttaattgaaacacaacgtaaattttcaccaacaaatattaggcaaattattaagataatatgtcataggaataggaagagatatattattgttgtcacaattaacattgaacatgttgtaatacataaaccaattaaacataatttggtttatatgtgtttttagtctctcgtattaaggaattgtttttttagtctttcaaattaaaatttatatttttttaaatttttcaaattcaaaaaatatttttttcaatttttctgtagtgttatctcaaattatgcattcaaattaccaaaaataagtcataaatgagttttaaaaaatagcatttcacgaagttgataattataactataaatttgaatttaaaagattaaaaaggcacgtagtaaatttaagagattaaaaagatatttaattcatatataattataaaacatgaaagaaagaaaaagaaaaacgtacagtagaatgaaatgcgcatgcaggccatgtttggcttatttatggatccctaggtaaggggagttgtatgcatacgtcttcaatacttggcgttcactcctccggagcaggagcaggaggaacaacgtaatctgaaaagcacaacttgatagtattaatcatctcaataccaaaaataacaaagatattcatcaaattagctttacatgcatacagcaaattattgaaaacaagtaaagaaatttgttgtttatgatcttggggtttatatatgttatccttccttctctgccagcggccaccataccattcacttttcatctatcagttaaattaaaatatattaaaagtgtaaaaaaaattgatactgtcattcaattgttattattttttttttctagagcccatatgtattatttatatgagaggtaaatttgatccaagttgaccaaaatcactataaggatcatatctctatctttgaatgtttaaagtgatttacataattcaaaatcacttattcaaataaaataatcttacattgattgtgttaaatactagatcattattcaattattataagttgttgcatatgattagattattagtttttataataattatttttaaaataattaaaattatttttttttaaatcatgtcatgagaacttatttgttggctttacaaatgattattttttctttaagatcctagatgaccttctttagtaggtatgtattttgtcgtaatattatttttattcacaaaacttaaatttaagaatttatttaaaagatttaaatataatattagttggatgaataacatattttgatatattaaaaagagagagaataaaggatgttaaagattatagaaattaaggttacctccacattgggtatcaatattttgattgttgagttattgggatgggggaatggtatccccttcctttcttatgaactcaccacatttctgaaaaatgagagtgaaattacctccgcattgagccgaggcaagtggcatgttccctagcactacaatgccagcaagcaccaacattgcaaatgccaagtttcctctaattgccatgctcacactcaactttaattatgattattattatttgtatggaggctggcttatgcttacaattctagaattgggatcacatctttatacaagaaaaaataaattgtcaaataatttacgacgtgcgttaaccaactccaagttcattttcgtttagttattaaaatgtcattaattaaataattgactttcttttaacccaaagctgaaagg

SEQ ID NO: 401 - DNA, 3400 bp, Glycine max
  Soy_ogl_4355 Gm13:29920801..29924200 Cluster 1
attaaaaaaaaatctaacttatgttttaaatatatcttttattaaaacttcaaaaaaaatattttttattattaattaaaatttattcatataactaacttgtgtagattttattctttatttaataaactttatttatgcctttttttttataaatttaatcaataataaagtgtttcagagaaaaaaatatcagagtttctaactaatactcatcctctcaaattatcttaatttattaattttatcttaaaaattttatatacttgagtttctttactatattaattatcatatataataaacttattaatttgtatcataattatcttaaaatttattatttagacttaattgtaatttttttggatacagagacttaattgcaattaatttactgtataaaaaaaattatactgaaatcagtgaaatgttagtactaaataagctcttgtttaaatatggggtctgagtcccagggtgaaaagagttattgtgaagaagacaaagctcttatgtgtcaaataatgtttatagttcattgttcatagtagttcattgttgcttagcttcacaactcagtggaatctcaaaatttattatcccatttatcaatcgctagataaataagacttaattattaatttgttttcaaattatttttgaattgtttaatttagttttcaaatttttaaaaaaaattaatttagtcattaaattcttaaaaaattaatttgattctcaattttttaaaatatttaattctcaaattcttaaaaataaatcacaaattgattcattattaaaaatctgaggattaaattaaaatttttaaaagtttaggaaataaattgattattttttaaaaatttagaaattaaattgaataatttaaaaactaaattaataattaagtccgacaaataaagtaacctattaaaatagtgtgtttagttatcctttgcattgcattgcacgaatggtgactttggcaaccgttgctgctttgcctccgatcaataacctattaaaatagtgtgtttagttttttttattatatgcaattctggcagtagtttaatcatgttgaaactgatttttttaaaaaaaatatttacaaatattcaactgttttaaattacaacaaaattattacactttatatttttcatagaaaaactcgcatttatcttaaaataaaataaatgaagtaaacaaaatattacaaacgaagaggagtactaaattcgatgacggatctaaaatcttgactcaatagagacattctacgattttattaaaaaaaataaaaagttaataaagaaaataaaattgtcgggtgagtgagaaattgggacaataaatttaaatataaaattaaggcacaaaatataaaattttgaaatatttacatatagaaaaaaataaaaaatattaattaagagaaaataattgttgatttataatccgtaagtgagttttttttaatctctttcaagaacacagacccttcatagtcgttgccaaaacagtgatttagcctttttaaaactcttcttttaacttacaaataattcaactaatgtacagtgtaggagtgaagagttttaattgcgtgccattaaatttggggacatggttagcaggttctgtaagcaagactgagatcattctcctttctccactgtaataataaaaataagaatggtgaaaaaacaaaaatgcaaaagggtgggtaaaggggccagcatctacacctataatggggtcatagacctagctagagactagagagcgtgccatatatgtaggtcatgatcatagcctaaccctaccctaattaagtgactcagattggtcttattggaaacaaatataggccgtatccactaaggcctatgagccaccttagggcacctcaaccaattttactggttctttcatgcatgtttggcactttggccaactggattgataatgatgtattgtgggataatcagatcaggatcctatatgctaacaaatcaaaaaagaaatatgaggatcctttatctatttattattagagttttgttaatcaatctcttattataagtattggttagaaaagaaattttaaaaaatgtttttaaagtaaaaaaatcatcaacataatcaatgagatcagggatcctttatgctaacaaatgaaaaataaaagactaaaagatgagggatcctttatctatttattattattaaccttattctttttttctatgcatgttagtattatatatttaaataatgttttttttatatgttttgggtattaatattcaaatacagtttttctaattacacttaagttttggatattattttcacttcaataacttgtactaatcttgaatataaacttctaggatataaattattgtgataaaattttaattctaattagaatataatactacaagtgtctcaattttcaagaagaactgtaaccatgtttggtcttattttttaagaatcaaatataagatgaattttttaaaaaaattatatgattatataaatatttttaaaatgtaattaagtatattttaattaaccaaaacttaatataagccccatattttagaaactatacagaacctaactattcttttgttccctctcttaactagctaggcaggtgatcaaaatctcattcatcaaaccttttttggcagtctcatatttgtagggttgggcagcaacatatatatagcatgtgtattgtgtaggtttaggtgagtcgtaaacgcaccttgtacccacaatacataacattgagcatgtgaaaatctactacactacgtaccatctttaattactgcaaatctgccatagctattagctactactgtacggtattacactgtagtatgtttagcttagctcaatcccaatttgaacaaaattaatagcttatttttaaatatatatttataaatcctgataaatatgtgattttttttaggatatattgaaccaaatttgtaattgattggttagtattctaaaatctaaatcaccaaacgtaatttatctggttaggtacgttttagaaatactactaaactacacctaaaaaaaagaaatagaagagttaagtaatatatatgatagttaagaaaacagagataaaaatgaaattgaagtctttgttgaatcattcgtataagaaaagaaaacagaaataaaaaaggaaacagagataattgaatacgttttgttgagtggtttatataaactcgaatccaaccccatcgacctgaaatatatgggatgaaaatggtataagagtattgtagaatagggttttgtattactcataagtgacatgtgagttacatttatggaaatgttttgatga

SEQ ID NO: 402 - DNA, 2900 bp, Glycine max
  Soy_ogl_4378 Gm13:31009101..31012000 Cluster 1
aactatatatccattatctgactacagtctaatgcctcttatggctttagaatctccctaacaaagaaaaccaatccacgtcacaagttcctcaaactcgttcaaatatgaccacacaacttcattggttcgagctcccctactctagcaattaggataacctgaccaccgatccaaatccaggaagcattcttctattggtgaacaagaaatctccaccccaatctatttaggctagtcatgtgattttggagaaaaataagcttcttaagctcttcaatgaaaaaagcttagctcatccacacccgaagttaagaattcggcatttaaatatagaaccacaaataaataagtgttagattgcatgttgaaatttaagaatacgaagatcacaatattaatctttttttttttacaaatctaaagttacgattgattgaatctctcaaaaattatttaaaaaaattatcacaaatgacatatatcatgttctatatttttttagtttactttatgctattattaagcaggggacccataaaatataagggaatcgatggattgtcaagtctttttcttgaaaatggccatccagctctactgttttgcagattaataatggtaggtcgtttgggttgcccgttttgcataaacatttggttggaggagaattttgagattgtaatagctatttatatatatttttcgtaaagaaattcctaaataattgtcccaagtcccaactaaattactccataaaatattgcaatatagaacaatgctgatttggttcaatcttacagccgtacggactcgtgattcattttttccatgctttgcccaaattctaacttgtaattatgacttgtaactttgtaaggctttattttattcgtactgatctatcatctcttttaacggcgttcttttttcctccgttaagggccggtttcacacttaagcacttttcccttttgttttcttgtttttgaagctaagcaacacttgatgtaactcgtttcagtcgattgaatgtaagtttgctttcattatttatacggcggcactcataagtcatcttaattcatattttagcaaaaacattcagaaattattatataaatgttttgaaaattagttttaatgcattgtcatcatacaaaaattgaatataatttgaatgcattgtctatgtagaaaaaatagtcatggaattaaacattatattgtttaataaatttgacatttcatgtgatattaaacactttaaataatgcattaatatattatcagacgttagtgtagaacttttatactaatattacattaaattaaaccaaaaaatgttattatatttaagtgaaatattaaaatcggtcattgagactaattttaagcatctaattgataaattttgttaaaagtatattaatatttttttttgtttttaatgtaatagatattttcttttccaataaaagcttgccagtttaagatgttagtagtaaaattaacttttaagagttcatgttaacaatcttgctaaaacgtatctttaatgatgtgttactactaatttataagttttatattttatatagtaattattaacacagttaaagttattaatttgaagtcaataaataattaatcaacagggtaaaatacagaattgatcatgaaggttaataatatgacgtgtactagtgattgtgtgtcgaaattttccatttgatgtgtgctagtgattgtgtgttggaacttttcatgtgtattaaggttctcagttaataataaacaaaattaatttcttttaaaacagatattgtgaaagtttttttaaaaagtcttttttatatatacgattaagaaagaacctaattaatatatctattaattgtgtcagagttccctaatagtagtagtataacgtattggaattaatgtcatattaaatgattttgaaatgtctgtaaaggttaataataatgtcaatgaaatcaatgcttatataaaaaaaatgttgtcgattgtcataaaaaatttctgtacataaaaaaattcaatcatttataagttttacacagatgttcgttaatcttgtatctttatttattttttaaatgctaaccattactcttagtcctaagactacttatatatagaagtaaaaagaaaaaatattttattgaaatgtaaaaaaaaaaaaaaaaaactctcttatatatgattttaaatgcatttttatgatttgcaacaaaacttcatatttatttttggaccaaagtctttatatagctagacccttttctttttagtaaagatatcaagtatccttaaaaaaaagataattgtgagtttaataaaattattatggatgataaatttatttttaaatatttaacgcaaaagtataatttaatttttgaaagacatgcagttatatgtttaatgtttaaatttaaaacttttaattaagttgaaatatttttgtgttaatcagagacagttccagaaatttattaaaataaacagactttttttcttgatttgaaattattatttattttattgagataataaacgaaatgtacagcatatatatcttatttgttccccctcttgtcactcactcgaacagaaccagcattcaaaaaattatcactaaagactctataaactttacgagattttatgcatcattgcacgagagcatacatggtattattatactccatgtttttctattctataatcttaagcatattcacattcagttaactaacttaattctcccaagtcatacaatcaatgtcactaacccaacaaatagttaaaatatagtaatatattaattaaatcaacattttttttctccttaggtctaacaattttagtcg

SEQ ID NO: 403 - DNA, 1900 bp, Glycine max
  Soy_ogl_4429 Gm13:33482601..33484500 Cluster 1
tgacgtttgcggtgggtgatggggcttctcgccagaaacacgccacgttttcctctcacgatgtggggcccaccacatgacatggtagaatggtcaaatcagacacgccagagactgtgaaatgacggccggctgggcccagattatcagctatggtatgcctcacccctccctattaccaatatatccacaacaatcataatacattctattattgctaaatattaattattaatactgtaatgctataatcatcattcatcaataggtaacaaactttaaatactatcacaatatattatttaatacccaaaaataaaaaataagtatgatgaaatttataacataggaataaaataaaattgttgataaaagatactcaaaacaatctttttctttttatttaactaataaatgaatcttataactcacgaaatgaaaaatattggttgaatgtttaaaataaataaaaatttgtatattattactcgtaagagttaaacacaactaaaaaatataaacagttttttgacatgctaaaaaagtaaaaatataaaattttgtaatactttgaagtaataataacataatatgaaatttgatatcataaataaaaaataaaatagatttaatatattattaagtctttgaactatcttagaaaattttaattaagtatgtaaattaaaaaatggtaattagatatttgattttgtaaaaaaaaaaaattaatttggatagtttatgcaggcttggaatcactacaaaaacaatattttatttgtcgtattataaagaaaaacaatattttaaaataattattattttagtttttaatgtataacattagttattttttaattgtactttttatactccatttcatttcatttatttattactttttttttaaaaaattgatactccatttcatttcatttatttattacttttttttgtttgtataaaataattgtggacttaaattattttgtgagggaggaaatataatttgttatagttttactaattttgaaaagtcaattaaatataataaactagttaatgtttatttctaatttagaccattatatatgtgtttcttttggaatatttaaatcgaagagaggatctgttaactctgatcataaataattaacgaaatatgcttaatatgtgtcaatagtaatcgttagaaaaagaaaataatgcagtattaattttcaacaatagtgtgtatggttctagagaatggtaaaggggggttatttgcgtgtgggggtaaatgggtaatgggttgagtttgtacttttgcagtcttgcgtctttttgtcacccaactgtgtgctcataatagttttctgacaattgggtttgaattgctcacattcttgccataataatatcactgcatcacctcgcaaaaacccaagctaacccactacaactcttgtaaaatactactccacataattgtagtttttaactttggaataatgttattctcaaaaaagaaaaaaaaaaccttgcaataatgtttattgctatctcagtgaaataaaattagatattaacgaacattaataattttaaatatttgatgaaaaattaatgtaattaaacgcgtttgtttttaatgattaactgaattaaagatattactcctataaaacatcactttgagcatttttaaattataattttgcattttagcaattttttttgcctattcacatataataaataaaaagtaaaagataaatatattattgatgagagattaaaagaatttaaaaatgaaaaaatatttttaaaagcttaactttaagtcactatgtctcattaatattataaataattttgcaaaaaatatataaatttaagataaatgtaatattat

SEQ ID NO: 404 - DNA, 2100 bp, Glycine max
  Soy_ogl_4485 Gm13:36487401..36489500 Cluster 1
cgaaaattgaggtaattaataatttgatagttaattaataacatctataatgcatgattctttaaattaattatttatctaaaaattttgaatcctataatactatatagatttgaaaattttacaaaaaaattaactcaaatactaaaattgttagaataaatatttaacttgagtcacattaaattttttaattgaaaaatgattttttaattaataaaaattaattaagtaataattatttatataaataactcaagtaatttgctgtgaagttatctattccaataataaaaatttgttaaacaatattacttaattttaagcaacttataaaacacttgtaaaggaaatgaaaaaaaatagtgtaaattatcggatgaaaaactcaactctaaaacattattctttatttgagtgttttgttttttacgtttattttttacaaggttttattttttacgttaaaacagttaatcaaaaattgatttaaagaatattggaaaagtcaagaagtcggaactatttaacatggacaatttatgaagagaaagtaacattacaaagggtctatttatgcggcaattggctcattaatgtctccctaaaaacagtagtaaaagattattccaagcataattaggaatgcaattattatcagggccataattacatgaatatgtatagttgccatagctaggtagctagtgctgccgacacagcgtttccatgcagattgattaaattttaaccatttccatcctttccttacctaagaattggcttttcaaagcaacaattaaataaagcttctcagagagaggtactgatctctcatcaattactttttaagtcaggcatacactatattccaaaacaagttctctagcttaattcctaccaaaagcattctcttggatttccttggacggtgaaatttctcctccacactttttaaaaaattataattaaaatttatcgtagatataaatttcaaaatattattaaaaagaagataacaatctcgctatactcgattagtgtaaaacaatttaggttatcactgcattcaattaaatattttctttatttactatcattatatatatcacactattttgttaaaacaaagcttagattagtttttttagttcaaattaatataatatactaatatcataaattaaaatacaaaaacggtgtctaacactacaaaagaaagatattggtcttatttttttttggaatatactaaaacagttaaaaaaaacacactcttaagcaggatatgggtattttttatgcattttataaaagataaaaaatctcaacttaaaggaccgataatatttaggaatagtttaaaatttatatcggagcaaagagtttgtctattaaaaaacaacgacgatgtatctcatttatcttttgatgagtgggaatcgaatataatattaaaaaatttataacaatttctgtgttatgtttaattaaactctcttgataaataatttttttaagtgataaaggactatctaatttaaaatcaatgcacacaataattaagtcttaataataactttacagcaatatttatgtaacgtattgataaaatttcaaaatcaaatttcgaacttaacaatttattattaacttttgtttttttggtacaactaactctggttgatctaattatttaactcaatgtagttgtttaagtcaataaatacatttctgtcaatatttttatttgagtaaataatttatatcatgacattgtaaaagttttctaaactaaagtcgtttaatcactttcttttcactttaacaataattattttaaaaattatatttatcatgatttttaattgatagagaatgtaaattttttacattgacaaagtataaaaattaaaagtagttttttaatttgatagcatctttaatttctcacgaaaatttaaattacaatttaaacataaattgtactacagtactgtagtttttttctttctagtctgaaactttggaaaggacaaaccggacatataatccacttaatccactatttgaattttgagccaaccgcgaaattcaaga

SEQ ID NO: 405 - DNA, 1940 bp, Glycine max
  Soy_ogl_5041 Gm15:13397604..13399543 Cluster 1
tactttttgttttttagttaatttttttaaatataattataaatattttaattaattttgattttcagattttatgaaaaatttgtgaaaataataaaaatttaaaacgaaaaaactaaaagtaaggtaacattttagttagtattaacaaaaatatgtcaactaaaataaagaaaaacttttggtaattgtaacttttacagaaatttttttcgtgtatatatagctctcggattactaaaaagaaataccatatataggctaataaaagacattaatatttatgtaaggtaacttttcactaacaaattaatattactttgtaattcatcgaggaaacaaactctcaaatttagaaaggatttaaactcgttgtattgttagtataaacaattttttatcatcaatcgataaacaattactagtatggttgatgtactttaaaaataattattataaatattaataagcttatgcatgataatttaatttaagattgtatgataatatacaaaactttttacattattaatacatacaccattttctcatttataaatatatatgaaacgtcatgatcatatgactttacttatcattttctaagagttagtgtactaaagaagtttacatgaatctacattattttatggataattcatcagttagagatgagtcctgtccaggacagatgtacatacatttttaggaggggaaatctttattttgttaatattatatatgatattttgaaattatgacattttttaacagtttgattatagaaataataatatttaagtattatttaattattttcatttttttaataaataaacaatttttttattatatcattgtaaagataatgaaataattaatttcttttcttagaaaaatattatattcttttatagtttttattgtagaaatcaaaattacaatttcacctaaaatagaaaaaccaaaatcatatattttgaggttcgtaacatatttttgacgttgagtgcttggtctagtacttcacattacgtgtaaagtttggaaaaacaaattagatattagaagcaaaccttgattattagcatgtttaagaatattgaatttttagttatgaatttaattagaagacattaataatataaatttttttacattattatatgaaatgatagattatcataaatattaagactgttaattttcataataattaatttaaaaatcatacttatattttaattaattgacagtataaaagtttttatggtaagaatgtataaaaataaatcccttactttatagcataaaaattaactaattttaatatgaatattttggcaatgaaattttgtaatcttaatcaaataaaccaaatgtgtaatagtttattgaaaaagttatgaaattattttcggaaagaacaattgataataatacaactcataccaagtcacatggaccggatccatttaaattatgttgacgtcaaatcatatcattaacactgaagtccaatgatctacaggaaattaatttgaattaagttgcgggttactgaactactccagctaactaattaatctaataattaatatagacattttatcatggacgtttgatatgggagaatttttttttcttatatgaaaattatgattcctgaaaataaattatatctatttggttgatcataaatattttttgaaatatttatataaattttcttaatatcaaagaattcatgatattttattagtgattttaattatttattacattaattaatctaataataataataatatgataatattttactatattaaaataaattctcaacttaaaaaagtttgattctcacattttttatgatttttttatgagaaactagcaaaaaatcattcttaaaaaactctattcacagacatgttatt

SEQ ID NO: 406 - DNA, 1568 bp, Glycine max
  Soy_ogl_5163 Gm15:48792533..48794100 Cluster 1
gtgagaaatgtagtgaccgtatttgaaaaaaatatcttagtaatcatataagatccatagtaaaaatagtgaaaaaagataattcgattacgtatttcttattttagttaatctaaaattatagaattatcttaatttaaagtaatttaattacattaattaaaatatatttagaattttgaattagattgatgataattagtctaattattcaaaattttcaaatatttatcataattactttgataatgattaatttataattattagttatcataaatttaattgttcaaaattttaaatcatattgataataattaatataattattcaaaatttaaaatacctatcataattactttataataattattagttatcataaacttaatttttcagaatttcaaatcatattgatgataattaatttaattattcaaaattttaaatacttatcataattatttgataataatcaatttataattataaaaaattatctaaaaatttcccgaaatgtataaggattcctttcaattaatataaagcgataaagttatattagttttaaatgagagagcaacgaaccgcgccaaaccatttcttcaatcatattcttattaaaaggttgtattcacaaatttaaaattgattttttttatcatgatattatcttcctacttaataatcaatcaagatttaaattctaaatcacgtatcgatcatgtattgcaacataaagatattataaagaaaaaggaaatatttgttattcatgaagaaaaaggaaatatagttttaactatacagttctgacaaccttttgagcgtttgaggtctattgtcatttggtattcatcattaccttgaccttttttcccccaaatcatagaagaaaatctatttaattttttagtcaaatagaatactgttaggattcagcatagttggacaaattcagaatatatttaatttgtcttaaatgtgttttttagatagtttaataatatatgttacttcttaaataagagaaattaaattttatttttcaaaataagtttaaattttttctgttttattttaaaaattatatatacatctcttccttaagagattatatgtgtcccttaaaaaaagatattatatgggttatacttatttatttttgtgaggttaaattaatttacaagttcatgaaatatttaataatttttaattaaattcttaaatctttctttttcaattaggtccctaaatttttatttgatttttaattagtctctatgatcaacatggttaacggtagaaacataattaaaaaacaaatagaagtttaaggagtcaattgaaaaaaaaattatataggaattataaaatttctaatggctcagggacctactaaataatttaatagtaaattaaaatcatacaaaaaataccacttaattgaagaatgcattcagagagagagagcattaggcttatctaaacaaaatctataaggggaaactggaagtgcaatcaggagtttggaatactagttgaaaaacttgttgaaggtgagaatt

SEQ ID NO: 407 - DNA, 2000 bp, Glycine max
  Soy_ogl_5601 Gm17:9141301..9143300 Cluster 1
acttcccgctatactcaatttttatttttggctgttaattatgccacgccattatttcctactttttttgttataaaaacagaaaaagtcaaaatctagtacctaattagtactattctcagaatataggctaatcaaaccgaatttagtcgtcaacttttattacacaaattaatactctcttttatctctaaataattatggtattgttttataccaattaaagaaaaataataaattgataaaaaaaagtaatattttatatttttttctcagaatagctatcatcgtttatttatttatagatcttatagttcatggttaatattggggttttattaattagtgctcttaaaatattaattgaagaaataaacatttattatgaaaattagaagagagcattatttttctcattctagttccataattcatattctaaaaacatcgattaatatttatcttaatattataagaaatataagtaaaaaaagtaattaatgttatattagaaatttaaaatgataattattttttttaaaaaaattcttacatgataattataattagattagggagtagtgatttataaaatgaaagtaaaataaggacaaactgaccgaaccaagttattgaaataccgcaaattaaacctgggaggcttaattgattaaggtagaatataaaaaatttaatctaaaaatacttaaaattatataaaaaaatacatagtaaaaaatttaaattaacaaaataaaaaaaataatggcatacattgtttttatgaaataacatattgtaaacctttaattaatcaaatattttacagacgcaactgtgaaaatagtatttttctgttttttttttttttgctacatttaaattttaggaatagtgtatcagtctaaagataaagaaaatctttaagctaaaaaaatacttatgaaaaacttacatttaattacctcaccttatagagacaaaaattgtattttaattcatgcaatgtatgaataacttccatacttttaataatcttaacaaaaactataaaatattatgtattttaaaatttaaattaaaacatttaagagataaggatatttttttgtaattggttgcttaaggatatataacaaaaaataatgtgaacagtataagatgaaaacaaatttaaacatttcaaatattaagattttccttttactttaatttatttaaaaaaaaactacatacatacactatgagtgtaaatgcttttacattgttaatctatacaaaattaaacagtttttaaatgatttttaaggcaactactataatattcaacaacttgtagtacatgatagtttgtaattgattggtagtataatttttttatattatttatacatgcattatttattctatttaaataaataataataattatatagataatgttagataagactgagttttaaattttttatttacaataaaaaataatttattgataaatttgtcattataattttataatctaaaaataaattaaattaaaaaaaatcgcatgaggataaggagaatgagaaaaattgtctactcttaataactaagtaaaagtcacgctaaaaaaaaaaatagaataacataatagtgttagaaagctaatattaaaagtaaattttgttcatagttgttattcatttctaatataaccaataattatacggtgtttttttttcaaaaaaaaatattaagtaaatgtgtcataaaaaatgtgtttttatttaatatatcaagggaattatgtagataaaattaaattgacatctgaatgtaaactatactcttaattgaaaatataaaaaaatacctaatgaattttattaaaataagtttgataaaaaaaaatatactactaaacagataaaatttaaaaatattattaaaaatattattctctaaataagatttaccttttatattattgatgataattttagttattgaaacta

SEQ ID NO: 408 - DNA, 2192 bp, Glycine max
  Soy_ogl_5672 Gm17:13391701..13393892 Cluster 1
tattcaacgccaagttataattaacgttactttgcctccagagacaaaataaatacctatttctccgagaggagagcctgagatacaacgaaccaataacaagcttatgatttttttttaatcgacaaaaacaaacttatgattactaccacctattggaaatttgaaatgccaataaatcgaaaaagaattgaaccaacttagcagttgatcaatatattctaaagctgaatcatacataaaggaatcataaacatttactcttacaattttcgaccttgatatcaattcaaaacacctcaaaataaccttcacgacttaaattctccacacatgcttcccataccaatctaatggtatgaaccctcctttccgctagaaaaataagactctcgatcttttccaaattcttattctcttttttatacatcatgaaatttcaattattattttctctatgacaggcaactattttttcaccattgccaatattaccatgattagtagtattgtaattaaaattacaaaagaattaaatataccttatcaatttcgcaggtcatttaatttgaagaaatgctatttctataacaattgtacaacagtttgtacaatactttttgtgtttatctctttttacacattatttattatatgtcataatcatggagagaaataaacacaaaaattaatattatatagattattatatgaattgttgtacatttaatttagggttagtacgtaagcggatatatgattgaacgatatacagttgtataatttcttttataacaaacaaatgtcatgaacaacatcactagataattaaattataggattatttctgttaacgtcaagcaaatttagctcttttgtcgatatttttatctaaaattctcaaattattagtttctatcaaagtgttttgagagttgtgatgaatttaattaagtgatactgtaattctaattttaaaaaattaaaagtaaaacaattagtaaattatactaataccatgaaattttgtaaaattacacatatttttacttttttaacatttaagacaactttcttataagaaaatatagtgtaatcttttttaaacaattaaagagaatataatgtgtaaggagtgtcagtctaatatttttcaaacaattgaagggttagtttaagggtaaaaaaaaaaaaaaaaatgtgtaatttcatgaaatctaaggagtgaaatttactctaagaaaaatacttgaattaggatttaaagaagataaggtttgagattttttttattattaaattttaggttgtgatcgattactttggagtaaaataatctttaaaacaatttagtatgtatgtgaagattttaaatagaaaaataaaatttgagaattttatatagaataaaattgataagggaattgattttgtttttaaaaatacagagacttaattgatttttaaaaaaaacttaaaattcaaaatttcaaataatatatcatgaaaaaaaaaatgaaaaagtgtaattaaggtcgaattctaatttatatatcatcactacgtacccacaattcatgtacatattatatttagtatggacccaataacttttacatgattgctttcaatgtttactatgcattttaataattctgtagaatgcaattgatatttgttaatattgctatactttaatgataaaaaatattgctatacttttttttttcataaataaaaattttatttataaagtcagaatactagatcaagttcataattaaatatatcacttgtaacatcttaactttataaaaactataagatatatacaccaacaaaaattataaaaacttattttttttataagctaaacagaaagcactatatattgatcacaattagctgaaaagtaagagatattgttggatgaacacaaacttaacacattccttacacataaccaataaaaaaattaaaaagtaataaaatataaagaaaaaatatttattatttatcagtattcatctaatttattttaataaaaaataatataatttgtttctctaaataacaatttgatcataagaagatatattaaatatttatataataaaaaaattcaatttctcttgttatctcttatttatgtgaaatcaaataagtatctaactaaatgagaaatcttataa

SEQ ID NO: 409 - DNA, 2490 bp, Glycine max
  Soy_ogl_5953 Gm18:5962901..5965390 Cluster 1
ctcatgcatgtgagtactgtctatacctataggaggaaatcaaccatgcgacgtggaatggatccttgggaggaaaatttggagtaaacagcctcaaatgtgtaatttactgttatttaggtccttaaaagatattaagatttttaaaagtgtaattagtctgtgattttttgtaggaataacatgccaaatttaaatcaaaggacattgagtctgaaattcttatttcaaaccatcaggtcattcgagatgctaacaatttgtatatgattttaattttatttttgttgttaatttgatatatacacttataagaaaataagacctttcaaatagtacttaaattataattaaaaaaaaagcatccgagattaaacctaaatataaatacttggatgactattatcaccatcattatgatggtaatggtaataatgatgtacgtgattgattttataatttttttttaattctagtcataattttttttttaattataagctaaagattatcatcaaaggttcttatcataaaggatttttcattcgaaacatcacgtacatacatgaaagattgattaaactatagtaatataagttactaaggattatcatcaaagcttcttattataaaagatttttcattcgaaacatcacgtacatacatgaaagattgatcaaaatatagtaatataacttattctcttctaatcaattgactaaagagtttcacatacatataaaactattgaagatggatcaaatatactaatatatataacatctatctacaacttgttctaatgatttgcttattgtaataccattcaataatcacatattcgacgaatgacagtcccttcacacaaactaaatgatgatttggtaggagagaaataaaaaaataaaaaaaatatttaaattaaaataaagagaaaaagatataaaactcatatcaaattttttctctctctcctacttctccaaaccaaacatcccataaaagacttacacttatttccagctgttctttttatatattacaatataaggctcctgatcaatccattaaagaagttcacgtgatcatgcaaaaacaaaaacatcttccaaacctcttgtgtccattgccaacaacatatttcaggttagttgtactggcattgctcattggaccgttggcattctcgtcgtttggggataagattttcagttttatgaagcgtgtggcatccacaataatcttctaaaatgtcctcataaatagtaaattcttctgcacaaccaaactaagtatgagaggttaatattgaataacgacttgactaaaacaaagattggataataggccaagtttcttgaacaaacagactaaaattaaaatgacctataccgaaagtttgcaattatacctatgataatttttaataagttgaaagtggaaaaaacttacactgataatacataacagaaattaaattcataaaaatatgtcaataattaatgtttataattattgttagaaaaaattctgatagatgccggttcaatttaacacatttaataagcgtgatttttgttctaaaattgtcgttattctaatactatattaaatatttgtggtattatatttaatatttaattaattcaaatcaaattaaatacatgtatggtggatgaaaaaaatgaataaaaaaaagaattcattaaaaataattaaccagatttctcaagcattcatcataagttagagtcagtaaataactatcatcgactcgcggttatccaaaaattttatctaagttccatcattatcaataacaaatatttcccttttaatttttaatattagcacatatttaattaaaaactcggattcaataaaaaaaaaattgtcactcgtgatgcatctcctcaagaactaaacatttgtaaggttgtgtctagaaattttgaggtcttaagcaaattttataggtaagtttattttaatataactcataaattttcattttttttattatacattttgaattaaaatttgttaattaaagtttaataatcaatcattttcactatttcactatatggtaattcattcaattattatttcgtaacatacttgatctcaaattaaaactaaaaaattaattttgaaaaaaattctcttaacaatgacattaattgtatgtattatttatcatattctataaatattgcatgcactaaaaaacttgattttttaatatatttaaagaattaataactgaacaagaacacgtgatctttgttgttttacaaaaattgaacgcgtgatctatcactaatattttcataagaaaaattgttgatgatactacttctacgaaatttaatttctatgttcatttcaacgtcatttaaaaaaaaattcaaactaaatgtaactaatttatcctatacctttctaaataagtaataaaagttctcaaataatctaaaacaatatcat

SEQ ID NO: 410 - DNA, 2300 bp, Glycine max
  Soy_ogl_6215 Gm18:56815401..56817700 Cluster 1
tgacgattgaggcatgcgtgtcaaagctcatgttgcatgggttccacgtttgctagggtttttatgaggagacgtgacgactgacaattttaaggaaaccttaaattttattttctcaaccttacaaaatccatatcccttaatttaaaattcaatcaagactaaaaataatgtttaaattttttttttggtttaagattacaaatgtcttctattatttttattttcatatattttccaaaccattattacatctcattacttaagctacttccatttttataataaaaaatgcacaaaaatgaatcttgacattaataacacgttcttaaatagtgatttttacttttaataaaatatatatgaacctacctttggaatatccacttgtatgaagacattacgttgtttctataataataataacaatccatatgtcccggttataagtgtcgttttaattattttttttaacacaaaccaaggaaagtgaataattaaatagacgaaaaaataataattgtataaaattaactttattatcattaatttatttatactttttgttgtcaattaataattttattagggatataaaccaagaaaaataataaatattacattaaaaactaaaataatgcttattttaaaacttaattttctttttacacaatacttatgagatggaatataaaagactagtgttggaatttattttgtttttgatgaatagtattggatgtccctcttatacttacgacctattttatgaactctcttaataattatcatatactccaagattatacactactaaaactccttgacaagtaataatggaccattatcagtttatttaaggccatttatggaaggaactgttatgtgaagcaaatgagaaattattagataattttagatcaccacatgttaataatttcgattaaatttcatgtgacatgtatttaaattttttattttaaaaaataattaataacacttaatgtcatattgtgtagagattggtctggtgaccatgaacaagtagtagacaaaaaccatctaataatttgaccaaaaaaaaaagatggaatctcataactaataggaaaacatcataactaggttggtctccaattcagaacaaagtcctcgcctccttcccccagatctaaaaggggaagaccatcaagtatctctatatgtggagttaggctatttggagtgaacaaatacataaaatatcataaagaaacttcttttattttttttattatattttaaaaatctatatgttttcttaatttgaaaaaaataattttgatattgaactgatatcaatgtaacttaatcattaaaatatttacaagcgcggcactataacacatacatatatgtaaagatgttatattatctcaaactaagaattttgcacgtaaaataaagaagtttttgatgattttttcttactcataaaaaatcttataaaataaataaaattggtgtcatggtcctcttagagttaaggtagcattccttcctgagtatgtagctagcgtaacaaacttaggtcgaacatatatataccttaagtagggcagtctccggtaacgaataattatagattttttattgataaatattaatttgttagttttattaaaaatatcgattaaaaaaatgtttctgcttatgagagtttataataggacaaaaatggagggtggattttgagtggtcatccgtaagaaattttgtcggagccacaactttctttattagatttttggaatcagccaagaaaaatgatttataaacactcataatattatatgaaacttaaaaacagagagagaaaagagaagtaaaaaaaattataaaatgtatgatgtgataggaaaataataaatacttataaaatatttaaaataaatagatatttatatatctaaaataaataagtatttatatatctattatattatattaattaaatattttactaataccaacagtataatttttctgttattttcctatcaaattaaattccgaatcatgtttatatttaattctctccgtgtattaattagtagaaaaatgttaataagtacaaaacataattcataaaactgcacgaatctcttgttttttttataaatctcattttacattttttttaatttttaattaagatgtagtttaaaaaatagatatcggtccaggccatccttttacattttgttcctaacaaatagcacttagtatttggtgttttctttttcagcataatttatgtc

SEQ ID NO: 411 - DNA, 3600 bp, Glycine max
  Soy_ogl_6397 Gm19:36442201..36445800 Cluster 1
cgtttttgtcttgttcaagtgttgattttgaaatagctgtctgttttgaatttatagttgggactgctatggcagttgttggtttggtagcatgtcgtgcatatgcagttaaaaagaattcctctggttagtcatcaagaaaatttataatgacagagctgacttgaattaactgttgaattcgtgttcagtattgagcacactaatcttggtaactttaagttagaatatattttttgtacagtgttactaatttcatttatttttcttgctataatggcttcatatatagctgccaaaatatgattgtggtccgtgtctgttttcaatttgattttcattgtgtatatttcaagtttaagttacattgactagatgtaattacactcatgtctcttgtggagtttgtttggaattaaatatttcaggtacttatttgatttgtaaaatatgaaataatttactcctgaaacattttcagtcaagtacagatgaaattcgatcaaaaattgtactcctaagatttaatttacttttagtggtttgtgggccagatagggatgattcagatatatgctggactgaagtcgaaaacaaattgaaattccattttttttataataaaagagttaattttaatattaaaataaattagcttaatttttattatttcaaacacaatctcaatttaggaaattatatttacttccttttacatgtacttttcacttttacgaagctaatcaggaaatgtatgcgcataaatttttacgtatttgtaaaataaataaacaagaatatttgtaattcaaagaaaggtaaattatcctcaatttaaaattggaaaatgttaagttttcatcaaattcaacgcggtcaaattgattaaactgaaaaatgaaagatcatatttaactctttaagatcgaagatatgttatgcaaagtgaaccaatattatacggtggttgattgacttggttgtttcttgtactttctgaggggtgttatctatatactttttattgttgtgcatgtctcattaccaagttcacaagaaacacattaatttctcatttagactgatgatattttttaattaatttatgtatgtaaattaattgccagcaatgatctttatttgtgccagtgaaaagatccagtgggctcaatgtgaagattgtatcaagtggtgcaaattgccagcaagtgcgcttcttccatcaagatgggtgtgttttgataattcgtgggatccagaaaggtaacaagagtgatgaaattctcttaattctcataggcatttttttggtctcatgtgttatcattagcttcttttttttctctcccttttaagctttcccgagtgtataagaatgtatttcatatttaaacaattagtatgaatagaaagtcatccttgatgttcaagagggtatctttctggaccttagatacatctagctaacgtgtacatatgattatcctttcttaatagagttgcaatatataaatgtatgtcttgctttattttggattcaactaaaagtgctatagacaagctttgtatacatgggatatcctgcattatattgatatttagactttggtaggaaggtttgttatttaaatatgattcttttggtgatgtttttgtgatatgaaatatttatctatttcaatttattgtagtgtagagcactctaggtaacatatctaatggcatgaaggtagatgatctggaaagccatatctacttattagtatgttattggaaggcactagtataaaatattgtctaatgataccatgtgtttgttgcttatgaatagcttaagtgagtgattttgtgtgttgagccttgagagtacattcgaaattgatagactatgtgttgtcttaaaagcctctagttagtctagtagacaattataatggtactccaggaattatttatcccatccctttatcaaatcaggaattactatgtttcttaaccttgtatatatgacagcaagacataaatctactttgtttttcatcttcaatactaaaaatgaaaaatacaatttagttaacattcttgcactgcattatcaatttggaattttattatagcattcctttgtatgtataagaattttattatagcccttctttcccttggaaatcctcttattctttccgacaaccatagctcttcaaggtcactctcgtctgtttcaagttgcgactgtaactccaaaacctacctgccttagcacacctcctctttatatttaaaaccctacttgtgcttgggctttgttttattaaaataataaggtaattgatattttcattctctttttcttctaagtacactccttttttctttttctaaaatcaaattaattaaatacttttttttcttccttgcacactctcctttgtagcttaacaacacactctctttttttatagcaaagcatattcttttttctttccttacacttcctcctcttttatataaaatgttttatatattagataaattatgtcacgttattttatataaaaatataaaacaatgggattacagttcttgtctacaaatcatatgtgttataaataatttaaaaagaaaggatttaattaattttctaagtaacataagagatgttcgttatttgaaggaaaaagtagaagctgttaaactgctagtaatttcttttatagtagaaaaatcaggataattcaagaattcttttttataattttacattgtcaatgtttttttcacaacatataacaatctaaaaaacacttaataatggaatataatcatgagttcatattgataatgtgaagttggctttttttcgtgaatggtgtaccgtaaccatcttttaccattggcttgccttcggtatttggtcgaatgagacatagtaagaatatattatctgtggatgtggctttttgcttaaatttaagtggaagcaggaacattgtaagtaggacatataatgaaaccagaacataattaataagtaatgttagagaaaataatatcatcagtttttatggaaattgttcaaatttatattgatttcaacatttgaaggtgctactacagtcacttcatattattttaatttcaccattaattgtgatctgaattttgaatgacaaggtgtaatccaatagcttgttgtcttgtttccatacttatattgcttttgtttttatatatgaatgaatttgctcacaaaatgttccatgtcttgtctatgcagtttggtgaatatgtttacaattagaagaaaaacaaccttttgtttttacaattttggattactgtataattaccacaacttgattttggccttttctgcagatgtgtcttgttttcagggtctgttgtttggcccagaggcatcttctttgttgcttcataacttcttcatttatcacattgatgctccgggacatgaggttggtattattagcattcttctcatatagccaacatagacttttccatttcattttgaagtcttcaacatgattgaatgctgaagaattgcaacttccatgaaatatttatgatttagttatt

SEQ ID NO: 412 - DNA, 2349 bp, Glycine max
  Soy_ogl_6485 Gm19:41246001..41248349 Cluster 1
agtctgtaagatctacaatacttattggaaactttattagtctatactactaattccaattttgataccatataatgatcaaatactttaatttattatcatattcatttgccacaaatattaacgtcactaaaattatagtgacaaaatttttaaaagttacatataaattgatttctcacaaaactttaatctgaattcgtgtacagtatatatattaatcttgatatttatatatagtcgaataatagaactaaaaaactataattaaaatatactacacaaaacattaattatttattaagttaagaagttgtattattaatatatagttatttataaatttatattttttaagagaatatatatagatcaagatgagatcagttgaaagttgaaacatgaacttgccttaaaaaaaaccaatagatctagtttcttaaatctaaatttataaaaatctggaaagggttggtgggagaagacgagtcataaacactcttactcataacggaaaactttgttaactcaaaggagttaaatttcacgtagaatcgtacaatctctattacagttttataaaattggatctcaattttaatttatggacatttttaattttgctaaattcaaatatactatcaaatattatttcatatattattattagacattgctcatttttcttaagtggataatatattgaatcttatgtatggtaaacatttagtttatatttctctgttacgttgtaattgtcattttacatttgacacggaacaagaacattaataaatagatgagaaaaaataattttataaaaaaatttataatcattaataacccaattaaaattgacattgagcaatttgtgtggaatcaataggggaagtaatttctgtttaaaaaaaataaaaataggagaagtaatctttacctaccaaaatcatgcagattttgttgttgttgcggtggacgtatgccaacaggcaacagttgtcgtgtcaacttttgttttttgaggtgattatcaggtcatggtaaatgtaatgtacttttaagcaaaaattatttttaatacatactagattaaaatgcactcgaaattttatatttggttgaattatattaaacctaaaatttcaacaagagaacaatgcaagactgagatatggttaaagaaaaaagtttgtgaaaaaaaagttttttttaaactaatcaatataacttcttacaatataattattttataaaattaattgttctcaactattatatatgttctaacctggtaggatcattatgggtgtgggtgcgagcagagcatgcttgataatgtctatactgtaatctaagtatgctttaatctttaataatttttagctgaatgcaggacaactagaagttcccgaaagtattgcataatacaatattcattgtataccttttaaaaatataaggtgtagtcgtgtcaaataaaataaaataaattaaaaatataaggtgtggttggcaatcatcaatatatacttcgagtggggtgatcatgtatgtttggctggtaatcataaatatatattgtcagttgtttcaagatttttatatgtgatggcatatctatcttgaaaattttgaagtattttatacttataattgaagtagcaaaattgcacgtctgtggttgcttcccataatataacttaatttagtaaagatattttcatattagccaagtgaagatatataaatgtgccttgtacgttgattttcgtacgtactggtggagcgtattagcaatacattttttgatattttattaatatattctttattgttaattaaaatttattggaaactacacaaaattgttatgagtaaactcgttaaataggaaatctgattcacaacttttataatttctaaataaactttatttaataattaatactgaaatagtacatgatatctttaacaataagtcctaatggagtcaaaggatctataataccaatgagaaaaacgcacttattcttacaataaatcagtactagagtgaatattgtttaagtccaaaatggaaatcataacagaatcgcatgttaaaaatcatattatttaatttgcataagccaagacgtccacaagactgagtgtcatagcatccagtcatctgccaaatattttttccttttctttcctcttactagtccttgatgataaagaaatgatcgatcacctaaaagtgtataagaataattattattgtttaatttactacttcttaacgtatattcttcaaaagtgttacttcaaagtttttgtatggaaatttttattcctaactttcac

SEQ ID NO: 413 - DNA, 5713 bp, Glycine max
  Soy_ogl_6679 Gm20:1517680..1523392 Cluster 1
agtatttttggttgattataggttacactaactattgtatcactctttcatgtacatgatttattcttaaacaatattaagtcaatagtatttgcacaattactactacatatacgggatgaatattacatgttggtattttaatatgttgatcttaaattctcattttcaaagtgtgacacaatattgtagaatttattgacaactggaagtttaaatggaaaattctgctgaacggaggaaacgtagaaaacacattttgcaacaaagaagacaaagttttgatagtccaaatcagcatttacctaatgataacaatgaatacaaacccccaattcatttgtgcatattttataaatactaatttggatataactactgttattgtagaaaagcgtaagcgtacctcaccatgtgacccacactttattggtgacagtctcacactacaaacacaggctacaccattatcaaacatcacttcatctgcaaatcagtgtcagcaacatcatacagggcaatttcaaattcgaccgaggaatttagtggatggatgtaccatcaatgcctcatcaatccagaggaatctgttgtccaggtttgggaaagaaaatttaagttcatcaaacatcaatccgccatcaacttctacattacatactcccacaggtgttgttccaattcaaactgccaccacatatatacattcaggaagatatacaatacacaattcaaaagtaatagagcacatctcagatgatagtgatgatgaaatcaatataacacagggagatattgatataggtaatatgtcgttattgttattacatcatgtcaaaatgccaaccatgtatatttaacttccaacgtatcttaccaacttaattatatacacacaacttattttagattaaacaattttatgtcatatagattattcatttgacgacccaccaacgaaagatgatgttgatactgatgattataggaatctagacacaccatatcattatcaaaataccggttttgacgatcaactttcaacttacattgtgttgtcatatattttttttagcatggggagaatctaaacttccaaattaatgtgtaggtccaacttacaatgatattggagatccagattggtaatgcaagcactgtaaagctataatgtgatatggtgaaaggattaacaaagataaagagaccaaaaacccatggtttgcattatgttgtggtgatggaaaaatacaactgtctctactaccacatcctgcataaccgttgaggcaactactctatgacaccaacaactcacaagctaagaacttccagcaaaacattcgttcatataatctgatgtttgcatttacatcacctagtgtcaaagttgacataacctataatactggaagaggtccttcaacattccgcatacatgatcaaaggaatcatcttattggaagcctcctacctatgcctaataactcaccgaagtttgcacaactatatatttatgatacagacaacgaagtcaacaacaagctttcccaaaacccgtaagtcttagcattcaacaaattgcatgatgcattatagttttttaaattgtctttttgataatgtatatcattaataattgtctatgcatcttcgtcaatgtccagtatcaaagatattcttgatgaagacattatcattgaaatcatgaatatgctagataaccacaatcaatatgcatagaagttcagaatggcaagggacaaactacaatgttttgcggtttgtgacctgaaacttaaactcattagtgacagacaattagatgaaagattatataatttgccaaatgttgttgaagtggctactttgattgttggtgacaagcatacatgcaataacagagatatcatcattgagaagaaaacaggcttgctccaaagaataagtgaactacatcttgcatacttatataagcaaccgcatgtattaatggagaacattatgaaattgttctccattaatattttgtacaaaagcttctaaacaaaaaagaagtagcgcttcgcctgcattccctcgcatttttttcccaccaagcgtttgatcaaacattgtgtggcacagacgttttgtgtccatcactgctacagtacttcaaagtacttcttattaattgcctcattaaatgtggtggcagcctttatgcatatcagaggcatttcaaaaattttgctcgaaaattgtgatggcagatttgacttatggcaaacatacttattatttaatatattttcactatatttgagttattctgaaatattgccattaaatatttagaatattggcgtcgtaaatattttcctgtgagatgaacattcaaataagtgatttaattttatttatcttggtaaaattaaaaatcttttggtttgaaaatataaagttttattaacactattaagcaatttgatcttacgcattacattttagtgttattggacaatgtaactataagtaataaaagtgacatgctccagtgaccttccaaatattaagcaacaaatactatattcaaacatatgaaggcataaataaagtaagtcaataatttgataataaatacgatgaaaccattttcggtaacgttgttcaggaaaaagtatatacgatataaaatattgtctatttctccaagggaattaaattacaacattgaaaaagtaaatactaaaacaaagttacataaatttttcatcaacaaacaactgtaaaataaaggtagtggattctggattgcaatatttaaccggactcatcttcattccatgtcatctgcttcctgaagatgacctcccatacatgttggttaggcctgtaatagaagacaacctcatcaccggccatcaactcatttacggttaagtaatggtaccatgggtgaccaagagattgtagcccattatggatagtcatcttccaaaggtgacgacgaccatgaataccaaggacaatcatatattttgttgatgcatcaacaaaattcagagcatctggtggcagcacctacattagaaccaagctagtgagtaaacatttaaaggtcatcaataaacacaacatagattaattacatgaccaaagacttaccaatggataagtgcgtgagatcaaacgttgggtaacatctacagtaaagacatgagttctagtggtcgcgagaggccttccacatgtttttctatgcagtggtggcatgaagtggatatggaacatccaattcttctcaggcacaacaaatgtgatcatgacacctttatgaatgcccatggttctcctgaagcccttcagtccatcagcaaagtagaatttgttattatgttttctgagccttatatagtgcttgtctccattgtagtcaagcagcacataaagtgggtaatgtggagcccattgtctatgatacaatgatggtatctcaatgagattctgcaagtaaacatgtgacaattgtattttggatcatttaataagtacatcagatatcatttttttgggattaagagaaatggataaaaaccttaaggttggcaatacttaccctaccaacatggaatgccaccttaaattgatatgttactgtgcatcccaacaaaacaagtgggtcctgaatgccaatatttaatgtaattagttactaataatttgtactaatttcatatagatcctaaaataaaagttgttacaacattggaatgagatgatgaatatgcttaatctgttacccaacataatatggaacatgaacatgaatgacgaaactataatgaacatatacataaaaagaaaaaagacgaagcatggaagaagatgataaatatcatcaatatcgtacgtgttaggcatacaaacatgaagatgaatgatgaatctataatgaacatatacatataagaaacaaaaaacaaaggataggaaaagaaaaagaaacttacaattataatttggaagatgaattacaaacatgtagatgaatttttaaactataatgaacatatacatataataagcaaaagatgaaggatggaaaagtaaaataaacttacaacattggaaaaaaatggtaattatgatgaatttcatacctgacagcatgacaaacgtgaagatggatgatgaaacaatattgaacatatacatataagaagaaaaagacgaaggatgaaaaagttaaagaaacttacaacattcaatgcagatgatgactgtgtactcatggtggtaagggttgtgtgatgttcttgggcaaatgagttaacaattggtgaaaattgttggttatggtttccacagacggagagaaaaataatcaaggttttctaattacgacttccaatgcatatagtaaacatgtttatgattgaatggggtttagtaaatacacaatgtctacttgatgtaactgccgtagcagttaatgcgtattggaaactgctatatatgtgaagtctagttgaatactgtataatagttggaatatgaagagtttactttgttgtattgattatatttgtcagttaatattcattaactataataattgtaaggctatcagacttccgataaattaaatcttgatactaattggatgtcgtcaaaacctaggtttatgatttctattgtttattaattaatattgttgtatattaattgtgagataattataatctttttcacttcccgcaataatgataactttagtacattaaatgcatttgttttagtctgcaatcatgaattaacaatattatatattatatgtaagggttctactctatccgtcatacttgtaattaattttcatgaataataattgcaaacatttactcttcccaaattataattatacaggtagtattttgttttgatgtattgggcattgggaaattgcacctcaagacacatctagtctattaattacatggatccttatatctactctaataattactatgtattgttatatgtaaattgtacttagaagattgaaggtactactcacagtctattaattaaatgcatcattatatccacagtataaagtattaggactccatcgtacctgtataagcacaaattccaagaatatctactgcagggattttgtagatgtgtatacattaccgtaataagtatgtcagcattggggaatattgaaggtcacttgtgaacctgcaagtaaatgctactaaaagatatatcaaaataatactcttgcattaacgaatatataatacataaattgcattgaacaaattgaccccacgaatttgaatcgactacaacaatgttaatagaatgaacgattctgatacatgcataaaatcattaaaaacaaacgataaaaaacattattttatgtgttttaatttaaaattaaaagacattaatctttcacattacgttgtgaatgttattcacattttatttttcaccaattttaaactaatgtttttattattatcatattttgcattatcaatttatttatatgaactctagctacttggtgcctagagagattttgtggaaagctctagagaagaaaggggttagggttgcatatattcgagctatccaagatatgtatgatagggtatcgactagtgttaggacacagggtggagagtcagacgattttcccatcacaatt

SEQ ID NO: 414 - DNA, 2200 bp, Glycine max
  Soy_ogl_6724 Gm20:33264001..33266200 Cluster 1
aatccaaaatagcatagtattatatgtaaattcagctcaaaatattcatatacaaacatgcatttttttttgtgagaatataacatgcattgtactgtgtaaaaaatatgttataatttatattaaataaacaataaatttatataaatacatgcactgtttttatttcttgttacaatatacatgtattgtgaaattgtataaaatgattttaaatttttttacaaataaaaatactggtaattgatattaaaatatgatttataagattggaattttaaatgaaaaataactttaaatatatttttcgacacttaactttaaatattattagttaatatattcactataaaataatattttgtatgacggtatattgaaaaattataaataaatatattaaaatttaatttattaaatttttttattagaaaaaaaaatttattgtttacccactaacaacataaataaaatgcattctaaatctccattaattacataaatatatctcaatgatatttttcatatctaaattgttgaatattttaagtagtagatgaaaatgtaatattttcatgtattgaaggcaataattttcaatatagattttttttttatatttcataaaatatctctatgagcataattaagaaactaattctttgagttaggaatgatgttgcattaaaaaaaaaaagaatgatggtcaaataaagctatttttaaaatataagttcttgaattcgtaacattgaaagggaagtttgaataaagtcttaattcatttgcattaattatataccactgggaaaataatttgatggcgacaataaatataacatttttttttattttaataacattattcaaacacatgtatttttcaccatttaatctttttacactttttatgcggaaagtaatttgtatataaatttattaaatgaattaatatgattaattgtattgataatatttttaaatacattaaataaatacagctcaacattatccgaacataagaatattaataatcaaattaagataatatcttattgtatcattttctaaggaagtaatataaaaaaaatactaattaaagataaacaattatgtgataaaaaaaagtataaagagagaatatatggaattgatagaaagaaaaaataaatatgtgtatatatttttcatatagatagaaagtgtgttacaaaattaccatatattttagaaaaccattaacatttttaattgatttgatttaattcttattgaacttttttcaatattctatgtatacatttattttttatatttttattttaaatttataaatataactttaattattttaaataaatttggaaaaaataaaatactattaaaaagaaaatttacttaataaatttttttttgagatatacttaataaatcatgattgacttggaatttgagatattcttatccacaattgaaattaagataattttatattaatatttgcaggtgaagaaatttgtgattgatcagtcacaaaaataattaattaccaacaactgattaacatggggctattgattaatttgagaaaggaaatttgtgcctcgactaagcttttggctcgtaataaagatctttctatcaatcttgaactaaagttttgactaaattaccggccgcactcttagtgaattgcgataaaaagatgagataaacaactgaaaaaaactaataaataaaagacagataaagttgtaaatctataatagtagataaattaaggagatattatgtttggtaatcgttttttacatttccttaattaaaattgtctattaatttaaatattaagaatttactaaaattgtcaacttaaactgtacagttttttaattttaaaaaactgtgaatttgttaactattttttaactttagcaatctaccaatttgttaactttaaaaaatattccaatttattactgtttattttttaaattgtaaaatcctaccaatttgttagttaaaccaacgtaaactaaactattgttatttaaaaagtatttttttaatttaaaaattcaaactatcccactattctcgtcttagcttttttttttttatataaaagaaatcactatttttaagaaaaaaactgacaatttttttaattttaaaattcaaactactccaattttctatt

SEQ ID NO: 415 - DNA, 1940 bp, Glycine max
  Soy_ogl_6740 Gm20:34305261..34307200 Cluster 1
gagatggatttcttgttggattttcgaaacctaataaaacctaataaagatggggttgaatttcatttttcatccttattttttttataaacctaaattcgtcctatattttgttaagagaaatagataaatctatctttaatctacgagttgtcattactaatagataaaaaaatatcttcttttaaaagaaacacactttatattatttcatatataaaatgagagattcaatataaatagggctacaatcaaaaacatgttgccaagcaaaaaatctagatgttgttgctaagcaattagcaactcaagacttgtctaaaaccaaattgcacactacattacacactacagttttggaaagataaaagacaacttaagttcataaaaaaatgtgcatgcattataaaaattatttattctttacaataaataagcaaaaatactaataaacgtaatgcgcatgtctttaataacgctccatataaatgtttgtccttggataattaattcaaaattctttgaatttaaatttaaaaaagaaaaaaagtaataacatgtatcacttcctaaaataaaattgattaaaaaattaattcaccctaaaaagattcaatctaatttaatatacaagaattgatgacgccggttactggaaatattccacacaggaaaatatttcttttacaataaatgtagaataacttttacttcaagaaaatgtatgataccttttgttattaattttatttttcttatgatattattataaaaaaattacagttttaaataattaatcatcttaagtgtatttttaagataatgatcacaatttttatttaatcctaggaattaaagatagataataagatatttataacaacttattctgttcaatcaattaaattaggtctctttagtataaaatttaataattttaaatttacggctggctgagtagtataaaatcattcctttacctgccgtttatttaagttattttctttaattttagaatattattaattacttcagaaaaataaaacaagagtattaattaaacatgtaaatgaaaaaaatagatataaaaaattatatatgaaattaaatatagcattaattatttgataatcgattaatataactgcgtttttttggtggaaaataaaactgtatataaaaatgtatgtggacgtaatttgaatttggttcaaaaatttaatttggttttcattttaaatcttcacaccgcaccattttttaactttaatgtcattttgttaaatttcaattagattcacgtttttcttgaaactaaattgttttcttttatattaaaatttattgcatttttatactggtgggttgataaaactagcttataagttaattggtagttgttagcagattgaattcaatatatttaatgagaatagttcataaatttcaaatgatataaagatatataattagttatttgattaaaaaagtaaaaaaaaatcccgagtaaattaatgaggattaaaaatatttaaaaaaatatattttgtaagctattttattttgattttgataagttatttgaagttttatgtgaaaataactaaataagttagaaactactaaaataagttcatgtgtcaaataaaatttggacaaactaacttataagatagttaaatgaatttataagctatccaagtgtcttaccaaagacactctatggtgatgaattattattttattcatttaaaaattgtatatgtgaatattttagaatttaattgaaatattttgagtttattatttttgtttctaaattttgttggatttttatttttagtccctaatgtaatttttgacttgttaaagttcttagactcttttttttctgtcatcacttttaattattgcatagtaaaattgattttgaaatgatc

SEQ ID NO: 416 - DNA, 2480 bp, Glycine max
  Soy_ogl_5158 Gm15:48311621..48314100 Cluster 1
caaggcaagttcttcgaggcaaggatttacatcccaactcaaaaccaaaaaacgtttttaccagctgggaaaaacttgaacttaaccatagttaaaatggattttctccattaaaattcggtcatgccaagattgatatatgtaaattcaaatttaattgtcgtatttagttaatgatgttttatgaaaatatttaattccatcaaattagaaattcattttatcataataatttgcataactaataatattctagagtgtgattatcttaaaagacaaataataagataaagagtactctcttttctcttcggtcctaattataaggtataaataattaattcacaaaggttaagaaatttgattaatttaatttagagtattatatttgttttatattggtaattttcttaaaaaaattattcctataatcaaaactaacattaatgggttatattgctctactacattctaaaactgatgttaatgaatggtatttttgatatttttgtaaagaaattaactaatacatgaaaaattatagattaaaccttaaaaagaaatcaaattatatttttaatttgaattttataataaagaccagaaaaaggactagttaataagaaactatatattccaacttactagattttgagttcaaagttataaatatgtggcaacattaaattttataaaaggaaaggttttattattcataatatctgacttcacacattagttatatattcaatgtaatgtccaaatacgagtcctcttaaataaaaagtaagaacattgaagacacatgttctaatagttgtgctaaggccaatttattgcgatattacccagttacaacagggtgtttcgctgttgaatttttttttcacactttcaaatgaaaaaataaatgtacgatacaaaaagaattaataaaacaataccaatttttttttaaaaaaaacttcaattatgaattctgaaattaatttacatatatgtttcaattaggtctaaacattaatgtgagattatatcaattaactagtgattttaaatttgactttaagtatgtaactgcattaaaaaataaatatataaagagaggagattttatcggccaaagcatgttactattgtgttcaaatagaattgtctctcatcaaaaataacttgtgagctttataaaaaaaaaatatcaaaattaatgttatcaaactcaaaaacaaaactgctcgatcctgtctgtaaataattgtgctgccttctatgcacctaaagagaggaaacaaataataggcaagaaaaaaagggcagaactaaggtacaattgacaaattgacaacaagaaaaattaaggctcttggattggacagtgaactatgctaatgctgcaagtcaatgaaatgtactactactcttgtcatgtgttattccctctcttttctttcatttattataagccacaagcatatctggcacaatgggatttaaacatgggcatgcaaattagtattcacaaaaggaccaaaacaatgatatggtataatatctagataaatgagtcttttatactccatttggtctaattataagaagaaaatatatgttttatatttattaagaaaattaattaatttcattaaattatattatttttaactaaaaataatacatttttttaaaattattttccactgaaagttgatatcaaatataaaaaagtctttaatcttattaaataaaagacaattttattaaataaaattttgttagttgatatttgtttatatttgagagaataaataaataattttttttattgcttatattaaagaccagaaaggagtatattattcttttgtaaaattggtcttttctttctattgtatgagttattcaatgaaatcctttacacttattttggattgaactacatattaattttatgtgtttggcatttcaagtgtgtaaacagactcacctaaagcttgaaggaaattttctcaattaacagtaggtttcataactaatctctgatgccgaaagatcaaggataacgatattatcaagactgtccaaatagaacaaagatcattaacacttctctacagacttaattggtcttatgttatataactaatttatactacctagtaactaatctactactagggaggaattaatgaaaagtttgaataattttaataaaatattaaatttaaactccattattgtcattatttaacagaacaaaaaaaatactatacggatatatttacaaatacggatctgttgagtatttttatactccctcccattataatttacatcctatgttattttatataggtgaataaaaaaaatttattgtctaacattaatattataagagatataaattaaaaaaataattaatattatattaaaaagtaataataataaaaattttaaaacttatttttttcttacattgcaat

SEQ ID NO: 417 - DNA, 2000 bp, Glycine max
  Soy_ogl_93 Gm01:3817201..3819200 Cluster 1
tagcatacaccatgaaagtagcaccaattgtcttccccaaacgacaaaggaaacaactattgtagtacttactcttctggtgactacgaatgtgaactcaatggcaatcttcctagtgtcggcatacaagtcaaaatgaaaaaaaaatgtaattttattataatgcacttaaattaaatttaacacaaatatatgataattaaaattattcttacgtacgcactcatatttatattacgtactaacttttagttttttgttttttattacaaacttttaggtttaaatatagttttgatttctttattatgattaatgtataatttttaattgaaatttagtctttaatgattttcaataataataaagttatttattttttaaaaactcagtgatagtaattaacatgtccaatggtccatgatttaccaattagtttaacacaattgatacataattgagttttttaaccattttgacactgatttgatttcttgatggtgtatatgaaaaaaaaattattgacaaatataaaatttacttcaatgataacttatttattgattagtttcatgagggtgattaaaggaatatctagctttagaaaaaaaaaaaaaacacccatgatttcgtcatcataccttacgtgggctttaggcaagaagtcttctacaattagtaattagcacagtgacttaagccttaatatatggtcaagtcttccttcctcttcttctgtatctgaaccagaattctcaacacacacattaattttgttatccccaccatcgttttcgctaaattagaatcttgctcataatggtttgaagtttgaagaaactctcactgaggataaaagtaagagaacctcaatgtacagaaaattgtttaagggtttttcgtcaactcctaaaaataaaatagcctctttctccatgtgcgaatcatcacgattcacgaccattttttactcactttcaatttcttgtttctttgctctaattgatctttctcgcaagaaattaacctcatatgggctagtttcattatttgtgatcctctctatacgccatacatatatacacaaatgtcagtatatcttttgtgaatgttaactttcatcaataaaaaatcattgttcatttaaagttctcattaattaattatattaatcataaaaagaatttatacaatttaaagactatttgctgtacttcatcaattaattttacttttatatataatattttttacacattaataaatgtccattataaaaaaaatatacttataaatatttattttatttaaaattttatatacaatcactgaaataatatcacacaatttgaagattagatttattaaattcatgaatttgattcacaagaatcgagtaattagttgttttgaaaatattttttgaaatcaattccataatacttaacaataaatttctcattcaaaatctactatgttttgcaaattatttccaaaaaaaagtgttttataaacaaaaataaaaaacgagatgctattttttatcttcttcttttttctctttaagtgctttgttcaagttttcaggaaacaaatgtttacaaaacagaaatctgctcagagaatagatacttttaaatatatgctcaaagaacaaacaaattttagaaaataaaaaattaattttgaaaacattgaacacactagacctgagtttttaaaactttgtcttaataaagtataatatattatttttttcgttttttaattaaatttaaagctttatctagataacttgcacaattttatcccaacttatatgcattaaacaagtaaaataataaataaaaccgtatctcacaaaatgaaaataaaaaatgaatgatgtgttgatgttttggaaaattaaatgaaagggggatttcaatctacaaactagcttttggaggaaatgaggccgttcacttttgactttcaagtttcaacacatctaacacttc

SEQ ID NO: 418 - DNA, 2589 bp, Glycine max
  Soy_ogl_381 Gm02:4709533..4712121 Cluster 1
taatctaatttcatgtttatgggagagaagaaatgattgataatttaatgcttagaggagataatctgaaaatttaatactggaaacaaaagatgggggaaaataattattttaaaattaaataataaattactacaatatccttaatgtaatcatactaaaaaaaagtttattggttatttttcaaatattcatggagttagtcgttaatgtaatcatactaaaaaaaatggtgtgagtccattaacattcccctttagttttttttaacattaagggcgagctttcagtgtttgaatattttaaaaactacatgagtctaaaactacatgagttaggtgatgatattcttcttttcttaatatatacagcacaatttctaacttgctaaataaaatataggagtgcaaaaagcaacaactcttatatatacacaaaactgtggtattttcttccttctaccaattacaaacagttgctgccatgcaatgaagtccaagaaatgaaatatcatacctattcgctgcattactgtgctaaaaataatttcaaaagggaacattaagaacataattaatgttttggttctcctcgacctgcaagcatagagcaaacttgttatacgtacacaataacccaaaatttctttagctctcttttattgtaattttccggtgaaacactctcctagcaaatattgagattttcgttaggttatatcagttccaaactatgcaactccaagaaatcatacgtgtgttagattcaaaaactctataaactacatcagtttacatttctcccttaccatgaaccatgcatgtataaattaattcatttctaatatcaagaagtcttttctgcccagtgatatttgatggctttgcattaagaatacgttgtcaaacctactttaatttgcctaaagtaatctcccaatatagagaaagtgagaggaactattctttgaaatctagaattacttgacctttaatggagcatatttggtctccagttaattaagcaataacatttctcctaccaaccatatataaaaggttatcgcaaatgtcccgcacctttactaaaattacctaaggtatacgaaagacaacccaaaatcttactatactagagagctaagtctagcaattcagatatatcagcatatatagctcaattttgtacccacccattgttggatatggttcaccatctcggcttatatttgtattgacattttaattgtggtagagataacaaagggcttaaagggcatcttagaagtaagtgtgtgtgagagaaaacgtatataaaattaattaagaactcagaatcaattaatataaaatccagcatgcgaacattgaacaccaaaattacgttaactagcattttaatgtaattttcaattatttaatatgatattaattacacactcatttttaacgcttaaaagcaccaataatgcataactgcataaatgtgttgcttatttgaattttgtgatcttataatttcacatagatttaaaccttcataaaaatttactttaatgttaagattgctaaagtatgtctataacttaattttatagatttcacaatgcttgaaaaaatattatttatggtataaaaatgttttaaagttttgttaactagtactcttaggagattagttaagaaattaaaacaataaaatatttattatgaaaatcataaaataatataaaaaaagttatagacaatataattttacgcatttcaatactattagttagttatcttttgttgatgttttaagcaacatttgtttgataataatacttatatataagcaattccataacatctatttcaattaaaaaaattaaacaactcatataaaactccatttggagatactctctcaacactatctttttgaaaacatatgttaaagttactaatcaataatacaaatatgcacttattaatcaaagtttgacattttttttaaaagacttgtagtggaatctccgtgtatctaacaacaaaggagctcaaatatacttcatgatgctaactagctggatgttatcgtctccatatccacacttccaagaaaaagttagcttttataacaaaaaaaaggaagagaaaatgaactttttgatagtttttattttaattatctgcaatatagagatatcaacaaactcttcctagactcttttcaagacaagaaatatcattgacaaactctttaatattctctttttaatattttttctattattaactattttttgtggatcttatttatgatttagtgattatttctccaaatttaaaaaggaaactcacaaaaaaatttgataatttttaataaattttattcaattatttaagttttaaaaaaattatctaaaaaataagatgtttaacacataggtatttgatgattcagtagcaagatgtaaaagtactagctgtttcatgttcataataaataagtacgatgaaatgtgattaattatttcttttagaggaattaattaattatttttagttagtgtaattttttttttatatttaagatcacatgaag

SEQ ID NO: 419 - DNA, 1757 bp, Glycine max
  Soy_ogl_467 Gm02:10018301..10020057 Cluster 1
gagtggggtcatgctgatgcataggtcgcagcagtgcgttctaattagtgaagtctctttgtaaccgcaaacaagtttggagttgcagagaactgcatgccctggctttttcttgctgcctcaatctcaagggtcaagacaataagattcctttcaacactcaagtcaaatacttactcattacaccagttatgatattttaacctttttctttctcctttcatgtgctctttttctttcaggaaattcaatttatacaatcatttaaaactaaaagaaaaaaaatatatataataaaataagtaatacaataaagcgatatatttgggttatattgcatgtttgacaagtattttaactaaatttccttttacttgatgaaaagttttatttcaccattcatgcaagtttttagtgttttgtgtaaacaactattttttaataacttggaacagattttgatattctgttttaagtagtgttttagtttccagtttttaattcttatatattttattttttttcttcttttttatctttgaaatgatatttattaaatttactttatacccttttatataaagtatagttttattactatactaatcaacataataaagatatgacgtcaatttatgtgttattttgattcattttaaatttgattgagaatactttaaaatataatataaggttaatattataatttttaatcatacaacaaaattaatttttattttaaacttggttgataatattttaaaatacaatgtaagattaactttttttattcatacagcaaaatgaaaatttatatgaatcatcaacttttaattactagctaatgtttttaatcttttattttttactcattttttaattacttttatcaaacatagtcttataaaaaatattttttttataatttattataaattattattataaaaaggtatttaaataatactctctctctctatataaattttaaactttctacatcgaaatattttcttagagtttagtagtgatgtaatgccaatataaaataatcatatactgatagtcaatcataaatcaatgttagtataacttagtattcaccaatttttttataattaattttcgttgaaaatcttgaatgattacttttagtacatttttttcataattatatttttttctatccaagatatttgaatttaaaaacatgtttaatgagattcatcttagtttcactcgactcaatagagataagatagtacccagcctctcaaactcaactataataacatgaagagattgaagaataaagtttttaactcggcccaatggagtccgaggatataattataaatataaatttatttgatttcaatgctcctaaaatttttagtccatattatatatatgtactttttttcgttgaattattatatatttgtacttgcaccacctaaatttgactttaactaactcgtagaaaataacatcaatttgatttaaattaaaaaattatatttagtgtttataaatatgatttttttaaaaaaaaagttgtcccttttaattttgtaaattttaagatttttaaaataatacacatcatcacttaacaataattatattatgttttatttatacattagaaaattattctgcaatgatatgattatacgtttgtcgtgatctttaagtaatgacgaacattattttaaaaaatttcgatgttcaaaaacaaaaaaagaactataatg

SEQ ID NO: 420 - DNA, 2200 bp, Glycine max
  Soy_ogl_533 Gm02:13817501..13819700 Cluster 1
ataattttttctgtttacgattgtaacgttttttgtccgtaaaaataaaaaaataagtgttaaaaaatttataacaattcacatattttatttaaccaattaaattatactttattggttgtacacactcccttgagatcttttgagatcttttgtgtatatataagaaaaaaaatcaaaattaaataaatatcaataaagaaaaatatttttttgagttgatatatgcttaattttttttctagtaatagatcatatatctagttttacacataaaactaataataaatatttttttgttaaaattattatttattaaaaattaaatatttaaataattacataaaaaaatttaatctccttaatatagttttagatccatctccgtccctagttgtacgattgtaaagtaggtgccaccggtaaagagaaaaatatatacaaaaacattgaagatgctatttggcttatatactaaaaaaatatattgcccataatttctacttgtagattcttaaaatcaaaacaacagttaggatcatgtgaagtaagtaatgaaaaaggtaaaaaaaaaaaaaaaaacacacaacgtagttttaatggcaataaggttactatctacctgtacatatgaaatggaaaattttacaattttgagaacacgcaaaactgtgtttaattttgttaaaaaagaatcttatacaaactagctgggcctacggtttgaactgatttcctttttcggcgtgtacaattcgtacaaacttgggataaatggttatttcgttcttaaaaatatgtaatattgattaatttatttttaaaaaatgaaaaaataaaatttagttttcataaaagataaaaaaaataagacaaatttattttattattagctttcacatgttaacattagaaaaactcatcgacataacatccaaagatgaaaatgtcaataaatcattaaagtggaaatatatttgtcaataattataatctttatatttaggtgagcatcaattttgtaattttttatccttgcatatcatataggcaaatttcataatattaacaaaaaaaggttaataataaaataaatttgtttaacttatacattttcaaaaaattaaattttatcatttcattaaggacaaatttatcaacctaacacatttttaataataaaaataattatttatcttataaagttaagaggaaagtttgcatatattaattaaattaaatttgtagaaagatggtgtggaatcctaatctcaactactactatcatatattgcgcgtgaaatccacgcgctgagcatttctcaacatcgttctagagataaggaatccaattgtgcagtggaccccactttcgacattgccccagattacgtctggaatattgcacagaggagaaagatgcctctttttcttttctgttcgtattttttattttttatagatcacacatatttttcgtaaaaaataattttatttcgattaaataagattattgatcataacaaaattattgtttcaagtatttaatgtaatttaatacttaatatttgaattcaagatatctaatcaattttaacaatcttacaacatttcgtgcacttgtttttttttatttattattgaaaaggacaagcttttaccaccgttagattccagttctcttccacagaattaagaatctctctcgctccacaaaatccccttttttaattaatttattatgatttggtttaagattcacacctttattactatttaatgtttgattgaatttgataataatatcttattcttatcttaagcatgcagttttgaattgttcgctcccatttcccgcatctccactgcttttgtcggatgcttaccatcaaagaatccaacctgcaaaaaagaagctacaaatgccaattttcataaataccctcataacatgcttatatttttttttttttactatatccctcatttattcatctctttctattttgtatcctaaacaaaccattgtttttacatgtttgataccgttatatgggtattaattttttttctagaaattattaaatgttgtaaatactaaaatctaatcaatacccggtgtcaattaattctcacatcaaattgacaaattgtcccgtattatattagcccaaattatccaaaaaaattcaaattttca

SEQ ID NO: 421 - DNA, 1900 bp, Glycine max
  Soy_ogl_613 Gm02:42793601..42795500 Cluster 1
atgtataaataagattagtggaatatccacatgttatggagggggccatggccccccttgaattttttttctttcccgtaatgtatgtatggacgtatttaagtgacaagatttgtagttttttattgcttgcagaacaatcgtagttatatgactaatttaatatatgtagaactaggatacatgaacgtcacacataattatagggattgagtatatatatgaattgcactaacgtgattgatgcatacataattatgcattaaatatggattgagtaaaaaagaatacaatacataggaattacaacgtcaattatagatattgatttaattttatttttttatgtttataatttatgaaggtaacaataaagttgtaaggaatttagtttttatctcttgatttatttttaaattataaatttaatagtaatcttatttaatttaaagaaatcttatctgaatatatttgatggaattttagttattatataatcagtttttatcttctgattttctgaaattataaaagtaataataattttatcttgaataaaatatcttatttgtagagatatgaaaaaaaaccctgtttttcttatctcttgtcttcatctcacttataagttcttataattttatttgaattttataacattaatatagttatttttgttaacgagttttccaagttacactttgttgttgaaaaaaggcgaacactaaacaaattaggagaattaattgctccttgtaaaaaaacaaaaaaaaaaggagaattaattgctggccgaagtcaagttggaaagccacaaatcttctgtcgttttcattttttgttgttgtaattttgtcgtttacataataatgcattctttatttttattattggaaatatatagtgtcattaataactaagcaacccatcagataaattaattgaacaccatgtcaacggctcattttcactattcactatttatcattgcctccattattaagataaatgtgtttacttaaaaaatgtctggaactttttgatttgttttgcataactctcgtgatagtgggttgatcaaaataaatctcgatgaattatcctccttgttatcctgtaaaatgcttaaattagattaaaatatgcaattaattttgtttgtatcacacaattttaatttttttattagcaaattattttaatttagtctttatataagtgtaaaatattttttaactaagtatattcttagtccctctaaactttatctttttttgttataattcctataagtattttggtctatctttaattttttatttatttttcatcatcaatattagtctctaagagttgtaattttcgttttttattttatttttagttcctcctaaaaattaatattgatgacaagaaaacaatgaagaactaagaatagatataaaaagttataaagactaaagctaaaaattttaaattttttagataaaaagaaaagcatatttaaccaattttttttaataactcgttaccttttagatttataacgctgtcacaaggtcatatttgcttatttatgtggctaacaggtgttgacctggtaatagatacatgttaatagttgaaacatgcattgatgcttgtttgcattatacaatcttaattttgcttcttatacatataatttctttaatttaatataatgcgaaaattttcaaaatctcacaagttaaatttatttttaatttataatgaaaaagtatacaaaagcatagtataaacacaacatacaaagatcactaatcatttgatgttagattcttctaacttaatcaaatgtctttaatttgaatcttgcatatatatttgtattaaacattcaaataaaattttattcata

SEQ ID NO: 422 - DNA, 2000 bp, Glycine max
  Soy_ogl_997 Gm03:40436701..40438700 Cluster 1
ggtagagaaatgctattgctcggatcatacaaaatactgctacactgcacatgcctaaaggttagagccacaataatgtaaatcacagtcaaatcattactgtacagcataattccaaactgcatgtaatacagttcacatcagttggaaactaattattaagccatataaatagaatgcatagtttcagactttcaggtttgttgtataaaaataattttttcttgttcaccgaaacagatcaaataaaattatattcatggagctttgttaatagaattttttttttcacattctgtgtatatactttgaaaaaagagaggtaaaggaaaaaaaaatagatgtaattaatgtgagagaaaataaaatatatataagatttttttttgcaaataaagaaaatataagattagtaatgtgaaaacatcaagataataaaacaccatttataacattctataactttgcggtttgcacatgtaatattagacctatcacccatgcaatggacttctagtggcaatctcaacatgactctgtttcagtaatattgaaggtgtttttctattctattatacttttataaaaaaaacaaattctttttttttcacctttttattcaaccaaaataatagaagtaagaatgtaacattgtttttttattttttctttttcttttacatcaaataatagaaaaaagaactataatttgtctcattttctttttccatttccttctctcctcccaattagtgtaaaatttgacaaaccgtctgttttctaagtttttatgtataaaattaaaaaataggataagcaaggaacacgtttatttgctgataaaaaaatgtttttaatgtaactttaattaagtatgttgaaaaaaaatgtcatattatgcttatgtttttattttttatgcgtcgaatatataattctggaaaagaattatataggttgataagtgataatatgtatttataagagtatgtgttattgacggtaacatttgtaaatttttcaaaacaacacagtacgtgaacttaataatttagaataaaaaaaagagaaatgttacacttattataattttttacaatatttttataactattttcttcatcccatcactcatcttgttcaatacttctttctatctttttcttaaattataagaattttatttttcaaaccctaacgtcatatcttatcaaatctttgatttttttttatgaagttttcactaaatttcttactttaaaacttttaaaattattttatatctcgaatacatcataaactattaaataataatttggatagaaaatgataaattgagggttttgatcgaggagaagaacattaatgggacataaatttgttaattttaaaaacaaaggaactaattaacttaaaaaaacagcaatataaaattttatttaataatatttaaatttacttaattattactgtttattgtaattattcaaaaaatattactttaaagtataaacaagtcaaataaaacagtattatttttagagaaatatatacacgcaacaaattataaccatatgtataataatgatgatgaactttgtcctggacttctctttgagaatttggacccaatttgacaaataagtgtatgctgaataagtaaagcacatcatttggaccttaaacaaatatgtcatcgaaaatcgtccaatggcaaataaacaacatttaagtataaaatcatggctaactatgttagaggtaataattttatttgaatttctttttatcggtagaaactgaacataaatattaaaaaagttataataatttgcatatattacttaactatgcagtaacctactaacagcacgctagacccttcatactgtctcacgtaaaaaatactacaataactaatcgaggaataatacaaataaatatcataatgtatgaggtattgtttctaactttaatcctttataagtttattaccgaaa

SEQ ID NO: 423 - DNA, 2164 bp, Glycine max
  Soy_ogl_2181 Gm07:4316638..4318801 Cluster 1
ataaccatggttcatgtctatcgtccactttcagggtttcggtcacattttttccgttgctaatttggaaaggatattttcttgcttctacaattgaaatgtctttatctttgtctttgaaaaaacagatttaaaagaaagcatataactaatctgccattaatttcaattaatatttataataataacttggagaattattcatgtagtcccaagtcctgtacgcgtattagttaataattaatcgaactgatgtcatgatgacataattatccattaattgccgtatagatattaaatggtctgcggctctaacagcttatctcatatttatttttactttttcatagaaaataagaaaaatcttcatcacatacatatgttgaaagaagaatattaattattacttagtactagtacttgtttttatccgatcatataagttactcgccccgtttcgttataattgtatttttataatgtaatatttattatttttattatatttttataatattaatgacgagtaataaaatttataaataaataaattttataaaattattattctcttttatttttttattaattttttttatctttataaaataatctgacaattattttgagacaaaagaagtatttattttcagtaaagtatgtattaattatgttcagaattaattttcaataaattcttctttttctattatacttattttatattcataggtcttgatttcaatattcattcagcaataaaaaatggtattgaattcaaattttaaattcaaaattcaaaagaaaattaaaattttactcaacaaattcaaattcaccatttttaatggaaatttaaattcacctaaactaacataatattgctatattaattattatctttagattaaataaaaaattaaaagtatataaaaattttaaaactaaaacagtaaaacaaattactacatttaatattaaaatttactacgaaaaaccaacaaattaaagagcattaattaaaaatatacagtaggttaggttgaagaataatagaatacttggaatgagagataaagatgagaccataaagatgtgttttttttttttttgagactataaagatgttacatgagaaaattaagacaataggattcataattttgagctcttaagaaaaagatttgtaattttgatatgagaaatatatgaaccgtgatagtctattaagtgtgaactcattaatttttataatagtataagtaatataattttaaattttctaaatatcttatataatgtattttttttgttacattattataatgtatatgtgtaggcatgggacaaggtgtatcaaaatattatacacgtattcatccttttaaactttcacgagtaaatattcttcctcaaatttagacgtaattaagcttcttttttttatataaaaaaaaattatacatatttaagaaataactcctctctatcaccgaccaatattttttagatgtattaactaaatgaaaattcaattaccatccttattatttgatgtttaattttgtcgtttttgaaaacagcatatacaaataaaatgttgtttaagtttaaggaaaaatgattacttctctctattttattctctacatattatttgagattgacaagaatataataaaacaaaaacattttttaatcattaataaaacaaacatataaatcaaatacatataaatgtttttcttctagtcttgttatattatcttgatagtacacgaaaaatatctaattagatattaatttgcacgttgccattattgtcgaaactagatcatatggactgtgaaataaatttttattttctatttttaataaaaatagagtcgttatcaaaattattattattaggaaatatcctaaaacatggtatcgagcctaaagttaaatgtgctaaaccagtttgcggatttgttcagaaaaaacacacttgagatgagattttcatgataattaaaaaagaaattgatttaaaatggcaatgactaaaccttttatactttttcttataaatattcaattttaatttaagaataatcaaacatcatatctaattatatctccaaaatgaaaaagcaacataacgtcatacatattacgcatt

SEQ ID NO: 424 - DNA, 2400 bp, Glycine max
  Soy_ogl_2268 Gm07:7940601..7943000 Cluster 1
ctgtaaatgatttgcatcgaaactggccaatcttagctatatgttgcgggagaagttggttaacagagaaacaattacttaagtcttagtttcaattaagagttaagttatgtacccaatattttgtgaaaataatagatcttaaacattattttgagttcaagttggatatagctttagtttgtcatgattttgatggtagctgagagttgttgcctcaatcttttctgttattggttttaacttttaattctgtttcgtgagtacaggctgagcaatttttcaaataaaaaaattagctcttcttttttcatatttttttaaacatcttgtttcaagaaataaatagcttttccaaaatcttgcttttaatctataggctaattttaacttataaaaaaataaaattaatttttttcttcttattttttttctgagtactaacggagaaaattatccaattaaataatcaaaaagtgaaatattgaactaaaatatgatacaaatgacaatatttattaaaaaaaaacttttactgtgatgatcaaatattttgacttccttaatataatattttttataaaaaaaagttgagctattaatataaatattataaagaatatatattacttcatattaataaaaaaaagttgatatatattatcaataaattataccataaatatttttttatatataaaaattaaagatacatacgtatgagagattataatagcatgttgaactaattagaaactcataatatgccataaatgcattacattatatcgttagtgtaaatttataataataataataatttactcttcgttcgttaaaaaaaaaaaagtgatacgaacgatgacattcctaacacccaaaggtaaataaatgaccttttattcagtgaaatattgtagctagaaatacattgattgatcggtagctgaaatgtgtacattatgttttgcagttcaatttttatacataataaataaacatgataggagcaaatatgtattggaccaaaattgtaacaatttaattaagcattactcaacaaaactatttgatttatttacaaacatgaatatgaattttactcaaattgtgtatatctttaaaagttttcttacgagcaagagattttttaaatggaacacaaaagataattcgattattataaagccaagaaatatattgaatcgcatattcactttctttttctcaactaagtgatttatcacaggaaagaaatctttactaatttaaaattcgatcaagaagtaagtaaaacttaatcaaaaatgctttctattaaggatcaaactttaatactacttaaaccattcaaccttaactttaatatactaaccacttatagtcaatcacttgattgtttattgactttaacacagcataaaaaagtaagcaacaaataattgtaattaaattttaacaagtacattattatttaaacattgaatcactcatttgtttatacatttcgtgatccaaatagttcatttaatttatatatttcattacttttttcatcttaaaaaaagtgtttttcttaagttattttagatagtatatgaagaaatggagaaagtaattaggggtgtaagcaaatcaattttgggttggatttggttaaacttgtgatccaacccatatacatgataatacatacacacatcctaatacaggtattataacactaatttgcagaactaaaagttccaaggacaatctatattcaatattttgaacaataaattgtaagcatcctctatttctagggagacctttcgttagttggcttcactgaggtctgcaaatcccacattctcttttagcctccttaaccttccaattaattcttcaagggaattaaggtcatcactcgcaaaccatctttttgaagagcatttttctttgacttagagatatacttgctctccttgggcaatcacctcaatagaatttgatttgataaatatgagaacaaatcagatgaaaacagtactgtcattccagtcatgataacagtcttcattgtttggtttgcaaaaaatagagaacacaactaaatattccagatgttgtatggactacaacttagagtatatttggaagacaaatacttacacaacctgaaaacatgaaagttgctgcatgaaaaggaaaagacttggtctcgtatggatgttaaaagtttccacagtcaatcagaaatgtatttgtcattgaaatcttaaaattttatgacaatttagtagtctatacctactgaagaagtggagttatgtaggcaggaacacaaaaaagatcattatgcaatgaatattggaacaatggttgaaataacaagttgcaaacaatatttgttgattg

SEQ ID NO: 425 - DNA, 1608 bp, Glycine max
  Soy_ogl_3130 Gm09:36527101..36528708 Cluster 1
tttataattttcagggtatccagtaaaagcggacttgaatcaaatatgtagacaacttgttccagacgaatttattttttttttactattagggatgcgtttgattaagaggataaaaaaaagataattttttgaattaaattaatatataaaacatgtgagtctcgcgtaaaagtataaaatttctctctattattattttaatcttccaacaaacacaactttaattatccttattcttcctctgtctttgattatgtgtgtttttttcttttcattattatttttggtacttttatggaataaaatattatgaatatggatatttaggcttttttttttacttttttttctatcagattacttatcagattttcctccttccatttttcacagcaaaattgagatataaaaaagaaaaataattatatatcaatattataaatttattttaaataatcatccaactatatatcataaatttattgatttttaaaataatatcttaaagtaatttgagtgatgtgtgattaaatgataatataaaattaatttatattctccaaatatataaattaaactcatatagaaaaccaaatatatattagggagtgggtattacatacattttagaatttatcccttgtatattactagatacaattttttcagacattttattgtataaaaagtcatgttataaaattaaacattaatcaaaggcttatagtaatattattttataaacaaactaattaacagactttgacatcgtttgattcaactattgcatcaaccttaccatgtatatattcctttgtagttgtgatcagtatattcttatagacaaaccaagtagaattagtctagtattagagggtccaaatagtttaattaaggttttagatttaaactatactattattattgtacacataacaatatattcttacagatattatgactcgtttctccgttattgtcgaaattttgaatttttttttttcaaagaatatattttactagtagtcatgcgtaatggcaacggacgatttttttcaatagcgtgaacttaacatagttttttaaaaaaaataaacacacaattaaaaatcaaaatttagtcaacatgtgtaaaaaaacataaaattcagcacaaattgaattaaaaaaataccaatatgcctaatcacagttcaaatccctttatttatatcccaaacgtatcttctacttgaatctgcattggttttgacgagaaagtttccaaataaaatataatcaattagcataaattataattttcatagagctagtcagagaccgcgaaatccacactaggaaagtttaataaaaaaaaaagtttgaaggaatataagtttaataattataaaatgtgaaaaagttaatttatctattttccacatcacatgtcttggatgtgaaattatctttaagaaccaaatttataaatgttgagtgattgtgattgaaaacgtagttagcaattaatctccagaacggctaaacgcactcaatttgcccatttgactttcaagtaaacagtctttcttccgtttcaaaataatagtggtactaaattgtaag

SEQ ID NO: 426 - DNA, 1647 bp, Glycine max
  Soy_ogl_3257 Gm09:42925101..42926747 Cluster 1
gaaactagaaagttcggtggagtaaatagcattaaatagtttagactttagatgagtcaaaaccaactttagtttgtgtataatttagtggcatgttctgaaagtcactaaaatccaggaggtgaagtgtattagcattttttaggatgaattgaatatattattagttgaaatttagaaagtttatattatcaagtatctaaatgtaaattgtttctaaattgatgtattatctgttaggcattcaattcaatggatcattataattttatttttagtaaaagacatagtggattgagaagagaccgtatttataatacatgttgccttaaaggatttgtttaaatagtgttataaagtttcacataagttaagaatcaagattaggaattgtttataaatattttttttcttcttaatttactatgatatttttttaagaataaaatcatgataattcatcgtatacttcagtggataatatcttaaacatcagaacttaataaaatttacaaacttgaggttggaacataaatattttataagtatactttaaacataataatttcttttaaaattatcacaaaaaaaagttgtgacatctgattcaattttaacatttaaagatatttttgcataatgcaagttcaatattttataattggattaagaatcatatggttatataaaatatatttaaaaagtacagtttttttttctcacttacgagaatgaatactaaaacttgttatatagagtaggatggatcattcatctatcattgtttcggagtttagttttcatatattattaatgtaaaactttctaaaaattgttaaagaagtagaaatcacttttctttgtatagcttctaaaataattattatgaaaaaacaaatgttgtacataataataaaaaagatgactgatgagagacaagttggtttagctcaggaaagagaagaggatagaagaaggaatgaaacaaaaaagatattaaggaatttaaattaggaaataagaaaagaagaagtgatcaatcttaaaagataaatattttaaaactaagaatatttatataagaagaaagtatagttcatatttaatcaaaagaaaaaataattaaaagaaatcgaatgtacaagaaaaaaaaaaaggaactctcacagattcaataactgtttttttttttacaaattaaataactgttctaatatagaaagtcaccaaaacccgatgacataaaattcattgcataaatatttttcaactagaaagaacacgtcgattaatattaataatttcccacttaattagcccaaagtccgcaaccctgtctcctctgccatcagcttctttgtctttttttttttcatgacataggttttcggcattctcgtatttaattaattaacgacttaatctatactaataataaagaaaatatttatattttgtgtccatgttttattggacaattttattcttaaattgtttcttaaatttttaaatttttcttctaatatatatatatatatataataacttttcactatttctatattgttagtttttttattcaatcacctttatttattaactgtatttaatttcaatttttttattatttaaaaaatttagagagat

SEQ ID NO: 427 - DNA, 3742 bp, Glycine max
  Soy_ogl_5051 Gm15:14837001..14840742 Cluster 1
atgattaattgtggaattaacatagagatagaatatttggtactacaaaacttgaaaaggattgtgggaatgttgtgatttgaaaacctagaactatattagaaatatgcttgatctaagaactgatgatgtgtgagtgtagaatgtttggttgaacttatgaaattactagattggttcttaagtgtgttgttgagaatgagaatggacttgaagtactatattagtttgatgaataatgcatacatgacattgcatgttgataggtacataagttgagagtaattggtgggctcttaatttagtgtttggggttttcgtgattgctaaagaggatgagcctatagattagaccagtgggcaaaatcctataaacataaggtcatgcaaaccttatagaggtaagtcattactcacacttgtctaattttgataataaaaaaaaacgcactgtctccacatgattagctcaaaggactccctaaatggtcgataattggaccgtggtaagggatgagacttatgggaaacgcctaaaagttgtagaaatccctatagagtcatgttcgcataacattacatgatgcatatgcataagagattaatgtgttaattgggattatcatatcatatgcttgaactgatttggaagtgaatgttttattcaaacttctcttttaagctatctcattatgcctttaccttcttatgatatgattcatttacataaacttacccttgtttttgtgcatgtattatgttgtatgattatgatgattgtgtttgacacgatataatatgatactgattctagagaagatcacatagtttcttgaaaatctagatctagaagatggactaggagtcaagatttctctctttttgctagttatatatgtatataatgttagtagagaccaacttaagactatgtgatagtcttttggattgttgtttttcccttaaaaaaaattcatttgaaacttatagtttactttcttagatgatatcttgttaacgctttaagacatgctataatattttagatatttctagtatgagctataatagaattatgtatgctataatattttagagcaataccataaatagaccgctacatttaactttaaactcacctctttcaaaataataaacccacctcattttaattgtaactttatttgatatttgagattgatcaataaaactaacttgcagaaaaaataaataattaaattaataggtcagtcagtacaactttgtgcgcagcttaattatatattaatggtcaacgcttacaacagttaatatgcatcatcgtgcttccaacttttaattcgactgactttttttttagttgtgttatttgcacaacagtttttagattaatttataaataatatttttatttctctattacatcattaagtatagtaacattcattgtacaaaactacaaataatatttatctctctttgaagtaacatggtgtttaatttacaatagaaaatataattttggatgaattaattttttattctttatttatattttatattttaatttggttttttaaatttaaattgtttattttagtgctttaaaatttttctgttacctttttacactaatttgatcaatttaatcacatatgacaaactatcatagatgtcatattagttaaaatttacacagttaatataaaaaattgacagaaagaccaattgctataacaaaaacattaaaaagaaatttatgataaaaattgaaacaaaaataggagagagcaaaaataaatatttaatgggatgaaatataaaaaaattatataaaatatatgttatataaattatatattttttcccaaaatgtttaaagccaacacgatctattatgcaaggattttttttttctaagttgaagttttagttatttctaattatcttttttgtaaaattgttatgactaaaataaaatgactagattttaatataaattattataaatgactagctttctaattagtagactaaaattttagattaaaaattttcaaaagttaaaagactcgtcaaaattctaaattcgaaaagaaagtagttaatgtttcttaaagaagatgtatatgtagtactaagtaaagtcttttaaattaatttaaattttggaaaactttggtgtcaaaacatgttagtgtaatttatttatttattttattcaagtaaatactactcttacgatttatttagggtaaaaaaaagctatattttttctttgttgagtagatttgctaatgaaattaaattatttttcataaatttgttcgatttaagatggtttaactataaatgcatattaagggctcgtttcatgtataatttagtagaattaattttgataaaattaacttcaaattttaaatataattgaaatatacatgtgaactttaaattaaaacatgctacactaaaaaattgatttttaaaatttctcaaactgatactaacaaaattaacgtccgttttcaaacgtaattgtgtaccactgttgacccgatgtacagtctcatttgttgaaattgtttgtacggaaaggggtttgcatttcacattttaaacgaattttgtcatttgaagaaataataaataatattagcagttttatttgaataaaatgaccaaaatattctcgagtcagtacgtattaaaacaaaagagaggaaaataaagtcaagggaaataagttgcgccaaagaaattttatactgagattttttttttatcagccaaaaagggattgcaacacatagtacggcaattataccgttacaagaaaagtaattacaatttgtggatttgttgtgtgtataatatatgtgatcactggcaggtcaaccaaagaagattatatcttttagcaaaacatttgtttaggtgggatagaaatgcaagattctcatataaaaaaatgaaaactatttctttaagcatactaaatacgttttcctaaaagatataataaagtattctcaatttctcatatatttcttttcatttttttatgagaatcttgcatttctatccaccaataaaaatattttgctaaaaatataataaaagattctcatatttttttaagcatactaaatacgttttaaatttattttttaaaaaaaatatgattcccaacaaacataaatttttaaagtattattttagaaatgaaaaaaattctacttaacccatgtctgataaattatttcaacattgaagctgtccatagattaggtgaagcaaaccgtggttgtcatattccgctattcaagtgatattattttatagtcatctttctctataaacaagagaagaatatcataaagccaacagaaatctaaacattagcaataaatgggcacttggaagcacataaaagagcttgatgctctgttacaaaacataatctttgtttttatcaaagaaaataatatgtttggtatgtggcatgtcacatgtgcataataaattagcagttttaattcttggtggatagcaaagaagacatcttctttaggttaatggatatcatttttaacaggaaaagaaaatgcaacttaagaaacaaatcaaacaagaacatacaacttgtattctatctttcttccttatattgtagttgtgaatcttctaatgaccctaaaaaagtaaattaaaaaattaatcaattaatgcaaaatattag

SEQ ID NO: 428 - DNA, 1760 bp, Glycine max
  Soy_ogl_5746 Gm17:37439901..37441660 Cluster 1
aatgtgaatttaagaattgaattattacatatttaagagaagtggatatctagctattcatcatactttaccatactaatagatatatgtaataatgtggaagtgtaatactttaatttaataggtttcttaatttgatattttataatgagacagcacaattcctcattagaatataaaaagacttttaacaaatattttttacatttttaattaattgtgtgtagatgcagcattagatgatataaaaagtttatacatacataaatagaacttgaaatcaatctagagagtaacttaatttctgtattggttctgaattaacctgatttaaactcggctttgttggttaattgtgaccacaaatatgtaagattttttcttcaacaagcattgcaacgacaaatccttcctgaattacaataacaatagagaaccaacattgaatacagaataaaatagaaccacttaaagacctaacataaaaactacgtttcattattgtgtacagtgcatctcgtagaccaaaatactagtgcaattttcctatttcaatcactaaacttaaaacaaagataaaatgagagatagtgtatctaagaatattggtgatgatgagacacccatgaggaggtttttctatcaaatgagaattcgtaatttttgtaatattaataattgaattaaatattagtaagatcatttctattggtaatgccaacatttcaaaagaaatatatattaaaataaaaattagaaaatgtttaaccaaaattatttaattttttattttgcacttaatatttactttttaagataattaaaatatgtaataaaatatactaaataatagtataataagattttctattgtgatatgacaagaaaataaaaatctttaaaaattatgttacccatttatttcctgctacgatgcaaaactagctgaacagggactttacaaaaaattaagattttttggtgggaagagaaagagattttaaagaattcatgtaataataataagagagaagagttgttgtttaaaaaaaaaatcataattgatcggttagtaaatgtttgcatgcatacatacatatgttgtgaatgggagtggggggaaggaagacattgttaaaacttacgtgcacatgctaacaaacgtgccaagtacattagttaagaaattaagagtaattctttttagtgaaagaggtaaaattgtgctcctcatgattttttttgccatcctcatttacaaattaaaaaatttctcctttgataatattttaaaaaaattaattttatattatatgtaataaatataataattcttactatataaatatatggcttaaatactttttttgatcttgtagtttagtatttttttttcttttctcttgaccctatatttttttcttgattttaattctttgcgaaacgtatttgttttattttttattcttaaaacattttagataatattattttattatttaaaatactatttgaaactcctttaaggataaaaaaatataatagacacattttacaataattaaaacggaaaaaaaattataggggcaaataaaatatatttaagcctaaatatattacattttattttatgaactagttttaaaaaaattgatttaaattaagaatgtgtgcattagtaaatactcatgagatttgttaagatgcatactccctattttttttatagtatgagtagtaagatataactagggaatgtc

SEQ ID NO: 429 - DNA, 2400 bp, Glycine max
  Soy_ogl_6182 Gm18:55083301..55085700 Cluster 1
catcaagctgaagatttggtttgactatttcaatgacatattgtgtacacatagtaatttattctacaaaattgagatggtctgagtctgactaaaaattattttaatcattttccatcaagctaagctagctataactatataatagtatatgcgatctatttgctttcttgtgaaaacatcgtaccaatataaatactttgatgtatcatggtaagcatttttttatcattcacggtaagcatacatattgattggtttagttagacaaaagactatgagtaaaacattcacatggggaaatggttgctattgcgttatagttaattatagaaaactagtggaagaaggaggcttaatatacagaataaaatttgaataaaaatgagaaaaataaaaacagttttagtgtattatttattattcaatacatgtttgcatttccactaccagtttgtgtctatgatgagtagttccttatattttctttagtcatgtaaacttatttgagtgtatgtatacttacttatttgggaaaatggatttaaaaaatgtggaaactaaatggggttatcatatctcttttattatagttatagatttaattagattacataaaaactagatcacaaacctgttcacagcacaaggtacaaatgaataacttttctttcaaattaaagcactatagtttaaatgaaaattaataaaatgccatttgtgcaggattttttttaattgtcacaagctgatgcatataggagtactggcagtttttattaatattactcaattgatattgacgaggtggtggacacagcaagtattacagtcacaatatgattttaaactctttaacatcacagtctcaataactgttagaaaaatagaaactatttgtgtttaaacaaatcccctaaaattgaaagaagaatcaatttccttgcctgcttgaaaagaagaagaaaaaatcccttttctcctgttcatggtgacctgcttttggccaagtccgtgttgccacttctataacttacagaagtatcactatcaggaggaacggtgccatatatgttaataataaaatatgttttccatatactttgagtaaaaactaataatgaacccccttaaaataaatataaaataatacggcaaatgtctattgcatgcaatagaaacttattcaccagagatatcccaacttcagagaaagaaaaaagaaatcaaaacatgctgggagtcactagatttctggatacttggactaggatgagtttgagaaggaatattaaagagattttttaatgtaatgattgatcttgtgaaaatcattcgataatatatatatatatatataaacacttataaaactttttattaactcttataatttatctaatttctttttttaattattatcacaccatattatatatctatctattgtatatttttctctctctctacgtacgtgtcaattagcatctaagtatcatttgaatgattttctaaatcattcctctctcctctttagttcaaactcttagaagttataattaatataatcatatgcaccacataaataattgcactttggcctaagctagctagcagctgatttgccgcatcttgaggtgacatcctgtagttcaaaacacaaatattcaaacttaaattccggcaagtaatgataattattgtggcattatattctaatcattcctaggtgttgatcacacgagtgggtgatcatggggcccttcttaaagaataatagattaccaccctgttggttctatatatatttttgtacagttagcataaattatacttataggcatgctaggtctaattacaagacactagtgagacaagcttagaaagcaattcaaagagtaaattcatgtatcttctatatatcatgtgctgcatcgcacgaagatcattttcctaattcatgtatcttaattgggaccatgttgcttgaactacctacatgataatgactctttgatatatacttaatagtggttacatgtttggttaatttgcaagtggttaagagagcaaataaggtcaactatttgtgatttatttgaatatggctcatcatatatatgttcgattaaactcatcatttgtttgatttaagaaaatataaatttgactattaattaaatgaatcaagtcaaaactttatgataactcgctaataacttgtgtatatatgtattatttaaattattataattttatttattacattcattaaaaaatataatttatttattattatcacacattttaattttcaagagttatatacaatattaaaaaaaatcttccattttcgcatcactaaaatttcgtttccgattttgagtcatcttatatata

SEQ ID NO: 430 - DNA, 2529 bp, Glycine max
  Soy_ogl_6420 Gm19:38436072..38438600 Cluster 1
aaaatcttaaaaaatacaaaaaaaatattaagaatttggattgaaggaattcgaattcattttgaaaaaatttaaaaaaatcacactgtgaatttgagtctccaaactcgaatttacgctgaaattttgtatatttatgtatatatttgttgaatatgtatgttttatatatttgttatttgttgtatgtttgtctgaaaaaatcgtggttaaggtcccttgtcgtagtgccacgtgcctttatcttggttcaccaagctgccaagtgtcaaatggagatatagagtagaaagtgactattccttgtccttttcattaatgccattcataccttgggaactgagaaggcactttttaatctgagtgggactctgggagtcagataggaagatggaacaggaataacacttcacctaaaaaaataatccaatcaagaaaaatatgaaatatgtgtaacaactcatcacaatataagtgattatagtccaaacaaaatttaacggttatagtttaaatcaatagtcaagagattttttgttacagatttaagagaacatttaaatataacaagtaggattttgagttgtgataataactttatagaaaatgaattcattctatttggtttcaagaaaaattaggaaaaaccataaactacgctactatatattcttttatttggttaagaagattaaaaaataatataattattttctaaattattttttactttgtttttaattcaaaattcattttttttctttcttctttaaatggaacgttaaagttaactttatattcaacattattataatgaaatactcccatatggtaatttctgtaaggtcctgttaattactttttcttgagagacgctacttatagtgaaattgtattgaaaattatgataaaaatctattattttttaattttaactaatattttaaaatcaagtgtaaagacgacatagattataataaaaatgttgttaaagagtatatgtatatatataataatgtgttaacttttttgtttatatttttttctgataaacagaataaatttattaaagacgcaaaaatatgcgtaaaatcagtacaaaagtttcatgaaacaaaaataactacaactcaaaccttataaataatatccaaaatttaaacactttttttttttagtttaggaaagaaaaaatcaatgtattccataattgtatccaaagtctgtacattatccaaataaataaaaggagcaatctgaattggatactcctcaatctaactgagctacaaggttgtccgtacagctgatgaagttaagagtgcaagtgtagtacaataattattgagcaagaccttgcaatcttccataactctggcaatagtttgtcttacacaatttgagttgttatactaacaggataaatgataactaaataatcgttcttaaatttgctaatcttttctgtatatgtgaaattgaattatgggcagtgaaaccaatcaatgataagctatgtgatatgccaaatgttcatacaggaaagtacgtagcactaactatttattatattatatttaaatttaaatgtaatattttcttatgttatcaaaagataaaaaagtgtgacaattttttatttgataagttaatattaaaaaacaaaccctttatattattgagatcagcccactcacgtgtgtgtgtgtttttatgcaatacaacatctcaattttcagaattgttaagcttttcgaattattcgttttgcatggtttcagtttacgaattcattcgtttatactattgttgtgttgtggttctcaattttcaggaaatggattttctgctgttagagagagaaagtaacaagaatccagagaacaaattaaacaagaatatctatcgctatttttttcatacattaaaaagttaataataaaatatagtatattaactaaaataaaagtcacatagccgactgcagggaaacctggtccatgttttggatgtctggcgtttacataattcatacgtgcgtaaagttaattatagttttttttttaatgttttttagaaactaaacgtggtgttatatgttttaaacatgtgtccaaacacatcgttatattattttaatattagataatatgtttttaatccctccactatttataatttttgttttaagtcctttaattagatatgactagtcttagttttcaaattaatgttccgtttgatttttagttctaccgtcaaattatttcgttaaatgttgatatgataatcgatttgtaacaattttttttacgagataaatttttttagaatatgttgaaccattttctgaaaacttgtagaatctattgaatcatttttttaagggtaaaaagctactagaaattgcaactcaaacatcaccacccgcatcaccaaattgaaccagagtcttttatgcaaaacacttataaaatgaattttattaattcataaactaattgttccatttcagaaatccaaattcta

SEQ ID NO: 431 - DNA, 1493 bp, Glycine max
  Soy_ogl_1350 Gm04:426171..42641993 Cluster 1
tttaatacttttattttgtgaaataagaaatataaacgaaatgtaaaacaaaacagttgaaactcatatattttaaaaattaataatatgtagtagtgttttattttatatataattttaaagttaataattattactcctataaagcagtagtaaaaataccttttttttttccttcgactatttcattaaaaaaatagccctatttgagatattattaaatggttgtactactaaataagaatacctatctcgatgaagattttcaatttaattcaccataaacaaccaccgacaccagataatacttaattctaaggttttacagtttttattaaaagttttatattattatctagttataaatgatctttttttgaattaatttaaaataattattttaaaataaataaagttatcatgtataatcagttagatgattgtataaaaaaaaatattatcgacatataagctttttctctcttcaaattaaagtcaatatttcagcggaaccaacacatacttccgcgtaactgtgtcggctgctatagcatctcctaccatccacagaaaattctaaacggcaaagtgtctaaaatttaaaaagaaaacagatcataaccaaaagagatgttcttaatattctttggtctaacatattggataaaatactaatattgataatattaaatattatagttttcggtttttgaaagaataatagttacattacatattaaaatttattattttgttagagacatgagagtctttttcctttactgccatgaaagtcttttatgtaacgaattatattactttaatgtaattttcacaagttagttttgatatacaaacttcgttttatctttgggccgatgaagaatgattcgacactctttgaagtaagaaggaagaggatgatatataagaaaatatgagaagagaaaaataagaatgtaataaaagagactgtaaaaatatactaaaataagtgtataaattgaaatatataaagtttacggagtttttaaaaataattacgagaataagaaacttaaaaaaaattagataggttttacggagtttttttatttattatcttggacctcactttaaatcctatctacttatattttatttatgctacttttttgttttattattttgatatatacatatattttttaagtagcaatttttaagtttctttttattacatggtcttttgtaccttcttgaacgttaacgtggtctttaagtttttttttttactttgctttttttattaatgcttgaatgtaataaaattcttattttcatatttctttaaaaacatcaaacaaccatatagaataagttaaaaatttcattatttgtactcaatatttaatttttttattaatattatatatataatttgcaaattatcactaaaataaattattagtaaaacaacttttgacattgttaaaattcaaaatcttaaatag

SEQ ID NO: 432 - DNA, 2086 bp, Glycine max
  Soy_ogl_2836 Gm08:40978801..40980886 Cluster 1
ttttttttaaactgaggtatcctcttttagttaatgattaatattttatgcatgagatgtaagcaggttttgtacaatccgcgagtccacccaactcaacctaataatctaattaggtttttatggattaaattaattattgggttgagttgaatttattaatttaatgaatttaattaaaattgggttaagtaactggttcagagttataaattcaattaaatccaatccaaactaaatataaaaaaaatattacgcatatttttttaaaggaaaaatactatgaatattatgagttgttaaattgattacatgtttgtgttttataattatgattaattacttaaatagtctatataacaaagtcaagtgggtttaatttaaagaattatttttgttcagttgaattgcaaaatataaaaaggataacttatgaacataaaagaaaacaataaaaattgaaactttttttaaaaaaatatttcttatgatttttatggtcaaatttatttaaagaaataagagtcgctggagaggttttaacaatttaatcaaaatctaactttaatgcatgatcttagtttttgaagacatttagggatgtattagattagaattttgaataactttaaaacacttttttatataaaaaaagttttggtattcaatcaaaacttttaaatgagtattatggtatttaattaagattttttaaaatttataaaaagttatctaatataaaaaaaatatgtaaattttgatcattttttttaatatgaatttagatagatttcatgtgatttttttaaataaaaaacataaataccaaattcatcaaataattcctaaaaaactctttgagactttcttatattttttttctattggttgtcaaacttttctttttcccataatacataatttctttctctcttccttaaagtgatatagacattcatgtatagtaattcttaactttcttctcattatgataaatttccaattgaatctatacacaaatcctgccttgccttgaccacaatatcaacaatgacaatataaatttccagtttatttactcttgagtagaggattttttgcaatgcatctccccaatttgtctacatcttttgttgggaatttttgcagcaacatgatatgaaatatgtaagtcactcctgcatattcattttgatggcaagtaattatttcttgtgccatcacagaaagtcatacaggggaacattgaaaacattatcaaaacggaatcttacatgaaaaaatttgaggacattgaaggttcgttgggttttgggaatcaaagaaggacttgccggcatgggtaagtgtattagagatttagagcttactgaacctattgttcaaattcaagagcaacacgatgcatggaggactagtatgggagaacatgaaactaggatcaactagctattatgaaaaaaattatattaaatttatttttctttattttagacataattattgttcacatcactttttgtaattttgaatgttttttaaaagtttataaattctttccaatcttataaatcatatttttttttctaatcttttaaattcttactatataaattaattaaaaatcaaattataaattttaatcataaaagttatttaaaaaaataataaatcataatatttttacacaatcctttaaaattcacatgattttttttcacatcttttaaaatctcaacccaatacatcccttaattgttttcttaatggatgaaacttatagaataatattaaatatttaatttatttttgcaatgtactaaaagaagtttattaaaattaaaaccattaaaatcttatttgtgatgtactatgttacaatatagattaagtaattctgcaatgatttttaaatgattttttattataaacagattattaataaattttgtaacaacaaaaatgtaaaaatgataatatttaaataattacgaggacatgtttttttttttttgccaagagcaacaaaaatctctggactaaccttgtcaggctattgcatcgaagtctcattgtggaaaattta

SEQ ID NO: 433 - DNA, 2339 bp, Glycine max
  Soy_ogl_4773 Gm14:44279701..44282039 Cluster 1
tgccaatagcagctttgaattgttaagtaaagaagaaaaaaatgtagaaaaacccaaattctagtaagattttttatgtaacgagaatcagaggatgtaaatatcgggttttagtttttttgtcgttatctaaggctaagtatcccaaatattttgtttttctccgacggcccacatgcagatttttcttttgtcttaaggcccacttgcttcgaatccagctccataaaaatataatgaatttatttaacagataagctgcttccatccttctacataagcctgttatttgggctcctaaattgttacggcttctattgcccggcctattctgttgctacccgactagattttgatcaatttataattattattttttggtatggatcagtttataaattgatactacacaatttaaatttgtttaaaatattttattaaactaataaaatcttaggttaactcaataatgcaaatatcacgtaatcaaaatttgaattttttacttcgatactaattaaggttagctattagacacaaatacaccgagtacttataaaaaaatgtctgtaacggatcacaagggtttcattcgttaaatgagttggaatataagtttcaataataatattatcaaacacattcgttaagttagtttaattttcaactttaatttcagttaacttttccgtttttaactaactgctaattttatcaaacataatttatatccacgcccataaaattacaaatttgttatatcatgtagtattatatttttaatttgttttgttttgttagtttttcataattcattttaatacaaaaataatatttttatgttgcaaggttgtaaaattgaagacacaatgaatgttttgttgacttaaatatatatgtctgtttctaataactataatatatatgtttcctatcaacattttcttgtgattttagtacctataaaattttatttgaaaattttcagttcgtattactatttattgatgatgtacaactatctattttaaaataagcctggtatatttttaataatacggactaaaataaatatcttctaatattgatatcaaaagtttataattttataaggattaaaactgtaaaatagaattttattggaaccaaaattatattttttttttataaaattgaatatattatgaagatctttatttcaaatctattttgtttaactaaaattttacatacaagtatggatttgaaaaaataacaaaaggaaaaaaaataacctcttatttttttaacaaccatagttaagatttttggtttttaaaatatttttacaaattttaattctttgaattgattataagattaatcatgagactcataacctcattctaagagtttgtcacacacacacaaccttcattatcattatcatcaagattttaacttctatcttctcacaaccagaaggcctagtttaagacccaatggggtaatattttccccccgaactttatctttttcctttttttttatttggtgaactttcgaattaatttagggaataatttaactccaaaaaatatatattactttactgattttcatagtctctcaccaaggttggcatttatactaattttaagttgttctgattctcattttttacttgggttgattcgatgcccatttggccatttctatactatgaaagtctttaagttcacggaagttccagctctacctaaatggcaaaaaactcttcaatggactttactatagaccaagtcaacagaatttatcgtaaatgatcgaggtactatgaccttttatatatattgatacatgtgaaccacgtaaaatgaatccataggcctgttcatgcaggaccgtggcaaattcaaagtaatttaggcggttgtctaaggccccaaattattcgaggcctaatttttttttatattatatatgagaaaaaatgttatacattgatggtgtaaatttttttatataattatattaaagtaatttaaatagtaatatataattatataactgtaaaattattttataatgttgatgcataatcatcaaactcattatatattactatttttattagtaagactgtatttttaaaattgtatcaattgaacaattgaaaacttcaaacaaatatggattataatgttgtatttctcttaaaaatatttcaagttttagcaagtattataatattgaaaatctagatttatttttataaataaagatattgcacaaagtataaagaaaagaaattcctatttcactaaaaaaatattggttattttttttaaaaaaagtat

SEQ ID NO: 434 - DNA, 3400 bp, Glycine max
  Soy_ogl_5648 Gm17:12181601..12185000 Cluster 1
ctcgaagaaaataagcatatttgagaggaaaattgatatttggacaacccaattataaaatactactacattctttgtttttttttttcatctttttttatcacatcatatttatcaatcaaataaattattttttttatttcttttctgtttagatctatctctctcaaaaaggtgtttacatctcctaagattgtataatatatttttccttttgagagagagaagattgatgagtgatgagttggagtttaaataaggaaatggggctgaggattatcactaatgcaagaaggctgagggaatgagaagcgccataggcatctatctctgatggtcttcgtgtcgtgtggcattacaccatccacacgagaggtgcaatttcttttttgttatgaatttaattaaaatataccgaaagtattaagtatgtaacgtggccacgtgggcgtgctataatattattcagtgattcggtgacatattagtacgtaaatgaatttgataatttctttagtaaatatttaagggaaaatacgtcacttactgatagtgtaataaagtaactgaatagtatccatgcatttacaaggttttcgaaagaagaaaaaaatagtttaatgaaaattttaatatgttattcaattggtataatttttgtaaaacttattaaaagaggaaaattatatattcttccttagtgcatatatatttggtctaacttattataaaaaaaatcacttagttttgttaactttcttaaagagatttttttttaaaaaaaggtaattgcttcttgcaaataatctcttaccaaacacactgttacttttaatatagaaaattgtatataaattttaactaatagtttgtccaaaatattaaaatatattcagtctctttttttttcttacatgtttagttaaataaaaatttaaaaaataaattttattttcacttattgtatgagaaaaaaaaattggtaaatacttttttaaaaaattggtaaacttttattcgtgaagggggactgaatgaacattattcggttgtacggtgtaaaattatgctgctacaacatctaacaaattaataactatatttggacacaggggtataaatatcttgtgagagataaaaagagagaagaaatatataaatgattgatagcataatatgacaataaaagataaataaagaaaaatgaaggatgtcaatggaatgcacgttaacgttattgaaatgtccaaatatcattatccctaccaaatatcaacaaaataatctctgaagattcaacaagaaataattattttatatgatcacatggaggatattcacgagtccttgcaagctatactgataatggctttagaagtgttaaatataagaacaatgtcactggaaaaagaggcaatgtggataaagccagagcacaattgcaataaagttggccataatgttggtgtatgttacaagtatcaataattaatatttcctgaaaaacttaattagcttcctcttagtaggtctcttctcttaactactgtatatatatttttttatctatctcaaaaacatacttaaactcaattatactgacaccaatgtataaagtaagtcaagttttcttcttttgataaaattactagtgaggattctatattgttcataaatttcacataagaccagaagcaatgaacgagggctaataaacctcatggtcatgagtcacgacatgatcctctacatgaaaacagtagagggaccacgtgggatttgtcggcattgttacatattgcatcggcgtggtctcttctcataaagtgtacgttgccatgatgaacgttttaatggttgagatttgagaatccgaataaccccagaagaagacacacgatagggacgtttgctttcagatgcaataaccatatatatcccaaaagaagaagggaatgcaatttgccattgtccacatatgaaaaagtttgtacagtaggctttccattaattgttacagatgccaattaagtactacagtagcacagcaccttatgctcctaatcaatggcagtatataaacactgtggcaatgggcgaattgaatggcctacaggtcacagatcttcatctgttgtctaatgaataatgattattggctaaaatgtcccttttcattatctctacgccaactgcatctttctatcattcctccttttcctaaacaaggagggtaaatttcctagcccaatcagctaggtcatagttttaagttgccatacgttcgtaattaaatgtaacttaagggtgtgtttcagtgtgtgaaagagaaaaaaaaaataaaagtgaattgaaaaaatatatttaaattaaagtaaagataacaaaaaatgtgaaatccacgctgttttttaaaacattcttcataaataatacttcctccccgcaaccaaaccaaagctaaaagttttcaatttcctaaccccgatcttttttgttttgggaaagatatgcacttctgatactaattcatgctcgacgaaagcaactttgatacaatgattggatttattatatttgataggaaggttttcatactatttattttagtcagcatgacattaggataaagcattttcagtgatatatcttttctaattacactattttttatatatttacttgtttaatgagatagaatctgatattcatattgcttttattataaataaatatgggttggatctagtacatgtgttgctttgggtaaattaagcattggaatacttgttgatgttgcttttttaatattctttcatgatgtagggtggattagttaatccggtttccatatatgcggtcatgcttcccctttttaacagttggattggatgtgtaaacattccttcgatctttaacatggcaccgttctttatagcagttgcaattgaaaagtaacccacggtcttgtcaatctataaccaacatcatttcaataactttttcctcttttggcgtattgtatgattcactgactaattacagaagcgaattgaatctaactattcagacttttgccaaacctagcctccttcctgtattaaaaggtcatgcagctatatgattgtcggcaccatttgttgatcctgtttttttagatattatttcttttattttatttatctaattgcttttttttaaaaaaaaattgtttgtatataatattttttctataaaactccgaactgttagacagataacagttcaggttagaaaatcaaactacttttaaattaatacttaacggaaactgtacatcaattttataaaggttgttacttgaggaagacttgaaacaagtgatatcgtgtgatttatgtttatctattcatgtaatgtt

SEQ ID NO: 435 - DNA, 2600 bp, Glycine max
  Soy_ogl_5753 Gm17:38217601..38220200 Cluster 1
aacatattaataaatctaactgatgtgattgagatcttttatgaatccaaaccaagccccaaggtaacgttggaagtcaataatctaaacgcatgaaatgagaaaatcggtctagttgtgcctaaccatcgtaatcaagagtacacgatgacgaaaaaattgtgaaaacctgcttcaaaatcacgatgacattgaacgttattagcattttacattgattatctaaatgcctcaaaaactgtgagtaaatcaagatatttctcaatcaatagtcaaggaatagttcatcaaattaaaatactaaaatttattcaacgagtgatcttttttaataattttttttatatataatcaaatcttgactacatgtttaatggataaaattatatttgtcaactatattagataatgttaatatttcctcatgcttcaaattgttcttttatcaactcataatgtaaaaaataaatcatcaaaatttgaagtgtatgggtgtgtggaattaaactttaaaacttcagtaattatgatgattttatcaagagaaaatggacaacaatcagatgatatcttttgtagctcagtgttttcttttgaataagagtatacatcttaataatgccacaaaccacttataaggactcagtttggtggagcagataaggttgggtgtggataagacatgttaaagtttcaaaacaaataaattacgagaaaattcaattgaaacatttgaaattaatctttcatttataaaatttcttatttagattattaaatatataaaataaaattattttcattataagataatgaaatgctgtgaaggtgaagtgtgacaacattttcactatatatgcccagggctcatccaccaatcctccaatcctccaatcgatcgagtttggcaagaaacccacttgctcattgaagttaatgggattatcacttagtgatccagcaggacagcaaaacaatagtataaagatcttggtttaataattttgaaattaattatatttacatagagatcttctatttggagtttaatttttgaatcggttattttgaaccttttttaattgttttaatttaagttaatgtttttacaaatatttgcatttgattgatcgagtttataaacgaaaataatttcattagttaccaaagtttgtgatccagaatgtttaagttgagtaatatgcatgaattattataaatttttaaacattattttttatttcccacggataaaaaatttatttctctcacaatgaattagagttgaataactgtgttatatacataaagagaaacttttaccattcataataattttacgttcaaacaaaatagtgtcctgtgaataatacctatttttttttattgaattagagtcaataaggatagagtaaataatacccgttactgatggggaaaattagaatttagttgtttcttttttcatatatctataatttattatgcatatgtatacagtattagtaattaattttctttattaacgattaagattgtctacattaaattttgggcccatcgtgggcctttagcgtgagctgtgactcatagtaattaacctaattatttttcttgtcatttactaacatttcatgattataagtatatttttaagtctcattctatacacttcacacttaccgatttgtgcgttgaaatgcaggtgtttgcaagtttctaccactcaaaaaggatctgttagtttgctgtgaaaaagagttaaaaataaacagtaaaataatctaaaactcaaatttttacattttaatttaatttaaaattttattttatttcattccaccctaccaaatggtcccaatagattattgtcactgaacaaaatgattttcactgccaagcatccaatacgttccgaaataccaaaatttctccaaacactttataaagtggattacttactttagaagaattagaccctctcatatatcacaaaatacttgagaacaatagtttatacgcgcattagtatttgtacaacatttaatgtgatagttgcatagtaattatttttaaataatattacaatagaagattgaatttaaaaaatgatccacttatttatgttttaattaaatgggacccgttgcataaatagcagtcacatcttattcagaaatttatacccttataacatcaaagtgtatcaaagaaataagctcaaataattaaataaaaaaaacaaaataccaaaaatatagttatgtagatgattccctattactaaaatgaagttatatagttatatagattattcctcattactaaaatttatacccttataaaatcaaagtgtataaataacaataagcaaatatagtagagtattcaaacgggcttcatcatgtatgccatgttattttttgttgtactgctttagaaacttcaccttagaaattgtaagatctcaaaacatcattaggaatagaaacttaattatttgctcaagtgtaccttgtaagttgtaactcttgtttggtttttatgcgcattagaatccctgttttgcattctgctttttcaaaccacaaattatgtat

SEQ ID NO: 436 - DNA, 2622 bp, Glycine max
  Soy_ogl_6105 Gm18:48523579..48526200 Cluster 1
ggagtattagaattgacttaactgttaaaactgaatcatatttaaatatttgattgttactatcatattataaaaaaaaatgattcattaatgataaaatattaaatgtattactagagttgacttaattattaagaataaattatatattaaatatttgattgttactatcatattattaataaaaaataatgatgaattaatgaataaatattaaatatattattaaatttgacataattgttaagactgaatcatattaaatattattagagtttacttaattgttaagactgaaccgtattaaatatttgattgttattatcatattattaataaaacaaataaatgatgcattaataaattaaatattaaatatattacaagagttgacttaattatctagaccaaatcatatattgtagtttcaaaaaacgagcaagaattggattccatatattgttttgatatttagaatatcatgtagatatttaattttgttcttctataaaatagatgtatgtaagagacacaaccaagcttgtgttttatcttctattttataggtctctaaaagaaaccttttatttataagattatgaattgagaattagtaattttgtattttgtaaattcaattttattaatcaaattgtgttttttaaaagataaacctatatatgcatttttatttgtccgttattatttctttcagtcaagttaataaatttagtttaaaaatttaaagttcaaaagaaattatttatagttaattgaaatttgattgatattttgaatatttgattgttttaattaaacatatttgattgggctaatacttaattgtttataaagtatacttagtttcaaaattaatttaataaaagacatactaccatttttgtaggtgaattaaatcaaacaattttttttatcattctacttgtaattttatttccttttttttatttttcagttttaattactttccaacaaaaaaaaaactatctagagaaaatttgacaaaattatataaataattaagaaaattaccatgagtatatatttggtttgattaaattgttaaatcttatatgaatttttattttacataatacattaatttaattgttagtttttctggaatagtttttataattacaataatcaattatgtgatcaaaataataaatgaaatattttattgattaattatgatatgtttaaaatgttgaaactatgcaattaactacaagtataaaatatagaaacatgtgtgcaaaccataataaatatatttacttaataaggcacaaaattctattgtaattaaacaatttcacacattttttattatcccacatcaagcttgcaaacaaaaataaatgaattaaattaaatttttttaaaaagaaagtggaaagggaacatgcatgcaagacatcactaaagctaagaagatcctacctaggacaacactcataataataacaattttttgaagcatatgtatatataaaaatatatttaaatatttattgacatatctactaacataaatttattaaaatttaaactaaataattaataatatattaaaatgtaaatattataaaaaatagtcctataaattataaaatataaatttaatactcgtgtatggtatagacaactaagctatattatatatttgactgtttttttactataaatatttgagtgttactaacgaattaaaaataaataatgcattaaggactaaatactttttttatgagcattaatgattaaatattaaatatattatcaggttgacttaattgaagtatgaatcatattaatatttgattgttactatcatattattaataaaataaataaatgatgcattaatgattaaatattatatatattattagagtcgacttaattgtttagacagtatctatcatatattaaatatttgattgttactataatattattaataaaataaataaatgatgagaagaatgtgtgctctatccactcttcctttgtggtttatttctaatatttgaattttgggatgttatatattggcaaggtccggataaggggcaactcatgcataatgatttgtttcatcacatcagaagatattgttctttaaccttttctctttgttaatatttaatgagataggatttctcattaagagtagattgatttctctatagagtctaggaaatctttttataacttttttgtgtgattgtaggaatactttggttatactgaggagtctcatgtggaattggtcaaggaacaaatgtagctttcaatggtagagaatgaattaatataaaaatttatttgttttcttttctctcaactcttatcttgcactttcttgatggtctcttatttttatatatatattttcttgtattggtttgttttaatttaattttttcccctcatatatacataaaaaaagatcctaagagaggagtaacagggcaccctgcttgcccccggccccacgaatctatcctagtttaaatacaaattatttaaaccctctacagaataaatatttaaagtagttcatctaaaattaaaatctcatacaaactaatt

SEQ ID NO: 437 - DNA, 2500 bp, Glycine max
  Soy_ogl_6135 Gm18:52318701..52321200 Cluster 1
taaataaatttgacaacaatcattattgaagtgggtatatgtagatatcttaatattgtactgtggggtgtctatgaagctatgatgcatggagcttggaccagctgagctcgacctcacaattcaagaactgtcaagttcaggctagttgaatcgtcataacagaagaatgcaacctagctaggaattgaattgaccaggatattttaacttttgactgtttaacacttcaatttttatatttatcttaagcggcgttttaataagaaatgtttttgaaaataataacgtgtgaattaaactttctcatatttatttataaaaagataattttaattaattaggcataaaatattgttataaatattcgtattaattttttttctattgagtaaaattgattgcatgaatcataagaatcgttatgacattaaacttggttataaccaaattcttaaaatactgttttattatgatatttttttcaatttcttattgacttcctctattatttttcacaatgcagttttaattattaatgcttttagaaatctttttatcttatccaaataacattaaatgattttcaatatatatttttttcaataagttataatattctttcaaatacaattatatatttcgtatcatattcattaaaaaaacatttaacacaggtgacaatcgaggttggcaaggtgactttcttatacaatcactacatggactccaaacttgtgttacacgaaaaggaaaaggatgacaatgatcaaaatgagttcttttaaaaatttaaaggaccaaattaaactcaaaataaattagaggattaaatcaaaataataaatgagataactaaacaattaatttaacctatcattaaacttacttattgagaaattttcatattacccctgcttactcggaaacgtttgtaatgtggtctaagccaaatttaattccctcttggatatatattgtagaattatattaactaatgtaaaattatattatatttgaaatttgagtattttttttaaaattggtttgaattagggccgaagaaacaaaaagtgagaattaaaataaaaattgatattttttattttacttaaaaaaagtaatatatgagatcttttagtttgtatgtgtgatttttttattttaaacaattaataataaatattgatagacttaaacctcaacttttagttattttatcattggatttacactggtttgaatttgtaatattgtgtattatgtattttactgacttagtgtagatttccttaaaaaaaaaaaagaaaaaagagtacgttagcgtatatttgtatttaatttaatctaagacctgaaccataggtacgttggttcttttaattgattcagattgtcaaaatcacgatctgtcacatggtgatatgaaatattttaagttaaatcaaaattttttgaatttttatcttggtccaaatataatgatatattggcccacaaaaaaaatgatatattccttggcgttgatacaacaacttacaagagatcattgcttgcgacaaaaattgatatggccgctgattgacgtattatttcaattatgttgaagttgaaaattaatgaactaattaataatgataacatcagttttatttacatatgtaacttaaatacatttttaatctttacaagatgaatgaatgcttttgatttagcttcctgtataactatttttttatccttctaaaatttgaaataattgtttttggtacctttaataaaatgagtgaattttgatgttggtctatgtaaaatatttttatgtaatttttattcttccaaaatctaaaattactattttatttggtcctaacattcattttaggacttgttaaaaaaatcattatgagcatctagaattttttttagaggcatgttatgctaatatggtattaatattgtagacattagaagaagtaacgtgagatagtcaatcacttgaccttttattaaaaccacatgacaatgtgaaccaaaactaatgattaattttatattttgaggattggaaattaaaaaaaaaataagggctgaaattaaaaattgctcattttataaaaaataaaaatatatttaagcttataaattatattaataaatgtaaaatatttgattgaatttattgttctcaaacattgtaattgtataatttttttcttttcagtttcaattatgttattcgagtctcttaagttttttcctatttacaatcatgtctatctatactaattgcatctaatatttaataaacttataaactgatattataaagccaacgtgatatgaaaatacataactacaatgcattagctaaaaaccacaaaatatttgaagcaataatgaatattaactttgactatattaacttaattttcgtgtcaatagaggtggaaaaaaaattgaaccaataaaattaaaccgtacggatttaaaattgaac

SEQ ID NO: 438 - DNA, 2500 bp, Glycine max
  Soy_ogl_6209 Gm18:56782401..56784900 Cluster 1
tatatgtatgcataatgcatgcaccatcatcatcgatttcagtatcacacaacgttgttaccgactttggacttacctaatctacttttctattctttaattaatgagtcattaattagcgtacatttaaggcagttacaaattttataattaactgatgagtaatgacatagtcagagttatgaacagtgtgaccggcgtaaagaaatcatcataataataaggaaaagggtaatcagtaggtaagaatattggttaaaaaaaattaaaataaaatcattttttattataaaacgaaaattatgttatttatgattttttttacattgtcttataatttatataataataattttcttctttaattcattaataaaattctttttctttatagtttcttaattaagacactaattaatatttagataataataactttaatgaatcacaattaattaacttaatgaaaaaatgttacatttttctaactgctaattcattaagacaagataaaaaggagtacaaaaagaggatgatgatacctgtagtggtaccacaccctgatagtcaataaaagctgccatatccaaaagaaaaactgcatcatcatcttccttacaaccctctatgtccgacctttacaaatcccctatcaataccatcctctaaacccatgtgtctcatacaagaaatataattttctgcctatatccagaaagagcccgcaatcaaataaagacatatcacctacacaaataaaatcattatatatgctttaaacacaaatggggattaagtgtctactgaacgaatgaatatgaaaagctttggtttgctccctttaaccatgactagctccagaacaaaatgctatccatcaaactagtatcatcaaaataacttcccttaaaacggccattatttctgcatcaagtccaaatattccggacaatagatcgaactccatacaattttccaagcctcattagatgttattgatcctccgaataaagcatgttgtagaaaaaatatattactatgctactaatagtgaatcacaattaatcagcttaaaatttttaatcgcgtcataaaaaacatcattttttttacaaaaaaaacttttaaaacttattatacttgtccaaagtcaaaacttttaaacgcgtcataaaaaaacatcatctataacgctttatttttaatgtttttctttatattttctcttcaaatgggtaactaaactatcgtaaattcaacctactgacaaccaaaattgatattcacgtgaatcatgacacgatagaatgaacaaaaaaatctgttattttctacttaattgaattagaattacaattatcctgatttttgaaagaaataaaaaaggagtaaacacctaatttatttcatataaaaattattcaaccaattcagtttttaaaagttattaaataatatcttaaaatttttaaatctgaaacattttaatccttgttaagtagtacatcagtatttaaaaaagatgtatatatttttaatcagtaaaagaaattaaaggtatatttatatatatgtaaggcgcagaaaagggtgctcaaacccaatcataatgacccttccacaaaaaacgccagactcaaatccaagctttagtcaaatatactataatttctgacctgtgcaaaagatacgttcttatacctttctgtttttagtaaatattttttcttaaataaacatttcacgattattttagtaatgaggagagagcgagataaaaaaaaatgagataagtgtgaaataaataaattatatgtaatataaaataaagaagttttagtagaaattgtattttcttcttgtgataacttttataataagacgaaagataaaaaggaaaaaagtgagataaaatgagtgatatgataaaaattatattgagaaatgaaaattactacctataataaaactgttgaggagaaattgtggtgagtataatattattctttcatttccatactttatgccctttcttgttgggttccatcacttatcttttaatctagaattgtcaacgatttggtgttagaggttccttagccgggaattttagaagtttcctagtgaattgtggcgtctgactacttttaacttttttttataataataataaaagtccgaaagttaatcagtttgaatcatctctatagctgcacatacttcagaagaagaaaaaacgcacatgaatctgaatctggatatacacaagaatttccaaagaatgagttctaacttattgattgtttttctctttttggaataagaaactcgtagggttaaatcagtttaggacgattaaaaaaaaaaaacacagtaacacccttttctcttctttcccaagtcgatcattatctatagtcatcggtgactataattctggggttcaaattctgccggcgacgacaaattcctccggccaaccatggtcgccggcgaccac

SEQ ID NO: 439 - DNA, 1700 bp, Glycine max
  Soy_ogl_6339 Gm19:2332001..2333700 Cluster 1
caataacggcgaataatgatcgaaggcaccagcagatagctttttgcatgtggacactttcatgagtggtcatgaatttgacgagtgagaccatgtctggcagctcacaattagaagaagcttcaagcacacaagtttttgtgtattgacatgcaaaaacgttacccccttttattgaagtcaatataataataatgattggataagaaatcatgcagtatgcaagggagaagattcagagaaacttagacacatttctacatttttctttctttttctttttattttttctcactccaactttatcttttagggtccatttgatagaatgaaaaaaaaaaggaaattgaatcacgacgaaaattttgaattaaagtaacatatattttataaaaatatgagtcccatgtgattttattactcttttttttttttctttttctacaatcgaacagatccttaatgcaagtttttggataagacaactcatttcgtgacatcatatactctatgtttccttaacattttaataacattactgtgtttgtgaggcttgaattttggatcagctatttctgaataaaatgtataattccagagtagaggaactagagtatctgtatattcttctcctaattaattttgtttttctaagaccttgtttagataaaaatttcaattattaattatatgaaaagaaaaaaaatgtagaacaaattaagtttcaactatagttataagttataatgcatttatttacttcgatttatatagaaggtccttcatttaacttttaaaaaaaaacttattataacatacgtagaagttaattttaacttaattatgagagaaattttttttacacaactatgaaaaaaacttaattcatttttatttttattttttttataagtatttattaaaaagattatttaaatgaaatgttatctcgtgcacaaaaaatatggcaacagtgaagtattttacttacgatgacaaaatatttgttcttacattagtaatgtttggggtgagaaaattggctgttagatcacacttcctccgctaaagatgtgtcatatcaatttaatttttgaaaagtgatagagtaactaaagaggataaggtgaatttataactattcattacaaaaataacgataaaaaattataacaaaaatcatatacatatataacaaacaattaaattattaaaaattctaaattgttaaaacttaaaagatacaaaaatgtactttgtcctttaatttggagtacatcttttattcagagattaaatccatggtcatttataccaattgtgctattctttctacaaaagagaagaaaaaaaatctcattattcatgtcaattggatttttgtttttggaggaatactatgaagtaattgctttcacatcactcatggtttgactcttaaagattaaatggaaaatacgcaatttattcatcactattttacaaatattcgtttggatttattcagtaattatggtgaatccaaaagcaaaagtccaacgtacaaaaacattctctggcaaattttatttgacaacaaaacttcaatttattcattagccctcaaactgtagttagattatttgggttttgtaggcccaactcttaagacatgtccataactatatggattgaatggaacattcagaactttacttcct

SEQ ID NO: 440 - DNA, 4000 bp, Glycine max
  Soy_ogl_6362 Gm19:5311001..5315000 Cluster 1
ttgaggttattattataccttttaggaaaaggatcgaattaaagataaaataattaaagtttaaattttaagttaattgataaagaaatatttattattaattttttaaagcaaaaggttacatgtgtaaaaaaaaagtctaacatataattcttttgcttaaagtaaaaaataaagtttttttaatttttttcatatctgctcttctccttgaagtcttgaaccattaggtgaaaaatccataatttctttatttaacttgtacatatttaagtgattttatctttattttttcctttaaagtatcgtccaatatatatatgtcatcccaatagaaaatatcaacctgatgatagctggccacgtatgtcatttgagtgttcaacgttttacttgagttcttgaaataaatgttagagtttatttttttattcatttttattaatattttcaattaattaaaaatactctaaatataactttgattgtaactgaataatgaccgtatatgtttcattccagttaattttaaatgttaagtgtttgttctggtttcacattgagtccttgaaaatcacattcaaatattagttaatgtaatattagataagtattcacatatttgatcttacattcaaaattaattggaagtctagaattaattttgagttgaaatattttaaataaatttttgttaaatgaaaaatttatattaaactttactactaatttaattacttttaaaataaaaacagagaaatataaatcaatacactttaaaactaattttgcaaaatcaaatttagttataatcaattttgtaaacgctgattccaacgcacatttgtatcctttgtggctatatgattggtagaaataagtgcttcataccaaaagtaactttaaggttaattaagattaaaatggctttcgatttttacagcagtaaaccctggaatcttgatgactgtctctaccgttataggcaacaaactataaaataaatattcttttctaggtgagatcttctggtggattgactttaccaatcaacttttttagatttgtttttcctctcatttaattttttttcttttaccatgaattggagttacatcactagcaaattaaaacacgcaatagacagagtggaagggaaagaaacaaaacaaaaaatgtcattttcatggatggagaaggagccctttgattccttagtgtcccaattggcattgaaagatgatatatatcactcattccctctagaaattagtcttgttttgtgtttgtgtgtggctcttgagagtggctttggttcaacatttatgccaagtaacgctgctatccccttgccgtccaggggatattttttaaggcttaagtggggactataagaatcattattacatcaatcataatgggtttgaaaatgatatagggtctctcaagctggtgacccctttgtttagctttcttgtttgctttaaccttcacttgttgtcactaaccttttgtcccattcatgagagcaaatatatgttagacttagacaagctagctagtaatggatatgtatccataccatgccagtattattctattaaagagtaatggtatcaactttttttcaacatattatacccaagaaaaaagattgaaaaaaaaatgtaataagaaagatgatgtgtgaaaaaagcttaaatatacattttttatttttgattaatgacctaattttatttttggtcttaataaaaaaatttattattgtcattgatgaatttaaaatattatttttggtctctatatttgtttagattgtactttaaatagagaaataaattgatttagataactctctacgagttaaaaacaaacttttaaattcatcagggtcaacaacttaatttgttttattaggaacaaaatatatttaaacctaaaaaaaaataaaaagaatgaatgtgtaaaaatattatatatacgcatatttattattactcttcaaatactttaaatattacatcttataatttaatttttaatttagtgacgttatatactcgttaccagtgaaatatcataatatcttgagaggagacactaatgactagctagggacataatcaatatatttattggggaaaccaaattatagtatatgaaaacttttaatcaaactgttacgttgataaaattttatgactttaattttgatacacggttaatatacatacttacatattattaattagggatgggttaagtgcctccaaataaaaatgagattaaataatcccgcctagatacctcaataaaattacataaaattttgtgtatataaaaatcctaactaaatgagtataattttattgggtcgtataaggtgggattgcttaatcccatttttagttggagttaattaaataaatcctattaactaattaaaaattactgaaatgactttcaatacaaaatttaataattttatgatatatcacacagtctattacaaaatttaaaatttgagtactcaaattttacattacgagtatattctaattagattcaaattctgtacgtgtaacaagatctgcacataaagtagattcacgcacaattacacacaaacaaaaatagatttgatgcaattggcaaatcacacggtcatatacatactcagcccagaatctagtgaaacctttgtgtttcatagccgtgccacgacaagaatttcatgtcaagaaggcactgaaattggatgaactgattgcaggcacatcacagatattaatgttgaaagggaattatagacagataaaaacaaaataaggagatgcagggtacagattataactgacaagaatgtgaaacaaatcctcaagagggtgcatatcctagcatatcaaataataataattctgtccaatgatattgctttttattatacctcaatttgggattcaaatatgatgtgtcatcccatgtatggggagaaaaaagaaaggggggataccatgcattcttctaatactactcattttttatttcttttttagtttagcttgctttggttttgttataaagaaaataatcaattcttggtatgtgttgttttttcagctaatgaattcccttttcttagacacatttgctgctttatagacttcaacattattttagttagttatggaaagtttatttaattagtaaatctcacatttgataaaaatgtgagtacaaattaacttcattattaatgtaaaaatcttattagtaaatacctttaagcacatagtgttttaagtcaagtaaatctttaggactcacatgtatttgatttcgcgttggaatcacaccacacccattaaaatgtgaataattgaatgttacaaataatttttatttttttatttctgtctaaacgaaatcaattatcctaaaatctcctacaaatctaacatattgccaatttacctaaacttttatgtacgtaacaaaaagaaaaactttagttagttggtttcttttgtataatatataatataaactctttatgcgatcttaggggcaaggtagttttctaaatgctattattcacttgaagcccaaggatttagacacacaatagtttctctaacattaaaaatatgtgcctattattgatttattaaatgggtcactttgaagcacagttggttagaactagcacactaccaactatcatatatgattgtattaggatgcaatcaaactaagtggcagatgttaaatggcagtggcactaagccattataaaatcgaatcaggtattgtaataattaaacaatctgccactgcagataacgtcaagagagtttacaaattgtgattggataatccatcacaactgtcactaccagaatatataacagcaacagctgcaacataaatacataacattataacaactttggtgacaagggacattttgttagcccttatataaaattggtgacag

SEQ ID NO: 441 - DNA, 2004 bp, Glycine max
  Soy_ogl_6477 Gm19:40905981..40907984 Cluster 1
caattagttaaatgaatttgtattttacaaattgattggcctaattacacgtgtatatgtttaatatttaacctcaaatctattcacgtttataatttttttaaaggttcatacttataattagataatcaatttttcaaattttataaaatgttatttattaattacgtgttttatgtaacccattcttttctttttttaggcaacccattctattcttctattaccttacattatgtgttttgttgaacattatacaatattatttataattatgatattttttattattgtaattaataacaacatatattactctaaatactattatttgtttatgagttaataagccaataacaatcgttctttaaaaaaaacacaaatcaataaacaattattttattactttatattattaccttaaatatatgtctcttataatatatctaaatgattctattaattttatcactatttttaataaattgaacttactccttataataattttgtataccacaactgtagcatgtttaattaatttaatttaaggcatatgttacttgttgatgatgactagtaatcgacaaaatcattagatatctctatcaataatgcagataaaaaaaagataaatcatttttttaaaaataaaatcaaaagagaacatgcaaaacattaaagtaaaggtgatcttatatttaggacaacactcttaataataataatcttttggaacatgtgtgtataaaaatgtatttaaatatttactgataataaataattaataatattttaaaatttaaaaatataaaaatatgattctgataaattataaaatatgaattcaatactcgtgtaagacacaaaaatattaagctggttgatttttaaaaatacaattacattcaaatttggtagtaaaagatttgctaattagtaattctatatgcgagtaaagtcaaaataaaatgggtattatgaaagaaaaaaaacttctactctaccttatttcacttcaaaagaatactaaagtttcttttaattaaaatttagtgttctgttaggagaatttgttcttgttttacccatcatgtgttttctgcttaattaaaatttataattttttaaaaattacacattcaaaagtacttttgattagtattatgaaaacaaaatttttattttatcaaacatatctttcaataaagaaatataaaatcataaattacctatagcaaacttgttttttttttattatacttgagttgataacatatttttcttcaaaattaagtttacaaattaactttaatccaaatatcaaatatgtagttagaattttagttgtgctctgtaaccaaaaaaaaaagaaaagatttttagttgtacatgtgtttaaataagtatcctgcaggtagctgatattttttagcaaaaagattgagtagcatcttcaatcactacacatctcaaaaaaaaaaaaacttcaatccttacatctccaaactatattaatcagcactattttttaaagctgcgtttattccgatttatccagtaagttcggaaatcgttaaatatccaaatatacctacgaaaaacatcttaattaaagtgctggtgttcaagccctacaaagggtatgcttcgcaaaacatgtatagaatgataggaattaatacccttttggtacaaatttctgccacaggtttatttgtacacctgaaagttaattgctttgttggagttgcgattgtaaactcacgagctagggttgctaatcatttttgtccccaacaaataccgttaattagtttggtttttctttgatctggcttcaattaattggaagataaagtaaaatcaaatcttcctcaatcaaacatttcattaatataataatcacgaattatacaatgttttttatatttttttttcacggatatatttccccgattctagcttgtaattgcatggttagtttttcttcttatatgagtg

SEQ ID NO: 442 - DNA, 1962 bp, Glycine max
  Soy_ogl_1958 Gm06:15290501..15292462 Cluster 1
tggttgtgaagatcacaacggaataaaattatatttttattatgtatttaatttttgttttaaaaatacaattttattacgtatttcaataaagatcaaaacaaaaatatgtttcaaaagataaataaaatagtcttttttaaaaaattaaaattttgtaggaatcaataacaattttgtatttgcccataagtcgactcgtagatccgccacaaatccattacccataagccgactcgtagatccattacccctttaaatggaaatattaattaaatattaataagttgcataaaatgtcatatatacccatttctttttgttcttgaaattaacgggagtggctggctgatcgaatttgaatatgaatcgagcactaatcggaatgacattcgagggttttgttgttggataaaggggatcgaagagggttgtgaatcaaatggaatttcagaaggggatttagatttagggttaataaacagatctaattaatttagaattttaaagtaaatagtagacaggaagcagaaatcgttgagtgttttgcttcgttttaacgaattcacataaaaaataatataaaaaatctggaccgttcactttttttacatttaatctaacggcatttaaacaacttcctcaccggtggaccacctaagtccttggtccaccgtagaaagatccccttttcaaatgtcaaatctaggcccttttgctttgtcagaaaagctatcggtcaaagcaattagactttttaaacctcgtagtcatcgaagagaaaagtaggtgaacaaaaaaagagtttggtggtggcataagaaaaaagttgtatgcttcttattttcaaagaggtttatgcaaacttgaaaaaaataacataaacctcttgctagaagcagcttaaaacacaaacaatcggtgcttcaagctcacagttgatctgtgcaaaagatggccgtcatggccactatgttgtcacatgcggatggaagatttttgcaccactagaaaaaaagaatatgaagatatatataattgagaaaagaacaaaaataaaagaaatgttttcaacatatatatgaagttaattgacccatagaaactaaactaaaatgtgtcatggaatgaaactagatctatatacaaaacggaaaacagaaggaagtagaagatgataagagaatgagggctttttatagaggcaccaagtgtgtttctagggcaaaaacattagtgagagaaacgggcaacgggcagtgcggtgtccagtagggggtaggttcagggcatcgtaggttgcgctgccgggcaaaataaaaaagaaaaaataatgtgcaagttggtgcagtcttgactagtgagatggatttcacaatggtcttttactccctgcacctccctatttgcttcctgcaccccaaaataatctgagtggacagaatggtctttcagagccgaagactcagcagtcagcacacccccaaccaggggcggacatacgtgtacccccctttttcatttctaatttttataatatatatataatataatgttttaatattaaattaattatttttatttaaagactttgattagaaaaatagtagtatttaagtattaattatctattttattttatttcttgacataatatttttttttctgtttataatattcattacaaaaatagtgtgcactaaataagaaattgataactttatttttcatttcagtttattttctttttagacaaatatactattttttttataaatactaattttcttttatattcttcattgaaatgataacatttttccttttttaaaacaaaatattcatagttatttacttcctttgttaatatgttttttttataatgtattattattattattttaaaggatataaatatttacatttgtaatcaaatgatttttatttgattataattgatat

SEQ ID NO: 443 - DNA, 2440 bp, Glycine max
  Soy_ogl_2320 Gm07:10236848..10239287 Cluster 1
ctttgtaataagagaggaagaagattccataagaaattgattgcttaataaaattgtttaaatgatattcaagatctctcgttgaaggtggagggagaagttgatcgacaccttcaatgataggttttcataatctaatatttatttaaggatatggtgtttactttattaatttgttttacttgaatacaagatcttaataaaccatgtcatataccatgtgaagataattttgttattctttgcatgatgtgatacttcgtaaatatataatttataacttctgcatgttcaatggaggattgaaatcggtggtacgcggtgatgtatctatcattgaatttacatatagaaattttgggttttcgcgtattagggtaaaagatttataagcttcatttgatgggctcataagaattttatgtaagtatataaatcgaaataaaaaaataaagcaattaaaaacttggttgttttgaaattttcaggatcaacgttaaacttctacatatttgtttaatgcttaaaataattagcttaagtttaaaaaacaagtaaagacgttctacatactaatacgtaaagttgactcttgaaactatagacatattaccaccaccttcttttaaattgctttgaattcaaataacttcgtttgacgctagcatgcatttactattagatgttgcaccctaaaagtaattgatttttgtagtctatattatatatatattccatattaaagaaggtaaaacaaaaacacatttattggttatttttttttattaattattaacaaaaaaattcaactataagattagacataaacattagaccttttagtttaatttattataaaaaattatctaatataaaagctaaccacttaaaattatttcaactcaaaatcaattttaaatctaaaataaatttctcaacatatgactaaatatgtaaacatttaaccaaattatgttacttttacatgattttgaattaatcaacatgaatccaaatacaagttgcaacactacaaaaattacggaattactaaattttgaatattttaatgttgtttgaataaattatgaatatttttattttaagcaacagataaaaaaatacaatatattggtgaaagtccaatacatacataatgtatccttccaagtactaggtagcagagatctggcaataggacttaggagtcaaattgtgataaataaaaaatacatacaatatagaaatgaagttaaataatgtaaacggtgatcttggagcatcacatctacttttataacttaaaatttagtaggatgattcaattgatcatgatagactggtttataatacagaaaattatcctgaataatattgaattcacaaactagtcttttattttatttatgttagattagctaaagtaaaactggatttagatgatttaagattttaaatttgaatattatggatataaaaaaaaatacaactgacaaagaagactttattaaaagtgattattgtcaagatttttttaacaaaagataatcatagataaaattaatagacatttaaaaaagaagtagaaactaaccttttattcagtcttgagcaaggtgtagtgtggttttagtttgaccttttcgttatatttaattttggtggcttattgaatagcaagatgatgacgcaacccaccacaggtgagagagttagtctctgttttaccaaaccaaactccattcttgacaccttcaaacccagcaattgcattgcaaaggaaaccatagcctcaatttttcattcatattaattaagccacccatttaattattattttttcttttgtttttggagactaaaggctattgacctccttgcgtgtgtggcgagaccatgatgcaataatcaccattctattctcatctttgaagaaaatttatcatcgagaatttcaatcctttgcataacgaatgaaggcttttgatggggtacggtgttagtttatttttggactaattctcttgcttagatttgtatttttcttttccttacactcataattttttttttggtcttaatgctctaactcataagaaaagtttaactttgactaatttgaaattagagataaataagatctaattacgatactatattaaacaaaaaatagtgtgcgtcagataaaataatcactcattaattaagtagatatacttgtttttttttattttataaaccaaatacaagtattaaccaatttatagcaactcatatgccctcaataaccaacttgatcaattgaattaaacttgttgctatatttggtttaatatttgccataaccaaactcacattttaattgtaggtaagctattcttgtatatttatgaatataacaacgctatttttaggggcagtaaattaaaaatatacatgt

SEQ ID NO: 444 - DNA, 1200 bp, Glycine max
  Soy_ogl_6443 Gm19:38911901..38913100 Cluster 1
gattcactaacttggtatctatcttgattatacatgcaaggttttatacgcgactcccaatccactcaaatactgatgttaaattcaaatagtttattataattttaatttaatctttaattttcaatctatgttgaacatatagtttttaaatacatatatattttctaaaaagaaacttatccatgaatttttttatagtaatgttttgtgaaagtagtatatacaaccggctgtgcgtaaaattactattcaatcacaaaatggcatatatgataaattcattaattttataatatttatctttaaaatcaagtaaaaaaatattttttaatttattgaaaatgtaaaatattttactctgtgtttttatcaaactcagtttttttacagtctttttatttttttataatgtttttgtctcactactatttttgtttttgcctcaaataagttgtcagaattcatcatatttatgtcttaatcactaatgaaaaaaaaatcttagtattgggcaatgtgcatttatatttacaaaaaaaatatgcaatattaacatatccgttgataatattttgtaactgtcttaagggtttggataaatttagccatctttacaaatatttggtacaaaaataaataaaatggtgttgtatgacacgaattaaacagataataaaatgcataggtttgaatcacatcacatactacaaaataataattatgatcatgaaaatataaaatgggttaaatgattaaagaaggagggaaatgaaaaaaaaaaagttacgtgttcaatttttttattaataaaaaatgaattttttaataaattaacatttgttaataaaaaaaattaagttgatgtcaaacatatacgatgttgcatttgtatattttaatcattgatatacacggttttttttctggtgatatacatggttatgcctacacaaacgactgatcaattagtaattacacattttttaaatctcatcaaatgtgacaagaaaatgaagaaatactagataaaaaaaaattgcttacagtctagtgtattctagacatgattcatagccaaggaatcttatttgacctcaaaagctgattgtgctgggaaagtgcatgcagacaaagaaatatcctctattttcccacctttgtgtgtaagtgatgagtctaaggctaagcagctggaag

SEQ ID NO: 445 - DNA, 1900 bp, Glycine max
  Soy_ogl_81 Gm01:3308301..3310200 Cluster 1
tctccttccctagtttgtttcatttcaaggcttatattttatatttgaataaattaaatataaattgataaaggcaaactgctaaaattatgttggctgattttatacctaagcgcatggatgaatcactatgaaattgttgtatatttagagatttttttttgaatatatacatattaagtatttagagaaaaaaattgttattcataataatcttaggtaactcaagttctaaagtaagattgtgtcttataaaaaaaaaagtatttgtgatttgtaacaaattaatgttggctgagttataaactattggtaattagacaaattgcatagatctatatattgataataaattgctcgtaaatagactaatgaacaggcgaatctgtagattatagaatttattttagtttaacttacaattttaaatttggatctatctaaccaactcaaataaaatattcctgtgaaaaaatacatttgatctcgtactattttttttatcataaataattaaatatttttatggacgttttttccaataaagttcctgattttatccaagaagacaaaattgttaatttacatcaaagtcgattagtattttttatgaacgtttgttgagtgtgagtcttaactagtaaacaaccttttttaaatttgaaccatttcatccttttcaaatagtttatttacaatatttggactgttttacgatataagtacttctatatgtaagtgtttcaaaagatttatgaaaatagcttatatatatttataaattataagttatttttaatttatttcaataatttttttaaaataaattacaatttatatacaaataatttagtcttattttctctccattataaaaatttgtacataaatatttacataataaataatattttgcaaacgtttaattacttcaattatttatccacacatactcactctttgttcacaaaagtaaatataattttataatagataacacccaaaagtttataattaagaaaaaaaaaatagttttgccgtacatgactatgcatacagatgcgtgtcgaagcataaatttgtaatgatgtaactatgcttcatgattgtttgtgtttaataataaaaaattgattgttttgtgttttctcaaaaaaaatatatgattgttttttgttgttagatattattttttataaggttttgaaaaggaatataatcagaatatcaataatacatataaatatttctacattatcatttaattataaattattatatataataatattattaacttatacatattttgattaattaagttagatgttcttgattattattaatacatataatacatgctactacaagaaacttaatgagaagaaaaaatggcatcatcacaaggaaaatattttctttttggtactactgctttttctactctttttttaaatgtaaatgactaatttaatcattaaaattatatcgtgttgtcacattagttcttaaaattaagatttttttttattctggtctttatatgtcgttgttatcatttaatgaaaaattttaaggatttatttaagtttttattagtttcaaagattaatatgaaaatgaaatacaacttaaaaaactaaattggacattttctttttttttttccttaaggttagtatttttttctctccgttttttttttgtctaaaggtgaaaattgattttaaaaaaagagagtggtggttattgtcaaatattaggttctgaaaagacaaataaaaagaaaatagtgttaaaaaagggacatgtagactttcccaaacaacgaatgatgctttctttgaatgtaagattccactacggcgagcgcacatatataggaaatatgagcgtctgc

SEQ ID NO: 446 - DNA, 2089 bp, Glycine max
  Soy_ogl_667 Gm02:45072702..45074790 Cluster 1
ttaatatttttaataatctcttttacttttgttgggcttatggatttactcattcattgttttgttcaagtgattatgattattattttttatttagagaaataattacaaggaccacgatcaatgtcctatatgtaccaaaatttatttataattatatacaaattataaattataaataaatccacaatgttttatgcaagaggatttaaaaatggttacaagaaccataaatccacaatcaatgtcatatacagaaattacggtaattataaatgttcggatttgcagtcaattatttttaccggttttcagtataaaaaaaaatacagttaaaaaattcgttttgttaagatattttaattttttttattataaataataactcttactttaaattgtttgaaatattattttacaataattatgtaaattattactttacctaacacataattattttttatttatctcatttatagtattttaagcatagtagatttatgatcaactatatatctatattggagaataataattaataattacaaatattatacttttttaattataaatgattcttaatttaaaattttaaaatattcatattattacttgaaatttatataaatattcatgaatgatatttaaccgtgtatgacacaggtcacacattctaatatacttacaatactatatacacgaaagtttataattagatgaaaatataaaagccagttatttatcatttatgtcttatttggatttttttcataaatacttataaaaataaaatgaattgaatttttcttataaactaatatcaatttatgcatttaatttttttaaaaaatatatatttaacttttttaaaaattggaatacataagttaattttagttgtataaaaacctatatttactttatttccttctcctgtaaatatttataaagaaatttattcaatcatattgttattgtttaacaaatgcataagtgggctattgttattttttgtttcaattaaaggacgtgcatgtagtgagatgtacatgtaagatgttagacaaataacatggtaacattattataggaaaaatactcctttattctttaaactttttcaaaagattagaaaaaaatatgtaaaagaaaatatacacgtattttttagagcttatatatgaaaataaattaaagacatcaaaagtatttattttaattgaaccaatttataaattagtcaaactaacttacaaactaataaagcaacttgttaaactaactctaagatttttgcagtttaaatataatatatattgatccgtaattccttatgtatattaaccagaatatatgcagtaaaaaaacagaaaaacctaataattttgtgttatttttggataaaaattagaaacgtatttttacaaatttcaatatactatcccaaatttcacggaacaaaatatatataaatttttattttagaggtaaaagcatttctgaactctatcaactattcaactcttaactgatatcaaaacatgcaccttatcaaaaattatgccacttgaaactatacgtatgacttggttataccaaacatcgatttcttgaatttagctggaagttaagttcatagtttggaagtatatgtgaacgttgaagtattcttgaattcgttaaatagaaccaaaaattgaatgtcaccagtatctcataaacaggagaaagtgtaacatataagcatgacatatgtaatagttttatctgtaacgtgaacgagcattttcaaagcagagatattattagatggaaataaacttaacatcttatccttacacacaatcaatggaaaaattagtaagtaataaaatataaaaaaatcattatttatttaatagaattaatctaattcattttaataaaaaaaatataatttgtttccttaaataacaatttgatcatatgaagatatattgaatatatttataataaaaaattcaatttctctgttattttttgtttatctaaaataaaatacgtaacttactaaatgagaaattttataaatatattttgtatgcat

SEQ ID NO: 447 - DNA, 2150 bp, Glycine max
  Soy_ogl_832 Gm03:3652151..3654300 Cluster 1
gatttatgtttatataaagattataatatttatatttacattatgcgtaatttgtagtgactaaaccattggaatttccttaaaaataacccatcggaattaaggccttaactatctatgatttgaaatggataaaacaggagttggattatgaaagtatggaaaataatgagatatttttgttttaacttaaatttgtataattacaaaataaccattctttttttagggacaaaataaccattcttaaaatttggttaaaataaggatagggtaatgcatccacgcacaactgttaataaaatctaaagacacaacaaggtttttccaaaatataattatcacaaatattcaactttcaatgttttcatccacaaatacttgataaacaatttatagaatctcatttcattaaagacatcctcctcaagaaattagcatcagcatgtatggtaaatctaatgtcttttacaaaaactaattaaaagtcatatttaccataatttattattggactcttaattaacatgaattttttttaaataaaagataaactcacgatatttttttttttacaataatatacttacccattaccatagttaaaacattgtaaagcatacattgcttttacaaggttaaacttaattgacttaatttttttcgtctataatttagtttttttcatttttgttccttttttgtttggatatttgcaaaatgtattttttcatctttaaaacattttagataatattttgaatgataaaaaaagttttaaatggtgaaaactatattttacaaagattaacatgaatttttgttacaggaacaaagatgaaaaaaaaatactaaattatataaaatatatatttaagtcaacttaatttaagtaattttacacatttttttccaatatcttcaattaaatggtgaaagagattaccaactttgagcatactactcattccatttgtgacaaaattacatgactgaaaaagacattgagtaaaaggaaacagaatttatatatggatgatgtttatattttaaaagacgttatcaacagaaagaacaaaattgaaaaacaaatttaatttatatatggatgaggtttatattttttatattaaaatatcgttcatttctattaattttaaagtataattttaaaaaattatattttatttatgttaagttaatccatatttatatttaccaatcacatgagtaattatattaggataaatttatttgggtgattaatttttttataatctttcactttttatatcaaaagattataagatatttatatttaaatttaatataccacttttataggaatgatgattaagtttattttatattgaaatatttttttttaaaaaaatttaacagtataaaaaattatattttaaaactaatatatactatttatatttatatttatattcatggattgcacaagtaatcatatgactaatcgtttaggtaattattcttttttattatgatagactttttaaagttaagagagtcttccgttatataaatgaatgaaaaagtatcctaaaaaatttattagcaaaaatctacaaacttaaaaagtaatattttttttatacaaaagtagtaattgtgagagtaactataagataaatatatttaaatatttttttatctattcaaaattttatatctgctaaaaaaatatgagaactttacaagataggtattaagtttacttaatgagattttgtgttcagatatataaatttagatatttaattatgactaaaatagtcaactaaaaattattatattttttagcatactcctatgtctatttttatagttaaataaaaaaactcaaattctttgtttactctttacatccctcaaaaaattagtattgactaaaagaaaacataattttaaaaggcgtcacattatcaacataatgaacaaaattgaaaagcagttattgacacaaaaggaacatgatatatttttaaagtcgaaagttgttgatccaaaggaacaaaataattaaaaagtcaaaagttattgacagaacagagcagaatttgcaaatggggggtgcttatataatcaatgatatagtgcttaaaaaaacataaacaatg

SEQ ID NO: 448 - DNA, 1510 bp, Glycine max
  Soy_ogl_2483 Gm08:3220801..3222310 Cluster 1
ttaactacaaaataaattgagaaattaaataaaaattaggagattaacaaaaataataataattttgtgaaatttattttaactctttttaatggaaatttattttaacttttaggaagaaagatcgatcataattttttcataagcatttataagaaaaaaggttcaattaatatgctgtttctcatacttctataaaaatttccgtctctaaacttttttctaattggatctttgtttatgaaaaaataataatagatacctaatcatatctacaaataatgaattgatgtatttgaaatatgttataaacacaactgaattaattataagatatttttataaaatttcaacctttggcaattatgagagatattttaccgaatttcaacctctgcggtggtggatgtacatccaactctatgggggtaattgttttttttttttaaagaaagtacaaaattatgagataaaagagaaaatacattgatatgtatatataaaagacagatataattgatagaacattacgaattttataattttttgtcttctattttgtaaaaacttataatatttttttatgaaaatattatgaaccgttttttacttccactaaacaaattttctgaatctgttagtattttgctgtacaaaaagttaaaactatcataaaactctcagaattgattcagctctgtgtataagattgtccaaaaatactagtccattatctatacctttaaataggtgtttatagttaattttttataacgataattagataaaagaatttaattgaaaaaaacaatttaggattcaatttaaaaacttgagacttaattaaaagtttggtaaaaaaatataaagatccgcataataattaaaaaaagctttttttataagttaaaattaatttaaatataaattaaaataaactttaaagaagttaatataaaataatttttgcaaattaacttatggataagttagttctaatttacacgaaaactttatttcagtttttataaaaaaaaacatatttttttttatctaaccagtattatatgcgtatataatataatttgacaaaatgaaagatcgaaaggaattgaaaatgtcaaatagatatttaaatattaagatatgtccatatatcaatgttctatacaaaacaccattgtctgtaataatttaatctgaattgacttcaatcagtggggcgtaatatattcagataacggtgggattagaccataataattagaaaaattaatataaaactctgtaaaaaaatactactactaattaggagtagtttgcagcagttgttttaaaaagtattctgctttttttttccataaagaaatactagtatttctcttcaactttagttgcggaataaatgctcgtgcattttgttataaactttatggcttccccgcacgcctcttgtaaatttgacggaacatcaacatacatataaaatactcacggtgtgtttggttgg

SEQ ID NO: 449 - DNA, 2000 bp, Glycine max
  Soy_ogl_3910 Gm11:35838401..35840400 Cluster 1
tcccatactgaattaatttattttttaaaataaattttggatttaataaataaattaactattatgaaaatatttaaatgtgaattaaatgatcaaattttcttaaatatcatttaatcatacgttaataatccttaacaataaattatatgctacaatttaaattaaatgattcaagtaagaagcaagtgtttagtaaaaattctattattaatacaattaatattgatgttttattgatcaattttctactaagattaatatcattaattaataataaatttatacaatggaatttttacaacactctctagttatttattttattgttcataattagaattttttaaatgaataaacagatatatcaaatttattatcataagaaatttcatcaaatttcataaaatttcacgtctatttaaaaataaaaacaaattatataaatatatcaaaattattgaatcctattatttttaaaaacatcatccaaatgcacaacataacatccacaactatgcattcaaaggcacacactaaactatacaaacaacttaacaatatattcaagcatgatcatccaaattaacattcaatatgattgttttgcaacatacaattatatataaactatatatagttaagatatgatttttgtggaataaataaacaaattatagattcaaatgcatgtctcttttcgtatattaaaaaatctatatctatctatactattataattcataattaattggattattcaatatacaaatttaataagtattttatcaattatttcaactatatatcaattaagtaaattaacacatattttgaaattactaatattattatttgtgtattttactcataaattttaaactcatttgttttatagtctttgtattaatcctttaatataaatcttaaattaggtttaaaaaaaataggtaacattttaaacttaacagtattaaaaattaatgatttcctttggagtatctaaaaacaaaaagaagaaaagggttgattaaacgaaagcttttacaggaaaaataaaataaagaataaaagattttggaacaattgttcatcaaaattgcaagcacaaaggtaaaaagaaaataagatttttgtttaagaagttacaatttaaatttatattgataaaaaaaagaaggatatgcatacatcttttagtactcactattatcaaatcttgaactctcccaatttaattgatttcacatggaaagaaaaactcaaaacagagaagaataaaaaaaaccctcgtggttatcctagttatggtttttgcggttaaactgttacaaacctttacgtgacggatgcttttgcaatgtgataagactatattgtgggtttgtgctcaaatttcttttaaagaaaaaataaatagtcacaaaataataggacagaattaaaaaaggaaagaagaaaaatttagaacataaaaagtggtttctcacccttttgttctacttctatattaattttttgttctcttatcctatgtaaattatgtttcaaaaaatttttttacaaaaaacttcaacataaaaatgtggagtcaatgggatataaaaaaaattcaattaaaatttgttactctttgccaagtgccatgcctatttttacacttagacaaaacacctcggatgaataacattggttggctaagtactatagttcattgcttttatgaaaatatttatctttttttattcacttgggtttcagtacagtctctcacccttttgttctacttctatattaacttcttgttctattaacctacgtaaattatgttaaaaaaatcaacataaaaatgtggagtcaattggatataaaaataaataaaatttaattaaatttttttactctttagcaagtgctatgcttatttttacatttggacaaaacatattagatgaataatacagattaaatattatgcttatatactaattatgttgatt

SEQ ID NO: 450 - DNA, 1400 bp, Glycine max
  Soy_ogl_5484 Gm17:3557201..3558600 Cluster 1
ggcacttgcattggtgttgccctttcaagatattgttcaatcaccttgatggtgaccttagtatcatcttctaacttcaactcacccttcttttatgtgttttatttttcctatttgagactcggaaagcaggcgatcttttttttatcaaaatgggtttaaaatgaaaattaattactattataagttgattaagaaaatatttattaaaattaatggtttttgtcacgtaataaataagagatgtaagtgtgactttgtattatgggttgatcaagcaaacgctaaatattcatgttaaatgattaaattcatgttacattttcaatcaatttaatgttgatacctacaaaaataaactcccaaccttatagcaatttatttttacctcaactttgtgttaatattaatgaggctactcataataaaaataaatgtataattaattatgaaaaaatgggtatatcttgttagtaacaaaaatgaaataatagtagtatatatttttatttcttttggtattgaaaaataaaataataagaatatgaattttagtattgttataatatactatgaatcatagattaaaatagttatattcttttttactgtggtactactttgtatatgttattaccatctgagattaaacagaagttttgactttaaaaaaaataaaaaagatatatttttgagaaaaaaaatcgtctaaacctcaaattttttatataatattttttaaaaatctatttgtacacaattcttttaagtattccaatgacacatttttttaggtttcaaaattatttgtattataataaagaagattcatttagtcgtaatattattttatttaaaatattattatgaaataaagattgaagaagtatattttaaagttatattgccttgatttgaccgaagttaaattgaataaaaatgaacataaattagtcattaaataaaaatgtttaatgtcgttcaatagcatgaaatatattagaatggtgtctcatgttacatgtacataataaacaaaaaaaaaacacaaggtatcattcatgatgacactttttatttattttttatgtaacaaaaattatccattttgattaaaataaaaagccaaaaatgcatgtgaaaagtatctcaattctttccgaccaccctttaggcttcaaccaccaagactttaaaattttctacacacatggcatccctttcccattagttgaggtttaacaaagttgtttttctgtttttaaatagacaaataggttttatcatctcgattgttaattagtgtgaactcctttcaaatttcaatattttttttttctaaaagcataccaaacaaatcccaattaaaattcatttatttcaagcaaaatatgaatttg

SEQ ID NO: 451 - DNA, 1510 bp, Glycine max
  Soy_ogl_922 Gm03:37249001..37250510 Cluster 1
tgaacctcttatcacgtgtattttgtttcttgaaaccttccattgcaattgcatctaaattgtgttgtggaagtgggaaaaaaaaatcccatgatgccaatagctctggggccctccaccttcaaacttcaatactctcattttttttcttctataacattaaggtgatctttatactttgttttaattttcatatctcaatttaattgctttttatttcttttcatcttaccgtaccgaacccattaactaagtctacctactaattcacccttcccatccatcctcgtgtatgcccacaatagcgattaattacgacaggcttatgattgattacaaccttctctacaagtacagaattataggagtatttattagttgatgataataacagcaactgtcatttccctcttagtgtttttaacttaaaatcttgataatcagtcttctaatcaagaataatggttaaaaaaattaaaagataaatgttaatcaatagcttaatacattaataattaaataactaaaataaaaattatttttattttgatgcgtaaaattatattgtcataatgttttttacactttcgtataatctttactacaaatatatttttttttaattccttaatcaatatttttaagaacaccctgattagcaactctcaaattaaagagaaaaaattcttgttgtgaaaacatagaaaagtgcaaaaaaaatcatgatgattaacataattttaattttatgcattccaataaaaaatattatttattttcttaaccatgattaacatttgtcttaacaaaaaaaaatacttaattttatacttattaagatattagttaagtgtatttttttaatttcatataaaaaattacattttctaaactatccttaatcatactaaaatattttttttacttatatttagtataaatttttgtatgccttagacatattttttaatttttataaatatggttaaccttgattttagtctttcaaaaaaaattgttgtcttttataaattaaaattttaaaatattatttattatcattcagtaatgatgtaacaagaatttaaattaatgataaaaaaactatttttaattttaaaagtttataaaagtttttttgaatccaaaatttataaaagttaacactaaagtttttttttaataattaaaatcaaatcagtgatttttataaggattaaaaataaatcaaactctaattaatttcaattattaaccctaattgtttttgaattgtgttttttcttcttcttaggaatgaaatgataattcaaaacaatgaagcaatttaaaaatatatacaaaaccataattattttcggattttggcaccgacaaagcatatcctcattcatggatcttttgtctgagagattttcatctaaggttttattttcatcctccatcaacatcatcaatgtgcaattttattttattttttaatttcttcccttacttttaccttttttat

SEQ ID NO: 452 - DNA, 1847 bp, Glycine max
  Soy_ogl_2085 Gm06:46205754..46207600 Cluster 1
taaataacatataactatatattatttttcagtaaaaataactttaagaatattgaccaatttaatgacagttctacacaaattagatgcagcaactagcaattcatacaataatttgtataacattggtttttgcatctatctctatatcattattacatgtaataaatattgttgggggagagaaatagattaaaaaaaattgttatataaattgttacacaaataatatttctcaaaattatttgacgaattttttaaaataaaataaaacttaaaggaaatttaagttataggttaacaatataaaataatttcacatttagtcaatcactaattagtgaaatttatttatatgataaatttattaacttttatacttcctctagttttatttataagacttaaattgaaaatagtactttattctttttatgagactcaattcataatgttattcgtattaattatttttagatcaaaatatcttaactaacaaacaaatacaagataaccaaaggagtattagggtcagttttcttaaacttaaaaaaattatgaagaaaaaaaatgtttttattaaaaaggtattttttttaaaaagaagatagaatttggtaattaaaaaaaaagtattttttttaagaaaaaccatttaaacagacactggaaaatagaaaattactttttttaaaaaaaatattttggcaaataagcttaaacaaactaatcttaatgacaatgttactttgaaaaaaaaatgtaaaacatatctagtgtagacaaactaatttaattatgtaatcttcattttaataattttgagtcatcaaattgaaactttaattttataataatcattaatataattcaatgtgatctaacaataatgaagaattaataattttaaaacttaatcttttataaaaaaataattataatttaatgctttctagtttactatttttattaaatagaaatagagaaaattaataaaataaggatgatatagttactccaaaataatattcattctcacaactttgtcgttgaacaacaacaatgataataatgatgatctataattttaattataataaatataagtattcaatttatgttgtgattaagttaatcaaacaaactctaaaaaaaattaattgaatgaaatctttaataatatcacataattaaaattaatatatttaaaataattaaaattattattttaaaatagttagcaactatatctattgcattaaaaaaacaactatgtctattaaataaaaattgcactatttcaaaaaatttaaaataaattttgactttgttaataaatgcatataaaaattattacatattaacattacatcaccaatgaataaaataaacatacaaatattattaattatatagtattatatattcatgtttgttatttttagattattttttaatttatattttttataaaagaaaatagacttgaaataaataaaaaatattttgataatggtttttttatttacttcataataattatgtgattgagaagatatataattgcgaaattacacatattattatgatttcttttcttttagaaccattattaggattatgtgctatagaattaaacttatatttttaatgattttagagttaagttaattattttcatttttctctttttttcttattcgaatgttaataaatatgaaatatatattgtataaggaaatatttgataagtaactttaataaactataatgttttatatattttattttcaataataacctcatgaagaattgaccatcaatatgcttaattttttttaaaaaat

SEQ ID NO: 453 - DNA, 1700 bp, Glycine max
  Soy_ogl_5942 Gm18:5406201..5407900 Cluster 1
tattccaaccaattgaatgttgcaagtacttggaaacaaatatttatatttcgtttcttggaaaagaaatgttcaatattttttgtctcattttcttgttaattgttcgaataaataaaaaaatgtcaagccattatataatatccttaatcagcttgttctgcattctgcaatatgtatttaaatatacacggcttgaatttttcttatggacctttatgaagtatttagagaaaaacatagtagctttttttggtttaatttcatatattatgaaagtgaaggttttttttttaaaaaaaaaaagtgaagatttttacaccttgaactaattacaaaatttgtaattagatgtcacttttaaaaagatttttattccaaactatatttttgaaatatatgcataaaatgaaaaataaaaagaaaaattattatatacaatattataagttaagttaatttgtaacattaaaatactgtctggagtatgaaaattcagttactttctcctttcccattcgtgttgtggaatcccaccaaagctggtaatttgtcagataatttgccaaatagaagatctttgacagtaaaattagtcatccaaatatatgacgtggaccttttatggaacctactagttatttttattacattttttactttttttcattcacatatttatccttttctttttgttttcttaaatcaaatagattttttttacctatttacattaaccttttatttttatctactttatttcgtatatattttttcctttttaccaaatgaactactttaaataaggatatgtgtagagtggctggtggtataaggctcaaaacataatataaaatgaagggagacgccaaataagattaaaatacctagagatgatcagaaaattaaataacatgtttgtttatgcttattttaaaaaacatttcttaataaataagtattattttatatgtttgcctaaatttttttttatttagaattttcactatcaaataccgaacatatgtattaatcaatgtaatattgtttcaacttaattaaaaaatgaagaaaagaaatatgtgtaaaaaaatttgtattgtaattcaattataactctttatatataagtttattaatttttattataattattttaaaagtatgatgaagtgtaattgaacaaatgtgtaaaaatattttacatgatgattaaattcattttctgcgtttcttaaacaatcattaaaaaactttttaaaatcacattttttttaaaaagtttaactaaacaagactaatatcttttacttatttctaatttttagctttagcttttaaaacgtttctttagaaataatattcccactttaatcgattttgaatgagaaactgattgttgagtagtatgaaaatattttagaaaacaatttttttttaaaaaatgaaggatgtcctaaatgcggctttaaaaatatcaatttatttttctatgccaacataaatgtgtctttaaacacatgttatattttcatgttcctctaaaatatcaaacaaacataataattaaaaaacaaaaatcaaataaacaaatctgtttgagaatcaaataaacaacttaatattcgttctcataaaatcttattatttaatagcattagaaaattagaaatattcatcaatatatacagttaactagc

SEQ ID NO: 454 - DNA, 1587 bp, Glycine max
  Soy_ogl_4365 Gm13:30565101..30566687 Cluster 1
attttgtgttgtgtgtgtgaaaggcaaaagcaatggatgctaattaattacaagaggtaggggctctcactctattatacctgcaaacttgtagtagtggtattatatataaagaattaatgaaacgacaatgtagatgtcattgtctacactgtagtatatctctttatcagtacctctaaaatatttcaacttaattaacatgcatgcgtggtcaattccctctctctccaaagtcacttccctttttctccccatgtccttttcctagacagtatttgattcctattcctccatattcatattgaatagcatgttacaggagatctaaggtgagttagcttattaaaggaggaaaaaattactaatttaatcatttttactaataaaataattcatatttattggcaaaaaaaatatgcgtacatagaatcaattagaaggaaaacatcaattaatagttttttttacataaaatcataaactattagtttgtctgttttccttaaaataatatggtcatttatttgatttgtctctatcgatataaaatttatttaaataaaaatattttaatataaatattatatataaaactaccaaatatacgtgtaaattaactaacgcaaaattatttcaccataattagtactctcatatttaaatcttaaatactattatgttaaatatgttaaatattcagagagaatttaatcatccattataattatattaattcaaatataattgtttatcgtcaaagacattaaaaaatatattataaatagaatgattactagtgctcgtacaaccacttttgcactctataaggtggtgtctttagctgcttgtttaaattgaaaacatttacaacgtgttagatgtttttggggtgattttttttttttatatatatacaaaatccgaacttaaactcataaaagaatagagtaatttattttgagcattccaactatacaaacacgttattagctgccattattttttatatttgtttattctcatcatattatttattataaatttaaatatatttttagtccttcaaattttaagttaattttgaatccctaaaatttacaaaatattttatttagttctacatagcgtgaaccaaacataaaataaaaaatgtgtaatttgtaataattttttactatcagaatttaactttctattttatattttaaaacataattttttaatgacttaaatccatcagaatcaagtcagtacgtgttaagcagttaatgaattttatttttttactgacttaattttgataatttttaactgtgaaacaaataaattttaatgatcaaaagttgtcataaattataaatttcttattctctgtttgaattacactatattaaaaggactaaaaaaaatattttatgaatttgagtgattaaaaaaattactttaaatctagaggactgaaaatatatttaaccattatacttttgtattatatctttttaggtataaataaactaactaattaatttttaggtgtttaaagtttttttttcaatattttaatttgaattatgagaacaatgt

SEQ ID NO: 455 - DNA, 2012 bp, Glycine max
  Soy_ogl_4612 Gm14:2559889..2561900 Cluster 1
gtttaatttggattgggtttaatatcctattttcagtaaaaaaataatattatagtttattatacattcaaggatatttattgtttgagtaattttcatatgttattaacatgttttttactattaattaattaaaatatattttatataaaattttaagtaattattataaaaaattaatgatattattgtacatgataattggtgatctaattggttcccactattaaaaacatttatagtctaaataaattgttattattttatgctacagtttcacacacacacacacactattaaaaacatttatagtctaaataaattgttattattttatgctacaatttcacacacacacacactattaaaaacatttatagtctaaataaattgttattattttatgctacaatttcacacacacacacacatatatataactatcttaatttgcttgttcactttttcttaataattatcaccaatttatgcttttagattaattcctttaatgaaggtatggacaactttaaaggtactccctctctctttgatacatttagatccatatccgttatgtaacgcttatataatattttcgaaaaataactatttttttaaaaattattttaagtatttgtgtttgtgttaacatttacttttcatattaaaaatatattactggtatatgttatacatctaaaattaattactatcaaatatttctattatattaaatagtataaaaagaaaaattcatagccaattaatgttaaattttgaggaaaacaaaaactaaaatagtttataatttggaaatcattaaatataaagaaagaatgttcaacacagcaaagtcgacgtcacatgtcaaaagtaaagtgaaggtacaataagttttttttcttcttttttaatgaacacagtacaataatttacatccattacaaacatgtagttttactgctatttaatacttacttttatatttttgaagaaccttcaattattgatattgatcttgaattttttcctgtaagttatgctttgtttttttacataaaacttttcattgatattcttaatttatttgttaaatatcaatttcagttacctgtatgcttttttttatattatatatattttttcttaacactatggccgcagttctgaaacaattatactttgttcctaatgattacgtgtaaggttaggtttcatcacatcgccctgctaatcaacccaatcaaaataggttagattgagttaaatttgtataaattttctatcaaattcaaattaaaccaacctaatcaatagtgagttgggtctacgggtattggaaattaaaaatatctcataatatttttaaaatatttttttatcattttcaaatgacattttgatataacttttgattagttacactgtgcaatatgcattttgatttttttctttctttcatatagtttaactataaacacaaaaattcatatgtaacaacgaagatgtgaacgctttgatttgttataaaataaagaatcctgggtaggataagaaaaaactagtatacttgctagtataattgtgtttggtgtgtgtgtgtgtttttctctatttttttatataaaaatatacaaaataataaattaaaataaaaatatgttacattaatagaattgttgggttaatggattccacaccaaaacccgacatccaacaaagaacttacgttttttttccactgatatatttttttttactaatcaaataaaaattaatgttgggtttatttattcactgatataaaaaatttgatagagtattgaaggagtagagttcgaataaaatactcaattaatttatatccttattatggtattaaaattgtcattgccttttgcaaaatgttaatttatatcgtgctatgaaaacaaaagcatagttctagaagaaacgtacgagtttgtagaaaccataaagagcccatagagacaattatcggcatatgc

SEQ ID NO: 456 - DNA, 1235 bp, Glycine max
  Soy_ogl_4713 Gm14:6365881..6367115 Cluster 1
atatctattgagagaaatgaaatccatgataaatctaagtattttaaaaaattaatcattaacttttcaactataaatacctgaatttactcaaaagattgattgtctcatttgttttttaataatatttgcttcctcaatagcgcttgttttgtatcagcattgttggcgcaatttattttgatataatctagaggtctcacgttaagaaactcaattcttttctataggatattaatttattctataaaaaaaaaatattactccaacaatgtaattcaattttttatttttaaaataaatagttttacactttaattatcagatgtttatctcatttgcccagttaaaatattttactatgacattaataattatttatgaagattcaccgaacaaaaaatatgaacaaatatataatcgacagtatatattcacagtatcaagtatgaggtagcatttaacttaacaaaaaaaagtaaacaaaagtctttcatgacaaactttgatttcttgttgggaaaggtaacctagtagtatgttgggtaacatattttaattaatttgtgatttgttttattagttaaaaaaattatttaattatttgataaatattttttaaatagttttttttatagtttttagtgtttttttagatgctacttaaaggaatgttttttaaaattctagagtttctaacttttaattttttatattttttattattattctcaatatatttatcaaatttcttaaatatatttttaaataaattataattttttattttacacttttcaacttctttaataactatttttactaaatatttataatttaataagtcaatttttcaatttttgactatccattaattttttagttaatttttgtgaacgtctagaacatgattatatttaaaggatttcaatttcaagtattgaatttttttttaaattcatattatattatattttaattacacatgtgattcaatttttttttaaagtaggaagtgttacacttttaattatcaaatattgattttaattgttcaattagaacattcaactatgacaagagacacttgttttgtacaatttattttgtcctatatcaaaacttgttcattaaattagatgagagtactacttaacttcaaacagatatgtaatagacaatggtctaaatcgtgctttcttaaacttgctgaaaacaatcattcgtgtgtttac

SEQ ID NO: 457 - DNA, 1665 bp, Glycine max
  Soy_ogl_5668 Gm17:13169978..13171642 Cluster 1
gataagatgaaatcaaattaggattgagacaaaaagggttaagagtgcgacttttgactaatcaagatacatatggtctcggtctcggatcttcattcaatcaccaccgttcaatttttccctttgcttcttctgtgctattaagtattataatgtattggggcagttgacgaagttattatacaattaattttcattgtaaaaaaataaaagatttaattattcatttgaatattaattgtatacattttcttttcgtacttataagttttgagaataatgactaaaagaaataaaaaaaagataatatgtataagaactaaaatgaattttaccaattattattgaatattttatgtattttaaaattaaaaaaataattagattcattgaaaatattaccaaaatattttttttcttataaatttttctctacataatcacaaattaaatttttaacaggttgatgtgactcagtataacacatatttcaatataaattgaaaatttgtgacttaaaattaatttgacaacattttgattgcattcaattgtttaaaaataatttacaaaatttaatgtttcatttatttttaaaattgaataatatttgttagactcgttgaaaagattacaaaataaaaagtatctctctttcaataaatctttttcttatacataatcataaattgatttttaacatctcgaagtaactcaaatatttacgacttcattgatttacttgaatattccactaatatcaaataattaataacgtgccacatcatacataatatcttaatagtttactttcattttaaaatcattttccatatagcccatataaataatacgtaattacgtactgtttaaaaattgaaggagataacagagttacctacctactcctttccagatgaaaaaaagaagaagagtgaattgtaagtttgatttcctataatttttattttttaaaataaataattttaatattttttattgatcattcaaaactaaaaattaattttaatgtgacatattaatgttaatctgaaatttatataaataattcatatgacacttatataaaaaataaaaaaaacatctttatagaaatttaaatcataatcctttattattcatagacaagactatataaatcacatacacttactttgtttaattaattagattaatatcattttctatgtaccattactcaataattattaattttttttaaaattatcaaaatttataaattaaaaaatatttaatgtataaatctttttaattttattttatatgtgttttattgtgagtattttatatattttttttatttcacccatttataattaaattttataaattagtatgtaaatcatttacataattttttaaaattgattttaatatatattatctttattctaattgtttacataaaattgcttattatgaaaaataaaggactaaatatcttaatttaaaaatagaaagactaaaatcatgaatttaaaattaaaattataatttaaccttaaaaaatatgcagtttttgttcacttcattgctacagtaacaacagtacttgttactttgaatttataccatttgaaaataaataaattatatagacacctaacatttagatgacgattg

SEQ ID NO: 458 - DNA, 2161 bp, Glycine max
  Soy_ogl_3010 Gm09:5272340..5274500 Cluster 1
cagttttggatatactaattaatagagtaattataataaaaatgacaagctgaaacgtactagaactgatttgaaaccctgcggatccttttaatcaacccagtagcatgatctttggcttatggaagtgacgatgataaagcatcttcaattactcacttgtggctgaggaagcaaggtctctgtctatggtgattgttctttaatttgttgaagtataaatcctattccagttttaatcagagaaataagcgctgttaaaaacattcgaattcgtgcagatatatgcagatcttcaatttgcttgaatttgtgctttagacaatttgtccaccacaaatactgatattctatggaataattaagtttccattaacaccgacatagggcacgtaatctttagatgatgacactattacactgttcctgcatgctgtacatagacacgaacttgatcatggtcaaccctatcgaaatctcatgtcattttcttgcaccacaaagcataaatcgctcgattatgattgatatcttcagagaacaaaatagataacaaaatgaaagagacattcttagaagaatgataatgctagctagtagattcatcaagttttctctttctaaaattgttagacaattttaatagatatttaacgatagacaatgataaagctttgttagaacaaagtttaaatggatgtttaatgtgatgataaataactgtcaatcacataccacctaattaccgaggagcaaaaataaattagctctcaaaaaacttaactaccgttttcaattcacgacctatatgagtttcttttttatttttatatttaatcagaatacattgacgttctaaaattctattacactgttatctaattatgaattataatatatggtaagattttgtttttgtaataattattttaaaacttataagatctaaaattatttttaattgtttaacgatgtaaattttttacaccggtatgctatcaaaattaaacttatttttcttattctttgtagctcactaaaattttacattctttcctgattattttataacagtgtgttttgattacaagaaaatggaaaacatggggaacaaaaggtttttttttttttaatttactattttttattttttttagaaatttagaaaaaaaagggaaaacaaatgagtaaaaagcgactataaaaacataataatactgacaaaacaattttcatgtaatttttaaaaattcattactgaaatttagtaataccagtattaatgataaaaatcggcattagtaactaatattttgatgtcacgaaagtattagtttcttgtagtatttataatttttggagtatgtagactaacttggtttgggattttattttttctctcattccctttcattactatattttcctttctttttccttgcaaatcagactactttttcttccgcttgcatctcctccaaaactattaattatttctttgttttcccttaaataagatgaaatttacatatgatttcatctctttccctaactaactaaataaaagacatctttttcttgaaaatcaaatgcactaaataaacaacatcaaaattatctgattatatcttatttaaacaacttatacatcttattcaatcaattgaaccgaatttattgaaccgaactttctttttatttagtttcattaatttgttcatttaatatctcataacatttcttgttattgaagaattaagccacttatttaccaatgattcttgtattacttaaaaaaatacatttataagtggtaatcggtaaacaataaattgagtgcatagctggcgctgcctctatcaagtaatcgaccttccactaacaacaacaactcctgcacatttcagatcgtcaagggacattttcatatctgtgtattcgactatatctaccgttattgattggatgttttatggaataagttctcattacggaaataatctcttgacaatgacagtactaaaatattccttctgtacaaaaaattcagataccttgatcatggtcaaaccaattaaaattaatctactatatatgccaattctttcaacattataaaaaataaatggttcatgatggggtggacccgtcacccgtgtct

SEQ ID NO: 459 - DNA, 2530 bp, Glycine max
  Soy_ogl_3152 Gm09:37245771..37248300 Cluster 1
gatagtgcattaaattaaactcttcaaacattccctaaccacttttattctaaaataccaattatactctataaaaaattaatttattattttagaaaaataaaaatgttaattacttttttttaataactgccactaaagacccaacagaaatcaggaaaaaagttgggaataactaccccaattaggacatcccttaaaagaggacataaggaagggggaaaggagtaaatgattctacaaatttaaaccaatgtctacatcatgatcattattggttaatgcatcaaaacttctaatagcttcctaatttatgctatggaaatttatatgggaagcaccttgcatatgagatcatataacccacacaacacaagatcaaggcaaggatgagatgggtccaagccactttagagtccatctccaccaagatccttgattactcaataggtagcaccatacataatccccacatcacaccccgcaaagttcatcttggagtactgctgaatagatgccatgttgcaaataaaaccttttagatttttcccagtgtcatcatctcttaacaaatttccacaagctacccatgagaaggaaaacacctacccatcagcatctggaataacactaagtatattttttctgttttgagacgaccagtatgtcggtcaatgaatattgatgagtatgagagcttttggaaatttaacttggtagatccgtgtaaagagagagtaaagagaagacacagtcaacttctatttgagacgtacaagaaaatataaaaggttgatcacatgattgagaaaaggtaaaaaaaaataaagaggttgtaagttcaattttttaactgagatttttaataaaattaataaattaacatttgtcaataaaaacaaaaaactatttgagacttacaattttctgagattataggaagaaaaaaccaaagctatttgacacttcaaattgagcatagaaattgagtttaatatattaacaaagctcgaaccaattcataccctcaagcatgattagaaatagatttttgatcaggagtatggggaaaaaatattggaaaaaaaaacaaagctttagtgatctctataagtagaagagattagacttcttctgttcactattgatcggagatatcttatttacacaaaatctgttttaatattataaatggatttttcactagttcaatatctagtcatgttcgtgatagtaaaatagaagataaaaaacatcttttaatataaaaaaaaggagaaaaatgtgtgcatacatagtgccaataaacgtataagaagaccctaaaacaatctacaaatgtgttgtgtcttgattgagcataggatgctgagaatagaaaaaaggggttagaacatagaagaatgacctcatatgcagcacttaattatctccctgaacttctcttttccggggcttttgttcatgattggatggaaataataataattaagagcaatagccaatgatacgtgttgggaagtaatgctaatgggacactctcacatagtattttttaatttttatcatccagcaaaatctttctgtcttataaataggaagcaaatttcactaaataaggaagcacattattaagtaattaataccaatggatttcagttaataagaatgattggtatggagagtgttaaatagtgtgtttttaacgttgtaatatccataaatcaaaaaaattgattgaaatgaaaccagatgaaaaaagaaatttgattaaagaatagataaactgaaatatatatttctttttttcccctaccttttcattctgattttacttcgtttagattagcaaatgataatcattaatcaagacattcaaatcaacaaatggtgacacaagatagtaaacatagttgtgatgaagatgattgtttcttatgtagacatcttttcactaccgaaagaaccaagaaagctacatttcataaaaggatgcacagaaagctacactatattacaaaaacggtatgtctcttcttctatcatatgtgaacaaggcataaatagaaacttaaaaaagaagtgaaagaacaggaaattattatgctaatttcttaaaatcttccaatctaagtttttgtacagccaaattaattaaattaaggttccttgttacttgttagacaaaccaaccattttggagttatttatttagtcggctaaatctccctaggaaagctcaagcaagaaaacataagccaaatccatcaaataggacaatggttacaccctattactggatactgaacgtggaaacttcttttaacaaagattcgaaacatgattcatcatattatgagatactattcccttctgttaaacccaactttattggtgttgcagcactaattatttcttcacagattgtgtgtttattgttagaatcctctgcaacctatgaaatcttagttgacaatgtcaatttgtacataatttttccatcataatctccatttgcgggattcaattt

SEQ ID NO: 460 - DNA, 1732 bp, Glycine max
  Soy_ogl_6500 Gm19:42221969..42223700 Cluster 1
tattatatatataaaaaattaaattatatataatattaaacacacagatacagacacagacacacacaaagttgagaattgttccttcaatttgttacattcttttttttttcttaaaaatcataatatataatatatatgttgtatcaattatagaaaaaaattatattgtttacatattatattaggataatttaagaatttattctatataagtttaattgagaattgttccttcaatttgttacattctattttttttcttaaaaatcataatatataatatatatgttgtatcaattatagaaaaaaattatattgtttacatattatattaggataatttaagaatttattctatataagtttttttttcctgtgttacaattgattgcttccgctttggagtgccaacatagttaaatgctatcattctatttgtttttaaaaaattatatataattttttaaactaataagaatacacacaactaaacacacattatatgcatgttatcgatccagtaaaacatattaatgcttaaaaacagtctatatgacaatgaaatcttatgttatcattccctttttcttatctcagaaagccatcatatcgaaagccattgactgagctaaagaatttaaaaagcaaagcactaattttagtaagacgatgtgggtcaatattaatctataagataaaatgtacaactgtacgtaccagtttttaccagagaaatcaggttctataaagtagttggaggacgtgtctgacaattgaaccatcatcttcatccataaacccaaattgtcccctctacttgtccttcctcatgcaattgctatgtcaggatacattgaactaagattattagatagaaacggcctaacattttgagcgccacctgtttttcctttattctctatgagaacctcattttcaatgtttataattaatattaagatccaaaaccatttctttcacattttccaacatcaagtactactaaaatatgcatatatcgatctgttatgtttgaagtatacaagatagtgggtcaaacttaatatatatgactgattaatcctgactgatagatgaattatgatagagccaattcaaacaccttgaatccagcctgcacaagtgacggtgtgtgtaaaggcttttttttttctttttttttttaaacagcaaaaggattttattagttggtacaagaagtaccttggtcatatacagaaaaggtggatgtaatgatgatgatgccatcggatccatttaataaacttaatattgtttctgtaagtaattgtatctacatgtattatgtattactccgaaaaaaaacatgtattatatgtattattatccttagcaaaaattgctctaacaagtaacttctatcaattagaagtaaatatttaacttatccaaaggtacgtaagtcccatttgaacaactgaaaatcatgggtgtaaattgacattaattttttttatcattcagaaagaattgacattaatttgatataaggttaagaaggtctttgagtactatttttcttttgagtaattgtagcgatgaacttgctacataataccagaagactatcatagttgaacgggcttcttataacttgaaggaaagacacacatttgggatgtgtggctttgctttgtgaacaaacacattccggacttttagtaatgtgtcatggagtattgaacga

SEQ ID NO: 461 - DNA, 1900 bp, Glycine max
  Soy_ogl_1673 Gm05:34648801..34650700 Cluster 1
aatcgatatacgcgcaggttacatctttgttgccagttgacgatatattaactgtatgagtagaatcgagagttaaatataaatttagaggtagatatttatatttactagtattgagtttttgcacaattttaaataaccaatcataatttgtttatacaagtagctgattatactatacaataaactagtagctgattataaaaggtgaaccaatttatgatattgcgaattcaattaattatatattcagatagattttatatatcaacaaacctatacaaaattaattagatcacaaatgcattttcattcataactatgatctagagataactatgctcataaatgtattttaattatatgtctagtgcttaatttaaaaaagaaaacggtacttcataggcgaaatggagtgatattaacgaaaatgcatagctaactattttctgtattagtacataggtttttatagatttgaaggaaactaaaaaataaaaatatcaacactaaattatgataaaataaagagtcgagatttaaaacttaaaattcaatacatattataatttgaacgaaataatgtatgggtgcataatcattatctttatgaattcaatacatattatatttcaattaaactccaataaaaatatttgaaaaaaatgaatagtatccttaatataaaagaagttacgcaatttaataaaaaattaactgttaagaatttattcatttaaaaataccaaatcatatttttttcttatatattaaaacaatgttttaactagctaaacacgtgtcagcagttgaaatatttttatccacacatttccttcttttatcttggccattatttttttttttatctaaaatagtatttcagtctaaaagatatataatacatttaccttctcttataataatttgtgtgaaaaataaatcactcacttactttttagtataataatcataaattatataaatggatttgatataaaccaacttcttataaggggataaaactattgtgttcacctacaaatgttgggagggataaatgatcaaaagttaaagacatgactgtcctgttgaagctggatcagtaaagacagttttaattaattccactctcaattctcaaccaccgtccacaaagaatctcaaattgttttcaatcaaaccatgtttgtttagtatttcggagtcaattcaaagtgcttttacatgcatcaaaatgaaatacacacacatatatatatataacaaattaattttatgaaaaattacttttgaagtaatttgatcttaacaatcaacacatacatgtgtatatagaaaataatataaattcacacaaatgattaagattaaaattaattaaaataattttgaaattctatgtttagttttatgtccaatattttctcctctcactaaatatgtcctatataatttataaagacatgtctaatgtcacacacatgccacatttttaagccatcatgtcatcattaactaataattttgaacatatgtgtatcattatatagttcaattttgtaattttcacttattttatattttactcatttttttaaaaaatgatcttttttcattcattctcttttacactttgtttggtcggtaagaaataggtgagaaatgaaaaaaaatgttaattttgagtggttaggtcgaatgagaaaggatgaaggttttaaataaaaaataaataaaaattgtgggttccacaactaaacatttcctctctcaacttagtgaaagtgtaagaaaattggaagtgtacattttgcttttcctcgtttagcccctcacaacacctcgtggaatttgtgggtgttgctcttgttcgagctgcaactcttcattttccacc

SEQ ID NO: 462 - DNA, 1676 bp, Glycine max
  Soy_ogl_2411 Gm07:38143578..38653 Cluster 1
gacagaggggcatactggaaggcttgtagttgtacacttttaaattaattgatggtttttggcaataatgtttaattctcttcctcactaaacttttaaactaaaaataaaacggtgactagaattttattaaatgggacatatattggcgttgtttaatttggtcaaataatactttaattagaagcaatatagtactactatattctataattatgccatacgaactattgaatttatgaagtctgattctggcatgttgccaccatccaatgttatttttgtctcaatatcaatgaaactggataaccacttaatgtatcatcttatatttttttttttacgtaacaacgtcatataataaagtttgtggccagtaaaaaaaaaaggtttgttaaaacttttaatgataatggcaaagatttaaaagaagaaaacaggaaactagtatcatcgtcttttttttttttttttaattacaagttcttaaaatagcatttatgtacgccttagaaatattttcacattatttctacaaaaatttcaggctacctacctaaaataaacataacagcatgctagaatttccccgtgcatagattccaattttatattgtataaatattataaaaaataagcttcattttatacattagtggcgtttaatattatagtttacagatacaacctatagctagtttacagattgacatatgttctaggaatatttacactatcgattttagatatattcattttcaattgaccaccaacttaaaatcaataccaaagctcatcctgaaatgccatgtaatccacttaactcacaagttgaggttgatcaacccggattaattaagccaggccattgttttttaaaattacttttcccttatttgagttataactataaatcccttttatctatttattctttaagtttgatattataaattagtatgttgtttagactttttatatttatatttgtcttttttttttataattttgttaaaataagtgaaataatttatgagtatgctcatgaactaacagaccaattaatttatgagtgacaccatgagctagttggtatcttaacgtcaaagggaccttggcttggtgtattttttttttctatcgtaaaatgttagtttattaatagttttgttaaaaatattaacagaaggaatttaaacgtgtgagttcttctttttttcatcttcctttaccttttcctgttcacacagaattaaccttatatctttcaccttggcttcgtgttttgttgggtaaatgttgtggatcaagggattgaggtaattggcttgacgcagtaatcttgtgaatggtttgaagtttgaaaacatgggagctggtttggttgcattgtatgtgttggctaggcgtgaggggtggttaatgcagcacttttttctttttattttcattcgatggttaatgcagcacttgtttacactgataggcgcgactgaacttagcttctatagtgtagcacgtgctagctcctctccttgttaatgttgcaccatttcacgctctccttgttaatgttgcaccatttcacgctccacttgtgcatgcaactgagcaaagtagtaccataatcgatgataatttagtttacatataatttcatgataaattgttctctc

SEQ ID NO: 463 - DNA, 1075 bp, Glycine max
  Soy_ogl_4947 Gm15:9317801..9318875 Cluster 1
agtaaagcaaatgagcccttaaaaacttaaagtcaccggactacaatattaattattttcatgttgaaaattgttgaattgcttttaaacaaagcaattccgtacatgatacttgactttgttatgcaaagtattaattataagagtgtttattattcaatttggatcgatcgacttttaatgaaactaaattgtagtttgaattgaaatagttataacttggttctggttatttttcagggacgttaaattataactcaaatatataatcaactgaataaaaactaagctaaaattataaatatctcattatttataactcgcaacatgacgtcaaaattatgaattattaaaaatatacatacatattcgtcagtaaattaaacaatacatgtggtaattagttgataattctctggatacatattacttcttatcgaatatttaatttcttctatttattaaaagatatataataacaaagaacaagagatcgaaaatacatttaactaattaatacatttataaaaatatatattatattatttaatgaaacacatttgagatagcaaatatgattacaatgatatttttatagataaaaattatacaaatattttagcatgtgtattgcaatttgcatgagtcatttttttttatataaaccacaaatattttttaccagaaagaatctcttttaaaaatttaattgttttaagatttaaattcaagatatttgtgttagaacaatctcaatctcgccgcaacttagtaaaatcttgaaaagaaaataagatagtaattaaattttgaatacaatgtgggattcttaagtgacattacaaatcccacgccatattgtgagttgacattcttaactgctagcttatcaaaatattgtgagtagatcacgagtcagttatattagatggcaataaatggcttgggtaaccaattcagtttggtaattcaggtgaattggtttattacatatcactgtaggtttttttttttttttggattctacataataaattattttatacatttaaattttataataagtaatatatgt

SEQ ID NO: 464 - DNA, 1943 bp, Glycine max
  Soy_ogl_5159 Gm15:48320231..48322173 Cluster 1
agtatcttacctatctaaatatgtgttatataaaaaatttattatatttatctttattcggttggatttagaaatcttttatatataattttaaactttcaaaagaaaaatattcaatcgtgtatgtataactaataaataactattatatgtaataattatttatatttatattattaatttcaaatttccagtaatgtgatagtcataaatattgtattattactttaaaataataacagcatgatattaataattaaaataattactattagttattctcattaatgtgtgcattaaattaatttattaatttgaatttctttttattagcattaatttgtaaattaatgagagagtaaatttagaaaattgagtgggaatgtataaagtaactgaaattatgaaagacgttaatgaattgtaaatttgatcattcgtaaaaataataactctcatcagaaaaataagattggtttggattcaaaaaggcatcacaggcctaattaaatactaatatggcttcttatttattaaaaaaaaagtgtatcttaagattttaaaaaaacaatctcctaaaaaaagatttaaaaattaacaaaattatctgatttcaaaatcaacttctattctataaatttaaatctttattcttgaatatgaggttatcttttattattttctttttctttttaacattttttttacttaatattttatatgctcatattattaattatttttaaaatattttatgctaagagtcttttcctcaaatcttaataaatatatattaattttattcattgaaaatttattgatcaaatatcgattacttatattgtcaaattattgtcaagtcggattgatatacttcctttgtttcactttataatattttttttggtagagctttgtttcacttaatatggcgtggtttggggggaaaaagtgttctaaattagttgccattttacaaaatccatgaaacattaatttttttcgcataaagtaaacttagtaggagtaaagaaaaaaaaaataattaattagagaaataaaaaatatattagaaagttatataatatttttttataaaaattataatattacatgtcaaaaccttaaacgttatgtaaaatacaacgaagatggtataaactttaaatttcatcaagtctaaactcatatttctttttaatgttttattatttttaatagatgttttcaaaaaaataaatatatctgtgacttgatgaacccaaaccaattcaagtttttgattgaatatcatacaatttaaattgggtataaaattctccacacacaaaaaatcaactcaacctcatttaattaatttaaatcaaagttttccctaaattatctaacccaatccaacctaccacccaaattcaaaaaaccagatcaattgtttgttttttttcaagctcattatagcacaaacctttcaaatataagtccatacgatgaattagcgacattaattagttgcatatgttactaaaattaagacgtggatggccacaagttatattattgtaggaggttgcaattcaataaatatttaaaactataaaagaccattaaagaataagaaataaaacaaaaatactcttcctgctcgtctttacctaaccaaacggccttgaacaataaggtgtgacattgagattgttttaattgaacaagtttggatgcaatttaaaaaaactggttgggcagaagcacaagctaggccgaaagcttgacatacttgatctaaagcatttatcatttccacaacctatatggaatagaaaagaagacatgctttctgtttgaataaaaaagttattgactaaataaatttataaattcatattcccatttgaagtgacatttttagctacctttttcatctaaccttagaagtacatgtaacc

SEQ ID NO: 465 - DNA, 1700 bp, Glycine max
  Soy_ogl_4720 Gm14:6481701..6483400 Cluster 1
aagcaaaacatagtttactaatgctatcaaggtcacttaaacaagaataaaagtcgctaaagcaaaaaaatgttacacaatgtaaataacaattttgcctaagctatatattatttgggatgggatcaaatgatgttaaagtatcaaaattaactcattaactcaataaaaaagtaacgcgctctctaagtccctcacgcgtcctctcattaacatcacctctctaattacttttttttttcacacatggtcattcgttccttatttaaatctatttgaatttgagtgtgcatattttttttaatattaaccgttatatgctttgaatcggaatattagagtcactagttttaagtagacaaaaagaataaaaattagatatataaaaaaatcactatcaaaaatctattgcaactctcaggttaagccttcaatttccgtccaaatagataacacaaagaaattctggagaacaaggtcatgtgaagggcttttagagagaacatcgcatttttaaaaaccaaagaaatttccatccaaatagataattcaaagaaatttacttttaaaaccaaagaaaactatgccaagggaaaataaagggatgagatctggtgtgaaacttaatttgatggtgtcatttaatcttaacccatgttatttacatttatttaaattgattgatttattatgttcacaaaaaggttttttttttcccttcaaataatacaaagtagtctagccttttgtgagtaatgttatatcctttaaaattttctattattttataaataaaatattaaatgaaaaataattacatttaatgttttgaaatataagattgcagtcatgaatacttttttcagattatatccaatcaatacttattataggataaaaagagtaggagaactaatacggtaatatatatgttagaaaatttaatttgaaattctttaatttaacatactttcaaaaaactattgatctaacctatttaataaattaaaaaaattaaccttagctgtaatgcatagataagataacctataaagtgtaacacccgtgaccagtaacttgatacttttgtaaggaaaaactacaaattagactaatgtgatatatatttaactttaaaataaaaagctatacttttttatttgtaaaaattaaaagatatataattttaaagtcttttctatatcttttttctttctaatgaatcaaacattgttacgtattcatttgttatcaaaactgattgctagaaatattatcaattcatttccccaattattttgttgtgtgaattttgaagacaaagaataattcattcaatgtttaaattaacgtataaaactgatttaaattttgtaactttttataaaatattttaaattttattgaaaatatgatctgacctcattattatcacaattaaaatcattatttctcttatatcttatatattattttaggtgtcaattagtatttttttaattatttatctttttacttttgtatagataagaaataaaggatgattagacaaataaattttataaacatatgcatcaaacaattataataaatgtgcagcatgcaaaaatggagtcaaatgaaatttttttcatgtcattgtttcaaaggcatgaaactttaagcactcacttttcataactttttcattttgctaatca

SEQ ID NO: 466 - DNA, 1578 bp, Glycine max
  Soy_ogl_6207 Gm18:56769876..56771453 Cluster 1
ctatgaaagtatatggaagaatttctttgaatatactaaaatacatatttgaattatgataaaaatatcattgatttttattgttttatttgcgatctaacttttattaattaatatctaaattactataatagtgaaaatcagttaatttgcctaaaaattaccttaagaattgacattcatgttaatcacgtttaaaaataaaatgtagctacatttggtcattaagtaaattaatcataaatttaatataattacataataaatgaatatttcaatcaaattaatttattttgagaatgttacgtgtaattgttttttatttcaaaacaatttattttacaaaactccggaaaaaatcacgtgtcaattttcatttttgaaaacattttcctattatgttttctttagaggattttcatatgtatgcagcatagatgtattttaaattcgtataaacatgatagttttttagttttttacaaagttttatttatttttatctttaaaactaaaagattataagaagtatttttagttattaaccagagactcaaaatgcatttttttttgttaaatataattttcaaatgactaaaagaagtatcatataaaattaagtttctcttccgattaaatacacagtaccggtagtggtcagttacttgttgatgggagagatataaacaggtaaatgatagaaatgcaactgatgagccggttgaacaaatatggctctacttgagccaccaatgatatgcaaacaccataatatttttaacacctcaataatatctcatttttttatattttttttatttatcatatcgtaaatttatatatttttttatttttctttatctaggtgtaaaataacatattaaatgtctatgtaacattttgcattaagaagatttactaaaaacatgcatgtgtttaacgtttaaggtattctcaaaacacatattttttattaaaaaatatcatagtttcattatgtacgtgtttttatattatgagtttaagttttatcattgtatatgttaataaattataaactactatgcaaagttgtattataaaatttggatgtatagttactgcaatattattaaagtatgtttgattctatatataaaatttttaggttaagtattccgaatagtttctaattccttggattggataggcatgttatttttgattcaggaaaaaaaggttgatacgataataaaaaagatatgacgtaaaaaagaaaaaagatttttgataagattgatacgtgggcaaacaaaagacaagaaacctggcgtgacggcggtccaatcgaaactgtcttaatcatacgtaacatcatgatattattttcaattatgagtggagaaattggaagcattaattattattacgaaatcattgtgtgttataattctgtttagattcaagagtaattaaagtaacattcttattccgtcaatttcttcgatttttgttcttttctatagaaagacaggaaagataaaaggaccttaaagagcggctcaagaatcttatagacttggaataaatttaagaagg

SEQ ID NO: 467 - DNA, 1708 bp, Glycine max
  Soy_ogl_1980 Gm06:16104711..16106418 Cluster 1
gttaaaaaattaactggattttaaataagaaacttcatataacttctgattacacacaataagaaattatttccacgaatttgaatgtgggatatagcattttcgtgtttgctataaattgttttaaaaaattgtaggcatatatagttgatttttatgaatgggtcatcttcatacattttgcctacctttcattttcatgttgacgaacgagtgggaatatataacaacatatataattcaactaataattttcattctcgcttttattttttctttcataatttgaatttaaaaaaagtcaaaaatattaaatcataatcaaatatgatttttggtttagcaaggatgtgttcctagcctgagtaataatattcctaagattgtaattgaaataaaactattatcaccgagtagatgaattaactaatgcggaaatattctacattaatcattagtcttgagtttaaattttatacatataattgtgttaaataacggtggaagatatatacttatagtttgtaactaaataaataaacatcagcaatttctatttatgttttcattatatcacctgtgatttttttttgttttgtttaattgaactaattccttccttgctcattctttgtcaaaatatccagcttgtgaattttgttgatgttaagataattaaatcttatagctttagattaaataaagttccaaaatttggaggtcacacgtacatgattacattgacatatgcactacgttagtcaaaggaaattgaaagattcaaaggtagaagttaaatagaaaatatttcatgcattatatgcgggatatttgtaaatgcacggttgctatctcgcatatttgcaaagatttcaggctaacaagtaacaactaacaaggttacctctatttttttcagaattttttaaagaatattccaattattattttaacgtcttgcggatagaatttccctctaccccttttattgaaatatatgattttgcttattttaccataacagcactgggatttcctcctcaaatatgataattcaatctcactcatctcccctttctctttcttaattgtgctcaaacccattcaactagtaattagaaactcctggatttctaagggtaccatagcgactcccatttaataataggtacttgaatgtgcatgtaaccataaaaaaaattaatgtttgaataattcttattaacatagatattaaattaatacttgaaatattagacatgaaatgtctaatatcgtgaaaaggtcctattcaattagttgagtaaattacatgagttattataaactctaatgttgacttcaattcctaccctaacaaatcaatattactaataatatatttttaaatatattatctttaacacttttttgttttacttatttattaaaatttattgaaaactattcagctataaccctttcccattattaaaatttatctataaaaaatgcatggaaaaaagtgtattaataaccctttcccttatggttaaatacttccaatcaatggttcaattattgtaaatttggctgacagtatgtcaaaaacctgaaatatcataacattttgtccttggtctagattctagacagcccattttttcggtaacaatggacaaaacctaccttaccttccgcaatatgatgagaccccaaacaaaacctt

SEQ ID NO: 468 - DNA, 1156 bp, Glycine max
  Soy_ogl_4712 Gm14:6364501..6365656 Cluster 1
agatcacagctaatgtagtgagatggaccatacaataatttctcccataatggagtgaataggtgcaaattaactaatagcaaatatgagagcaaattgtttgatcaaaatgacctccaactcttcaattatgtatattggaactcaatgctagctattaaggaccaaaggaatcaaagagaagtaaaaaaaaaaagaaaaaagtgcgggggtatgagtacgtaactattcaattaagttccaaggcctaaagaaacaacaccgaatgaattgaatgatggtgttcagttgcaagaagcttgcgtttgcaagggtgaatcgtgaaagtgggggtagtagatttccactaacatactgatagggttaaaagagctatggaatctgtgattagaatcccaacagcttattcgattcccactagggtcccccaaaaaatagaaatttggaattttatgtgtaaggatgattaattgggggattggtttatttcatctgaaattttgataagattatttagttaaacttaaatctaactcgattattgttaattttatggttaaaaatttaaacctatactgcaacttattatgtttgcatgactgtatgatgatattgtttatctatctcaaattctcaatatgatatgattaacagatgattttgtgttttcttaatttttaattataagatatttttaattaatttaccttcctaacaaaaaataactaatttaattaatcacgttagatatatattaattattggtatcaccatttcaatttttttttctctttctatccacttaattatttttttattaatgtttagagagagaataattagataagagtatatagagaaaaataatgaatgcatctaaaaattagaaaaatattttataaaaaaacaaatttctaaaaaaaattataattaaagataaatgaatatcttaaacatgtaaccaagtatttgattcttgatccatacatataaaaaaatatctactgagagaagtgaaacccataataaatctaagtattttgaaaaattactcttccaaccataaatacctgaatttactcaaaagattgattgtctcatttgtttttttattaatatttacttcctcaatcacactttttatctctctatttac

SEQ ID NO: 469 - DNA, 2085 bp, Glycine max
  Soy_ogl_6154 Gm18:53416596..53418680 Cluster 1
taattaatatcatcaggaacctgattgaccacctatagtgagttcctcctcttaaccatgtttttcatctacaaagactaaaacctagaatgctcattgcttaaggaaattgaataaattaagtttcactcaaactaataatatgttatttaaaataatttagcaataatatgttatttaaaataaaataattatagaaacaatatatgtatttgaaaaatgatgttatcttttgctagaatttaacatttttagtgaaatttgaatttcttttgttttatttcctatcatcattatcatgatcatttttaccaaaatatctttttatagatcatacattcttacaaaaaatttgagttatatactaattttaataatatttttagggggtgagacaagagagataaagtctaaaatagatgcaaaattatttttcttaacttcttttaaataaatgataggttaaatatttttagttcctaatctttttaggatttatgtttttaatccctaaactttttttattggtcaaggtctaatagttaattaagaaactaaaacttttttaatctcttaacttttatatttttctgtttttatttttagtccatttttccttccttacaaaataattaaggggattaaaaactattttaaaatagtttagggactagaagcaaaaatcctaaaaagattggaaatcaaaagatactaaaccctaaacaataagattacaattaaattattggcatcttaaaactggatagtcttatgtatgaaaataatataataaataatacattatatcatgataaatttatgacatagttataaaaaaaatgaaaagtgttcaattattagggccaaagaaaatcgcctcaatcgctttttgctttccactaccctaaatgtctctcaccgtgggaaaatatatttttacagtcggatttgcatctattcaacttttaaacaaacagttaagattttcctttgccttttgcctatatttttacagtcggatttgcatctattcaacttttaaacaaacagttaagattttcttttgccttttgcctttttcctttttctattatttaattttctttgtctttcctaatttaccccctcacccctctatttgcgacaattcaccctaacccttccccgacaaccacggagtgtgacgccaccacacacgtctcacccaaccaccaaggaccaccgcactccacctctccatcgccatcatcaaactaaaaggaccttaaacggaaaaatctgagagagatggggtttcgccagtgcttgcggtttgggagtatggggtggtggaattcggtggttgtaggcgaggttgaaatgaaggagcaagattgtctgtaacatagaaggagggccgcggtaacggacgacggtggcgacggacaatttcaccgctgagagagaaagggacaggggcaagtagggaaacacaaagaaaacaaagaagaaaaaagaggtttaaccgttgatttagaaaactaactagatccattattggtgaatttttagtttcctcccacgttagccggtgtcatgttccggattcaacaaaaggtctagttggaaagtcgatatattagtttaatattcgatttaagtaaattatctaaatcatcttgagaataattagtcaaaaaaatagagagaactggtggtcaaaattggtaaacctagtcaaaatcatttaaaaatgatcacaacagatcaatgaaaaacacttaatataatgccattttttaaatgaaaaatcaatttaagaattttccattttttttaattctataagtgtgcttattattgttaatagacattattgtgtattattacaacataggtttaagtactatgatatataattttgaatgttaaaaacctgtaaattgatgtttcgtttttaattttagagttaaaaaaattaaaatattatgtggggctatctaacttatgccagtattcatgcaaagaaaactcatctcaatccaaatattatttggttttaaattgaatttaagtttaaatactattttagttcttatcatttaa

SEQ ID NO: 470 - DNA, 1400 bp, Glycine max
  Soy_ogl_69 Gm01:2967201..2968600 Cluster 1
ccaatacattttccattgtcatccttaattggtatgtcattaactaatgttgtaacttgagaggttaacaataatttttcaaaaaaaaaaaaaacttgaacaaaagataggatattttattatagggatcaaatcgttatttaagaaggtcatgaatattacaattaagaatttaattaaaacaatataacaatttgataatataaaatttaaccataatttgttatgtaaggtaatattttcaatttttataatacatattttaaaatcatatctaaaatatttttaattgattaacatagtaaattttttatatgaacaatatatttaaattctcaattgattttaatataataaataaacaatcattataaaaattcattgataatttaatcatgtctttccatcaagtcagacaaaagttttatcatcccatccgtcttggatcccaagtttaattatccaagatcatcaaacttatatacagaatatttacatttttaagaaaatgtatttttcattgacttaaaaatggctttatcatgtacaacattcatcataattgagtcttttgtaacaaaggaaaatggtgggacaaagtttacgtgtggaacgacctggaagtatagtaagtacatttccaagatgcgaaaaccagaggctacaaagcagcaggtgaaccctgcaagcctctttccaacattggacccctaaggttggaccaacactttttttttactccaaacttaaatttgttgcatgacattaacaattacattttgttggaaatttaatttataggtaatgttatgtaaaatttgtttacattattgtctcagaaaaatgcatataaattattctttaaattacaacatactaaaatatgtttgaataactgtccgaacacgttccaatgtatccaaatggaaaagtttctctctgtatgcattgaaatgaaaggacgtttgaggtgttggaacagaaatccaaacacactactagttatcataaaaatccattatgtgtttactatttaatgtcacaatgtatccttttattcaattttgtagatttataataattaacacagtatatcatatccttctaaatctaactttggttaaatcgttagctatcgtatattcgtatgtgctttgtaaattttgcacgaatgtatgtgtattaagatgttcttggttaggaatatgatcacaatgcttcttatatatgaaggttggtcaactctctctctctctaaattggtttttgagatttagttagcctcaatccatttctattacaatataaaagtctctctcaacatataagctttaatactaggtcatagtaatgtattatcttatttcctaaaataaaaaaaagtctgatccaggggcgga

SEQ ID NO: 471 - DNA, 1550 bp, Glycine max
  Soy_ogl_212 Gm01:227201..228750 Cluster 1
gctttcaccctgcggattgttgttgttgttggttggatgggatgtgtcatcagagggagaagatggagactttttggtggaatcatcttcagaagggttctggttctgcatgtctgtggctgaaaatgaaaaacctaagaatgatgaaaatggcaagtgtgggaaagggattgaagagattgtgatgagaagagtatttatgatggttcatatatatgccatgttttgagtgcgaaaccactacatgagtttggattgaaggggtatactagctagcactgttttgttgatgctgagaacgcacccatttgtgaaacgatgcaactgtgcatatttatgattctagaggaagaaagatgctgcggggaatgtatgtgtcagtttgcttaaaaaggcattaaattaagaaaaatactattattcacccatttattttctctttcatctcacttctatctcattattttttttcttccttttctatcacaatatcataagagtaactcttaacttaattaaacaatgaatggtagtatattgctataaacaataagtttaataaatcgccaaaatttcactatactagctcacttaacaatattataattttatctaaaagtaaataccctctaaaaaatctaaaagtaaatatgcattacctattaatattaaatacttattattatcaactcttctcattattctcatactttcatttatttgtcttttacctttatgctcccacttgttttgttttacttaagttaggacagaatggtaaaacaaaatcacacccctctccttgtaaattctagatgagactctgtctcaagcctcttaatttgttacacctttagcatctcattattctcatactttcatttatttgtagtgaataaaaaataagggtgtgacgaagaaaaaatggtgaaaatagaatagccctcaattcaaagctaaaattagatatacgataaagacttattacctagcttatattaaactcggactaggccaaggttatttaggaaataaacatggtctaagattttataaaattctatttaatttaaaagtaatattataaatcacttaaaaagtcttttaagtcaaacaagtcggcagaatataaatgatgatattttgttagtatttttattattatattaaatttggtctaatgtattaaatcatttattttttttatcttttttcaatattatttatgttgacttacatgatgagtcaaatctataaacttatagaaagataaaaaaaaattctgtttagtggcctttttacaaaatagatttttaaaaaagctgtcatgaatgtcaaattaaatattaaaaataattggggaagtctacatcctttggctttatattttaaaaatgaaaatatcataaatgtatgagataaaattcatttaactcatttataatggacattaattatttaatatttaaatgataaaataaaataaataaataatattaaattctaaaatattatagtcaataccattattaatggcattaattataatg

SEQ ID NO: 472 - DNA, 1644 bp, Glycine max
  Soy_ogl_2416 Gm07:38246744..38248387 Cluster 1
cacgttgagtagcttaaattgaaaactgaaaacggccacactttgttaaggctcttccaacgtgcataaaataaaaacaaccttaacaaatcaaagtttgaaccaaccaccatggcataacgtgcaaaaaaagattttgtatcgttaatataaaaataggatataataaatctccctgatcggctaataacattaagaaaatatatccaagcagtctaaaaaaaagagttaacagattaaacatggtcaccaagttagtatggagtaaatttaattagatatattttcattttttgaaagagaaagaatattactttagattaatttgtcattaaaaaataaaaataacctcgaattggtatattaattaaacaaatgtcttgctatgaaatctcgaatctttccaaatttgtatttcatcttaataatattttcattatttttttttatctttttaatcaaatctctaaattttcccagttgtttagtttttattttagttgtaattgttaagtccaaaaatgttatctttgtgtctttgatatttattgtttgacaacgatcatgaacttgcggttaaatcatatcagcaacatctgacaacatgcttaaaatattctccaaacccctgttggtcttgtttatttaaatttataaaaaaaatatgaattaaaatctaattaaaataaatgaaaataaaattattaaagatacattcaacttcttttccatcatattcatacctttttttccccttatatctctctgtctccctcttttaattttcatcatcacctcatttgtatattaaatttcctgtcttgctttattttttttcctcaccatttttgtcttccttccactcatatcccaaaaattgggtgtaggagtctcattattcattactacgttaaaaaaaagaaaaaaaatgacataattaggaaagtattcaattttgattattatcgcaaacaaaacattcggtgtataaagagtcaagtgactgatgttaagaaggaaaatttgtttctcaactacgggctttcaaactactggaaaaaatgtttggtgcagatgaagagaaagaagtgtgaaaaatgataaaataaaacttaaaagcaccacagttttccccattatccaagtgcttcctagattttaggcttctactaacccccacttcttgattcactttgaccgattcttctatgatttcagctccctttttagattaaaaaaataattttcattaatcctcttgagctttgacatattttcagcccaattcacgatctccacccacttgaaccaatcggtttcaaggctaccgaaaattaattactaacaattttcataaatattaaaagattgttgaacaaacaaagcaaatattttttaaccaatcatgtaaatattaaatacgttaaatatgttaatttttttatgagcaattggttcaggaaatttaaatcaatcaacaattccagtaactcaaatcatacaaattgattgatatacctttaaaaaaataaatcgttagaaatatataataaaatgaagaatattactcgattagattcatcggaggtgtcatatgtgagattttttcatatatttgttcaaaagacataattatttactcat

SEQ ID NO: 473 - DNA, 1620 bp, Glycine max
  Soy_ogl_5631 Gm17:10376401..10378020 Cluster 1
caaccgataagcaattcaaagttgtatagacacagttacaaaccttctgttattacaattcctttctcttttactgtcgtacgccaaacaattattttaatataagtttgtataactgataacaatttgtttgacaagcaaccacagcaacaatcttattgttaagggtctatttgatttagaaaaaaaaataaaaaaataaagttttgaattaaaataaagtgtaagagatcttagtgttaagggtctatttggtttatctatcatttaatactatattacattaagaaaaataataatttcccaatttattaaatgatttgtaattttttggcatttcatttatttctattatctattactttgatatttagtactaatatctattttttattgctttattatttatattatttaaaaaaattagttgctttagaattctaatatataattgtagatttttttttcaattatactcttatatagtggagtaattaatactatttctctgtgaagttgtactgaaaaggaaaattatcccatccaagagctgcataataaaaaatatcatttatagaaatttataaaaacaaaaatggggatattttaatctaaaatttatatataagttaaatatttttaatccatgagtacaaattttaagcacccaaaaattagaaatgggggagtatattaatattaatataacataaaaaaaagaaggtatacagacactcttttacctctatcattgtttttatcattttatagattgagttgcctatccttttttaatgcaacattttataaacgaagtttatatatatataaaagaattttataaacaaagttgcaagttgcaactcttaaacaattcaatgctgaatagacacggtaacaaaccttttgttattacaatttgtttctcttttattgtcgtaagccaaacttttattataattctaacaatttgttggacaaacaaccacaccaacactcttgttcttaaatatatattttattggaaaaaagtagtagtacttattggaaaaaataataatagaaaagtgttagaatgtcttatttctttattgaaaaaaaaatattaattacactttttcagtgtgataaattatttctttctcgataaaaaaatttatcaattttatattattgtaaatttgaagcaatcctaaaacttaagagtcaatgttaataaaatttaccaaaatatgaaatatttgttccacttaatatatatatacattataatattgttgtttttctcttttttgataagtactataattgagaaaatactcaaaataagtgacaatttttctcttggttttgtattttgaatttatcttctccaattattcaaatttgaatttgaacgcggcttcaaataaaaaaaaaatgagaaaatagtaattagtataattttaaaactttaaaatgatacaaaaaaaatataataatattaaaaaaatacatatagataaaaaaaatattgaatatgtaagagtttaactagaaagtctagttcaattacttaaacaatgtgcaatatcgtgacgaccataaggccaatgaagcttttgtcttgggcctcaaggg

SEQ ID NO: 474 - DNA, 1741 bp, Glycine max
  Soy_ogl_5747 Gm17:37618160..37619900 Cluster 1
tattattttatattaataaaaaattattagatatctcctttaatttagagccaattgattttttcttttatatgtgtatatgacatatcaagtaagagttatatataaaattattagatcatatttgaattttattatttattactcactggggtgagtcttgtctcttgcagtgagagatttggataacatgaggtctcagctctatcttttcgtttggaatttttttatccaatatgattatgctttatgtgattataaacataaatgtttcatttctttgcctattgttgtgaaagatttaagatatgatggatcatacatttgttgtcatgtttaataaactctaaaataacaatagtaataattttttattcataaaaattaaacatgatattaagaggtttataagattcatctatcttattcaatcaattgagtgctgcaatatgattatatacacacacacaaaaaagtcaaattattgtgagaattgataacatttaattacatacagccattagattaaaactacctgtttaaattgtgtatttttttttttggtagtgtaaggaaataatataaagacaaaactaccagaggcctagcggaagtcagtttttttttttaataactaaccgaagccagttagtactttggtagcatattcagaatctaacacattgtatttaattataaatcttaatctccaattaaagaagaaagaaaatgacgtaagatttatatatattgagattattgtttatcagcagatttatattgagcttagtaatattccagctctatttttttttttttttttgtgtgtgtgcgtgattctagctcgatctcatgaaacatatatttgattctgttagacatgctgattaagatatgacttcttttatgaacaaatttgattctttaattacttatacaaaaaagaattttgtagagaaaataaaactcacttagataatctactctatctcgaaaagcattggccatttaactattggcttgaaaatcatatgggtgtaaaaacaacaatttgtgcatatatagggacactaacctatttaatacaatttatgggtgtaaaaacaacaaattgtattatccgttatttctttaatatgctgaaaagactacacatatccataatgaatattaaagaaagattatgctcgcacagaatatagtatgtcagccttaaagtaatgccaaacgttgacattaattaggagagtaaaaattgatgaaatctctaacagttaaaatcgaaaagcaaacaggatatagatttttaagaaaatattaagattttatgagaaaaatataagaaaagaagatatgcatgaaaacacgctcctcacagatacaattaattaattacagtttcataaatgacaaataaattaagatttttttcaatgataaaaaaattatttgaaactgatgaaaaaagcgatattttttcatcatttcattgagtagttcaatttttaagatgctactttaaataactaaagtaatatatcttctaaaattcatgacatgatggatgcttttataagatgattcacaattaaaaaaggaaaagcaaccggcatgcaggtagctgcaggttgtatttgatgacaattatcgttgtaatttagttttcttatttctataattaatttgaaagagaggctatacatacattcaaaattattaagacatccatttattggagctt

SEQ ID NO: 475 - DNA, 1311 bp, Glycine max
  Soy_ogl_5924 Gm18:3327290..3328600 Cluster 1
tacttattttggatcaaatttttttcttttaaatgtgacacttattttagacaagatggtaagcatcttgaattttgcaatatgtcttgtttttttatttctttattttctcttttttgtaaagttttttttataaaataaacaagtgcgaaaggcaacaataaaaaatatatttgtttactattagattaagaagataaaataaaataaattagtgaggtttatgtaaaaaatatgttttgaagagaaattgaaaatgaaaagtaacttgtaagaatatgattaaaaggccaatttttttaaataaataaaacatttattatttatattataacaatttatattcctattttttcctatttatgagcagtgtagataataaaatatatttttgcgatttattaaaaattaatctactcctgattgccatttttttttacaaattttaaaactataaaagtaaaatttgataagttaaaagataacttataatttctctgtacttaagattaattaatatatgtaacaaaatatgtatttattttcaaatttatcaaaaagtaatatactttttttgctagtatttgtttaaaaaactattgtataactgtgcaaatttgaaagcttaagaaaactaaaagtaaaaatagatattaattaatatatctaataatagtacaataagtggagtaataaattaaagattaaaattttagaaaagaaaatgttatgtaataattgtagtggaaaaacaattttatataaatcagtacacggcgcttataaatcacagatggcttttatatactacagtattcttttatttctttttttttttttctgtttggtcagtggtctagtggagttgttcaatttcttcttttcttttcccttcttattgctaccattctatgtcaaaatttcaattagacacgtttctcgttttcattattttatacattgttacaggtcattttatttagtttttgggttattttttatttggttacaccaataactttttctgtcaaaaaagttcccaaaaaggaaaaaaaactgtaaagctataattaaacttatcctcaaataaaataatttttatgattaatgctccacctccatcatataattctttggagttcttatagcaaatttccatttggaggaaataacagccagagaaattaataatctactatgaattaatgatgatgcatcatattcagaaaacaaattacaaagacaactcattggttaaattcaaatctttgaaaacattctggctgcaaaagaaagaaaattcccctgctt

SEQ ID NO: 476 - DNA, 1766 bp, Glycine max
  Soy_ogl_5040 Gm15:13395801..13397566 Cluster 1
tttttgaaaccaaaattaatactaactctttttacgagaaattaaaactattttcttactttaattataaaaatatcttattatgttcactattttctactacattaatttataaattcgtataaaataacgaatttaataaaagttcattttacctttttcttatataaatattcagattaaacatgtagtttagtttcaatgattcctgttaggtgtgcataacttatcagtttgattcctattatcattaatccctttacacattcttaatctaatattaatccttatatgtgtaactcatttttaacttggatattttttttgtcagcaaaaaggtctatatatattaattcaaagaatgagacacaattcgccacaaggtgatacccaatgccatcccatatacaaccaccattcacatcaggcaaggttattcagcatcaatggctcgtgtaacctattctcgtaacaaattgtaatttggttcttaatcatgtagttcattctaaatttagttcctaggccaaattaagaatgaactatatgtatagatatcaaataaaaaatgtgctagacatatagatatgaaactaaaattgtgtaagggagttaacgggatgaatgtatgatgatgaggattaaactggaatgtttatatgtgtagattaatttaataagtttaattttatgtataaagattaaattgaaaatctataatatgtacaaagattaaattatatatttaaataaatatttaaaaacaaaagataaaaaacaaaatatttttttaaaccgaacaaatctttcgtatatattttttaagaaatgaaaaagtatcttttataaaaattaaagacaatagtctagtgtttgttcccttcttttacaaaacaagtgagtagccgcctaaattgaaagttctagatgtaatgcattgcattccaaccaacctctgtgtaggagtcttaaattgcatttgttccccacctactgattgtggtaacttactatgccaagattttgtacgatcttgttttctttttgtcatctctaataggaaatcttattttaaaattttaattattttttttaactatgttatattactcataagatttcttttattttttatttcaataataaatttcattttaagattttaaatcatttttttaagtcttacaagaattggatgtaatataattgtgtgaaaagaataaaaaattattttaaaaaaaatagatatagatcttgacaattcttgtaaaaatccaacatcatgctacaacagtagatcttaataagatcagatctttagactaagatctacttgcgagattttcatccatttaaaatttttttttttactctcttcaaaaattgatttacattcaatttttataaaatctaaaaaaatatttaagatctcaaaataagatatactaaaaataaagaacatcttaaaagtaatatgaaaatgtgaggtccaaaaaacactaactaaaatctcaaataaaattctctattaaaaatgttattagtcgaatatataaatacatattttatggaaggcatttcagtttgattaagttaatagaattactgtaggtattaaagctcttctttcaaatatatttaatgttattttatatacaagattaaaattcaaaattaattattcaaccagtacaatcgcaccagttaatttttgtgttcggtgggaaaaaatatccatattcttttatagggagcaaacgtgtgtg

SEQ ID NO: 477 - DNA, 1800 bp, Glycine max
  Soy_ogl_6185 Gm18:55504101..55505900 Cluster 1
ctatttgtagccaatttaattagcaacacatagtaagcaagcttgttggatgatcacattcggtggttttaattacatgtatattatttataatacctttttataatattatgttagaatatatatcagtatattttttatctagttttcttattataatctaagatttttcttgtgtataattagtttttttattattgattttcttattataatttaggatctcataacttaggatctctcttgtatttgctgtgtttaacaacaattttgctaatggactaaataagaaaatatattctttcatataattttttgttactctttttacattatttatgttatcacatctctctcaatttctcctctttaatttatacaaaatgttgtataaaaataaattatgactaatatgagagtcactctgctatagcagtgcacctaataattcaaaagctttctaacatttccttttaattaaatgttgtaatttacttttcactcaaatagtaaattttgaaaaataaataaattcaaactgtctaaatcaaaattgagagtagtgacttgttaacgccggggagtaaggtaaagtccataaaatccatataggcaaatataatgcatgcatgctatgttttgatatttaatttgttaaaattactcacccttatattataattctaaatacttttttattggaataattctaaacacttactcttattataattaattatttaccattccacgaaaatactttttaagatttatttccttgtttcactaagttgcatttgcacaacttttaatgacaattgaaactaaaaaatatgaattttttttttacttatattcaatgaatataaatgacttctatatagagatcctagagatcatataattgtgctaatgactttagagttgagtgaatgttttgaatctttaatgcatgaagtcactatatttttttcatacaatatagtacaatcaattcatttaattttttccttttgtctttgtattttagtggacttaattaatgctgtaaaaacttcaaaatcaccaccgcaagtttaattttgaatgaaataatatgaacttttaagagacaatgtttaaagtaatcttgatatacttatgtaaattatttttaattactatgagcatcataatcacatttgtaaaattttgttagaaactcatctaatatttaatatgaatatcaaaatgtttaggatctgtaaacatcaaacgtcataggttccatccaacacgttatatacgacttaattactcaaatattattaaaaaattaagtcatatatcctaattataactttaatttggttttttttaaattttcaattacgacttgtattattgtactatttttttaagctgtgccattctagtaaattccgggaaaaaaaataaagcagtgacatttttcgtgggaagcatcctaaaatatccacgttgtttactttttcaatcgagcaacttatgtatccataggaatctaattacacatggcctacgtgaaggcaatgggggtaattgactagttggctaatcactcacactcctttaattatacatgctgggtgatcctctcattgcaagtggtcctcttttgtgtttagatttttttttttttttttgcgtgatgaaaagaaagttagatgacaagaaataagaggaaagctataaaatacataaaaaaagtagattaagttatttatgttgagagaaaaaagaagtaaaaatggtcaagtgttttttttatttaattattcg

SEQ ID NO: 478 - DNA, 1861 bp, Glycine max
  Soy_ogl_4303 Gm13:27309201..27311061 Cluster 1
ttttttttagtccgttggatgctatgttgaaaacatattttttgcgtctacgatacttatataggtgctggacacatgattttcgactttgttactatacttggttattttgaaaaactatttagcaagtgtagtatcaaatcatttatatgttaggagtgattttagtcaccttgaatatgtgaaccgccaacctgactgacactttaaattctgattgactttttctttttagttgtgtctatcagtgaaggaggtgtcatcatgtgtgtagctaacatgaggcattgtcttggttggcaccatttctgtctctaaaagattaaaatattagaaaataggtctttagcactagtcaagccaattctaattggtgtaaaaaagatcagcgctattttgaaaaaagaatcgacaacaaaaccctctaagtgactaaatactattaaataaaaaaaaaacactaagatttaggtttttaacccaatatttctttaatgggatctatactaatctatattatctaatttcttatataggagatttgttataattaaaaccatatattatctaacttctctacctaggaactaagataaaaagaatgctcaaatatacttttttcaatattgatttggttttcatcataaaattttcttcatttctaatgacgtgtccatatgtacttatattggcacctaaaaaatgacatcaagagattgattgcaacaaccacaacgtcatccactcaaattgcaagaaaccaattcctatagttgctcacatgattgataaagaataataagtagaaaaagtaaaataacctaaaattgttaaatttctttggcaccatttagagtcgcttaacggacgttaaatatctatgtttttgtatttaaatatttttgagatggaaagggatttagcgtattaaggtagcacctcttgatacaggacaaacgaataaaatgatacgcatagtgatgcctttctcacatctgacgtcataaaaatcactcatgatatagaattaatttacatattattccattttggtaaataaattttttaaataacccaatttagtaaaaaaaaagtccatgtttttcaaaatactttagaagcttgacattatccatatctctggtttcaacgttaatttatatatttatcttttgatgtgtgatataataatttttttttaaaataaattgcccctattgactttaggtaatggatttgccattgatggagcttaattatttcttctacgtaagattgtttacgacactatgaagaagctatggaattcaaaagtagacttaaggacaacgggaacaaggcgtgcatagaataaaaatagaaatatagttattattagtttttttaaaagagagatagtatatttaaaaaattaaactatttaataaataagaaagtaatatttattattttgattggaagcgaatctattgatctaaaaaaatatatatttaaaagaatcgatcattagtaatattataaactgatataatatttaactcagttcgttaaacattttaaatatcctaatattatcttctattcttatgaataaaataaaaactgatgcaattgaattctttgtagtcttagaataataaatattgtatgtactaatattttttaatgagcagatattgagcgatgcttaaataatgagttttttttttccgaattgcttaataatgagtaatttcgactaataattagttgccaatttttaaaaaaagttgagttgaggatatgtaccttcgagatcaggtagcctagttttagggtggattaatattttcaataacttgtctaacattattattatttt

SEQ ID NO: 479 - DNA, 1671 bp, Glycine max
  Soy_ogl_1665 Gm05:32714201..32715871 Cluster 1
ctatcatttaaatatataattttggtcccatttcaagatatttatataaaagaagtactattaggaaaatgttcttatttaaatggcacatttcagagctggattttgaagaaaatgaaaggagaatagaatttttatttctattttgataattttttaaaataaaaaagataaaataatagactagcagaaacttaatatatcaatctatggtttacttttataaatattatataattatttgtagaaataagtatttgtcgttctttttctttcctctcaaaaatccaattcccaaacataccataattttgggtaatacgtaccataagtatttgattatattgtaagagattaatctctcacttactgtgagaatataatatgagaaatgaaagaaaaaaaacacggtcctttcatctacttttgttaagcaaatcattttattagttgcactatcggatgacaaaatggataaaattcttcgatgtaatgcgacgaaaagaccatcaaaattcagttaagcaactttattagagttgcaacgttgactttggtagacgaaacaagtagtccaattaaattgattttaattcatgattcataaatgaaatcaaatgaaacttaacccccaatgttttaactaatgtgttaaaattcctttctcgagtgctccgttttcttcaatttagaatatttccaaaaatatttaacttttttttatctcttttttaattattgcttttgaaaaacagccgtgctatttagcacgaaagaaacaacacacgaacacgaatctggaagactattgtttttttttaaaaagtaaatattgatttaaaaataaaaaatatatgatatatgattttgcggcaagacacattcgtgcatgtttcacgaaaactttttctcacaaaacaaccattttctttcaaaaatcaaatcaatacttttaatgattcttagtagcattgtctttgtgaattagtaattgatcctcgattttttagaaaatacttagttattcacaattttaattgttacaaataataagaaaaatgtgttttttgtttttatactttttggtcaaacttgattttacttcttatactttcaaattgataatttagtcctcaaattttataaaatatttgaatttagtctctttttcaattttgtgacggtaaaaaatctcaccaaatgttaagtttgaacataaaaaagattaaatttacatatttttaaaacttggagaattaaattcatcagtttaaaattttagagactaaaatcaaatttaataaaaaatataaggactaaaacatttttgttctaaataatgtaataaaataatgacactattatgatacttctttggacctaaatataaaaaactaactaattttatactaattaattaaaaaaatttagctaataacatttaattcttttattttcattcacgaaatatttttttttctaaacttttctttactgaaacttgatataaaaaacaaaaagtgatcgttagaaatagtatctcaattaattgaagggtactttttacatatatcattaaataagataaaaataattaaaattttacttatatttgagtcttagaatttttttcttcttcttatatttagaccgtaatagtattactttatg

SEQ ID NO: 480 - DNA, 2034 bp, Glycine max
  Soy_ogl_4343 Gm13:29277101..29279134 Cluster 1
atccataggagttgtgttttatgattatcaatttataatgattcaaaaagatagaatattgagatattttatttgatcagaaagaaaaaatattgagaatcaaataaaaaggaaaagtaaattaaaacaaaagaaataatatcaagaattagattaaaaaaaaggatttcacaacaagactcttattcaattaatcaaataattcaaggttttttttttctaattttcttttaatagtaaattaatcaaaggtaatatttgttctttctcaagaaataaagatgtgtataattgaattacatttattgtcttataatgtctataatcctttatgctttttactaatatgttttatccacctagcatattgtcatatattaaagcctaagctcacttatgatttcaatgcactataagttcacattcatccttaggcatctaggatcatacaaatggtaatcaagcaccaaacatgtatataattgataaaagaagaattaaaaaaaaaactaaaaagaacctcaaaataatcagattatcataagcaaaagtcaaggactatgccccaactctaaaaaaattaaaaaagcacttaagcattgagaattttatcataagcaatagtcaaagactatgccccattactcacctaatcaatcaacaatgcattaaaatgaaactaaagatgtctttctaccattatcccattgattttttttcttgttatttaatttttttaccctatattaatttaaaccaaatctatacattatatttaagttttaaatatttctttgtacttaccaatatatcactacttttagctcttaccattacttgtaaattcttcttttaagtctttataattctttccatttttagtccatttttctgaaatgataacatgacattattgttggcatgtccctgatgacgtcgcacatgctaatgttagcaaattaatgtttttgaagtggatgttgatgataataaaaaattaaacttttgaaaatgtgagggatcattcatgggaaataaaagatagaaagatgaaaaatgataaagaacgaaaatcatatttaaatctatataaaaaagttaattacatttgttccccaagtattataattgttcaattttaaacctttaagttctaattatacaaattggatcctcctattatcataatgtgtatttttgctctttgtcggtcttctattaaatatttcagactagttactaaaatgaaacatgatagaatgtgctgtttaaaaaaaaagattttaattggaggaaatatgaaagaaaaaatgaatttatatgcctagttagtataaaatatttttacatatttattgaatacgaatttactttaccattgcatgattaacgaatagaataatgtaataaaataattagtttttattatatgaaaaatactcacttatatattcatcaatatgaatttagtatgcagtcgcattatattaataaatagaatgatgtaataaaaataatcaaattttattagttgtattttttgtgtgactttttttactagttgtatttgtaaaaatgtttttcacattgtatataaattaaatataaaaaataattcacattccactaaaaatattaaaatatatattattttcaaatgcatgtattgttactaaaatattattgacgatatttgtacttgttattattgttggatgtatgggcaactacattaaacaaaatcgtcttttaatatgttgatagagaaattttagatttaaaaaaattaattaaaaaattttgataaataatttcattattgagaaaaaatgaaatttgacacattacattaaattaaattttaaatataaaaacttgaccctgacgttttaggatttttataatatcctatttagatcatactcattaccatttctaataagattacacttaaatgatttaagtccattttattcaaaccaacataatgttagttaaaattgatataattcccaacaacaattgacacaaatg

SEQ ID NO: 481 - DNA, 1700 bp, Glycine max
  Soy_ogl_4381 Gm13:31093901..31095600 Cluster 1
ttatgtaaacaaatatttaaattaattaaatttttatacatacaatacaaattaatacacatgaaaataaataaaatacttcattttatgagataagaaacaaataaaattaacaaaacatttttgttaacattacaatgtgagaaaacggaatatgcaccaatattatctgatcatttaattacaaattaatttgtaataattaacttaaaagttatataaatactgaattaaattgtgattgaatgataatataaaattttatattatcaatgcatagtttttcaattcttataatatacttgtgtaaaattgttttattaataaaattttttattagagtatctacaatggaagttgcttaacaaaaatatatatttttggtggtgtgaaaattgtgattttgggttgcttaaatttggagaaaataacttatataagcaactatcgctcatgagctgtttaactattatcaaaggaatttagctcaaataaaagacataaataaattatttatgagttaaacaacttgttaatagaaatgtccattaaaagaaaattgattgagttacttatatcaaaatcattagatatgttgtacacttttactaataaaggaatttaaaattttcaaatacaataaaattaaatgaattttcaaaaaaaattcctattttttaaggatatttatttaacatttatggatggcctggagccacaaagaaaaaccaacaggccatgtaaccaaacctttaaagtagagtaaaatattatctaataattaaaaattagcaaaataaaaaaattataattaaaatatgtattaattatgaaacttaaaaaaaaatgaggggagtcgtggcgcttggctaacagatagatccagccggggactaacattatatctcgcagagaggtaagagttaaattataaaacttttttagttctcatctataactcaattgataatctcacaaaattcatcctcaaagaaagatagagagttttaagtgtaattataccctaaattcttgataattaatcttataatcaatccaaaaagttaaaacttatgaaaatattttagattccaccaaagacccaaatgtgatgactgtaatggttacttaaataaaagaatttggccgaagtccataagacagagagggtatatatagtttgaattttgaaatcaaataattaaaatgaagtagctagaattttatttatttttatataaaatttcaagtattataataatacattagtcactcgactaatgtaaatttagttgaaaaaagttaataattttctaaattttttatgcaatagagtttaaatagacgtcatatttatacatttaattactttctttaagggaaataaatttaattacttgagagagatatatcttggagattaattattccaataaaaattaggaaaacttgtcatcaaatagtcgacgagaatatattgtcatgtcaaaaatcaacttaataaaacataacccaaaaagtaacgtataaacaccagctaatttttcgggaaaatatttgttgtacaaacatgatataagtcacaattcaagtagattcatgacttaacgaaaatcgaaagtgtgtgagaatattattttgatggtgggatccagttaattaagcagtatccattttatagcttgcatagtctgttgtgt

SEQ ID NO: 482 - DNA, 1251 bp, Glycine max
  Soy_ogl_5768 Gm17:39023901..39025151 Cluster 1
attttgagacataacccttgttttagtaattggagacatgaaacttgtctcaaatttacttaaaaactatgaagtcaaactaatgttcaaagtaacatggagaagatattcttagtctaatttagttataaccaactttaatcatatggatcacattgcctcgtcggaattcaattgtgtaaaattaagtagaatatatataaagagagaaaaaatcaacttatatatattttaagaataatcgaccttataattcattttttttaatctaacccataaacttcatgacttattataactattagatttaaaaaaatcaatgataagaatggagagtaaagaattactcttcacacacatatatatagaccaccacagacattacaaaatctataagttttcaatattatatgaatttcttttcatttcccaaacctagctttaaaaatatgttgtatgtcattaagtggtggaattgtagtaatacctaattagagataacatttttgccaaattttgtaagagaaattacaaaaggaaaaaaggatcaatttttttaaaaaaaatgattttattcactgtactttggaaagtacatattcaaaataggtatttcatcaatatatttcacaatatggatgaaggatataaaaaaatattgtgaaaaaacaggatatagtatattgtgaaaagacaagatatagtattattgtgaaatatattgatgagatgcttatttattcttaatgcatttattagtctaatatcaatgtaagtaaaacccattgaatcattggtgaaaaactatgttagattgtatttgtttcaagttatcacaatttattcctgagtatgtaaacataaaaatatcacattctcattttcttttataagttttaaaaatatattcttaggttgattttcaagaatataaaatattcatatgtgtctcgcttattattctcatgataaagaatgaatatctagattcacatgaaaattgaagttactttctaaaataactatccatttccactattttcttttccatttcttcttttattttgattcttttaattaaataattttccggaatgatcaaatagtactaacctaatacgttcatggaatgaatattctcatgcatggtattccaataaatataatttccgaaaatgtaatagcaaatcttgaaacaaacatctccctataaattaggtgtagtattattaaatgaactattactcaaac

SEQ ID NO: 483 - DNA, 1913 bp, Glycine max
  Soy_ogl_471 Gm02:45901..47813 Cluster 1
taggatgaggccaagtgttattatatttatcagatctaggtaatatttttcttgtcttttaatttatatcaaaagtttctttattgtttaaattaagttaaaaagttaagattttttaatttaaggttaaagttgttggatcattttataaattttttaatttcaaaattacttttaagttaaaatttcttaattaaatattattattagattttgggatttgaaataagaaaaaagctaactttttttaagatgttcaattccttttcctggagttttattcataaaaagctatttttcaaaaattcatttttttttctaaaattgtttggttcaacttcttttttaagaaaaaatttaaaaataaagttagatcaaacgcttccttagtctaagactcttaagttatgatgctatatgtggcacatagccacgtagctgcttaagattatgtagattaacggttataggagtatgcgctgagatatcttccacttgattaggttcctaaaccgaacataggtgtaagtttctccaacttcatctaaatcatgcaagcactaatctttaggtacagaaagggattttataatagttatttcaaagcctctaaatgccgattcttcgactatttagttgttatatattctcagaaaacacatattggccgtattgggcctattgtttagacattcaaactgtttgcaaaaagttttggtgttttgacttttgagagtttggccgcgtttaccaaaattattacatagaatagtgttttaggctatgtttgataacttgttttagtttgtttttaacttttttttattaagtttttagattacttgtcatcttgttattattattttttgttgctctagtttctagaaaaaatttaggaaaaattacatatacagaaacatgtgtgaagagtgaggagataggagagtgaagtacagcacttcaccaaaaggaaaaaagagtattcaaatgaatggagtgaatgtgagggactttgggaagaatagcaagatagacagacttgtgcatttatatataaagatattagttgaactttcaaaaattaatttaaagttaaatttgagaagttaattaattgaactaaaagtatttaataaaattaattgataagtgtaaaataatattaaaaaatatgaaaaaaaggaattataatatgataaggaaatataaatgataaaaaagtacactagaaacttatatcaaatgacataaattaaccttttagaaaatgttacaaaagtttcctcacaacaaattcactctttggtcctattcttggtaaatagcccattttgcacttgattgacatgagctatatctcgattctcgagaataaaaacaaaaagataatacaatttgtatgtttaacgtgtcattaatgattaggaaaagactattttaaaagtagtttgtgcatattggtataaaatcatatctattagatttaattttaaacccgtacactagacgggttggattaaattattataaagagaaaaatgactcctgggataacaatttatgtatgagaatataaaaataactaataataattttcatattaaaattaaattgataaataattaagattaagattcaaattggattacatggactaactttaatttatttttacatgtcagatttttttgtagcgaactaaacaatcgcctaaaacatgttttctcaatcttcattggttatacggggcaacacaaacagatcataacattttttttcagtgtgcttgtcttactttcatcacattatcatgccaaaagatatgcagctttatgtgaacatactaccaggacactcgatctctctccactctatagagcgcacttccattttttgtccagtttactaaattc

SEQ ID NO: 484 - DNA, 1700 bp, Glycine max
  Soy_ogl_3013 Gm09:5414201..5415900 Cluster 1
gacgggagaaagatggatcacaagtcttgctgcactaatcttcttcttcgctgctatgttgggtcgtttttgagtctgaggcttattataatgacacctgataatgacgaataattagaatatatattatgacccgattaccatcatataaacacatatatatgaattagatgattatgacccgattgataaggccatgtatgccacaatttgtccaaagggtcatgtcacatgtcatgacatacgtcatgatataccgtatttttttcttttcccaccctttcttttcaaccattgtgaaaaaaaacaatgttattaatagatataataaatctgttcagccatcaattaaaattataaaattacacaagccccttgttgcattcttactttctttttcttttgcatttagaaaacgggtcattgttttgtttcttgtgccttgcaaagctaacctattgctctagtaacttataaatcccattattagcacttcattctctctgctcattttaaccctttagtttattagttagacttagctaagattaaaaaaattaaagagtcttggactcttgttcttcatcaagatctttatgaccttagtttgtcttcgtcaaaactctttgaaactcagaaatgagaagtcatgttcaacaaagttttcatttggtgttgcttttcgtggtttagcatagcttaaatggcaacttcgcattagtattattttattgttgtatttatcttaaaagataattatttttttctccaaaaaggggagaggagtttaaagaagcttgattaaatacaagaatacttggattgtgacaattgagtttttgttgtagtttaagaatcatagtaaaatttgttacaagagaaaaaatataataaattagggattaaaaccaaagaagcctatatttttaaatacgaaatatatttaagccatttgaattcgtactattttttacattataccacatccttctctaggtggatttgcttgttcaatattcttcaaaaatatatagaacattaggtatggtccaatgttaattatataaatgaaataaaaaacgggtttctgttttcaacccaatatcaaattaccaacaacaatcgatataagtgagaatttagtcaaataattaatgagttaaattctgattttgtgtatgaaataaattatattttttaaaaaatattcatcttataggtactcatgattcctaacaagttatttcatatgatcattataaagaaaaaaacttaatatctaattcttgaattgatttcttacaaaatactttcctacaagatacataaattactcttaaattatattgagaagtattttctttttatcataatattgggataagatatttacaagcgttactaatgattgatttcgactttttattcaaccatttttaataaggtattacttccttcattcataatacttaaatgtaaaactttgtttaaaatattagaatttatttctattcaaataaacactatgttaattattcaaaagtaccataattattcacatgcatccaatatcagattaaatatttgattcaatcatgctacaaaaatttaactttcatttcgtatatttattttgtttgcttgtgaataaataaccgtaggtggtatatatatatgtcattatcatgcggtgggtgata

SEQ ID NO: 485 - DNA, 1500 bp, Glycine max
  Soy_ogl_4073 Gm12:33608601..33610100 Cluster 1
tgatgagaaatcacttcaaataaattgtaggactaattaaaaaattaacttttaaaaattataaataaattttaaaaaattattgataccattaacacaaagaataagagaaattaaacacaacttttaaaaaatttgtaggactaataaaaacaaattactttttgaaggaataaaaaaaataattatcaaattttaaaaaattccctgttactaaaatgtataggaaaaaaaatatttatactaaaacaaacaaactactacgttaaagatgtgttcctttactgaaaaaagaatataaataaaagaaaaattaacaataaaataacatgagacttatgcaccttaaaaattaaatattatatattttaaaaaatatataatattgtttatattttaaaaaataaattatatgttaaaatgaagttaattcacgaaatatcaaacatttttaaattatataaaattgatcaaattttttgttgctgcaatatgaattttttgttttactggaaagttgggaagcaaaaagaacgtgcagtgtcaatattccttgtttcgctttggctttcgtttcaatcttctcactgttttggtgttttcgttttggtgccgtgcaactgaaaagacaaaaaaaaaaaaaacacatgtcaacaaaataaaatgtctattttgatcattttgacggcctatattttttttaatagtatctatctatagatagatatcatataagatttaattcacttaaatttaaaaactacttcaattaaattgaatgttttaatttcttgatgtattttttttattttgttaatgttatttgaaatgttatcttaatacaaaaattatccacaaatagaataacatactattagtgtcataatttgaatacaaaacttagtaatccaacaatatttgaaaaaccaatgtactactcagtaatcacaacactcaatacaacatttcaatataatcacatatcacaatccaatataacgaattacagtatattatacattcatatacattttattataattttttttatataaaaacacaaaaatcatataattaaaaaaaacgcgtaagaacagttttcaaaataattcaaagctattaaatttataagcacattaaaataatggagtatatattataaaaatatataaaagtttaatcaaattcatacagagattttattttttgaaagaacaacatacagagattttttagtttagttttaattctcaaattgatttttatgatttacattaaatggattcgatttatgagaactactcaaagtactaacaactaccccgaataacgtgcgcaagtaaacaacacatcttaataagacgtgtcttcattgctggggtttccccaggcacaacatctctaataagttgaaaacaattaaattaagaagcatggtacaagatccagcattaagattgcaatgaattagcatggtagttccacccaacacaactgaac

SEQ ID NO: 486 - DNA, 1648 bp, Glycine max
  Soy_ogl_5382 Gm16:30888582..30890229 Cluster 1
gtgtgttatgttaaacatttttagtcctattatgctaaatgaatttaaatttatgacagataacaaatgttttaataataaaagatataaagttcgtttttgtaatttatgaattaaaggattcattatttaatttataaaatattttaattttattttttctttatgattttagaaattttctcgatgaggataaatatcatattacaacttttcatgtgaaaaaggttaatatgcaataaattattttacatattgtgtgttataactaataatattttcacactttactgtcaaaacaatttatatccattcgcagttaaataattcttttattaaaaatatactttctactatatggtttattaaatttattttcataatattttttattgattttgataaatatcattatttaaaatattattaattatttttattaaattttatcatgtaacacaaaatgttataaagtaatatagcccatctaaatctcttctaccaatgtttggtatggtggatacaggataaaaataattttggaattttggaggagaaataaggagaaagtaattttaaattttctttgtctctctcttcatcttttctctatttctctcaaatcaaatacatttaatttttacattatttatcacctatttttattcatcattttttattttcatccaccctaaaaaatggtagaacctattatgatttttctttgtctttctcttcatctcttttctatttctctcaaatcaaatacatttaatttttacattatttatcacctatttttaggtatcatttttattttcatttgccctaaaaatggtagaacctactatgatttttctctgtctctctcctcatctcctttctatttttatttttacattatttatcacctatttatcatatagacccttaaattatgtaccaaaaatacctctttcctatctaattaactggagaaaacaatttgaaaaaaaagaaatagaaaaaaaaggagaaatatcgtcactttcctgtctatccggagaactgatgtgggaatcaacagttttgcttgttttttgagaagaagaaaaaacttgcgctgcatatataatatattatcccgtatgaaaattaataaagcacaaatcttatgtattaatatttatatatattagaacacaattaaaagtacaatttcattcatttaagtaacttacacaattaataataaaaaaaaagatatttacgatttgtgtttttatatgctgaccttttcattctcattgtgactaataattaatttgatgactaaaatatatttcttttcagtatatgaaaatgtttgaaatttatttacgtaaaatttttaatatgtttttcttttttataaaattgaaatatatcattgttttattcacataaatttaaacctataatgataatttttatatcgattatgcttatataatgtaaaatgtaacattttttttatatcattatacatataattaattgtaaaaaagttatatgcatataggtttagatgtttcttgtttcggacatatacattttaatttggtaagaatgaaaaatatattaaaaattttacatgatagattttgaatatttttatatttaagaggat

SEQ ID NO: 487 - DNA, 1643 bp, Glycine max
  Soy_ogl_809 Gm03:2344558..2346200 Cluster 1
cctggaaatgtgcgtctatatttggaacaaaaacatttacactaataaattggacgacatataagttggaataattcattgacaaatacttgggcgccaagttattcacaggacatcattattacgttagacattgaacagaagattagtgaaatggaaaacttagtaaaaatgaaatagttgaatagtaaaatttacaaaaataaaagctcgatgaaatgtacaattaagtcttaattatttatcaaagttattaacattaatatttttttacaaatgcaataaagtatatatttatttgtttctatttattatttttataacaataattcattctgactcgttaaaaaaatacatgcacttatttaaaaatagaaaaaataaatgtataatgtaattacgatttaaacttatttataaattttattatcacgtattctttattttatgcattttattgtaaaatcattatgtaatatttttttaacctatattaatggtaaaatatatatatcataagtagaaaaaaaatataaaatttattaagtgaaacatttgtagaaaacattatttttttaataatttttataaacagctaaaaaatttaatcaagtaatctaattgattgattataattaattaattgattatatattaaagttatcgtgtttattaagatattacatccggtgtcaatagatcctatctgtctatcatttagcattataacaatggtttgatgcatgggaaggagctccttagaaatccaagctatttgaattcaaattgtataaattagaattattcattgttataactaagaatgtctctaatccaacattttgagggatcactccctttcagctaaagaacaagtggactttgcctttagtaacaaaaaattttccatatacataactaataatcaagccctaataaacatgctaagttatctaatcatttattagatatgttcaactttgttggcttcatatattcttattcaagattaactgatcccatagctcatattacatatgaaattatatatcttaagttctttaagagatatagatttatcttttttaaaattaatgacaattaaataactatttttaggcatcgatgagaaaaacaatagttaattttcaatacattaatgatttataatattaattatgcgcgcgcctttgtatgtaaatttaaacgtagatttacagaataaaaaaaaatcgtagattttatcttcaacgactaagattacttattttatcttctaagataagtttgttcactttgaataagccaggtttgatatggatttatgatgctactaaaattttattgatgattttatatgaatttaacaaaaaactgaacctgaagatatttatagttttgcgaatgcaatataaatggttagtaataaataacattaacagacaacatttcagtaaaacaaaaaacaaaaaacaataacagacaacataacaatcctcaggaagtcagttttattaatttttcacttcaaagttctttttctcctaatcatccaatttattttttcctcctagacctctaatttgataaatttatttttcacctttcacactgtctagaagaacatgctgatatctctggtc

SEQ ID NO: 488 - DNA, 2266 bp, Glycine max
  Soy_ogl_3699 Gm11:2842201..2844466 Cluster 1
aatgttttaaagatatctatttagataaatcgaagaaaaaaaaatctaattaggatcggtttagtgaaagaaacttagatagttcatataaaaatttatagttaaaacttcacatcttattgttgtcattgcattaaatatttaattttcagtataataaatactttttttgtaaacatttttgtgttttcattactttaatgggtctttagcaacttttcctagaagtatcagattggccacattcatgattatgttttccactttaattaggaacaacttagtgcccctggctttcccctccttctggaaatggttttgggatccaactgtatagaatggtaagagttcaagttgtgatttggttgttgtcaattgtgacatgtgaggctgtcagccatatgcgattcttcttctcatgatttacaataaactagcgctaaagaatactacaaggtaaacaaaagacggaaagcctttattgatttagctttaattgctgtgcctttgcccgttaatgaacttttcatagtactaatttaataaataatagtaattgctctaactcaaatgagtgttactctttaattatgtaagaatctaacaaaatattttaatgtggtggtagccaaagatttgccgctcaagattatcactaattatatgtactgtattttgtatccatttaggaggattcccggggatggtggtttcgtgtaaacatttggctctcctcaaactgctacataacctgattcttttttatgctttttctctctagttattgattcaagcatataaaaaattaaaacctttcaaaagattttttatagtattttctaatacaatttaagatagtttttgacagaaactttatttattaaccttttaattataagatatttcttaaaatcaacccctcgagttgtgttttactgttttatcttcatctgcctttactcttctacaactatcaaggaaggacccatctttataattcatccatttaaatcatagattttatgttcctttttttcatattttgttttgtccagatctgtgatgtaaactgttcgacttttcattaatccccaaatatgaaatatcgctaggtagtttcttccatcacttattgagtactgataagaaactacgaacaatgtatactctcctattatattcactagcccaattggatggactaaatacagcatcttcgtaaagtagctttatgatcttcttatcgagttcgtctatattaatttatatattataaatatttgtaatattcaagaaatattatttattaaatcaactaatttacttattctaatgacataaaatcactttcccataatagaatacatgatcaagtatcccactataaccttcttttttatacttaatctttgtttgcttcatccaatttaattactcgagtttagcttccatgatttttcaatggttaaaataaactattttattaaaaaatcattaattaacgaaaatataaacgaaaagtgtaacactaaaagtagctattgtaaagcatttgaaacaatcattcatgcacatatattatgtaacttacatacaccacatcttgtattgctgaaatgattgtttttaataaatattattcgtttacaaaaatatatataatgttgttgtttgtcgtctaattctcacgattaaaaatgtgtattttatagtttcccgagaataaaattacttttctacaataattacttctccgcattagatatgacaattaactttgtattattttatcagaagtttatcaagggatcaaccgtgcaagtattcacattgtttttaaaccagtgtattataatgtctttcatcattcaagatgtggtccgaacttgataattgttctgtaattttcattggctagaatttagattcgacgtcttcaacttcaatcaatcaaagcattttacaatcttaaatttttatgatcgtttacaattaaataatattataaaatatttttatgcagatatatatgttttaattaggattataatataatgtaatttttaaaataactttattatatactagtataatagtttagcatgagataacaatataaaatacttttatattattataaaaactatgatttctttttcaatgaatcaaccatatattttttagtggtaaaaatggaagaagaaaaaattaaaataaaaagtaccataaaagtgtgttcggtagtgggagaaaaaaatgatgaatc

SEQ ID NO: 489 - DNA, 2448 bp, Glycine max
  Soy_ogl_4453 Gm13:34864101..34866548 Cluster 1
aatgggaaaaagggaagggacactactctttggttgtctttgtctctaaaatttcctatttccgacagctgttctttctacgtgtccactaaagaacttctattatattatttctttgtactttttcttaattatagtttttttagtcttgttagttccttagttaatgtttttatgatattacttaacattttattttctaaagcacaaagttcataaataggttggttagatttttttaacttagcatagaatgtgccctagatctttttgttaattaattgcatttgacaaacccggtgtctatttctgataaatttctgcattggagcaataaattttgtttttaatcagcaaaaaggttaaattatgtataagagggtacaaatgggtgcccaaaaccatatacacgagaacatgatacccatacagttgatttggcatgagagcattggaacaataataagttgcagttgatttgacattctaaatttcggtcagactatatgaattttgtcaaaaactaatacattgatctattgaagtagtagcaaatgaacgtagatattgctaaattaaagtaccctcgagttattaattaactggtgatcctagtcctgtacaatttatataattctctctgtttaattaataatttagttcttacacttatccacagtccacacagttgtttggattctacatttaaaaaccgtaagtttaattaaagccatgcttggtttctcattcacctgctttcaatgtcggtctatcttgctaaactcaggtgatatgtttgatttcttatttattaagtaattttgcacatttatgtttaccttcaaatcaagtttttcaaaggaaaacatattggtggtggttttaaaacttaagttttcaaacggaagtactttttttagtggaaaatgaaagttttttttaatctaaatatgctaactctgttaattttataaatccatcagtttttaatttctgtgacagttaatcataaaccctctagaaattttgtgacaattaaccataaaaatttcctatttttttgggttagagaaaatagggtattttttaatttattggaccaaaaaataattcgcgaccctcttatccaagaaaatattaaataaattgttttcctaatattttacatatgacacaatgaaaccttataagattatgttaattttatgtgttaaattgatagaaaattagatgatgaaaaaatccaaaaaaaaaaaaaaattgacaaaaaggttattaggtcatactatcaacgacgggacagtttgaattttttttactgcattttttttttattttttaatgcatcttatttttgtctttttaaaaaaattaaacattttattctattacttttttttctatcactttttttttaccaaaaaatgtgcattgcacggattacaactctaggtagttttaatttgtttattttgcaaacaataatagtaatatgtatttttagattataatattcatcaataacaaacacattcaactattcatcaacttaattttacggctggtatctctttcgaatacaaaaatgaatttcatccctttaattatatccaagagtattttccaaaaaaaaagaagcttacaaagggctaaaacaactattattttgaagaagaaaaaaactaaaaattattatgttaaaatgtaaggagtgctttaataataaaaagatgtaatacgtgtaaaataattcagacaagtacttttatcctactcgaaaataattttaatacctgtgatttaaacggaaataatttatacaactacttcctctagttttaaatataaccaaaaagtcttgaatgctgattttaaatataagtaaatatcaatcaattttattttatttaaaaatatcatttttaaaatattgttcattcaatatgagttttaattacaatgacttcttattttttatatcaattagtttttttcttcttatatttaataagaagaaatgtatactaatttatataatattatttttatttttatctctctaatattatgatatctaataaatgataccaaaaagagagacaaacataaaaaaaatattgttgtacatacaactgtatgaattgatatataataactttttccatagtacaatacagtaatttaaagaaaaaataagatgaaaaataattcaattataaattagtagtatgtttaaaataccagtagtaattattaaattaataatcactaatcgacttccactgaatgagtaacagctgtgcaggtacatgatttcctcttgactcttgtgcagagaatttcatccctccaactatttaactaataatttaatgcctattgagtaagatattttcttctctctctaccacgttgccgtttttatagtacctcatgcccttccgcaaa

SEQ ID NO: 490 - DNA, 1800 bp, Glycine max
  Soy_ogl_614 Gm02:42795701..42797500 Cluster 1
ctctgacacacgtacaaatctaaatattttattttcgaatttattacttttcatagaataaaaaatttatttttgataattcagaaaaattagaaacactgaatacatatcttgggtttgtttattgttttcgaaaatacttttttttttatttctaaaatttgtttgttacttgattatttgaaagtgtatatatatataaaacgtaagaagaaaacaataatagttcttctacacatgaaatctttaatgcttacgagacgcgcatcatactagttaaagtcttctgattaagctagcagtatctgtcaaacgtgattatatgattcattgttcaaattattattatcattaattacaattgatagatgatgacaaaactctttgccatgttttacaaatggaaacacaattttaacggtaaaaggttcggatccaattaaatgagttacttattataattttatggatgttataattttatataaatttaaatattctatatgaaaatttatttcaatgttaaatttattaaagtgagcgattaatttaattttttgaattttaaaaatattttatttatgatacaaatttattaaacaacaattatttatataaataatgtcatgtcatctgttctaataaaacaatattaaataatgttagtcaaacaagttatataaatactctaatttaaagatttttgcgtgacacatcttattagtgccactttatttcttcatagtttctcgaagaacctatagacatatatagttcaagggtaaataaaagaaaacggaaaagggaatagggaaaaggagtatgaaccaaagcatttgaggtatagatccccaattgtacattatgacttcaaagaatctttcatgttcccaaatgtcatttgcgtcttcaatcaagcaattttttcggagaaagaaagaaacaaatgaggataggatagagcttgaaactgttcctttttcttttcactctaattttataatttcttcaaaaattatcaacatgttattaatttgaataccgttaaatttgattctcttaattaagatattaaatttattttttattctcttaattaagatattaaatttatttaaatcttgtgaatgaaaaaaatataattgaattttttttattaaaagtaactaacctaacggaacttaatcattgaaaaaactaatactctaaattaataacataatgataattttttctatcaacaaatattaatggttaattattaatttttgttacttaagaaattcaaatcgagctctcctcctcttttctcctttcactatcgttgatcttataactttgataaaaaaaaaatagattgtctatttatagagatcaaagttttaaattgcgataggaatcacgattagaatttgataaggtaggaaaatgcagataaatatagttgaggtgatcagaattttatcactttaaagtgactaaaaccttcggctgggaacaaaattgcggtattaattgtaaaatcttggtaaggggcagagtagaactacttgttacttgttattagcctaggcacaatcgattacttcatctaccaatgaaattgaaaagtttgtatcaaacattaattaagccgagaaaattcaggcaatacccacatgaccgtacacacaattcacatatgtgttctttctttctagtttgttcagcaactcggtaaaggaccttgtcattggcctgtggggactcttaatgaatggtgaaaactgaaaacgatgtgaaaaatggaccattgctaca

SEQ ID NO: 491 - DNA, 2434 bp, Glycine max
  Soy_ogl_2532 Gm08:6908367..6910800 Cluster 1
ggtcaaacacccatctaaaccttttgattttcttgttcttactactcttgtgtggatccttgttatttgttctttttttaatttatcttgtcctacaaacacatcctttggatctcattatcaccatcataggcgcattgcaagagcaactggtcccagctactccatcatgtggacatgcatggttggcaaagactaatacatctttaatttctaagtcatataattgaaaactccccatttgaatctccatgactttctaaactttcaacaaacaaacgtcacaagcacatggacacatatcagccacacaggcacataatatgctcttggtgcaaataggaaagcctagacagtttgtagggatgtgaatggcagtgatggtcaaactcttcatcatcagcatcatcgtcaaagtcttcatcttgcattcagaaagactaaacgtcaagtctcatcattggaaccaacagaatccatatccaacccatttgtccttaaaattaaattctagaacttgtttctaaacctctgacaaaataatctttctcaattttaaaataaaaaagttttattttaaaaaaacaataatagtaatcaacgcccataagttttatccaaacgaatgcttctcgatattgagcatgtttcttcagccaaagtaaaatcgaaacttattggacccactccaggtgatggccatcggttggcaataagctgttgaacatgattatcattaactgttaattttttagcattaacaatagtaattaacctactaggattgacctattaatcaagagtttggataatttgcacaaagtcctaacttctaatcttattatgcttaatcatgtatatacaaatagcttttgttctatattttgctgattgcgcgctctaaacaaactactctaacacaattgcaaaaatctaaaaatgagtaactcgtttttgtaattaatgaacaatcgcaaattaaattgaaagatcacttcaaatttttgcaagaaaagttcctaacttgtttatactcggtcgtattataccagttgcaaattttttggatatttaataattagttttcgacataaaaaaaaaaaaaaaactttttctttgaactatcgttatctactccttgcatgcttgttgtgtagcttagcttttcttcattactgtgataacatgtgcacacacactgcatggatgcttcttctcatttcttttcttctaactctcttttatatatcggtaaagagattaaaaaacataaaagggccgttgttgaagaaaaatcccttcttatgcttttgctttttccggatcctttacggtggaaattagattcgatcacttttatttatttattttaataattaataatagtctccaatttaaccaaaaagatattctaaaactaagcaaaaatgttttaatgacgagtgagtgacgacagaaacatcataccttgacgtcagaaagaaattggggtttcattgtttcattcttcgttttctttattggacctggcgtttcaggttgggtcgatccttcactgttcctctttgattatgaacccaatttgttgagggcagttgctttctacacctcctttaaactcccagaccacctaatccaaaatataaaattacattccagaaaggtgtttcttgaaatgtaaaagtgtaggaagcaaatggaaggtgcaggaaataattttctttactgagcttgaaaaggctctgacaaaaccgaaatgtttaatgtcacaaaaaaccaagttgtcattcaacaaaaacatatgcattcaatacaatgttgattgttgatatcttttttgttttggtgaaaatgttgactgttgatgaaccaaatgtttttatttatccttcactctttaattattaaaccacgtcatgttttaatttatttaataaaaaagttattttatttagatatctgaacagcatgtttttattttattaattgaacaaagaaaagcatataatttatgttaatataatatatgtatatatataaagaatttaattatattgtactgacaatgcaaaagtttttcatactatcatttaaatagaataagatattagtctatgataaataaatttggtataagatggatagtctataaaagaataaaatggattgataaaatttgaatagttagatattagagtgagtaacggaaagaaagaaaaattcaactaactaatgcataataacattaatattagccaaatggtaataattaaattaatgacacaaaatcaactaactaatgcataataacattaactgttaaatcaaacttttgtaagaaaaaacaatgacaaaaatattttggtaaaaatattagccaaatgataataattaaattaatgacacaaaataaaacttccttaagaaacaaatt

SEQ ID NO: 492 - DNA, 2732 bp, Glycine max
  Soy_ogl_3394 Gm10:6571769..30500 Cluster 1
cgatgcttttgttgattcgttctacgaaaaataatatttgaaataatttgactgatttaatttgtaaatgtcttagaaaaactaagaatttgagaatttttaatttaaaaattaataaaagaccaaatttacctaatttttaaaataagtatacttaatttccattaaattttaaaagattaatatcacacaagatgaattatgaatgtgtttgagaatatattgagaacacaaataatcacattaaatgagtaagatacgcagaaatacatctttgatagcttctggtaagtaataaatcgcattaaatgtgtcatatccaaacacgtagcacataaaaaaaaaatgtaagaaagataagttagtctatcaataaaatgggccgacatatggatgtttgatgttaaaagtttttcctaaaatttatgagcattattttgcatgttctgattttggaaagaaaatgatcaatttaattcctaatttgcatctcattgttattttaatttattaaaaattagtaaattcaaataaatttctattttttaaggtttcatttaaatctttaaaattaatttatttttcttattttaatctctaaacttataatccttccgttttttataagaaaaaaacaattttttttattttataagtaaattttaactatttttattttattttatgagattatatctaagatatttgtaatgtaataagaagtttatgtttaatatcaaattcgttgaatgatagtttagaaaaaatatttatttttaattaaaaatcataccatttcataaaattaactaaattttttaaataggtattaaattgaattttgaattttttttataaaagagaacggagacaatattatttttatcacttaatctccaaacaaagaactaaatattatttttatcacttaatctctaaacaaagaactaaaaaatgaaagaaaaaaaaactattttgaagaacttaaatgaaattctaaaaggattgaaatttattaaacctttattaattttaagacttgaaacaacaacaaaatacaaatcttgagagtaaattcaccgattactctgaaaattttcggaaaaaaaaaaaacagcaacgaaggtgatgggaaacgcagttttttgtgttcctaaaaaaaatgtaggtgggccctaccggagcacgaagatttagcaaaacgacaaagcagagaggacagtgtgtaatgaatgcaccgtcattcggtgtaccccacaaaatgctgagagtacatttcccacgtttgcgttagggcatggaccacttacacgtgtccgtccccaaaacgatgacgtggcacttccacgtcactacataggattcctctctccgtcctcaggtgcaatgcatgcgcacactgccctcatcaaaacttttctgtcgttgaccccataaaataaataattttttattaattaatatttccctcaaaaataaaatgtgtttgcttgcaggattgtttgttagtgccaatttttattttcggtggacaaagtttgttggattagtttgaagaaaataccaacaacaacttgcgaggttctttaatcatgtatccttcgtatcgtagcaagtggtaaaaatctctttattaaaagtaagaaatgtttttaactattgaattttcaattctaaaaagtatgtgtagtttaagtgcacgatcgcacatgcagttaaattaactgtataaaatagtaaaaagatttcaaattaaggtttaaccgttgaaaatattactcttatatatactactaccctaccttagaatttgtcctatttaaaggctaattcctatgtaccaaaaaccaccacgcgttgcgggcatgggaaatgatggggttttgtagtttttgttgttactgccccttctccaacttttttaggttatggtcaaacattatattcaactacacttggagactttgaatggtacaaaggacgaatacgacagcttgtatgataaaaaaaaatatatttaagtgtagccaaatgggtcactcccacagcagacatataaatctttgaacatattctttttatgaaagctctttgtgaagacagaagacgcacataaaaccatcccagccttttaatatttgggaaaacgacactccgtccaatttctctcctctctctctcgaactaaaaggttcgctttatgtagccatgagattgttgtggatatttctctttcacaaatcttctctacaagatttggaaactgggtatgttcattctccacaaatatgcaaagtcgtgtgggtttgatttagaagttacacaagtatggacaatgtatataagattcatataaataccacaaattgatataacttatcaacacctcaagaaaatatcatcatatcattatgaaatatcatttcttttttaaatcagcagtgaaatatcatattgtagtatgtgtttttaatatttcaaaataaaagtaaattttcatattatgattcaaattttatggataatgataaaataaatttatgtattaaattaaaagaatggtgagaaatttgagatgatatgcatgagattataggttcaacctcattacaatcattatacaccaaaataaattttaaaatgggaattgaatcttatatcttagaatttaggttgttaatgtgggattactaacatttatccaccctgcaaaagtgaatatttacgagtga

SEQ ID NO: 493 - DNA, 1789 bp, Glycine max
  Soy_ogl_5981 Gm18:7476112..7477900 Cluster 1
ttttctaaagtggtggatccttttgttttctttttataaggattatattattaagcggtggattgactaaaactatatgccatattttctgtatctcagcacgcgacgcataattttgtttataacaaatgttaattaatatctttagagtattagttaaaaaattaaatgaagaaacttttattttattgaaatgtgtaaaattatgttattcatatttttttttaaaactctcttatgatattataataatactttttattttaatttctgaaccaatgctttatgtattgataaaaaaaaaaaaaaaaaacaatgtcttatgtgtttatatctgtctagcatttataacaacggtaccagcaattaatgtctaacgagtaattaaacttcaatgtatgagatttgtttctttgtatctagaacaacaaatcattcgagtcttctatcttttcacattaatttggtattttaatatttaatagatcacataatttatgttttaacttaattaaatttacagtttaaaatctaattaaattgatcgatatccaaatatttttagaagatcgacgacgagggagacacccaactcccataagaacaccagcaacttgcatcgattgtgattaatgtaaatttatgatgctagtggggcgaagggcagaagatgacacatgcagaaatgtaggtacaaaatgtaacacgcatgcagtattagtctttgtatccgataaagtatctatacctttgataaatattaataagtgtttttaagacattaattaaaaatatttttattataatacctaaaattttagtttatgattttttttatgttcttatataattttcacaataattttttttttaattttttaattaatatcataagaacactaatcagtatatattcatcgatctcttttttctaattccaattgaatattggctatcctatttgactattttggtcacgccgtactgcaacttaaatattagtgtcgttgaacactctagtaggttgatatatatgaatatggcgtgtacactttaattaaaacaaagtgttaatgaacatgttatgtaaaggattgattaaaatataggtatgcagtatgctttagtatatttcataaagtaggttgatatatatatgaatatggtttgtacacttttagctttaataaagaaaaagtttgaatttgtgaggattgatatgaaatattcttttctttactgtaaaaaaaggattaattatttcatataaggaaataaaatccttggcaaatgtaaacataaatatactatacgaacgtgacgatgccttgctaggaaatccatagatgtggtaaataaagccaatggaattccttgtaactaaaataattttcttcacataatctaatttatttttaaattacaaatattttattactcaagtcattctttataataaaataaatcaaaacagtttacatgtgttctaatttattttcaaaactacaagttccttgatagtttgatagatccttataattaaactatttaatatataaaataaattggataatatatcatcatatatattgtcatgaaatcatgaaaactataaacaacatgtagaaaaataaaattttgttcctaaaataagatttttatagtcattgataagatataacttgaattaaattattttaatttgaatttgaaatcttatttttataataattgtttggaataaaattaatttttgttgtgaacttctttgacaagtagaataaaaaaa

SEQ ID NO: 494 - DNA, 2169 bp, Glycine max
  Soy_ogl_1637 Gm05:31174632..31176800 Cluster 1
gaaaaatttctattaaaattaaatatgaaaaaaatattcatagaaaacgtgtgtaaacattctaaaatatgtttgtaactaatataaaaatatttttatcataaaaaatataaaaaaaataatgatactcaaaattgatgattcttagggattgattcccgaatatgacaacatttgtcccccaccaaatgccatcgatgttttctagaaggtgtgtttgcaaagtatattttaacaagctctaatttattatccttactaatagtttttttttcttccttttacagcatattcttactaatagttaaaatttattaacctgggttatagttaaattgaaagtacatattgagtttgtagagaaacatctaaattcttacataatatattcttaaaaaagatgatgaactttaaaaatgattaaatcccgaatgattaaattccaaatcgagaattagttcataactgattcaaagagccaaagcttgtagactattttgagatcccatcaatgagttaaaaatcttaattaggtggttgaatcgaaataaagttaaaatttatcaaaaattacaaaatcataagtaaaacttattaaataagagacaatacttgtaaagttttataatttttaatagaaaaaaaaatatatttttctaatattttctaatcgatgaaatcaatcgtccaacttttaaaaatgtgattttcttctcctcaatttgtgattttgacaccaataaagctagtgagaagggacaaaactcctatatttttaaaaattggaggattaatttcatggctttgaaattatatatggattacaatttaatttgattttttgagaaagtcaaacaatttaagtttgatgcatatgattgttgagggctatagtaccaacttggttaggattattgccatcattgtgatgtttttgcacaccttttgattaaaaaatatgaatatcaaatggataatcgaattaaacaaaatcaaatcaaacaaaaaaaataagtaattcatttatttttataaattactaataaagatgagtctaattaataagaaaccaaaaagatatgaattaattttttttagtattttattaataaataatatatacaagagttgggtgactctttaaggtttactgaccgccgttaacttcaagatgaaactcacctaaaaatatatatttttataaagtgattcgattccattggatttgatttattttttcttccaaaaatctaaatttggtaccgccctaatcccatcgcatgaagacattccttgaccaattgtaaagttgagattggatgagtgagtacgttggaggcatctcgagtgtcaaaccaacatcgtggcagctctacagtgggataaccaacaatcctgcccaccaaggaaaaaccatttctaccggcaatagtatttggataaaatattctctctcaagtcccaccttacctttagttacacttttttcatataaaaataaaataaaaaactctccttttcatcgtgggatatcaaaacatgcattttaagaattaaattacagaaagaaagaaaacaaatgatactaatatttattttttaagagcattatacaatgtttaaaggaataaataaagaagtcaatggttatgcatatgtagtgtaaaaaataaaaaaataatataaaaatgttttacactatcagataatatattatttatttttttataaataaaataataagatattaattttattactcttaatatttacactagtgtagaataaaaaatgccctgaaagactttgctctctcttttcctttgagatatttattaaaaattaaaatatgttgaagtgaattatattttcatttataacacaaatgtcataactttttatatataaaataaagcagtatttttttttcttttacaactatctttcatgaaaagaaaattccttcccaaagcaggtaaagcaccaaaaattggacatagaacaactcttccaaattaacgtgaacagagatagtatcttatgacaatttatagaatatttttttatgtttttatttcttttcattatattatttattacttcattttgcatcatatacttcttttttcactttctctttttagttgtaagttgtaatttctcatgtga

SEQ ID NO: 495 - DNA, 1101 bp, Glycine max
  Soy_ogl_990 Gm03:39902753..39903853 Cluster 1
ccctgaaatttttaaatcttttcttttaagttctttatttaactccgttaatattttatattaaatgtacgctacatcttgttgcagatagataatgtagctgagaaaattgttacagtcaattcatcggccgatgtttgttccaagaattaggtttgacaacaacaaatgtaatatttgaatttaattatatgtacttatttggaaataatagagttgcagacataaaaaaaatttctattcttgcaggcacactgaatgttattgctagaaataaaaatgttaatattggaacaattgttgttgtaaacatttaattgaaaaattaatggagtaaaataaaagacttagaaggagaattttgaaaatttcatgaccaaaagtaatcatattatttttggaggattaaaattaatatagatctttggagcaccaaaatcatatctaatccttaattaaataaaatgctcattgttgccaattaaaacatttcttatcataaattatatttttaataaacataatttattatttaataatattatttatacatttccatttttaaatcaaagtaataatatttgtacattgtatgagaagtttcttaataagttaataacaataaaaagtattatttattttctaatctgttgattataaaataatacgtaaactatgataaatgtataacattattagaaactgaataaaaaagtttaatatttcaaaagatgataaataactcttttttttattttccaaacgattttttttcttatcatgtgattgatagttcaatacgaaataatttcgtccaaaataatgattaattttcatccgaagtagagatgagtatttttctaaaacttatatagatatgaacaattttatttataaaagtaaataagagaaaaagacggagtaaatacattacagtattacacgatcaagaggtcgttgcatttgcatgtttcatgtttgtattccaccgaagaaggtggaatcgtgccaacgctaagccccaagcagatcttcgttagcacaagaaaacacgaatacgatcattgactccgtactctctcaccgatgtgccgtgtcttc

SEQ ID NO: 496 - DNA, 1800 bp, Glycine max
  Soy_ogl_4630 Gm14:3855601..3857400 Cluster 1
aaacttcatacacttcaaatgtaagtttataattttctacccaaacacacgagttgttgattattgaaacttatatgaagatcgaattccacatcatacactttattagaaattagattctaatgtgaattgtgaatttaacatggctgcatatatataattgaccaccagttgaaaaaatgaccaccgtaccagcgataaattcaaaaacatatttttttcttttgtaattatttaaatgtctaattcttaatgtaatatatttttcaaaaaattattaatttttgttttaaataataataactttaactattataataaaaataacaagcacaaattagttttacacgattttatttttgttatcaccttaacttattacagtaataataacaaatacaactaaatttacactaattaaccttaatttataattattataacaataatataaaaattaattttacataattttatattaactaactttattatatagagaaaatatcaagttatatccatataaataaattaaattgtgcataagttatgcccaactcaagtatccagtacaaatatcacacacaaaaaagtttaaaaaaagaaaatatcaagaaacaatatctttttcccttgcaagctttaactccattaaaacaaggtacgtattccatattaaaagaacatatacatatataatatagtggctcaaggttgaactcaataaaaatccttcaatggaaaaagattaacatgacatcccacgtggtctgcacctcgcattcgcaactgccatatcctcgattgtctaaagcatttaatttaatagcaaagaaaaagttgtattgatcctttgcaccacatttgactaaatcatttaatcaccgaaaaagcatctaatcacaatagtttttgcatgagcatgaggatctgcacccatcctaattagccatgtgctatgtgcccaaaggtcatgaaaaaacaccatttcaagttcaaaacacacacaccactttatgatacaatacatttttttattcagttaatacaatgcatcgaatacaaggtaattccgcatactcattccttcgcacacaaaaaaaataacattcattcacttgaaagaccaagctttggatattatgaaatggcttttcccccctttttactcttgtatccttgcacattagattccagctcttataatcttaattgacaccccttttctacagctacaccaagaatattctccatgtacattaacgtcttatagttcagctaattaattgttttctttttaatcttaatatgcagcattcttaattaattttcttgtacattattgtattatctttgagaaacacacaatctatcacaatcatccttagccgtgtgtgaaagaaatccttttcaggaatggaaaaatattaattaaattaattttcatcaaaattccttcaactccttttggagaatggtgagttgaaaaatgactcgattcattcatcttttgagagtataagttccaaaaataatttgaaaaaaaaaatcaatcaatcttatgtctggactgaagttgtttagcaaacaaaaatgataaatgggcattccaatagtatactatacactcatttaacatctctcatttctctctaatagtattttaatttctctcatgccaatatatagtatactatatcacctattacagtatttctctcttctatattataaaagaaaatgtatttctctcttctatatatttctttttctcaagattctatcgacggaacatgcatt

SEQ ID NO: 497 - DNA, 1997 bp, Glycine max
  Soy_ogl_2541 Gm08:7496504..7498500 Cluster 1
cagaaacaattggtgccaatcctcatccaattcaaacactcagttttgcacacgttaacgtaccttttcacgttaaaaatacaaaagacacaacagcaactcggtgaagcttgggaaagctttttttatttttcttcaatttcaactgtttttatatataaaaaaataagatatttatcaaataagctagatatttggaaaatcaactaaaatttagcataaaaaatccaaaaaataagctgttttcaagaatctaatttcttttagcttgtggttattttcaaataactttttttaatcaataaattggtgaatgataggccattgcaataattaattattgagtgaatgatagtccttaattaaaatagaataaattggtgatgatatattttttaatcaataaatattaattgttaatgtagtggtagagaaaagatttgaatggacaatctctttctccttcttttttgtttcactattaaatcaatcttataacccacaaataaattggtcatattgatccttaaaattaatataagtgatcaaataattttggaattatatattattaatcaaattaatccctaatattacagtagatgaccaaatagataaatggtctttaaaattgtaaatcatcataattttttttaaaaaaagcttaattgcacttttctctctaactattaaaatttcacacattttgttctataagtttattactccctgccttcaaaactttgtgcattttggaaaattgtaaataatattagagatgaggtttgaatccttaacccttccttctccacaaccaccaaaatcatcaagggtgtatttatgtaatagttgcatttaacatataactcgctttcatgttattgggataaacgaatttcttctatatgtttactgcataggaaaagtgagaattttcgtttgaagcgcctcaaacgtgaattcaaacacattctaagtcatttgttttgtttgatgtttataaaaagtatattcaatatataatattattatatttaatttgttaattgcaattttgatttcatgtatattgtatgaaaaaatattaaaaggcaaaatgataaaagaatatttattaaatacttttattttaattgtatcaatttataaatgatacaaaactacttattattaaattatataatatctcataaatatatttatgaaatattttactccgaacaactaccctacaagtaaaaaggtggtagatgaataacaagttattatcttaagcagcagtttcaacatcaaagctaatttgatattgatggagcgaatggaagtttttcaaagtctcgcagaatgtgataaagttatatgattattggaggaccatgttgaatccatcatatcatgctagatggatggtcttggtcggcatatatgaccaaggcagaattagaaattgatttattgtttggacattgttgtaggctggtgggggcgtgggggaatgtgaataactaaagtatattgttaggatcaaactctattcctctacattaatatcttcatacgtaccagtcagaatacatccaaacttcaatcacttgaataaaccattatattttatataagtttgagtttttatgtacaagcaaaaactaattattattataaaaaaacttatgtaaaagaaataaaataaacccccttcattaatcattcatgcagcagttaccctcaatcattcaatatataatgactaattgtcattttgcagataacatgtttcgtcaaaatttatttatcctgaactatttgattagaaaaataggtattcacagtaaataataataataaataaaaacaaaagtcactagattgaattgcacattcaatagtaatttctgtcaatttataagtcgtgaaaactaatttctttccagacataaaaattaataaaataatttttgtcttttctacataattacatgatcacaaattgaatttct

SEQ ID NO: 498 - DNA, 1425 bp, Glycine max
  Soy_ogl_3729 Gm11:4630102..4631526 Cluster 1
aagttcatgaacacagtgattcatgataataaacatgaatacaataacaaattttcttaaggattcgtaaaataaatctaaaaccttaacctcaagtaagtcgaataggatacctcataaaaacaaaaacgaaccagtacttctataatccattcaatcccataaacagaattagttcatgatctagacattaacaccgtctctgttaataagttttctattcaaatttgatataataagctgtcaacatctcctctaaatcttcactttaatccttttaaatattcgtaaaatcatgatcaataaaagagaaatgagacatcaccaattacgtaaaagaaaatcaccagaaactatcacaaatatatacacaagcataaattaaattataataccaaaattctacaaacttttttttaaaataaaatctactcctgtaaagtggagtagactaagtcacagaaacactatatgaaacctatcacttttgcacccttcacctcataatccctagttgatggattattattgaggaaggtattgcttctgagttataaacttatttgatatccgggggtcctacttcatcacttaagtcaaataatgtttctttttttaaaataaatcgcgtaaactcaattgctttggcacgtatatacattctgtatgcatgctgacgatcgagaatcttaatttaagcattaatcaagaagcagaaatacatattaaaaagcaaaacacatacttttgaaaaatcattgtcatctcttagcttattttaatttataaaggtagtcatggtagatttttaatgttttgcagtttttttttcttaaatgacaatttggttctataaaatatctttttattaatactttaaggataaaatttaggtttagtttatgtcaaatttaaaattttatatattagtctctattgttaagtaacaatattaagtattagctaatggcataattatggtgtttgtaacttattgactttctatgttattaaggggtaggaaaaaataattatgtgtatttttttaataaaacgtgttttaaaatctttatttgtttagaataatatgacagtaaattacttgatgagaaatttaaaatataatttattaaaaaatacatttgattatcctattagatttttttttacaacataacaaattaattaactatcaacattattgttatttgataacatgaactaaacccaaaaaaatcaattttacatagactaaattttaaaaaataactttaaaggaacaaaataaaaaataagacatttataaggctcaaaaacttatttaagtctaattttttcttatagtatcctttgcactaataatatattttacatacataatttttttaaagtaaaatataataaaatgacacacttaaaagattc

SEQ ID NO: 499 - DNA, 1703 bp, Glycine max
  Soy_ogl_6348 Gm19:2510801..2512503 Cluster 1
tttgtcattattagtagggattggtctctctcctttactcatgtttttagaaaagctaattcagctgttcatcaacctcatcctttatgtatttattttgttcctccttctgcccttggtactgtcttgcttagagctagatagcttagggtagttcttctgttctgttagtttttccacagaatcaaaaacaaaaataagtaaaatttgtagttggcagtagtgtgagagtttagtttcctgcaatatcatgtctttttcgcattcaaaataagtaagaaaatttttaataaaactaagtaactaacaatacccatccaaaaaaaaaaaacttttcaatttggtacagttgaaaattctccttaatgtatgctttttgtgtgtgtagaatgataataaccaggattgaacaaattagggatgttcatgagttccggtaactcataaatccaaaccgactcaaatcaatataaatagttcctcttgatttttttttagagtttacacaaatccaatcttcctgtagaaatttgatgggattggataacatgtttaattaaatatgttcgactcaacccaatacctttacacccctaaaactaatctaaattttcatgcgttaatctcaagtttccaatccccaattttcatgtgtggagatgtattatgaaaacatgtcaaaataactctactcaaatgaaatcaaatcgtgccatgtattgtatgtaatatacaagtcaaaattaaattaattcttggtttataactttaaagcaaagagttttaatgtgttatggaagacttgcatgcaagagtctgtcttctacgagcaagttagtagatactacaatttaggaacaaagaactgatttataaaggctctttgcctccttcaatctatacttaatttgttgtgtcgtttcctttcatcaaacactaacaagccatgcagaatactactatttggaaggaaaaaaaaaaaaaaagactgtacccacaattaagatatttttttaatcaacctaagatatctcttatcttatctgaaactcaaaatttaatctcttaaaatattaaaatctatttaagaaattactacaggcataggcataacatatatagagtaaaaaccaatgtgaaggtagagttattgtcacatggtaaggacattgtaatttgtaagttattgaatcttcaatcctcattactcgatcttcatctaaacccaaaagggaagcatcaaattaatttggtccccccaagtgggtgtttccaattgggaagcccacatgctcaaacatggagccccgcaattggtgtgcattctaacttttgttttaattctttccgtatgctgtaccttagaaatttaattaattgcaaggcaccaaacacacattcaatgcgcctatgctaaaagaatcaaaattgcatgaatcaaattaatataagactcagcattaaaaaattcataaagtattataaggatattgattaaagaattaaaagaagaaatatttttattaacatacgtaaaattatgttgttttttatttttcacatattcttttttattttcacatttaatatattctccttttattttcttaacaaatgttagtaagaccctaaggctaattaatagtaaatagtgtatacacaaaaaaataaagactttttaaaattattattcaattacaaat

SEQ ID NO: 500 - DNA, 1400 bp, Glycine max
  Soy_ogl_184 Gm01:47213701..47215100 Cluster 1
agttgtatataaatttaataattttattgattcattaatctaccatttgaattgactggtccaattctacttttcattttaagtttatgggcgtttgacgaggacaagttttttggtactcgaaaaatatgatttttgaaaaagtcgatttttaagaattataatttttgagattgtggaaaatatatttgattagttataacatattttttatgaattaaaaattaatataaaatatataattaaaacttttttttcactggtgaaagttgaattctgtctgtttgttatttttttttacaaaaaagtaaattaaaattaattttcgaaaatcataaattttaataatttttttattattacatattaaacatgggaatcataatttttcattttaaaattattgagaaagtaaaaattttagcctatccaaaagctcctttggagttaaaagcataatggagtcaaccaaaaatgagcaatggatatgcattaacaaaatttcacacaaatatcgatagaaataataattaatcactgtgaaatatgaattgaacactgtttttaaagataagaaagggattgtgtgtcatcctcttgtttcttctttttctgtttttacctgctgagatgggcaaactgtcttaaagctagactctcacacacgataataacattctatctttttgttattattttttacatctattttttcctgtctcccatcttgtcatacatatagcgtgtcaagtgtcaaccagtgtgacttacttgaaaagaagcgaatccattctttctgtctacaacattattataattctaataattagaggaagagagacacttcgagtctctttatatattttaaataaaaataaaataaaataaatatttagaagttaaaaaaataagaaaaggaaatagctaactaaaaaataatagagcagttagttataaaaaaatttgatgaaaaataaaattatttaaaatatatatatactaaatgggataattttcattattagttgttatagataatcatgggtaaattgtttttctttctagatgttgcaaagtattttttttataagaataaattagacttaagtgagataggatagatcttatcagcatcaaattactcatggactcaattggatattgagtcaataagtcattgattgatgtccatgattcagtttaaaactatttaagtaatttcataacctgtagacttatacacaaagtttaacaaaatttaatatatttaaaagataaattttgaacttatttaaaaatcttaagcaacatattatttttttttcttcagaattcagcctacactaacacataatttaaatcaactatttattaaaactataatcgttgcatactggaaa

SEQ ID NO: 501 - DNA, 1300 bp, Glycine max
  Soy_ogl_6482 Gm19:41132701..41134000 Cluster 1
atatataaaaatcatgataaaatagaagcaaataagaataatttttatttctaccattcaaaattagttttatcatcgttaatccaaacatacacctaccatgttatgatgccttgcattttatattaatggctttaattagttaacctttttaaataccacttccaatttaatgatgatttttttttactaattttaaaagtctcgctacgtgtttaaaataacctatatgaaatttatttagacttttttttattttattctccgattttttaaatctaaatatttttaaaaaatttcttatgctccatttattaataataataataatttgtgtaaatagtttttatgtttcttttctatagaaaatatatttagacatatcaatttataaattataattataataattatcgttagcatcaatttataaaaattattttcaatatgtttctcaataaagttggaaatatcatggcacgggaaaatgctagtatttcaatatgacaataaaaagaaaaactatttatgtccattatagtttaaatatatcaaactatttaatgtatttgaatgaaaagaatagccaaaatatacattgctttctgcaaacaaatttttaaaatggataaaaagactactggtattaattaatagttcatgataagctttcattagattgttttctatcgacaattaaaaagaagatctttattggattcctttttttagaagctttattagattcctaggtaccaatcaggaaggaaatgaatattaaaaaaagataaaattacgaaactacagtgcatatctgaagaattttttattaatagaaatcgattatatataataattcacacacattcttacctcttactaaatcaattggattagattttgaattcaaattccaaaaaattcttataattaaataatgaaattattggaataaaatcgttacataacaactaaaataaaaatatatattctgttttttttaaaaaaaaaaatcgctttggctaatcactagaaagttgagacttgagaccgtagctaagctaagctgatcacgtaagacataaaattaagaagtggggccattagtgtagaggttcaatcctattctccattagccaaaaggcaaagggtagacagtacacagtacacacacaaagatcatgttaaaagttaaaacaattttcttctcagaaaataatatttggtgaaaaaaataagcaaaaaagaccattctagaaccaatagtaaaaaataactataaaattatatgcaaataatt

SEQ ID NO: 502 - DNA, 1700 bp, Glycine max
  Soy_ogl_454 Gm02:9340101..9341800 Cluster 1
atttcagggattgaaatgaaatcctaaaaaatttcaaaaatttagttgaatttttcttaattttaagaactaaattgactttgtaaaaaaaaaactaaaatgaaaatgaaatttaaatttaaggactaattaactatttattcaattaataatgaccaaacagtgaaatttcgatcagagaagtattgattaatcaataaattgataattatcattttaaaaattattttttcgatttagtgaatataaatttacttatttaccgtaaaatattggaacactatcagttattatgataattaatcgggttattcgtgtgcgatgtacggatcattctttaaaattattgattattttaattaaatttataaatcactcttaacttattctaagtgcaatatttactatgagatttttttaaaaattatgatgttcgatgatatttttaattccctaaatgaattttttattgctgtcaaaattttacaacaagactgcaaatttagttaccctgggatcaacaaatcaaagtctaagaattgaatttatggatttatacattttttatttcccaaattatatttgtacattccttttacccttagaatctacaaactacaaatattaataatgaatggtgcaatataattttaaataagcatttgaatgtataagtaattaatagttactactttgcgatattaaaaatctgttaagaatgatcaagctcccaacattataaatttgctatgtatttgttattgggaaaattaaaacaatcctttatgacattaatcaagtttttaaacaaacctcaattccttcaaacaacaacaaaccttaattatgacattgacgatgcaattaagagatgcttgattactacatagattccagataatatattcattgattggtatgcatttttaatatcaattagacaataattaatacaaattgatttaataataatattaatattttacatgatttatgtgattttttttagcgggatttgcatgtaaaataggcagaaaaaattatgtacaaaacttttcactttaataatataagagaagattgattgacatgagtttttaatatcaaataggtagtaattaatacagatcgctctaataacaatatttgtattttatgtgatttacgtgattttttaaaccggataaacatgcaaaaaggggggggaatttatctatcgaacttcttcgctttagtaataagaaaagatatgtcaaacacgaattgtatttctacatttcttttacccttaggatctgcaaaccacaaatattaagaattaaaggtgcaatataactttaataaatatttaaatgtataagcaattaatacttaataatttactatattaaaaatctattaagaacgatcaaggtctcaactttataaattttctatgtatttattattgggataattaaaacaatccttaattatgacataaacgatgcaattaagggatgtttgattaatacgtagattttagataatatattcattgattgttatgcatttttattatcaattagtagtaatcgatacaaattggtttaataataatatcaatattttacatgatttatgctaattttttagcgggatttacatgcaaaaaaagacggaaaaatttatgtacagaacttcttcactttaatacatgc

SEQ ID NO: 503 - DNA, 1400 bp, Glycine max
  Soy_ogl_3567 Gm10:46197201..46198600 Cluster 1
agaatgcttttcattttgattgcttaaaaatttaacaaatttgacataattaataaatagtgtactaactcagcctataactcgattattaaattatcgctagaaaataatcactcaactgtttatcccactaattcaaaattagttagctacttatcttctaattctacttaaattcttattattcgtgatatttttctatacacacaacaaaaaaatcaaacttttatcggtatacttaaaaaattaatcatctataatcatattaaaccttattagttagttagaattttatttcttgtcatatttatacaaaaatacttttttataatttttatattttaaaagtaaataatctttaactattaactcaaaaatatttcctacgcaaaaaaggtgtcaatttttttcattcaatttgcactgtaaataaataaataaaagggtatgtaatcctattcttaattagcatgatttttatggcataagtactgtaaaagctctttcaaacgtcagtctaacaatgacaaacattgtgacggcagttagtgacattgatattacagatttagaagaggtgaaattaatctctgacatattcagacatgaatgaacgtaactagtatcttcacacgttatttgacttttcattcatcacttcaaggttcaaactttaaaaaggcaaagaagtaataagaactttccggcttaatttatttctgataatatttttttgaggaaataaatctcttcacacacgttgagataaaagaacagaatacactaacaatatagtaaaaggatacaaatttaacgtcttcagacacttttatctgcattcacgataatatctcaatcaataatatatttatctttatctttaaaattagaaattataatattttcaacatctttatcattttattaaaatcaagaaaatattattattattatgttaaccacagtaatttgagcctttaattctccaaattatatatgcaattaaatcagttttaatgaagtaattattcgatcttaaccttactcaaagttacttacatcttctcaaagatgtgttcaaaaattaccctgaagtaagactaacttttaaactttattattagaagaggaataattaatatattaatataatacataaaggggaagcatgatttataattcaatcgaagtgtagctactttatataattaagttaataagtttgttagtactgccttaatctgatggttttgtaaacgtacattagaaagtaatgtattgtaaacttaaaaaacaaatgtaatgcacaaaagggaagcgttagtttccacaatttagttatcaatttttatcttgtaactctttatagaatttttggtacatttaaatttaggaggagg

SEQ ID NO: 504 - DNA, 1700 bp, Glycine max
  Soy_ogl_5229 Gm16:1332701..1334400 Cluster 1
tgtacaatgatgaattgattgaatgatgtatgttacaaaatttctattaagttcggcacgtcatgaataaattaaggtcttgatgatttaaagtcattcgaggttaagtttttactcaaagagactcatcatttcatttataaagatagaattaatacaatacggtaaataatcaataaatattggagtaacatagactttagacatcctaataacagagggagcgacttgattcgcttgcttagttaattttatgttttaagccatataattatatataaataattaaaattaaatttaagtaaatttaatcttaatcttttttttttgaaatattaatcttaattcataatatccaccacaaaagtatcattcaatatgtcacatgttttatatatgatcatatgcatgagagagagaaagataatacacatttttttatgcgtatataatagtaatacacacattattaattatatcaatacaaggcaatatattttcaattaaatatataatattattatttactatgataaaacaacattttgacttaaaataacaagtgaatgacaattgctgtccaaggagtaaaattttcaaggttgaattaaactcaaaatatattttaaaatgacattaaattttatcataaatttatcatatattatattatacacacatcaaacttaacagtattcaacataaaaaaatatattaaaaaaaatccaaattacacattaactagaaagagtatcaagtcatatatataaatagagaaaaatttccatcttataaactggttttttgaatttaattaagtagtgttttagtcaaatatgaaacttgagaacaataattatatatccaaatcatatataaattgttaaaattaaaaataatagatataattaacttttaataatgaccatcaatctataattatatatttgaaatttataataatcatttctcccaataattaaagtttacataatgaacgaaaataagttcattatgcgcaatgccgaccttctccctctgatagatcactataaaagttgcatcacctatatatggcttccattactatcattccaatgcccaaaagtcaagataatcaacccctaatgattaatttttattgcaaaaaggaccaaggctttactttaaaaagtatattaatattaatcagttcaaaactcttccaatcattctaccataatagtaaaagattaatcaagtatttcccccttacatcatcaatagttaaaaatttccttacggcctaccagtaccaccaatcactaaccttgatcgcccttaggatttaggaagatattacattacttgttttcaaatctccattggtatgatgaacaacttgatgcggttttagatcctcaacatgagcgtcttgacatgtatgtgcattgtagcactcgtaatcggttcctcaacaggaaaaaattggtactaatgttacaatgcatattatttctgcttggtttatttatgcaactaaggatgctagctagcatttgcttcagaccaactaatcttgtaggctcatactatcaatttgaaggagaatattttctttcttgtgactaatctccattatgatatttttctttggccgtcttgactcttctttactgctgttaagaagacttgctatataaggttattattattaatta

SEQ ID NO: 505 - DNA, 1638 bp, Glycine max
  Soy_ogl_1826 Gm06:7253763..7255400 Cluster 1
gatttgtgattaaatgacagtataaaaatattttatcctatcaatgtatgataattaaactcttttatttagtaaagtataaataattttaaaattttataaatactcgtttagagctatttcaaatacttgttttattaagaaaaataatttcaataatagttgtgaaagcaatatataatagtaataattattaaaatattaatcatatacttttcatcgtagaagaactagagaaagataatatgttacacgaatacacgatgcatgggaatttaattttagaaaaaacaattagatttagaatatatcagatgtcaattgaaggatataatttttttttacaatgattatgcatataaaatattttttttcgagaataaaattagactggttacctttttcacctaattgaccttttcaattaattcactaaaagaatgtagtccatgagaattggactaatgttatcattgtcatttgttatttctctctctagctaattcactaatgttagcttgaagttgtgagtgtttagaatcagaattggacgactgataataattttcttgcttttcaagattctgaatcaagagtcaataacataagcaacacataatattacattctagtgtcattgttggttaaaaataaatagttctttttggtaggcgttaaaaataattagttaaatcccatacaacaggtttgaacaattgaataataaataaattgaaagaaacaattaaccttcaaagatgtcattaacgaaacaattaactgcagaatcagcacgacagcaccctccttattgattctctcttatagaatatataattattgcttcacaatattcatctctgggttattctttaggtaaaaaatatgaggaagaaaagtaagaaaactaaatagcaaagccaaataaatttatacatcacctatatgtaaatgttgcttagaatagcacttagaaataaagcaataaaaatgtttgtccaatttctgttaacattatcagattattaggcaagagaagcacaaacctctttttttttttttttttataagcaatagtagcacaaacctaattaactatcaaagaagtagacatttaagttttctaaatatttttgtttcctagggtgtaaaaaaatgtattccggaaaattaaattgactaaattctctaagtaacattttattgaaaacaaaagcgcaaaattaaattgatcgatccctcaaatgaaagttgttgttattatttcatatacaccccctgtgactcttaagggaatttaatcaaaactccatgatgagtatcaatgtatctcacgtacaacaaagttcctacaaagttatggaattataaatagagttctgaagcataaatggagtatgggaagaagacatacttcgctggagaaaagtcagagaggtgaaatcgttggaaaaggctgaagagtgaaacgagaagagaggggaatgtcaaatgtggtgaatgggggagtattgtttttaccagagtaccagggggagtgcgtgaacgggatgaacaatttgaaagatagaagaaaaaataaggctagttaagtaatttaattgaaaaaaagaaaacaaaaaaggggagtgtatttgt

SEQ ID NO: 506 - DNA, 2000 bp, Glycine max
  Soy_ogl_768 Gm03:339101..341100 Cluster 2
atgaaatcagcgttccaatggcaccaaaagtcatcagaataaatcaatgaagtatattgaagagtagtattacatgggcgttataagcctgcacaatcaaagtagaatcgcattcaatccacaatcccctagagtcaccaaagagaagagaacatggacaccttaccatgtagaaatctccagaaaagtgatgaacacaccattgttactccaagacaccagttactggcgagccctcaaaaagtcataataagctcacttaatttaacagacataagcagcaccacacgattcatatcaaatatattgctgcgtctcagttatagtggatgtggatgattgtttcactttttatttatttatttagttaagtaaaattacatttgtcttgcaggaacggggtaaggtaatttttttcataaatcaccaaaatgctagatatttaaaaaattatggaaatggataaatcgttttttctaaaagtctatttctaatatgaaaatatcatgctatgtgttcaaaaaatgattttacttttgtaattttgtttaaatgtgatagttaaaaatgatcataaattacttttttagttgccataaaatggacatttatatgtttttctgaagaaatttgtaacggttaaaagtcaccacaatttcttttataaaataataaaaaaaactagaaaatattgattttggtaatttataaaaaaatgcacaaattttgtacaaaagccaacggagtacatgtagtattattctggtatttatgttaaaataggccaaagaaagccgaaaagaaagatgattaagtggtttaaagatttatttttaaatatttatttattttatttcccttaaaataataggacgatcatatttgttgagttgtcattcattaggattgctatttattttttttggacacacaggattgctatttaacatggagttacaatattgatgaggtatcaatgaaagaaatgaattatcttattttcttttctctattctctagtgtgtgtgtttttcaaagaaatctattaattctctagttttttttgggttatttccagtagtttaggattaggaatggaatttccttaaaatcctaacaattttccttttataaaaaacaaagtgctatatttttccaagactagtcaaagtgccttaaagttgcggcggctaatagttattttctctcatgttgttggttgagtttcctaaacagttaggtcaatatttactacacgtaattaagtagtagtagctaactgggtacattttactatataaggcattataaagaaacttctataacgtcaagaaattaagcttaattatgaaaaacatttacagaaagagacaaatctgatcggttacgtggatcaccaaaaaataataataatctggtcggttacgtggactgtaaattagactttaaaaagttacataaaaaactaaaagataaaaaagcaatttgacttcgatcaaattaattaaacaattattttctatgtgacgagaaaaaggatatatatatatgatagagtagacattgagatgtaaaatttgaaagaaagcttgtttggtaactatttctaaaaatattttttagtttttgaaaatataaaaataaaaaaacttatttaatgttgtgtttttttatcaattatttaaaaaataaaaagagagaaaattgttcttaaaaataaaaaagccacaacatctttataatacttttttaattctctgtgttaattgttttctaatttttaaatctgtttttaaaatattttaccttaacttatttccttttcttgtctttaaaaatagattttaaaagttattttacaagatagttttaaaaaaatagaacagaatcaatcaacctgtatgtttctctcttgtcttttttctgaaaacaaatgttactgaaatttagccttaaattgggtataagaataagaaaaccctaacttcttttgcaacagg

SEQ ID NO: 507 - DNA, 1699 bp, Glycine max
  Soy_ogl_942 Gm03:37768501..37770199 Cluster 2
caggaagccattcttgcacaaataatgttgggtatgtgcacaataggaatcattcagtaaaaaaaatacaaaggaattaattggggtttcaatcaatggcttgtgtaggatttttttttttttttatatacacccataatatctcctgatcaaagagttagaaactaatttacgtactgaaattcatttaaaaaattaacatttctcaacaaatattctttcatttaaagaatgaaccttatatcatctccttaagacatgttatctaccgaatataacacaccaatgataccatgttagttggacaatagtatgtgaggaatgtgagtgcatgcatcattactcagttattcaggtcatgaaatgatagaaagaccgaaggtaatcataaaatatttacccatggaacctcacaaaatttatcaacttagataagtcaaaaactttttaaaaaaatcgtattcttgctacattagaactcttcgggaagcacggtatggtccatttatggtccccattgaaaaatgaggatgaggagtaacctgttcatagtctttcctaatttctctgcgttcattttattaaatggatgctcaaggaaatcaccgtcaatgcagtgatttaatcttttaaagggaaaacaaactcaacaccatcatggcaacataaagtctttaatatcctaatttcttcgcattgcacaatgttttcaacctgccagtgaatcttagaaaggtcatagtcatcaatttacaattgacaatgctagataacagtggcatgtcttgctagctatttcaacgaggattctttattctttttttttttttatgttgcctcgaaaagaaaagaaaaataaatatcaaacctaataacgtgcaagatgttgaccatatgatggctgaaactaacgatcttttcataatgtaaataagggtattagggtaactaacttttgggctccatattaaacgattctttcatttcttttgatgttttttcttaggttagatgatgtgacacaacaattatattatatcctcagcgcgaagttttatcagcaagcgctgttcagtgttctccaatgtcaggttcagattgtcgtttctttctttgctgctttcttgatgtgaaccattcatgtgtgcttcaggggatttcaagtttctgacttctttttttagcttaggtgattatataatataaaggttggactgtctagtttgcttctacaacaataatatcttaaattaatttctgaaattatattatatgaattgattcatttatttactaatataatagaaatgtaaattcaattcattttttataatagttaattatttaatcctcaaaattaacatcaacatcattatattaagacttgtgctactcaaatcttacatcaaatgagtaaattcttattttagaaggggagattgtcagtatttattagataagtctctaattatgatcaaaagctaagtctctaattttatagtatctttttttttaacaacaattttatagtatcttcagttatataatttatcggagttacataatttattttttgtactttatatagttgtcatcatgatacactatttttaaaaactttttctaacttaagaaattatttcttttaatgggtctcacgcgttacatctacaactatttatttattcaaacaaattat

SEQ ID NO: 508 - DNA, 2337 bp, Glycine max
  Soy_ogl_961 Gm03:39133173..39135509 Cluster 2
ccctgagttacataggaccgttcaataattttgtccttaatatatagttataagtttgatttctaacccatatgtatgaagaaaaaaaaatattttatggagagatatcaatcctttaaatagattttaatattcttaagggcattcatcattgatttttggtcaaagaatagtctgattcacacaaaataaaaaaagaaaaagcatttcacatttctctgttttcacagcaccacacgaggacaaataaaacgtggagaaagaggagtgtggaaattgcatcctgaaataactaggcctgttttttgataatcggataaccttaataacatgggatgtttgggtcatatactgctttcaatcccaaaattatacaagccacaaatccgtgaaggaaataaattggggcggcctgtttattttcattgtgatggaaagaacaagaaagttacaattttctaatccaggaaaccttatctagcaagtgatgagaagaaaccaggtgacccctctaatagtgtttgtttggtatagtacataagaagacccatttacgcaaatgtatttacatgtcaaaattttaacataattaaaccaattcaaattcaagtgggattaatggaaaccaaataataaaaattatatagacggaaagtaaaacatgtaagtgtatgtgtaagtcaagcattattttttttttccatattgagtacaaagtgaaaattattaacaggttctgcaattatttgatttattttcattcttataattaagagttcctcgacctatatattaacaatgagacaaagtgcctaactcaagcaccattaccatttgccatgaaaacaattgtaaaagacaggaaatttacctcctggcatggttttatttaatttgttataagtaataacccttctcaagtattattaccttacactgttaaaatgagtctcgagtctgtaagacgactaaaattaataatccaaaaattaaaatgtatgtattaaattaacataatcaaagagaatacaattaaattttccaattcaaatcgtacatgtaatataaggaaagaaaatgtaagcctgtaaatcgatacaaatagctcgcaagccggggcacctaaactcctatatagtatatggtgggttgaatcgtcacctttgcctagctagaagagttcaaccatttggtgatgaagcaatcacctaataattaagttagcaacaaattaaacctccaaagagttaggtagagtgtgccaccgctacgtacgttgatgccaaatatgtaataggggtccaaagcaacgtgaacaattggaaatagaacaaaaggctctggtaatgacctagtcaaaatccaagtgaaaaattcaatgcatctttgttttgcctatatcacaagacatagctatgttgtatcatatttgaggttaacatccttgatgcgattcttcaattcagtgtgaaaaaacccaagcattttaagagggttcacaaagctatagatgccaaataacatcccaaagaaacatatataggtgaatttttcttctagagcatcacaatttaattataaatggaacagctggtcgtacgtgtgactgagttaattgctctattttggataagtttggcctcattggcataacctacgacaagaattacttcaatctttaaaggaccacactgtcagaaccatactatcgcaatagatacgtacattagggttgaccgggtgaggatgatgttatccaaaagaacacaatatatatatatatatacacacacacacttacagtacaatgcggtatacgtacactcactattaatttatgtaggctggcatatttacttacatcagataatctaaatttgataatttgggatcaagattctcttaagtaatctaaggttattttggtcatgttataagagaatgagatatagaataattatagtgaaatcaatcattgtttatgtgtaaactttattaattttgttcttgtatttttctctttcataatataacgttatattacttactaactttagaggatatacttcaattgatctactgcatagagatatttcttgttattaccatgtgtatgcaaatgagttgactgttagaataggacatatgagttgactgttagaataggacatatacatatatatatatggctaaggattaattggagctttccaattcatcatagggaaatcattgcgctgatgtcttagcaaaaatgggtgctagaaatgctagtctcccaacttgttgctgttgcttgtagcagatgccattggaactagcttccaaaggcaccag

SEQ ID NO: 509 - DNA, 1196 bp, Glycine max
  Soy_ogl_2183 Gm07:4408501..4409696 Cluster 2
aaattggtcacgaagtgaatgaagagtttacaaactttgttcataatatgctgtagaatccttgttttaaactgctataatagtttacaattttgatgtaattgtgaaaaccataaaaccttgatccatgttgtacttacattttttttttacaaaaacgttgtacttacaattgagattacgaattatagtttaaaacactatataatatctatagggtgtgttcttcataaccaaccttttttttacagtagcaaaaaaaagatttttaagttttaacataatttaattataatgctttcttaaaaatcaatgtaggatgtgaaattatgatatttttataatattaacataatatcttttacatcaattgtcttaaaatcaatctagaaaatgatttttgaattaggtgtattaagaactgatgtaagaaatactttttttttaaaaaaaattaatcacccatctaaaatgtttattttcttgcaatttttaaaattctcaacaagacttttaaattgattatttttaaaaatgatgtcttgttgatgaattttcaaaattttggaaaatgctttttagattggttatactaaggaattaatattgattttaacattagttgtttttttttattacttctacatcaattattagtacaaccaatatagaaaatttgttaatttttttatgattttagtagcatgttcatatcactctaagtttcaaaacaagatattcacaatattcttatacaagtacgacttcaatctattattatttgcacaacttatctaagaagtattttctagattggttgtaaagcaataaacgtaaaaatattgttcattccattataaaaaatgtcaccacatcatatatcgtatcagtttgaaaaaaacgacataagctttttactttagaagtgtttttcttttaccaattctagtttcttaaaatgttacaacccctcattcaaacgcaaccatattgaattcgataactgcgcctgcatgttattaattaatatatggaatggaatgcttatacctaattaattagttacgagctgaggtcatagtaagttggcagatagcttcattttgccctattttgtttttttaataatcacaaagttttggatagtgttcctttttttgcctctcaattctcgagcctcatgctgttagtttttt

SEQ ID NO: 510 - DNA, 2201 bp, Glycine max
  Soy_ogl_4143 Gm12:38117401..38119601 Cluster 2
tgccttcgacttccagcttgccaagtttcacattaactagctagttcccttgcacatgaagcaatgttccacactacagaactagaacaataccttttttatggaagaaaatcaatatctaatttccttctaattttagaacactagtctatttctttgtcacaccaatcctcataagagcaacataggctataagtctgtaatctatcatcattatcactagagcagatgcagccatgacttgctcctgcaaattgaaatgaaaccctgtttgctttatagaaggaaattccgcaacttgacactggccagtagaacaagggtatgtctcgccattgctatactgagacgcgataaagagctggtagttgtagtagctgatggaaatgtacttcacccatgaaataaacaccagaacatgctgaacataaaaaccaccagcaagcaagaaacacagcaggagcagtgaggacaatgtggttgcatcttttgatccatgacagaagcgccgaggtcctgtgagactaagacatggagtaagagggtgtgaataaatatggagggaagactaagttccatttgaaggtcagctaccacccttgacatgaagtacgaggagagcctgtacattcctgaagatctttctttctctagcatcaatagctcttagggaatagtgaaaatggcttgaaagagagggaagaaaccccaaaagccggatatgaagaatagaagcccaatctgcatgtacagtatagttatgattatcaatattgtacttaagtcattcttttcataatttaattcgctgtccaaacaatagtgaaaaccaaatcatacctataaattcagaaagaacaaaacttacattcagttctctaagtgttttttatgttattctctaattagaattgaaatttcatttcaataacttatactaccctttatgcatatttttattacgcacattagtaaggtaaaactctaattttgatcagaaaacaatatgaaaacacctaaaaaaaccacacctaagttttgtccattcaccaagtaattttgtaaatttataattatatactttcaggtttgttattattaatatataaaatcaattgcaatgaatgagtacatgataagttaattccaatgttactgaagattgagataaagtttacataaagcagaaacgtaggcaagatctatacacaaagcagaaaagatgcataagtcagaaatattttgaaattatatgtcaagagagaatacctaaacagaaatgaataattagccatatcttagcattagtaattaatagttatggttgaagcaaattgtgttacattgagcatttaccaagagtactcctaagtaacaaaactctaatcattttccaactttttggtaagcatagtgaattctcagcaatatttttaaagattttaccggtgaagaaatatgtcaatataatatttttttataaccacaggaactaaagccttgggctttctattgacataccagaacaatataatgcagctctctgattttatcttccactttcctttcaagctcatgaattgtgtgctccctttcacaaagttgctccagcaaagccagttaaataagtttttagagtaaagaagctctattttacattattaacatggtcctagagttgagcatcaaaggtgcctcgcatttccattatctcagttataacaatcatttgagcctttagttcaatataagatagaagatagaagatcattctgaacaatatatatgcatgacatgacacgtaatttggtgatcaggctcaccagataatatatcgtcaagttaaatgtgatcgtagtggatttgcattctaaattaaactacgtacgcacctatataaatgtttactttatataattatatcgccgcattaaagattcactgcagttattttatataatatatcgccattaaagataatataagataatcacattactttatgcatggacattgatggtaaccgtggtgctcatcagataatcataatcctaagagttttctttcttatgatcaaggattgttagagggagaagataattttctaatctcacaaaagaaaaatggatgtgtttagaaagacaatttaattaacaacttttttagagcaaattaagaatttattaaataagtgtttatta

SEQ ID NO: 511 - DNA, 2000 bp, Glycine max
  Soy_ogl_4442 Gm13:34040101..34042100 Cluster 2
acattaagaaatgataaatggaagcttacactgagaaattccaatcgaagttgtgaaatatagaaagaaaagtaaaatgagtggtcatgtacgttcatgaataccaatttcaaatttaggattgaaagctttaaaacaaatgggtagagagaagataaaggatatatacataaataccaaattaagggtgagaaaaaaattcatctaaaagatcatacttacctaataagatcacaatagtgtaaatcataaggcttcaagttaaaactattaaataagtacctacaattgtataattaattttttttaggaaaataattaaacaacctttaaatagtacattcataatataaacacatttaagaaaattttctaataagaaatcaaacattataatttaatttttgcaaagtgtaaatcaaatgggtacaaaaatgttttatgcaattctatagaataaataattgaaaaaaaatgaaacacaattttgtgttgcttttgacaattaatataaaaccaaaaaagtaaagttttgattactaatgtaataaagcataattattataataatgttgtgatggggataaaaagtaccaacctcagttgagactagcttgattgtaaaccagataacatataaaaaatcaaagaaaagattttaacatataactgaataagattaaccaaaagaacacttggcctgatgtttaaatgaaagatgtgcaacaggaaaacaacttcaaacaattgaaaaaaaaaacacacaaaagaaactgatttgggaaaggaattggcatcccaaaaagaatttgatttgtggaaaaaggattcgaaaaaaaaaaagtaaacatataacatgtagggagaaaaaattatatcttttactttgttagggtaggtgaagtttaaatatatcaaatgaatcctttcaaattctctcgagagttgaaaactctcatgactcttttatttaatgatagcattcaaattttgaaatgtcttaaaaagatacatgaagcccaccaattgaaaccaccattaactattggttaaaatgcttttaaaactattgacacacattaaaagttttttgttacaaaaagttaatataaatttgacattgctttaaattcattccaaaaacttattttgaattaatgagaaattgaaatattgtattaatttaaatggaaaaaggatgatggccaaaattagtttttcttctgaaactacccccatccttctcattttatcttccaaaactaccctcacccttctccttttatatatataaagatatagatgttatatcaaaaactgatccattagtctaaatagtaactagggaggtgtgaatagtaatgccttgtaaggttttgagacagttttgggcctggatccatgtattgggtccacaacacataataatcgcaactaccagtgattcgcatttataatcctgatttgtgcaatacgaagctaactaaatttttacttttgctgattttgatatttattctgatcaaccatttgggactcatataaatttcttgctcatcatcatcatcattaacttgtagacaatcttatgaatccaattctgaacagttcagcatgaataatcaaaatcaggttcttgactcccctttactaagaattgctgccggagttaaacttgggttcctcaaagcattattaataacagcttccgttgattttctttcatattgtggtcaggccatattcgactattgaccttgaatccttgaggtgatcattcttatacattaatttatgccttggtggttggttatacatgttatgcaagtttagtataattaattaagcacatgatttttaaatgacttatgagccatcttttacttcagaaaggactacaagggaacttcctcattaggttccttttcaaagaatttgtcaaactggaggcaagaatacacccactagggggtatgccaagtattgccaacatattcaaa

SEQ ID NO: 512 - DNA, 1700 bp, Glycine max
  Soy_ogl_6853 Gm20:38888701..38890400 Cluster 2
taagggaagaggatgttatatatataaattatcttattcttgattcttaagtgatgtaaactattttagtgtatcaaaataataacccccaagttaaggttaacgggcttcaaggccatcgatatgagattattttagtgtacgggaacaaaagtttaggtctctcattaaacttattgcacataatcacataaaataagatgtagagagtgtagagatggtgagtgtagaagaaaacctcaagcattgtacgcctgaaccgaggaaagctggtcacccacatgactaatgcaattaaactcgcaatcaccccagctacatttgatacatatgtcttgctccactccattgggacatcatcaaaatgcttatatagtcacaagattaacgctatgtctatattcatgtgcctttttatattgaatgtgtgtctacaatctccatgcgtggatacacatcttcctatatatggaaagagatagatgagataactatatgatacgttatgatattatctatttaggtctaatatatttttacggattgtctagggtttataattcaatttctgatgagaaaattagcggttatcactagaaaataaggaagttcacattaaggtaaccttatcttggttaagtaattttctaagaatgataacgtctcagacaagtagagatcacttttttaatccaaagatgattcaatatgaattaaaatcagtgatgaatccatcccatctttagaaatttgaaattaaaaacaaaaacaaagaatcaatgtatcacatgtcagaaatattttttctttaaaaatacgtctaatataatttaagctgattaaataagattattaaaataaattaaaacacaaaaagtactttaatctttctcataagttaacaggaaaagcttctaaaacaaaattatcactataaattaaaattcatatattaaccattagttatatagtagtattggtataaactttatccgacaaaaatttaattattaatataaatattgtatatctatactaataattatactcccctccactactgtttctttttaactgttgtattttttttaaaaaaattgtttttatttatctatctttcacaaagcgcaataaatattaattagttatttatcaattatacttttacttatttcctaatctttaattaatttatatatgtatttattgtgagatgaaaagaaaataagataaaataaaaaacagataaataattatatgttggaatcaaagaagatttattatattttttaatttctacaaaataatcttaaaaaacagataacaaagaatgaaaggagtatatatattaaatttttataccaacatataattatttattagtatgatgtgttagacttagttaataatatcaacagatgaacttttgtcagacaaattaaaatatatactaaccgagacaactctatcaactaataattgctctatgattttttgttttgcggtggattaaagtgcttttattccatgcttatctaaattatgtatccttaaactttagtcattaaatgtgtggttaattgtttaagattgttagcggctcgaaactggtaattagcaaatactagtatactaattagatattatcaaaaaggagggacgaacttattcttcgcgataataaattcctagcctcatat

SEQ ID NO: 513 - DNA, 1700 bp, Glycine max
  Soy_ogl_6978 Gm20:44169601..44171300 Cluster 2
ggcctatttatattgttctttcataggttatgatagtgattattatataatgaaacatgagaaaccacctataagggtgaatcaagttacttgcgttattaatcaattatgaactaaatcatatgttttgtgactaaattaaagttgatgcggaaagacataaagtgagttagatagttaaaaaaaatattataagtttgatcttctatgttaacaaaaaaaaaaatcaaagttgacatgaggtttgagttttttattctttaatgtgttgagtcttgctagtctacatgtatgcatgatcaacattgttatttttcattcatatcataccatacctaatcacatgttaaaggttgattatttttcgatcatatcatattatgttggtgagctgagacctataattgttttctcaatacaaattttaggtaaaagtaaaataaattaaaaatgaaagtagagatttgggttgaattttttaattgattgagccgagagatctataaaacaagtacaattaggccatgattcgatgaattcataaatttataatagtttttttttacagaaaatttattttatgttagatagagttccttatattctttattattgagtttttaatcaaattacgatgtgcgaacgtttttcctaatactaaacttgcataaaatatgttttgcagattttttttttaaaaaaataagtattcacatattaaattatttttaaaaaaaaattgtaataatataatcattttgatgtaaaatttatcatttatccaaactcaacttatcactgaagaccgcagtgcatgtaacttggacattgaacctataaaaagccttctcctttacttcttttggtttcaattatctatgcttattttatgagtttatctctaaaatatactttatttagtaaagttttagatttttttgtttgatatcaaattcaaatgaaagatagtttagaaaaagtatttaatttttaattgaaaatacatgaaattaattaatttttttaataaatgtgaattttttttttttacaattgagatcgaatggaatatttttttatattttacaagcatgtgcatttataagatttaaaacacaatagttatattactgcatgtgtgaattgatgtgaagttattttaatttaaccaaataactcgagcaatattatctccgggtgaattaaataaaaaattagttatgcacttgtgtaggaataggaaatctgattcatggattggtgggtagcccacagccaaacccagatgaacggcccacgatagagttgttaaagaaaaacaaaaagtcttcaacaacgtacagaggcagaattgaacaaaaaaacgatcgatctgcagcagcagttgcatcaccaaccgctgaacttctttgtgggaatccatcagtatatatcattatcaatatttaatgatcctatgttggttgttcctcagtcgtaagacacagcatttttacgtaagatacattgcatatctccaaacggtccagttccctatattgagatgagtttatttgagaacaagttgacaacaaagaaatgcaacttgtgaggtgaaataattgattctcttatttatgaattccaaaaagtccaagattgtaactttgtaattgggaggacaagtcacggattgaaaggaaatggtagtattttactaa

SEQ ID NO: 514 - DNA, 1297 bp, Glycine max
  Soy_ogl_963 Gm03:39247601..39248897 Cluster 2
ttgcaggaaatggacatccacatttgaaactaaattaattttgaagacttcaattcgtagctatctgcttcttttggatttgaactaataattagatccttcggaagtttcaaagtgttgtcaatgagttgatttgttacataacggcctcggtctgtcgaacattctccaaggaaacatcatcttacgtccttgtaaattctttcaagtgtcctatcatttctagctattaaactttaaaggaaaatcagtaacatccgtgccattttggatggataaggtggatgacagatataaagaaagagaactagttaaaaacaacataatgctacaaagtgtgatttatgttttgttctttcaagcttttgaacattttttttactcttgttattttctatttatctaataaaactttttgagagtgtttttttttttaaaaaaaaaagtctattgttcattcattgtacgtacgagtggtttatgcaattgtttatcctatcccccttatatttccttgatttttggtttctttaaagctatctatatattaagagttagtttcggtgcagagctatttaaaattctataggtcaaggtaaaagaatactagttgttcagtagcctaaagaggttgtattagtgattatactgagggtctgtttgggtaattttaaaaaaaaaacactcttaagagaagaaaaatttgaatcttatttgaatgaatacgttaaatatatttaaatagttaaagaattattttatattcattttaaaagttaaaggattaatctaaatttaattaacatcgttttgtccatgtcactcaattttgttttctaggttaatgaatatcacacttacctgatggtaaatgttattttaaaccttataaataagataaataatcacattctttttaaaagataagataccattttaaaaaaaataaaataagatcaaggatcaaaagtaatatttaatcttattaaaagtagaaggaacaaagatgtttaagctcaggattggagtgatttttagttttgaaattttttaaaaacaacaatcaatttttagttttagttttaaaaaaatcatcaggttttaaaatatagttagtttcagttttttttttttcaattttaacctaatttacaatcttgcttttttttttggcagcctaatcttcttgctattaggttgtgttcgtttcatagcaaagtaaatgaaactaagtaactccagcgagaaaaagggacgaaaatacagaggtaaaattggagttgtagatttggttaat

SEQ ID NO: 515 - DNA, 1537 bp, Glycine max
  Soy_ogl_5945 Gm18:5549957..5551493 Cluster 2
ttaaaatatcatctatataagataaattgtttaagacagaaaaaaaaacttagagcatctttgaaaattgtaaaacaaaattttttatattatcatctaaggtaagttgtttaagataaaacttagatgtggatattaatttatataagtatttttagtgtattttttttctatttctatttttttaatcataacattaatgttgagtatttatattaatctttgtttgattaattatctttaataatatttatccttctaattatttattttttcattcaagactccaccctgatatcttgcttaaatagatcgaacataatttttcttacaccatgttacttccttaagtaattcatgttgatatttaatggaaaattttattatattaattagtgggataaaactattctattcaaagagcaacactaaaataccaataaaatgaatctagattttgtctattttttttaacttttacaataatatttttaattattagttaacagttgataataataatagtaaaactatataaatttccaaacaaatgttctaacagatctagatggtagtgggggccattgtatgtacaatatggattggtccccaacccttctcttccaaggtgttcaaaaaaatcaaaagggatggtgaagaaatgaacaaatcagatgctatatatcatatcaacgccgccccatgtcatgtctttggatatgcatgcaccttcttagttaaggcatatggatatgtgaaaaagaattttgctgcgaaaaaatgacctcttgaagaattttacgctatatgtaggggtgaagttaacgtttgagaaccaagttacggccaaaaaatgcatcgcagtgtactactgcatgacattattatgtttgtctgtataatccagtgcttttctgtctgattaatttttatttaagtaaaaagcaccaatgtttttttttctttttttgtcagaaagaatctatgtttataaacttgttaaattaaccagctggaagaactaggaaggagggtgctttgttcaactggccggttctactcatttttaatcctgtggaactaggtttttaaacagtggttaaattggttgcttatgatttgtctacatttgtataggaatctagagtttgctatattatatatattacttctgttcctcactgttggtctgttggtgttggataagggtaaatgggaaggtgtgttcatacaacaattagaaattaaattattaacagatagttgattctggacttatggaggagtaaaagtgtatattagttattcttattctgcacaatgatacaattgcatgtatatatactagtatattataagtttataacacatttaattttgataaatcgcttattctaggctgacttggtgaaaggaggtgttgaaaagtctcacgtcatctttcctgttttttagagtccaacttatatataggttagacaacgtaacttttgaactagttgatttgattttaagatataatgtgtttggtagagtg

SEQ ID NO: 516 - DNA, 1600 bp, Glycine max
  Soy_ogl_244 Gm01:50317201..50318800 Cluster 2
ttaacgtagctcttaagggttataaagttaacctgatagaaaaagtaaaaaaaaaaattatagatttgaatctcttcactaataaaaaaatcaaagattaatcattaatatttgtttgataaaaaaaattaaaataagtgtgcgttggaaatagatcaaatctgaactatatataaaaaagtactggatgtaattaataatattttacaaatgacttttgaactaataataacggtaactaatttcctagtgttaaagaaacgaatccgaacaagattggctgcacatcttcgtttttgatgtgatatggacaacggaggttgttcttctctagtctagtaactagaagaaaaagaagaagaagtagaccatgcttaataaatccgtacagtgtcgttattgcacgcgcgtttgtcctttcctagcaaaaggaatataaatgtcacagcaaatataagcattttatttccttgagattctctttggtggtaagccagccacacgtggtttcgccctatctcatatcagtatcaattttgatgatattatttccctcgtattgatcaatgctggccccctctgcccacgactctgcgtgttgatcagggaacgaagcaagcaccaaccctctctaatccaacggagagaaacgcttgcattgcaatatctcttgttaataatattgtatatcgaccttgaaatttctgcatctaataactaaaattaattaaccaccggaaatatgtaatgaaacataatcataaaaatcactgtagttgcatgtctcccatgtccctagactctagggacatcattatactagtagtagttactattatgcctaattatgcagtgtatgtagtcaaggcagaatttggatgtttgtttagatcctaaaccttaattaggagagaaaatgaccctacgcgcacgactgtttgaattagactgactacttcagttaatgagattattggtatctgcgcaattctaagctctcactacctatttatgcatgttttgttacgggagatgataaacgtacatccatgtcttgcgctttatttgttagcgatcgtcgaacggagttatttttgccaagatagaaacgagggatgcttttttttttcggaatgaattgagaggtaaatatcattaaagtaagttttatttctttccacaaatttttcttcatacacataataaaagaagtaaatttttgtcaacatacttaaaaaaaactcatttatctaccaactaagttgaaccttgttgagtgaaggatggttgtttggtattagtgcatttgcctgagaaataaatttgaataaggtgaatggcatgaggcagtttttcagtcatcaaatgagcggatagaaaagaaggaaagttgagttttaatgtcattttataactatattaaattctctcttctcattcgaaaaaaaaaaacaaaaataaattataaatatgataagtaatgtgatcaaaaaataaggtaaaaatgttagtatgttaaatatttttcttttgttattgtgttagggaaattttatttcaacaaaaatgaaattaatttttaaaaagtttatcataaagt

SEQ ID NO: 517 - DNA, 1483 bp, Glycine max
  Soy_ogl_4514 Gm13:37275801..37277283 Cluster 2
attgcttcagttatgaaaaagaaaattgaaccaaatcttaataacagaatttgaccttgatggatttttctttatttttttaaaattgatttagtgatttaaaatgacttgaaataaagggagagactaaataggagtgattattcggaaagtaatcattaatgtagaaaaagctaaaataatagtagccaccattaatttaatatgaatattcgccttaagacgaaactgataacttttcttttttgttgtaatacggaacggagaactaaagcagttagagtgtgtacgtgcgtgataaggagaaaccatgctgaacgagaggttgaattatttattaattattaacataggttgcatttgaagtaatacgtatgaaaaagacattttcctacccccactattacatttttttaataagaggccgagaatcatgtgattcttgaaatacttatataatttagtttattcaaaagatatagtacaactttttgagttattaattaatttcggagtcatgcacagagagagatgaatatttcagtattatattcacttatatgacttgaaattttaataattttgttgccttttttcccaccaacactcgtaaattaagatctagaaattaaattgaaggtttctttttttttcaaaatttgaaacaaagatataaatataaacaaaaatcttttcaaatttttaaaacttcaacattcttttgttttcttcccacgagatgattctctagggcattgattagatgtggtatttccaagtgaaactttatttttaacttcccatgaggtaatatttcataaaccaaacaaagacaaagcatcgtgcaacgtcgtagctcgtgcctttgctacgatactgttaatgctaaatatatgccccacagaaaatgagataaggtatgcattgttcgtagctaacattagtagtgttgctcatgaaaaattaatagtgccaatagctgtgcctaataagtacgattccgggactgagagtgacattctatttatataatattttaacggtatattgtatatattaaattctatggtacgagaagcgtttcgaatatattaatcacaaatttaatagtggctatagcactgcataatttattttttttggaaaacattgcagtactgtaacacttaccttagccagaatattgctttagattttagaagtacgcgttagacaagtggaagcttcactgcaacttcctccattttgcttctattattgtgcgtgtgttgtaacagcttcttcgaatccatgtgtcctaaatcgttttaaatacagaaaaatgtttgatgagtagatatctaatatactattcaacacgcagagcgagaaaaataaaaatataatataatttataatatgataagaagaaagaaatatgaaaaaattagaaatattgatatgatgtttactataaatagtaattgatattttgtccgttttc

SEQ ID NO: 518 - DNA, 1300 bp, Glycine max
  Soy_ogl_4645 Gm14:4250001..4251300 Cluster 2
gcacaatgctttactgggcccatatatatggatcatactccttccagaccaaccttcgtttattgtagaattcatttatctatctagattcttctgtcttttattaatctatcaataacaatagtattttttttccaatcatgatttttgcagattaattaattaaaatccacaatcactaaaagaattatatgttcacaatttaaaattggattaattaacttctatatatattatagtcttttttatatgacttcaaaatatatagtctttgtttaataaaaattaaactgttaatatagagatttaagactttatattaacagaattgtacttgataaaaacagggaattctattagtacatgagtatatcctattaatacatcaaatattagtattatacatcatattgttgatataaattcacaatgtatacttatatattaatgttttatgttttattaaccaataaaaataaaacttaaataactgtttttatctgagtaaattttttataataaacctgaactttaagatataaaacagcaagatcacgagggtacgtagttttctatgatggatttctttttaatcgaagtttccctattgtcccaaagggaagacatccattacttatttcatcttgaaggtctattacggttcagattcaattgaaatccgatgctagaattcatggagagagagaaacaaaaaggacaatttgtgattttaaggcatttataattaccccttaaaaaatttgacttaccacttttaataggatttctccttcaaattttttatttctattcacaaaattcaaaccctaaaactttacatatataagagatttaagttcaatttaacctagactaactatatcttatataattaattttaacttagttatataaaagttgcattatcatctaataataaattgtcatacataataaaatattgaactttaaataatcattttaaaatcatatttaaggtgaattcaaattagttaactaacaatgtacaatttttccacccatgggactgttctctgtataatgttgtgattgaatttgccactccttgtgaaaattgggtcttcttaatctataataataataattgctttgctgtgaaaaaaaaccaatgtacaaattttatattaccaatatgcctgaaagttaaagtctttatcatgcatgattaatatttgttatgcaattatttaattaaaatataaaacacattatgtttatgcattaattgaatgagaaatatagctaaatatcagcctca

SEQ ID NO: 519 - DNA, 1617 bp, Glycine max
  Soy_ogl_1079 Gm03:44051584..44053200 Cluster 2
ccaaaacctaaattgactcctatgcacactaattcagtttctgtcagtgttaatttaatctttttaagttcattaataaaactatatacttataacttagttcattataaaactaataacaattttaagttgtatttggtccgtattaaaaaaaatatttggtatcagaaaatattttttattttattgttaattataaaatacgtgtttattttattttaaaataatgtataagaaacagtaaaaaactgtattgtttttatataaaaaaattaaaacaaaaaattaaatataaattatgtgatatttttataataaaaaaaatcgtacttcttatttagttttttttttattgttcaacaatactatatactcacttaaaaataacaatactactccatatagtaagaattatatattgaaaaaactaatatattacaaaattccacgcccagtgttacgctgttgtaatttttaggacataataatcgtcaaaaagaacttcatgataatgcaacaaaaaacgatcttatccatactaacaaattataattccgacactaaaagaaacaaaagaatcggttgacatctaatctaatttaaccacgttaatcttatgcaattattttgccatatggtctctattgaacgtgtggctttttgtttattccattcatttttttcctttcagaccaaaaaatttgagggagcctcgctcgaaatcgttgtttcagaccaaattttccttagtcccctcccctccttcttcaagagcaggaagcatcacactccttcaagttatgcctaacttattcgtctcgtgtgcttctcctaggcaagaataccacacacctgataacacatgatgacaaaaaaaaaaaagacacgtgtctctttcaccatgcagattttttttatattttaattaataattaataatttaataacaaaaacacttgttcagacacagattgccaagtagcagtagcaggtttattcagagttatgacagttcgtgagttttccagacagatcgatgggaccagcttgagttgttgtgctactataatttaatttctgactttgactaatccatttaatttatcttatttgtgtactgtgaatgtattttcttattttaagttttgatattttggtcacgtaacagaataagttaaccatgcatattatgaattttccccaagtcaatttcaaatttgctcagactaatttattagttagtcaaaatagtttataaattatcaaataacctttgaattttgtatttttaggagtggacttatatgtacataagactgatttgaagcttgaaaaaaagagaaaaaaaattgtgaattcaaatctttctattaatattttttttattaaaaacaacaacaatgagaactaactaattaaaaaaaagcttatatttacatcaatttattttagactatttaataagtttttattaaataattttatcttaaaaatttatacaaatagttacgaaaccaaacgtaaaaaccagcattatataaattgtctatatatatacaaacagttatattaattttaaaaaatttaatatgtcgttggtatacattaaaattgaca

SEQ ID NO: 520 - DNA, 1600 bp, Glycine max
  Soy_ogl_3489 Gm10:40899501..40901100 Cluster 2
atgataagaatttggaagacgagagtcattatgttcatatagctagtccaatgaaaaagtatttaggaagacttcatctttttatttcaattgagaccaaaagaaatttttgctttgttgctttttgtacgaatgacattcttaaactattaccttaatcaccgtctatctctactttcaacctataccaaatcgttctatcaaaaaaaaaaaaaatcatataccaaatcgtattaaaattgtcgtagtcaaccaacacctattggataatgataaagttattgattctggtggtatttttactgaagtttggacaaatgcaggagataagtgaaagttattgaacgaaattttgaaatctaaaaaagagtttgataagtgaaagactttagatcctcacaagtgagatacttaatattctgtaaattacatcatcacattatgaaattataagaaagtacgattacgaataaattaagactagagataagaattgtaaaaaaaaaaacaaatatattttatcccagaaggtttataagagaagttatttgttatttatcttttaggaagattgatggaaagatattaaagtaaataaaagagacttacatgtaatctttatagacttggaaaaagcatgattaaatgtttaggagaagtttcatggaagactttgtaaaagaaaggtatttgtgtggtttatatatgaactatatacaaaatgattgatgaggtgacttctagtgtagaaatttagaagagacccaagaatttcctacaataataaattgaataggcttagctttgagtctttaattaattaatttagtcctatttttgctcctaaggagcatacaagagattgttcttaaataatgttgtttcctgaattcaattcaggtttcatattggtcaaaaaacaaaataattaaatgttatctaactttttatctattaactctttcaaatttttatttttagtctccaaatatattttttattagttttaatccctgaacttttcctctattaatacttttgattcctatcgataaataatactgttaattaattgatgagattatgttaattttattatattttattatgttttgtgacagttgttatgttcgagcggttaaaaattaaaaatactcagaaattactttattaagatgaatcaaacaatttctaagactaaacccctcaaaattgcttatgccttttttggttttacccctttcttctgtcaatcaatgcatactcaattcaaattcaaaaccagatcagatccaaaaaaaagaaagtagacacgaattctaatcaaaatcaaattcagttccaacaacacaaattcacacatttaaaacaatacaacaccataacttcgtgatgacaccaatcgttctgttcattgcaacacaaacgatagacaaaaattagaaaaggcaaaaacaatttttttgaagaattttagccgtgaaaaattgtttgattcattttaacaaaagacattttatatgacaatttttaaccatgaaaaaataaattgtcactaattgcgataaaattaacatcatctcatcaattaacggtgcta

SEQ ID NO: 521 - DNA, 1625 bp, Glycine max
  Soy_ogl_426 Gm02:6903176..6904800 Cluster 2
caacgtgagttacttacattccattaaggcattataagcatatatcgccaaaattttcacctagatgaatggccacatttctgcacctgcactcaagactagcagaaacttaactaacgacgacgaagaacctcttatggacgccatgctcccctattcgctgaacaacatccaacaatgaagaaccagtttctctctcacaaacacgaccaacattgttcggaaagaatgaacaacatttttttggaaattaaagcataagactgaaaccctaatggaggcctacaacaactttgtttgggaagaagattcaaccctaatgatgtacaccaaaacgacaccatattcattaaaagggcccttaatctttcattaaatattttttttatcaaaaattactacaactacgtcatccacaaccctcatgcttacatgtcactattaaccaaacacattagcacaaaataaactaccactaactatgaagactcaaagcaaaaccttttgtttttttatcataccaaaatttaaaaatttattaagtttaggtcaatataacataaatatctctaattaagaaacaaaatgtgataattaatcttttcataaaaatatatttaggagaatattttttacacaagtttaatttttacacaatgataatataaaagtatattatcaattaattataaattatcatgagtatgattttagaggaaaagtaatgtctaattcatttttttttactttctatccaactaaataagagggaaaaaatcaaaacaatatttcatttccttcttttcattttctatcttatcaaacaacttaaacaatattcttttttctatttttttctttctctttccttcaaatcactttcttctcttaatcggaaggggggttgtttgttatgtagaaactagaaaaaaaaacacgtattcagtttaatttaatggctcaatagtacaaaacagaaagtgaatattcaactcctctcgtattacgttgggtaatagtaatagtaatctataacaattgcgtaagttgaacatgagttttccaacccaaagatgcccaaagtacaattaagctagaataaagtcggtacaagattccatatagtataataatgcatggcattgctttcataaatcgtcacgataaaaatgagaaactatggaaaaataagacttaaaagacaaacaactagcatatcctttcatataaaaatataacatcaattattatacaagtagtttcttatactaataaactagttgttgtgccctttaaataaataatgtcaagcgccaccgtagaaaaatattgtccactattttgatgcacctactgctgccgacagtttcttgtggtccacattcgcatctttaagctgttagaacaacattatctgcaatattttgcattcattttagactcgttacaataagattagaaaaattaagctgggttataatatccatattgatcacaaaaagatctgattcatttaattatttatttcaagctaacccttttaaatataatctgtacacttttggacagattttaatatttttgggactagaacatttattccgacggactttaggattaattgc

SEQ ID NO: 522 - DNA, 1100 bp, Glycine max
  Soy_ogl_966 Gm03:39399801..39400900 Cluster 2
ttcaattttataataattattcaaaaatcatattatcaataacttctaaaaaaaataattctaactgaataacagtaatctaccgaacatgtttattaaactcaatgtattaatctcgtactcgcagtatcaacaaaatttaccaaaagcaacggttcatcaagacatcaattgatgaatagaaaaaaaatgcttttttttataaggtcgttacagagaaggtcttttggtttcggccgatagtacaaaaagactctttcaattaaaacatatccaaaaaaaattaatggacttttcaaatgggtccaacttagggtgccttaaagaaatctcatgcaaatgggcctgcgtcataattctccacaatgtcatgatttgtaaaagttgcgagaggagtggccacggtgttggaagaaccagtggtactagcatcaaacaaataagttattcattgtgagcttatgtgggttgaatacttgaattatataatttacgagattaaatggccattaatatattttattgcattcaaataatttctgataaggaaaaatatttcaatttgatatataatgacaatttttaaactataaaataaaatgatatactaacatgatttttcaagaaattaaatgacagtaacatattctttcaaacataatactctattattaattaaaatttattgagacttatgaaaaagaattgagtcccattaactattaattgaatctcactcataattttatatcttccaacagttttcaacaaatggaagagacataaaatatatatttgtaatatgtgagagaggatattactaatccttcttctccagtagaatatcatatcagcaatctaaagggttgagataatgatataaaattccgttgcaatcataagtgaaagatacccataatgtctcactcagaaaagaaaaaaaaacactttcgtgtcaacattttgagtacttcttgttcctagacacaatgtggacttcaaacataatactcttgtaagggtttaggcccaagacacaatgtggacttagttgttcgatttgacccgaacctaaatcatccatgcatgagggaggatct

SEQ ID NO: 523 - DNA, 1796 bp, Glycine max
  Soy_ogl_1101 Gm03:455175..45542300 Cluster 2
tatgatatgtaatttgagaaaaacataaatagcagtgtaatttaatcaatttaaattttttgagaatataataatcattcggtatagtatgttgttatgaagggccaaatagctctctattgagtctaattgtacgttccacttgcaattttaaattaataaaatttcctgttccttttaagaattcagtgcggagtaattaatgcaagagactacgagtcccttaggttattgagttttgactgaagaaattgacaaagttgtgacgaataagatgatgcaatgaagtggtacttaggaaaaaagatagacaatgttgagattgagaagaagagagggatgaggtgagagtggagttgtgtaagcaaatgatcatagaatcatagtataaagagaagagatggcgtgacgtgaggatacaatgcataatggaatggatatatatcaatatatgttatcacagtccaaacaaaatactctttctctgttctccaagcgccactcaaagtggaaatttgccttacaaagtggggggtcactggctgttgctggctcattttagttctgcatgtcgtttgctacaatacaatatatttgtgttggaaattgaagcctaagatcagagggagacaaaccaagccagtgctgcccacgtggaagaatccttaaaacccaagcaatgctagtgtgtactgacagatacacagatattttattttgattaattagcacatattatatcagtaacatatattattcaatgtatattaaaattaacagaaaaaaattaagtgtgaagttagatgaaggttgataaaattggagtgtgtttggatatgcatttgtgactttaaatttgagttttggatgggttgagcatgatttttcacgatttagaattttggacttaagttccattgaaataatttaaaataaattgtgtatcaacttgaatttgagtctttcaaacacatcatttatatttgataaagtaatcctttagaccaaaatgacacccaacacacctaaatcaaatatctcattccaccacatatccaaaccgtgtacccccttggtcgcatacatacatattttttataataagttttgcattaaagtgtcttttttagaatacaaaaacattcgccaaaagttctaacttaaatcctgacttgagcgttaaaatgttttttacatatatcccttgctttcagacttacacgcgccaccgccaaataattcaacaaagaactatcaaagaagatccttcggcacactaaaaaatctttcaacaatggaataagtgtttggtccactgtgacagaaacaccttgatatgcaacaaggttgtggatattaaaatccattttaataattatatatatctaaaatcaattttgaatgcaagtttttaaacaatttagtatgataaaattatttttttaatatatgtttccaaacaaaaaccacattacaacgtactctcgtttatttaaaatcggttttgtaaaatcagttgattcaaaattaattctacaaactcgtattcaaacatacattaattttgaataaaattatttttaaaatgatataatttatgtttaaaaaaatgtattctaaaaagaagtttggagaaaaatttagaatactttttatattcaacataaaaattatttaaaattattttaactcataattaatctggatttagaaataattttttaacatgagattaaatataacattaatctaaattacactagccgaccttttaacttgattttagaaaatttgta

SEQ ID NO: 524 - DNA, 1500 bp, Glycine max
  Soy_ogl_1220 Gm04:4398301..4399800 Cluster 2
caaatccaagtcactgatgcgcggtaaagtaagcaattattgttgtggggtgttaagttaagatgctgattattcacagccgcacaggacaggacactggttaatagccagccatatatgggttccttgtacttaacaagcaacaaagttttctgcatggtataacactatttacattgtactgttcttatatgatttttggtttatagtaataacttgactgctattacttttaatttgacaatcttttctttttattttaaaatttttacaattaaaaaaatgataacatattttagaagtcactttaatggtacaacttacaaaaatgattaaaagaataaatactctattattgacaagacactatatatcatcaaaacacaaattattacatataataaaattttaaaatttaataacaattactttaaagataatttcaatatatagaaattaaattctaatcaaaatgcatctaattatgaaatacatatgttttattttatataacttaaataaatttttcccttgattctaaataatattccaaatgaaacttgaaaatcattctacatttctttcttttagtttttttttttgtgcgactgttattaaaacataaacattaattatgtggttgttaaataatacctttgtccctttatataggaatattttgaaaattttgtttgtcattttttataaaactattttgaaatggtctcttgcattgtattttttttcttagccagtaatttttttgaatggcaatgttttagccaatctctttctctcttcttgaggatggggaaagatgactagctacacattagttactaattatttaagtgaaaagcaacttaacgaaaagagtgggatgaggaatcttaatgattttaagggttatttttttaaaaataacacaaattattaagaattttaacgtcaataattaaattaactcactttttaatttatgtgaattagttaaaaagctcttgtaatttttatttatgatctttatgtgtgctaattattagctacacttttaggatttgttcaacaaatataagtcgtaaactattaaattatttttactaaaaattaaacaagagaatattaacagtttagaatagtttagaaaacttaaaatagaaaataaaattatacgtagagatagttaaaataaatttacttaacttgaccgcatattttaattacaaaatcaatattacttcgttttacctacacactttgtgggtgtcctagctaaaataaattaataagagtcctaaaaacccatgtgcagagcaattctcgagtaattatagagccgttggatcatgatcgataacgaaaattttattctgaagagaaattatgtgcacataattttttgaacaatgaaatatacaatagaagaggcaataaaaagataaagtacataaaatgtgggataaaataatatggtagagagaaaaatattagccctgtaag

SEQ ID NO: 525 - DNA, 1680 bp, Glycine max
  Soy_ogl_4383 Gm13:31242101..31243780 Cluster 2
caccaccacacacactacacaaaagtataagttttaaccacgtgtaaatttgaagtggtcctgcatccttgcaaaacaatctgactcagttgagtggtcctacacactttcaaaatttaattagctatctaccatatagataaatattaaattttatgtataccggttttacacactttaaaaaataattataattaaaattctttgacttcagacgagactcaaatgtattctcacatattttagttcttgatttgaattaagtttaatcatatttaaaattcattatgttttttgaaatatattatgcacaaatcaaattcagcttctcctccgtaaattcattgtgcattgttaatttaactgagtaatttaaaaaatatatataatgcaaagaagataatgaaagaaagacgtgaaacaaactttttttccgttaaagaaaataacactagtcttgatatgtgctgatgtgcacagtgcaactaatcgtttggggaacctgcctctttgaaacgctgatgtgcatatttgctagctttagaatgccccattcttctgaaatggaaattttaaaggacacgagatcaaattcataacaaaagtgtgtattaacgttacctttgatgttttgtttttctgcagcatttagcaaacaaataaatcctattccgagttgcacgagacaacgtcaagatggcagagccagagagtacgtggttagatggttaatctagttcttgaaattctgatttcatgtaacttaattggatgttttagtggaatttttaaaagaaaattctgaagctgtaatcgacaatttcattcaaatttataaatttaaccacttattgtttctctcttcttcttctttttttcttttctgaatatatgttaacgtgattactcttaagtcacacattacctataaatttagattgatatgagtgacaaataacaattttgattatttttataaaaatatatcaattttaaatattacagcgatggtgaatcacaattctaataactaaattactatttaccttcatggttatgctttgtgtgtgtgtttatttattttttgtttgtagtgtaacgcccataatttatttgtcacttccttgcaattattttttaaaaaaatattataatttttttgggcatcccaaaattttcttgtttatatagtattaagatcaatgactgatttatattttaaattaataaagattggcagggaaaaaaaatcttacttttaaaagtaaacagactaaaacaaaaaaacaatttcaataatcaatgactgatttaatataggactgcaaatttgggtgagcctggtgcattcggactacactgatttgaatcaatatattttcaagttaagttggatgagatcaatttctacgtgatttataaatttattagtctaaccttatgtatgttatggactaaatgggtcattttatccgtgcatttttctaaaaaaatgtattttgaccatatacttttatttaaaaagaaggttaattgtaatttttgtatctctttaattcttgatacacaatttggatggtcatattttcccgatttaagtttcatatttaaaataattcatatgtttcgtttcttttatataatacaattgaattctaaatctaataaattcatttaagg

SEQ ID NO: 526 - DNA, 2190 bp, Glycine max
  Soy_ogl_1448 Gm04:432108..46861297 Cluster 2
gggaccctgatttaatcaacccctttgataaaaaaataaggggtccgtccgttttaggttgtgtgaattggctcgatcgttgtgatccccttctccctttaagggatgaaagaaaaaaattgggggggggggggggggttgcgggatatgaggaaatgcaatgatgaaaacaatgatttggttttaatagaaagttaaagtaacgcgcagagagagaaagagaagtggatggggtctggtggtcatggtcatttctggaacacagctgtagttgttggggtgagggtttaaagctgaccatcctcttaaaacgtgtctgtttcatttgtctacgatttaggagagagagagagagcaagagaatcatgcgatggaagcagtaggacaatgaatggagtcgattctttctgctttgtaccataatattttatgcttggtcgttaacctaactcatttttttatactgattaacctaactcatttggctcacttatttactgtacgtgtgacttttattatcttgtggaaaataatcattttacaaccaagatggtttatataatgttgaggaaacaaaaaaatggttcaaacaataatgttttggaaaatttagcacatgttttatgtacttatgttagaaaaatttatgcagactcatcaaatttttagacaatatcaaatcaatatagtttgcatgtcattgaatgataatatatatgtatagatattttcttttagttgagttaatagaatcaatactttttatatatactatagaaattattttagttctagtaacttttgtcagtaaaaaaaaaatgtatgaatgcaactgatatacttagttatacattaggaagtctcactttgataccattaattcgattgattttcaggctcaaaatattacctggcaagttgacaactttacttatattacaataaaaaaagaagtggcgtgtactacagattgctactaattaaaattagtgcatttttagttaattatgattaaacaatattactctcgaaacattaatgctaataaattaataaagactgcagactagtggataaaacgtgcaggtacctttatcaatcacccaaataacccataaaaagttggtttaggcattactttttggagtaaagtaatatatatgcttgttgatataggtttttttttctatattataaatttattaaatcacaaaaatgttttgcataatataataatatgtacattctcttatcggtgaaaatattagaagataatatcagataatttacaataaatactttaatagttactttcctttaaaaaatctatatatagatttgtttctttaatttgaatagtttttcaataaattttcgtttataaaaggatataataaatctacgcgcccttgatttctttcaaagccaccttccatgaagctttgcctggattgacaactaatgatgggaaactttaaactccgattccataggttcctgactaacagtaccaagtgagatggattaagctgtttatttagattacacatgcattcgtagagttattaatttggcaaaaagtagtcaacagattgttgtctgatttgaggttcaacctagctataagcctttgatatgcgtgcgtcaatcccacctttgtcctctagcaattcgttcatagcctccacccgcatttcatgtcgggaatactaaatgagaggttatgatacaatatgcatgcgcatgcggatgcatatacagtagtgagtggactcttaatttggaatgaaagcagccatgatacagcttgctcatccttacaaggttatgttatgcatgtctgtatggcaaatgatacagaattttagtatttgagcaactcgttattttcttctgtactaacttgcttctaatcatcttctcttcttaagtttgtttccaggtgaggacttctttgatatcttcttgtttctcttggatttaaaaagagagagaaaagagggagcaattaactgatctatctttatggttcaaacttttataatattaaattaaattaaaaacatattaatagcatactctaccatactattctcaaaattaaacattattttattaatagcatactctaccatatgcatactattttatgagataagttttctccttctttaagcaataaagtactga

SEQ ID NO: 527 - DNA, 2100 bp, Glycine max
  Soy_ogl_3693 Gm11:2495601..2497700 Cluster 2
tgtcttaaagcacaactggatgcacgacttacatcttcaacccaaatatctgaaaattacatctctcctactacatatatatatattcacgttcgtcaacaaatttcaactgcataatacaacatataaggcatctcacttactataaaggggtgaagatggattaattagattaatattgtggcaagtcttatctcatctaattctcaaattaaaagaattgagtttgatctatttatttgttgatatacaaaccactatttcaaatttgtttgtctatcctgaaaacttatttaaaattctaatttataaaaaaaattaccaaataaagtttcaaacaattttaaacatagattaatgaatctgtacttgtatatagactaataaatttaagtctttaaatagactagcaaatatataatatcaaaatattgtaataaaaattaatatagtcataataatattactatgttatttatatttattcaaatgagttgatttgttaggtctaaaagttttttttataaattgaccaaaatctaacttttaattaaatatataacttttaaaaaaaattgatttaattcatttaacaaataactctaacttatctgagtcttattaatgtaagttaacttataggattttcacaagcggtccaaaatatccccatcctattttctattccagatagaattaaatagttttaggtggccatatattcttcaggaaagttctatttcaacaactttattttctgtaactatttttataatgaagagaaataaaggataaaatatgtaaaataaaatgagcaatgtgataaaaaaaaagagattaaaaaattatacaaatagtttaaaaaatatgaaaataatataattgtaatttttatggtaggattatatgatacattccattacaataaaacgaattggccacacagtttggcgaattatataaaaaaattaaaactaaaaaccttgtcagattaattctgcaaaaaaaaaatgaaatcatgcgaatcaaaaataggtaaaatcgtgaaatcgattcgtttttatacgagtataatctcatttatctatttgtttatacgagtataaataaaaaatttaaatgtattaaaatagtaataaagttggaatatttgcaaaaaaattactttcaagcttttaattgattatatttaattatatgctctatggtcacttttgaattattcgatcttatgaaatgagtgatggaatcttttgaatcttaaaattctttttggataagacaggtcaagttaaatggataaggatacaacttttattgtgtagagatcaatcataattaagtgaagggttaattcttatgttgtaaaaacatctttttattaactaaaacaccaaatttcattactgaaaacatgaaaaggattcaaattcataaataaatatcaatgagttgctatatgttcgaaagtagaattttattaccaataatcttatttgaaggaaatagatttggttcatacatgttggtctgtatccaaaaaaccatgtcaattattttaaactatacatatttaatttttttaaaagcgaaatctcgttttagataaagaattagtactatcatattttggatattgtcaatttaaatagggttatttctgatataaaaacattattccctatgaaaaatgcttgtaatcctgaataaagattataaataaattatcattaaaaaatattttataaacttcaatttttttttgtcaaacttacgtttttagatgtagcttttgtaagtttattttttttattaatttttcaaatttatgtaaattttatttttaatatctacattaaactcagccattaattttgtatataacaattttttttatattctttattttatgctcgtgacggtaacattgtttttgctgttttttctttatttgtttctttacaataggcagcaatgacaattgaacatatattattaggtactgttattgggcgaacaattccttatagcgacggagcttgataataatcttggaagttaactatgaccttgaaatcatgttacgtactcctaaagtgc

SEQ ID NO: 528 - DNA, 1435 bp, Glycine max
  Soy_ogl_6944 Gm20:43169666..43171100 Cluster 2
cacatattataaaacttggggggtcattgcccctgtcaatccccctccctctgcctctactcaatactaaaggatatttatcacaattcaaatacattattcaatcaattaatctagtctcttttctagttttcttattgcaacttcaactacattgaagaattatagtttacatcattgaagttgcaataagaaaaactatagtttacgtcattgaagattatagtttttatcaattttttaaaggattgtaactcttttatatatatttgtttgcattgtatataaatactttcatttattttttttactaatttaatttgtagggcatataatttgtgtgtcaattacttttaatgccaagcatgaattaaatttaaggttgaattactcatttaatttttatatttgcacaaattttactttttaattcttatacttaaaaatcataaattttaattcctacacatacaatttttcatatcttttagttcttatacatatcattttaatctctttcggtccttttttttcaaactcgatcataaggattaatagggataatttttaagtatatggactaaaagataaaatttgtacaactatacttaagatagtgtaataatattcaatcaaacaagctagatttaaaaggtaaaaacatacttaagatgctaatttatacaagaacatttatcaaaatttgtattatttgcaatgtagatttagatacaagtaagtctaatgttttaaggtgatttgctaaagtttgctgattaagtgttattcacttattcggaaattacggtatgattattaagataattattattaaaattaataaatttattatatttattaataatttgttgttgaaccacaatatgaaattattctgtctctctttgtatatatgttttagttttgggaggttaaaatttaaaagcattaagttaatttattatttgatttcacaaaatgcactctaaattttgtttaaaatatagcattgtaaactttcaaaattttattcataaccatgatgtttatcttaattattttttaataatatataaaatttcttaatttttaagaaaaaaatatattataaatcttttcaaaataggattgatgtacgtagttcttgttaatttgacagtcatatcaactcgggagtcaggataaagaaccctcccttatgcttcagttttgttaacttgatggcaaatagatgttgtacaaaccatgctgtccaaggtatcatgcatgcctcatgaattacaattcaaccatatattttgcttctgtatgataagaaaaacttttaaacataactctttcgaggaatttaacaaatgcggtctttgtatggattattctttaatttggttctgtttcttgtatccctaactatagaggttatatccactccttc

SEQ ID NO: 529 - DNA, 2496 bp, Glycine max
  Soy_ogl_1251 Gm04:6247501..6249996 Cluster 2
aaaatgtattacatgtatagtgaaaaatcaaactaattattaattaaataactttgcgtggtttaaaatgataaatgtgtacatctgtaaggaaacaactgaatatttctgccggttaattgccagtatttataaaaaaaaaaaaaactgaggccatgatattttctgacgacccgtcaattttacatttatcagtgatagtaaaaatagagtaaaccacatgtctctttctgactataattttttttatcttcttcaattgggcatgaatattttataataaatgagaatggccttcctcagccatttaatttatttattttttaataaaaatagacagtgacatttctcaattctcacatcacagtgtttataaacgacaaagtttaaggggaaaaaaaaacatggaaaagtatatgcgaggccaacaacatttatacggtgatactgccaaatgcaatgccgccacgcccctccggcattgccgcgtgaccgcccacattatacaaactccagttgggatcggcccaagcaatacgttaaaaaccctaaagaaaaatagcatgtaatcggaaggggaaaataaaatggcaatactatgtcattagtaaaagttgactgaatttagcaagaattttaaaattttatttccttatgggttactcaaatatttgtagcaatgttaataaaaatacatcttattagtctctttaaaaaattaccaacattatgttggttaaagtgaactagaaaaaacacgtaattttaaggaaagatcatatttaagataatcagtgagaatcttcaacaaaattataattataaaaaatgttgatgaatattttttatttgatgatatgatacaaaaaaatattaaaataaatttaagttttaatcaacattagttttgatattagtagtcttaattttttttccctaaattggagttacggaaagaaatactaatataaaagaaattaatgacctattcaaagtattaaagtatatttaaaaattatttttttttaatgcgtgtaatgtttgtaaaatattattgctaatacttgcattttgagataaattttgttgtatggtggtaattgaatatattgccatcgactgttaaattgcttgattattaaactttaaaaaactaactcgcagttaaaaattataattaaaatataaattaataaattatattatgatcccttagtttttttataattgttatcttaggttattttgcacataaaaaaattaataaataaatgaaaaaaaaatgataatgttataaaattaatcttgttatcattaattcatttgtaatttttgtagtccatatcatttatattataaagggtataaatgaacaaaaataattaataatacattataaaactaaaatgacttgggataaattttttcgattattaattatgagatagaggaagtaatgacaaaatcataatggcatgggaaagttccccttagagtgggaaagttgacttcactgttaattaaaagttctaattcttaagaactatgaatcgattccccaagaagttaaaattaattttataaaaaaaaggagtatttatctctaaaagaaatgacaagcccccttgtgcattcacccttgaaggtggtgcgtgccgctacgtttacaatgaatctcaatgagcaaaaaggagataaaggtgtttgagagaagcaaagagggggaagacatctagaaacatattgttttttgtatccctttagaagactctagaagagaataagaaatgggcaagaagcaagtggtgaatttggacgatcagagaattatgaagttgcaggaaatctttcacacgtttgattggaacaatcatgaaagtctcacaattgttaggtctgaagtacaataacatacttgttgaatttttcatgttaaccgtgcttgtggcatcaaagttttttttttcttattaatattaattgttagtttttgttaatagtgagtggaatgatttgaacttacaatctttctcactttttccttcaactcttaaatctctctttccgaccaacaagttaattttataactccttttctaagtttctataaccaaagttgccttacacaagcatttacaagttagcaatggatgtggttgagaaagcatgttgccatgtttgtgtgagaaataaacatataaaaagacaaaacatgaaatcactaaaagtgggatggtaggctaagtagtttctaaattgaaaaaaaaaaatacttcaagtaaataagtgagtttaaaaaatgaaaaaagtcagtaccttataagttacaagttaataaaagtagattatgaaaataagttaaaaactactaaaattaacttatgtactaaattgctagcttattttgatcaaattatcttattaaccggaaaaactaataagctattagtatatacatatagcttatcaaacaaagggttaaatgctttccccata

SEQ ID NO: 530 - DNA, 1943 bp, Glycine max
  Soy_ogl_2265 Gm07:7918758..7920700 Cluster 2
taataattctaaatcattctaaataattgattaatgttaatctataaatattcttacacaatcatcattattcctaaaatattccattttttagtgggcaagatagatgttcttaaggcagttcttgattgtcaaagttatttgagtgttatgacgtgagataaaatagagcaagttaatgtactctccataataattgttcttgagttgatattgcttttggttaagcaatgttaatttattaattgaaaaacaaatgttattttcataacagttgtcttcaaggtaatattgttttgcttaagcaataccaacttaagttgaagcttccatatataacacatacaatataaacatttatttgatacttcttattttttttcttattattatatcatatcacctattaattaaactacatttatttttcttttgtttcttttttgaattgccttctagtatgggcgtgaaagatgaaacaaccttagacactcggaagtagaagtagaagtagctagataaaagagacatatagatatagtaagtgacataatatgataagaaaaaaaagaagcctcaatgagtatttacactgtgtgggtcttatgtctaccaaacttggacttgtaggttgtaacttaataattaagatcataagcaaaagctatgtctgacatatttgcaagacatggttttgaagatgagctatcttatagttctacgtgcgtttcttttcctccatacatagttgggcaaaatagtaacgatcctagtgtaaagacgcaaattaaagtcatcgtcagtggtcatgcattccttcgtcaaaactaatggcaaatggtcctagagaaagatatataacactgatcaatcatatggttattacaataaatctcttttggaccacgtttattaaaggcagtaaataaacaaatacaaaatgtatggtatagattgaagagcatgtgcaccagcatcctgtatacctgcacagtacaatatgaaagctgagtaggggttaattttctatggcgtcacgtgcgatttggaccatatatatgtaagtccttcgacccttaatgtcatctctggttgacagtttgggctcatgcatgtaccagctaataataatgaaatagttgtctagacttagacttgatcactacaatattcctaaccctgaaaataattagagggtgggatgtgataagaaaaaaacgttgatacttgtcatgtcatatctatatcaaacaaaaatgtatggtaaacactttaactactcttagttatattttatagcaacttctatttttcaaatttttatttgaataaaatatcacaataatcagatagttatagtattttattttttattctcatttttttaaaacatgatttctttctctcttaatttaatatttataaattttataatgtactataataaattcatatcttataattttaatgtgtagtattctattgatcatgtcatatgatatttgggcttcacgttttctttttttttttggtatactttataagaatgtgattgttttgattaaatatgttgttgtttaagtattgtaacacagcttgcattgtttgtactttgacaacgaaatgcatgattaccttcaataagattatataaatttctagctatatatcattccatgctaaaagaataaataagttactgacatggttggaataagctgataggatgtacattatataaactttacacgaagtctttaaaccagctacctacagggggctttgcttttgttttgtgatcctgcaacctttatgttactgttatgggtatttcttgtatcactatattaatacatattcatattttctgtagcaaaaaaaaaaaaaaaacgaagtctttaaacaaaatttgatcatatatgaaaagtacttttgaaagtttg

SEQ ID NO: 531 - DNA, 2392 bp, Glycine max
  Soy_ogl_2286 Gm07:8239201..8241592 Cluster 2
gaaaaaactcagctacttcatagtcaattctcatagttattacaatgcaagttgctcaaataaaaaatagaaatataagctccttatgctatatctcatctaaaaaattagacatttaagtcaagaaagatttcttcggcatgcaataaattacttaagtatatcatacccttgcttggttaaggaattcgcaataagagtgaatttttccaaccaaacttccctgcatgcacgaaagaatataattcatttgtaaaagcatctctataaaccacgtaaatcgataataccaaatttaatattaactaaagcaatatatatttctattgatataatctattttttagctgatcatgtactgtatttaatagtgataaatagggtacatgtaggaccattccaacaaaatccaaaattaatatatttgtagtttatggagcacatcacataacatgttccttcactgctaaactatcaataaatttaatatataaaatttacttaaacactgatgaaaaaaatatatgtatgaaagtataattaggcagcaatattaagtccaatatttattaagatatctttaacatgattagaaagaaagaattgtgtttaatgttatgtatatcatatcatatgagaagaaaaaggagcagtggtgctcctccatgcatggtagtgatgcgccgtcagcagcaacaaggtaacgagatgacagaatggagttcatagtgaatgcgccgtcagcagcaacaagggtaacgagaatgacaggaaatggaggttcataattgattgttcttttgtttgtagaaactctggagagacaaatttgcaactcttgctgtattgaagtaaagtgtgagctaaaaaaatagtatttctcccaaaagatatttctttctccattcattttcatactaaattcatctttcctttaatatttttcaaattttttcaattaattagtcgggctgttttgcaatttatcaaaattattccccttttttctttgatttatgtgataactgaagagacaaaaatttgggattgtttcttctatctacctctaaaatcgtggtgattgtttctcccaaaagatatattctttttcattcgatttttgtatatgatcattctcatttattatgtttaggataaactctgtatacaaagccaagattactactattaagagaaaaaatatgcaaccatttcaacgatgaatttttatgtgctattaatttaaagtgtgcatgtattttgatatgtgaatcatcatttttttcatcttttcacccatctatattaggactatgaggggagaaactacataaattagtaaaggtatattcaatatatcaatttaaatcttagctagtcattttttatatatgatttttttctttaagattctttctgtttctctctcttttgtccttgaaccctaattaaaaaaacgcctttaaaaattatacgaaacacttgggtattttacattgtgtcattgtaaatgttgttattttctttttctttttttttcaattcatgttgttttactaatatatatatacattaaaatatcaaattaaatcaacattatcacaattattttttcatgcaaaattaatatctaaaattaatttttaaaacaaataatttattatttattatttattatcttctaaattaaataaatcattcataattttcttacacttaggcaattattaattttctgatatacattgatatcccaacgtattaaaataaaaattatatataaattataacacgtggatgaatgttatttttcttataaaagagagtagaaatttctacctaatttacaaggaaaaacaatttaactgaagtcatattagtatataaattattattgctaaattattttttattatgattgttttaatttaaatataatttttatgaatgcctatttctttatttaaataattcattgaatgttttaatttaccatcttagaacgtataaaaaaatttaatagaggagatcaataattttcataaaaatataaagagaaatttaagtttagacttagcttatcatataaatatataaaatgtatcacatggataaacatttttattataaaaacaagttgaaaaatttacactaaactcatacggataaaaaatttaactaaatacttttgtacaatcaaagttaaatattcatttagataattaatatatatttaattaaaaaatcaaattaaattgacataatcattactattttttcatgaaaaattagtgccaaaatttaattttctaggaaagtaactattcatttctttatttattatgttctcacctaaataaattattcattattttcttataattgggaagat

SEQ ID NO: 532 - DNA, 2420 bp, Glycine max
  Soy_ogl_2406 Gm07:38058581..38061000 Cluster 2
caagaacaaacacacacgcatacacaataaaaacttagtataaatagccaagtctcatttatgcttttgtttgctgtttagtctcaactcatgtcttttcataatttatacaattagagtaaacgtgaaagaaatatatttatgttgttcaatgttttatgtcaaacctacccaataaatgatgttacacgtgtcagactttaggaactgtttaccaatttgttgtgttcctccttcatttattggattagctatcacaattgtgccgttgatcttcaacttgcatgtcacggcgattgctttggatcgatatacaacaacatgacaaggcacgaggaaagtcatcttatcttgtaaaattatttcgtgtcattatctctaagatactatatccatcatcattaattatggcttgttgtttatatttacttcataaataattatttttcattgataaatatgttcttaaaagttaaatatgttcttaaaagttaaatatcttatattaataaaatagtttaagtgacacaagtgaataaattaaaaaaaatagtaatattttcatttaataagaacatattaatattttctttaaccggatatatttattatactttttacatttttagagattaaattttatatttttattttttaaaaatatattacatatttaaaaataaaaataattatttatcttatttaatttaatttaataacaactctataacttaggttgatagtgtctccaaattcttcataacttaagtgtttaggcgtgtccatggaacaacaaataagaggaaaaaaaaatctatccactgtcgaaaaatctgactaacagtgaaatgtgttcttttaagcatattattttccatcaattagtaaagggaatcgagctaataccgcttagatcaactcacatttctaataaaactaattaactaacatttgtttgctcataaaaaaaagttttagttcaaattgaaaagtgcttgatattatttgttgaatatttactttgattaagtgaaaaaattataaactcaaaatataataagatatcactggactatggatatatttatatatcaccaattaaacatttatttatttaaattactaaattgtaatagttttctttaatatgatattgtttattttagtatttatcaatagtttattaatataatccgatagttcaaaaagtaacattttaatacataatcaatgtttttattttctgcaatgtagattatatttttctaattaatcgtttattatgatcatatagagtatatcattgcaatcactattttagttagtcaaaggcttgaacttaaaacctcattttgtccttttacctaaccctagtatcccacatgggaaaaaaaaacctcagctattaatgtttatcaattatcgggatcaaggttcatgcatgacaaaagagtcactttcacaaacaaaattatagtggagaatcttgcaaacaaaataatgaaggagcccacggtgatattcattcataattatggtgtgcattgtctgtttggtgaaatgcgtaggtgaaaatgatagaatctctctcactatctttacagctcctaaaccaggttcagcttatccaaccaactgcccataatttaaaatatatctgatacattaaaaacaacaaaaatatgttttcatctaagtagatgaaatccagtacatcattatattgattaaaattaaatcctcacaattaattattttctatgattttataaaaaatatccttaatgtctttcttgattttcctgtctcttttcacatatttgaaaacttaaaaaattatgaaatacgttcttttcttcgatgcctctaatggcattttttttacatgttcaaatcatcttaattttttttcatctttttttgacaggtgttacatcaatatagctttgtatataattattttgtatttgatattttcttttttttatgactatgtatacttatatacttttttctctgccagaaaatatagtttgttacctagtatagtagtatcataaaatttattatgtatatttgcgatcagaaataacatatctaatgtttttctttattttaatttcctaacgtgggcattgtgtgacatctttattaattttttttatttattttataattttgatttcaaatacttaacttagaaagatgtggtataacatcttcaatttttacctcttaaattattttacaatcatatctttttaatatcatctatatcttactcttgttcacgtgaaaatcttatgattctaatttctgcctcaaaaactcaaatgaaaagtcaacctaattagatttaaaaaaatcttaacaatattctcttatagctaggtagtaatgaatagtataaacaagcatat

SEQ ID NO: 533 - DNA, 2900 bp, Glycine max
  Soy_ogl_11 Gm08:11678701..11681600 Cluster 2
gaaaactaacttatttaaagtttataaagtcaaaaggttaatagcgttgtctttaaaaaaacaggaataaccaatagttgagaatcggtagtcaaacacaagctagggaattaaacatgacttgatttgaatgtctaaaattggaccatatctttaatacgtttaacagtgatttttgaatacttaatgtctcctaatccttacgttccttatttttactacatcaaaattataaatacaaagataaattttacttttattaatagatgttcgaataattgaattacattattttattttaaaatttaaataattatgtatatataagtgaaaatatttgttatgtgtttagttaatttatttaatataactaattttatgagtgatattataaatttatgaataaaaatatatatacatatttacaaagtttatattggataaaaaaaaaatcaaattcttaatccgttagttaatttttctgttgattcagttttcaatattttggaccgattttttcagtttacatttggattggattgtttttgaacaccgaaaatagataccctaaagcaaacatgacaagtcaacatgtgaaattaaatgtgcatggtgtggactgtggattctggggaaattcttgtgtagaattgatgaatattttgacttgaaaataagaaccatcaaattggtcattctcacaatccaaatccacacgaaaacgagaatggccgaactttctacagttggggtgtgtgtgtttgattgagtgtgtcgtaaatgagacgatattagatagaagcaataaaaaaattgaaaggaagaaagaaaaaaaggggtctttatcagtgtcattatgatatcattgtttgatctttcctcttttgaagccactaacaagtaacaaagattgaatgtgatgtccttgtttcattggcttgataaactttctcttcatttggctatgctttgttcacttcgatcacttaataattaatcatccattcatcattcttcttattattccctcatccccacttaaatcattttctacttctccacttctctcataagtataacatcaggatcaattaatctttttggttttctttcttttcctttttcccctttctctcattgagtcttaactactaagttattattattttggatttaatataatatttatgtgataataaattagtaattacgaatgtaaaggaaaataattttatttaatcaaataatgatataaatttttttatttaacttttatggttgtgtcattgtaaaaaaaaaaaaaaaaggtcttttaaacatcaaaagtcttgattctaaatcttagaatgaacttcattcaaccaatcccttgagtgaatcactactattgaaaccaataaaatttaaatttggatcaacataatcgatttggttttccttactaattgtgccaacaatagctgactcatgatttaaaaactaattggtactagtaaaattgtgaattaaagattatacctaataattaattaacattatcgtgcaatgcttttttttatacccattcaaattgattagtacctgaaatttatagcaaattacgaacattatttaattaggtgaattaaactttcttagtaaatcatgcaatgtgaaagtaagtatgaataatagcgcttatttattttaagtcttagtatagtataattcattttgaaatattgaatataattaaatatgtatctaaattaatcttagtttatgttacatcaaacgtatattattgcatgtaaaattgattttgcttctaaactatatgagcatatatgagttggaaagaagaatagggatgtttattttaatttattgtagaattgttttaaaaactctgaatgtaattgagatgtgtgtctaaaataatcttcaccgtatattttacattggaatgtatatatatgtgaaattgattttgttggtaaaccatatgacacatacacatagttgtaaagaagaagaatgatgatttgtagagttatgaacacgcaacttctttaaaaggattgatttaaaaaaaaaaatcaattttaagatcttttaaattgtttagataacattttcttaaaaaaattaaaaatagtttttaaaaaaatttaattggagtaattcttcaaaatagccacttgtaatgagtaaaaaaatggataagataaacaatttttacacaattttttatttgtaaaaaatagtacttttcaatttttgttctttcaaaatataagtgatttttaatattcatcgtaatgctctaagaaaaatgttattttattcaaacaacttaaaattaattttttaataataaataatttttatacttatagtagataaaaacagacttaattaaaatttaccatgttattatttttgaataataaatattattattttttaatatcatcattcaattttttcgcacattatatcaccatgtttttagtttttataattttatcactcaagtttttttcatatattttttttttcacacattttagatacaattttaattgattgataaaatatataaattttttaaaaaatatgatgataaaatacagaaaagactaggtgataaaaaatttataaaattataatagttggatgataaaatatgcaattaatcctaaatataaaacaatttttaaagatgtaaattttttttataaattatataaattttcaaattaaaatttttacacaatttcaactaccttttttaaaacttaaactaatagtctttatttactacctttttagaactttaactaactaaactacctttattatttatttacttcagcttatttaccaaaaatctttttgatatttcatgcttggttatt

SEQ ID NO: 534 - DNA, 2100 bp, Glycine max
  Soy_ogl_3214 Gm09:40024801..40026900 Cluster 2
agagcttccatcctcaacaggcaacagctacttagcctccgtgacatgatatcatgcgcatggaaacccaacagaaatcttcctacctctacactaatttctcgactgctgataatattatggaacaaaactaacccttccacgtttaaatgtctgatattttgtgaaattaattaagatagataatcaggcctcttttacaaattaacaatatcttgtgcacatagcttaacttgtgaagaattacataatttttttagtaaatttaggatgtttctgaccaagctaagactcaaggattaattaatctctagagatattagtaatatctatttttttgacagaaaatattaatgatatctattcgtgatatttttgtcaaacattaatcattcaatgggtttttttcatatcaaatatctaattatataccgataatattatctatcaatgacacataattttaataacttggttttatttatttattttaaaaaatagataaggaaacatatgtgtattagttttatttattagttttaaaaattatactcaaactcaattaatacgtaaatatcataccactacatataatttttattaatatccattacatctgggttcattgtcacctccgtaagtaaatggcttatatggaaaaagaggaacgtcaataatatatttttttattaatcaaaattattaaattatgagggcaaaggatccttttaagtggagggagaaaaaactttggaggattaagtgaaatgatctcatcaattttttttttttttgaaagagatatgttctcgtcatttgtttttttagtctttcactttataattaaaatcatattatattaaattgttaatgaaatttattaaaggattgggatctctgccaataataatgtcatcaaagacaatttatttctaataacaagcgagtctctttaaataagaaataaaattcatgaaatgttataattttcgatagatttcatcatttcttccaataacaaataatatgttggacggattcttttcatccatgtaaaaatgctttaagcaccaagcaaccaatagttttttactaatgaagaattaactgcgagtggcccatcccccactaataatggaagattgattgtcctactttgagaattttttaatcggtaatgtcaaatatcgccttatttataatctgctattataaatgtattgggagtaaatcataaaaaaataatattgggagcagttaagaaataaaagtaaaaaaaaaatcttactaagtataaaactcctttttaatactttgtttagaataatgttagcagttttgatggtcctaatgattcattcttatgatttagcatatgaaacttacaaaaattgttattttctaataaattatagaaaaaaggttagaaataaagtgtttaagagagtatcactaatgttcttcatatttttaatatacattttgtacttttaataaaaacttttatttacaatctttactctcttacctattatcattttcagagtaatgaataagcatattaaatgtatcatctgaattatatatttattatgtttatttcgcgacgtcatattttgttttgcatgcttatagaatgctaaattacctatcaaagaaaggagaaaagggagaaggcaaactgcgtaccaaaacaatatgaaataaccacgattatatatacctatagaaaaccttttggccgtcataagactaccttcattagcgttaattaaaagaaacgtgaaaggtgaaaagctgcatatctgatatattattgaaacattcagatgatacaaatttatgatttaacctatataacaatactaagagaaaagagtcatttgttaactatttcacatcaattatataactgttgatagcataacttttgattgaaaaaaaattaattattaatatgtatattgcgagtttgcattaaaattgtaatgcattatttaactattttattatttttattatagattattagaggcaattttacttaattaaaataagattattataaataataaagattttctttcagtagtttgatac

SEQ ID NO: 535 - DNA, 1881 bp, Glycine max
  Soy_ogl_3311 Gm10:1972120..1974000 Cluster 2
agaataattttaaattttcttactatattttttacttttttatatggcaagaattaaatatgttttagttttttgaaaatgtatttctttttcatttaatacttcatatacggggaaatgagaggatttataaaaagattagcagaaaaaatgaaaaatataacattattctttgggtacattcggtatggagaaatttttagtttcccaaaaatttgaagtcgaaattttttgttttccgtgtttaatttactttaagaaaatcattaccgataaacaatatttcacgagaaactttttagttatatttctcataaagtttgttttcatggaggatgaaggatgtggaaatctaatttttttaattattcttttttattgtagtaaaaatatcatattattttttttatcaaatcatttaatatgttaaataattaaaacttatggtaaaaataccacttactctttgattctcaatagaattatataaatattttcagaaatattttttaccgacaagataaattatagtcatttttaagaattatgattctcattccttggaatttatgatttttataaattataatttccggacacaaaaaaacttttttagtaccaaatgccccttaaagatatggatgaaaaatggattttaaggacatgtacattaatggtatgtttgaaaaaaaaggaaacaaaaaaatataaattggaccaatactaaatttttctaccaattatcctccttctttctttatataataatattaaatacattttaaatattcaaaaaatttaatatatttaatttttcattaatacttttctataaggaaataggaggatttataggaagattagcagaaagatataacattactattaaaaatacatatgaaataaggattttaataatgcacacatctttttaaatgaaatcatgcacagcaatataggtaaaaataaaataattgcaagctaaatgaccatgggcttaacaaaaattgatttagataactcttcaactcgtgatgagaaaagatgacaatatatgctcttactaacttattttatattttaaaaaatattaatttaaattttattaagagaggttttgagggagagaaaaaatcctacaattacatatgtcaaacatgcattaaaaataagttgttgtccataagtaaacacttaatatacaatatgagtttcttaaattgtggaccttcctcaattagtaataagtatttattattgttaaaattgatggtaaaatgttatcatgataatttattaggatcccataaaaaaatggaaaatgatgttatatgatatgtgaatcgattgtcttcatctagacgctgcaaattatatatttttcctgatgttaaatataagaaattaaaaaaaatatatgtcacactaaataaaaaaaactatttaatcatatttaattgtatcaattttaattaaaaaaatatttttttaacttatcattcattgaaatttgatatcaatgataaaaattaaaaaatagtcattaaaactagcactttgaataaatgaaggttattttaataataataataataaataaggtgatgttaattaattttattatatttaagataaaaaaaaagtattttttttctccttcttatatttaagataagagggggtacaaagttatgaacatgtactcatgaacatgcatgtactcgatttccatcataagttttgggaatgctcgcattgcatggcagtagttggaaattataacataaagttcttgcattttatacaccctagttgtggatatatatgatccgttctttgttaatatacatgtgtgtctgttagagacatgtgagctttcac

SEQ ID NO: 536 - DNA, 3705 bp, Glycine max
  Soy_ogl_4424 Gm13:33454896..33458600 Cluster 2
tacgtttatccatgcaccttactgttttacggaccttgtaaaagcccacccaaatgagccgaaatttgtttttatttggggtgtagaacgagcccgtcatgatagcttatgtaaagacacaaacggataattaatgcccccaaagccagacccaaaccctaaactattttttttattttcttagtttctatcgaatcttttatttatttataaaaaataagaaaaaaggaaaagaaattcttatttaaataagatccactcaattcaacccaatatttataataaaataaaagtgattcctactgatattaataattagggctaatttgtatgaatttacttcagactggttggctcatttagctactatattaagtgcttattctgatcatattttctgtaatgaaactatttttcactggaaattgatgtccaatattcataaatttaaaaatgactaatatttgtcataatgtataacgtgaataaataagatgcatgcctatcaattaggtgtggattatatgttgctaatatatacgatgttatggcaccttaagggtatgccttagaatagtttttgagagatcttagttagacaagactagttgtaaactagatgcagaaaagataagctttatcccgtcgtaataagagatcaacatgacttcaggcagaagaatggaatagtatatatgttgacagtattttgagcctttagatattttttcatttataaagtttaaatttaaaatcttatttacaaaagtcaaatttaatttcatttaagtcaatgacatgttgatataataaaactttttaattaagtatgcataaacaaaaactttttttaaccatcgaacatggagatcattgaattaacgagtataaagttgtttaaccttaagtaaaggttttaagtttatgtcttaaatatataattgtgttaaatattcaacaaaataattttattgtcaattcctgttgagaatatatgtactccataaaaaaaacttttttttggaatacaaacagatatatttttttatccaaattaatggaggccgatttaaaataaaaaatgcgttttacagtaatgattcttttccgtagctaactcaatcaataattttcttaagccatacaggtttcagaagaaaaaaatatatattgtaataaaggatttacagtttcctgtcttactcgtgttaaatgcgatgcacggttactattaagtccactcaaacaattttgtctacctaatttagattcttttaaggctacacttaacgagcaattttatgttgaaaatctacggggggaattaacaaaaaaggaatagagaaaactgcttttacatatttttattcaattagggtgtgcttcttttaacttatctaataagaaacattattgcgcattgggtttatatgtttgtcaggtcaatttcctttattttcccggcaagtgaaggcttagatagcgattggcgatgcgcactcgttctaaggtgcatgttgttttctgaacacaactaattcactttcaagaggaactctatatttttaacatttttttttttttgcccttcaagttatcgaattcttaacatgcttagtatttatttatccctggggggtatggatgatttgactcagtatttgcctttattttttcgttttgtagcgtaatttgcactcgtttgattttccacttttagcttcgcttagatatcaagcatacacgaagattgaacaagtttttaatggtgatttttgttcttgtggaactaagtcagtttcattcatgcttgttcaaccaggtatgccaaaggaatctgaatatatagattataattaaatgcctagtggcgacaaattaggggaaaaaacgaattccatgtcaaatcggtgccaatttattatggagtcataggttcacatttggatatgcagtacgctttagtcgtaatttgacaataatattcatgcagtcgaaattgttgttagtttaaggagcacatgggaatagaatttaagaagatcaaacctcccaacacgaatcaggaaggttccaacgtatacaagttgaattaattaaacttggccggccagcaggttacaatagaaaaaataataatatcacttgcttatggttgacttgcaattttttcttttgaaggtgtggaatgttgatgctgctcttaaatttttattgggggcacagggggtagttaactttctgaatcttagtgcatctcctttctggttttgttacgggtggatgtctgataccgttgttctgtgcctcaccaagttcaatgaattcatttcaaaaataaaatagaaacaaattattctggcaagtattacaaaaactttaacgaaaaaaataagatcctgttgtctttcttttatgaattctgatattctctacttgacacaaatctattaagatattgagatttttctaaggaatcgatattttctaacaaatatatatttaagaaatatttgtcaaccatattaaatttaaaatttaggagaaattattttagtctttaccaaaaaataagaactagccgtagatattgtgatggttcaaaattaaaagaatttaattaactcttccaaacttgagaaaaaataaaaataccaaatttataaaaaaaagtatttattataaaccaatttacctgtctagaaaaaaaaaagatcctatttaaaaattgttcttaacaatcatattttatttataattaagaaacaaaaacatttgtattagaaacttctttttcaaaattatatttatttagtttatttttaaaaataaaaagtcgttatgctaaagaacgtcgttgcctatggaggagttcctaagtcgaagtaacccgaatagaccttcgcaagttgttgccctactcgtgaatccgcagcaaaggtggtgacccttcttctattcatagtgggtggtcccttttgtccttatatcacaagacaaatctctaatgcacatcgatgctacatttgtgaccccttgcatgaaatattaggatgcactgcaccttttgctttgtcaccacatctttggttggcagtgttgcttcgtcttcctaacatatcaaaatgcgatgttccctttgcctcatcacaacattctcgtataataatgtgtctactttgtcaagttttaggtattgtatttgtatggggtgtatctaaattaccaagtcattctatggttgcatcccttagttcattgtgattaatcttttatgtcatacatcctagttactttcatcctttcgatgatataggccaataagtgcttcaagtgagcatcctttgttcatgataattgcatcatttctcacaaaacagtacacaaccctttaagcattaggtcaagaagtgagcatcctctcttcatgataatcatcgatcaccttgatcggacggtctagaatccaaaacagttataaattatttctattttttgttctgtttttcttaccgcatcatgcaattaaggaaaaaaaaaactttcaaaataaatttagcaaacatcattttaatttctaaatatgttttcaaattaatacttaacaaacaacttttatattttattttaaaaaattgtacttccaaatctttttaataaaaaacaaaacacaattaaagagatggtacgtttagacacatacag

SEQ ID NO: 537 - DNA, 1174 bp, Glycine max
  Soy_ogl_4700 Gm14:5919901..5921074 Cluster 2
aataatgatattgaccataacaccttatccgcctcatgcgacatgtgtttgagcacgtggcatctgccaactgaaactttctgtccatttttcgaaaagccacaattgcccttctggctagaaacagtaactttgtttcgtaatcatagtttatttaatgaatatttattgaagttttttataagaaaattttaatgattttttaaaatctatgcttgtaaaattaatatattaataaccaaactaattttatgaaatttataaaaaaaaagatatattgtgctctctaattttaaggtcaagtatatttttattcttaataaatacttaatttttatatttattctctaataaatttttgtttttttactgaatttataataaaaataacaatttttttttgtttttaatattcctttttagtatttgataaattaacgaattttttatttatcccttaataaatgttttagtctaactaattattaacaaataatttttttcatcaagaaacaaatataaaatataaatattttgtagagatcaaaaacatatttaaatcttaattttattattaaaaattttcatcaaattctagagttatgctatgacaaattaaaaagaacaatcctaactagattgaaactacactcatcatcaacagtcaaaacaatacactccactatatttaaaaaaaaaagatcatggagagacaaacaactaaaatctgtgtacaatcatgtgaatatgaaacaaagaatgacatatatttttttttaaaaaaaactcttcccaaaataaaagagagaagaaaacctcactaaattaaacaattggtggtaacaccatctgagacgagtctatctattaacacaaaaatttccttcacgatatatatgagaaataaataaaaaaagacatagaatgagttacatatatacaaagccaccactttagcctatttgaaaccttaaataacaagcatggaatcacattctatccaaagctttctccaccatttatcaaaagctgccacaatgccgggcggaaacggatctttcacttaattggccagcaacttgctaattcctgaaatttttgaataattattgttattagttttaatataaaaaattattagtataagaatttatttgaattaaaagtattaatg

SEQ ID NO: 538 - DNA, 3316 bp, Glycine max
  Soy_ogl_5215 Gm16:795585..798900 Cluster 2
aataaacttagcttgtatcatgtgcaatgcttaaccagaatacttagtatattactaaaatcaaataccctccatttaaaaaaatagattaacaaaaaattaatatcttaagaatttaatttaaataaatttataatatatatttttatattatcatccaatcatagattatcatgtaagatttattgactttttgtaatagttacattaaaaattcatatttaaagtgtttttgaatttattaacagtgtatgaaaattaaatttatattttaattttagtttttttataagtatttatatcattttcttagtttaaaattatttattttttctaccctactatttgcttataatactccactttcaaacaatgtttagagaattgaaaaagagcaactaaaagttggttagtgaaaattatgaattgtagaaaagacttagaaaaagtctatatattagtgtttgattttttatactgaaagcttcttagcgaagccatggttgcgcaaacaaagtgacaaaggtgattctttatactgttcgtcctttcctcttttgtactctcttccctatttggccaaagctatccatccgggtggggaaagggaaaagttatcatttgtggttttcctttctcaacacgtctaaacaataatttaggaaattaaaatatctaaatttatctttgattaactaattcgtcgaaagagaaaaaaaaatgtcaatttcattgcatatacatataaaaattatttgatttttaaaactaataactcaaatttgttacgccgggagatgcttaattgcttttggttttagaaatgagtctcgtaacaaatttggatttagaaaaacaccaaatgaaataataactaacagaatcacataaccaccaattattggtattattttagccttgttgtagtatttgcttgttactttaaaatgttaaaaaaaaaaagaaaaaaactatacagtacctcaatcaatgacgagggatttcaacttagccttgttggtattattttagccttgatgtagtatttgattgttactttaaagtgttaaaaaaggaagaaagaaaaaaaaattatcgagtaataaaatcaatgatgcatgaggaatttcaacttatctagaagtcaagttgaaattaaatatgtaattgtcttaaatatctaaatttttttatcaattgtcactgtcttatacctgacccgagtaaagaaattattttctaagatatataattgcattaactacttaacaaaactttgtcactcactaatcctatccaattattcaacttgagcaacatcaagtctagtagaagatatctataatctatatatatatatataaagcgatgctagagatataatttgaagtgcagatcagataaactggacagcgaaaaaaataatactaaatgatataatacagaaaaatacattatgaacaataaagattgaacgtggagaggacgaggagtaatggataaaagcaaatgaaaaattctacaaattttaattgatatattaatttctgataaatatgtagtaatgtaggtcgatcgtgtcgtcgatgagagtgcatgatttttgtatttttcctgatgaagaagaagctcaatcacatgcaaattagagtgtggaagagaaaaatgataattatggtgacagcagaagtgataacgatctctacaatactcctattgtacgcttcaattccttcatgtttgtgtcataaatggaggacctctatttgaggaaaaatctataaaaacaaaacaatttcttcatatttttaattattttctcgttccaaaatttggaagcattaaatggacgatatcattaatagttgatgtcgaccattactagttctctactaattatatatattagtagtatattgtatgtacttcatttttcctttaaacatgtatatgcgtgatagcttctcattaattctgaaatggtttaatatgcgtccaaacccaaaagtacgtagttgagacatcgttttctaaatgtaaaatcagtttaagaacccgatggtaacattttccatgttctatgaactagtacaatattttgaactacttttcgatgataaagtagtggaaatagtttactaagatttcaataaagaattctaaatcaatagttcaatacactcttcgcttcactttagcacgttttaataaattttaatttgttccaacaattacctttttaaatattaatacacaattaaataatttttcatatttatccttaatttggccggtgaattttgaacactaattattttttcagaatttttttattgtatctttcaataaaaaaaattgttttggtgaataaatttttaataaaattagattgctcattaaaattattaatgctttcttaatctttatgtcaaaacttgaatacaggcaattttgtcgcaagttggctcaaggtggaccttttctccaatgtgtttaattagtcctaattaattagaagaattctttcaagttttgatgtgtggacgtgagacggttaatgccacaaactttgctttgatttaataaccacaccctttacctcaaatatatgccatccgtaatcgtgaaaacagttcattggaaaaatgaaaattttcagatcatggagtactctcatcatggatattttagttatcatttatcaaatattaataattttttttacaagaatcaaatattaatgatcaatcataataaatatttaaaaattatgttttcacgaaatatatcagcatatatctagtggatatttgacatttattattggataaataactaaatccttcttgaaagggcaagacgtgaaaaattgatatgtaaaaaataaaaaatttaaatttagtccatcaatgtataaaaaatataaaaaattagtcatttaatgcaaattggtctccaaattttataacttaattttaaattaattcttaaaaaatataatttattatcaaattgatcatccaatattataatttaatgataagatgatttcataaatttaacaactaatgtgttttattttttttttacaaatttaataattaaatttacattttttactttttatagattaatttattaccacatttgagataaatttgattatttacctttattatttatatatggttaaagggagagttgttttaagacataagaataactttttagggatgatattatttgaaatactaaaatcaagtatttcacttttggatgaatttgaaattaagtgtagttaaaatataatatttta

SEQ ID NO: 539 - DNA, 2930 bp, Glycine max
  Soy_ogl_5522 Gm17:5271568..5274497 Cluster 2
aagaaaaagaagctgaagttaaagttatcttcatatatgaatgatcagaaattttcatcgaccggacacctcgtcaaataattataaatatggaattcatgaattaatcactaataagaaactctcgagtccatatacggtgaaaccaatttgtggacatgcttgttactctttaaaaggacttcaagagtgtttttgaccgaagaaacaagaggatctaaattgcaaatatttgtaaccttatttggaaggaatatgtttcaaactatccccatatataattaacctttgactttagccccgtaacttcaaaaaaagaagctcaaaaagcagtactgcgagacctagccaagaagcaaaacgacaaaattaatgaagcatggaaaagaaaatgcgtagcgcgcgccatgaggagttgcaacttgcaagtgacgagacatgttcattttgtagctttaatgatcgatcatgtcattagaagtcactgccatgtaagccataacttaaagtctaaagctgaaatgtgtaccataaaagaaatgttaatcactaagaaaaaggagagaacaattccattggaggagctagcacagtggaggcagaaaaagatgcacgaagtttgtaaaaggaaagaggtaccttctcattcacttatgtatttagtttagatttagattagatagaagccagtaaaaacataaatatacttgtcaacaacctcttatctaagtctgcctttcacatatattccatatctaaacgtgagacaagattttgcttccatctcatcaatgttgtcactaggctttgcagttctcgattccatgtctctttctcccactacaaatctataatcattaccaagttgggcttattcaaagttgttttttaaaaacagagttatttagataggttgttttacttgtttaatttgttttggaatattgtttgaaaacagtcaatccatatgtaataaaaacaacgttagaattattactttataaaggtttagtagagagaagttgtactcatttcagtgttaattttcttttgttgaaattaaaaacaaacgtaaaataagttttcttatacatatttcaaaatttaataattttactagcaaattgactataaacaatataacaaaatttatcatttaataatttgattttttttaattaacatgagaattgagatgactgtggatcttaagcataggcccagagacatgcacgaccttaatgatctcgtggttagactttccttgtgagtttttattttatttttttaataaagaggggaggaggaagtgctatattataatgcacgcaccaaagttagaaatccgtttagtatttatttattctataaacttaaaatttagaggttgatcttttttttactggtaaaatttagaggttgatagaatgctattttactgcatgaagtatacagtcatgttattagagagttttttttttttttaactaaacaaatgggccaaaacctgacaaaacccatgagagcctgtagttcaatacgaagagaatccgtagtccgtactccgtagcatgatatccagatacattaatttttaaaatggtgcagtttgaaaaagaaaaaaaaagtttaattattgataataaatctctatcaaaaaatcttagtaattacttttagttaaatatttcatcatatttatgtttttttcgtccaatgtgaccttaaaaacagaatctcttcatcaaaggacacttaaaaacacaaataccctattgcaattcatgtttaaagtttaacggtgcatcttaaaactcagctagcttagcaagcttatatttaacaataaaacataaataaaaaacattttgaaagctgagaactgggttgccaaaattttacagttgaaaccaacattttacggttgaacatgtttaaaccaacatttctctttaaacttggattaaaatacattgtgatatgataagtgtgtaatatatttatgatattttttcttcaaatcgtgatcttgttattattatcaattataatgacctgtgtggtatgagttatgtgtgctttgttcaaaagctctaaacaatctgtctaaaggctccaaaaattatattctcaactcgctcaaggcatcatgatctgccacaacaataaagagataatgaactttctctcttttggttacatgggtcaaatgcgagaaatttgactcctacaacaatatgtacaaagttttttttttcttttcgtttgatcttgatatgaattcaatttcttcctccatgcagctctcatttctgcttttttgcttcacatttcttttataataaatctttcactttatttatattcattattctttggtaaaactatcatcactatctcctacattttaacactcattttctacttgatcaaacctaaaaaatactagaaaatgagtgttgaaatatacaagtgatcgtggtagttttgttaaacatgaataaatgcaatttgggtaaaaatttataataacaaaaatgtgaaataaaaagaaagataaaactagcttgaaagaaggaactggatacttataatgttgtgttttaatatacaaatgtattgcatgtacgatatgaaatgaagtgttccataatgttcaattttgtatataattttagctttgtatttttttttataaaaaatagacaatgcatttgcaatgttttttttaataggtttttaactttttttttacatcaaatattgtcactatcaatttaaaagaaggtttcttagatcgattatatatggattttaaattgatttaaaaatgccaactttctatatcaattaattctacatcggctagtaaaataatgttgaatataattaagattaaaaacctattttacactagtgcaggatttgaa

SEQ ID NO: 540 - DNA, 1600 bp, Glycine max
  Soy_ogl_5766 Gm17:39009301..39010900 Cluster 2
ttgtcttattttatggatttcaattaagatttgtgtgtgtttattttttctttttagaaatcaagaaagagggataaaaactctaatgaattaagaaagaaaacttaatatgtaaaaaaaaatccaaaaatagaacttaattattatatgcctttttttcaatgtcaattacttagccaacaatataaaacaacaggaaaggaaaaaatgattaagttgttttttcttcaactctctcattaggcagttgttgttgaggttatttttattcaaaaatgttaattattagtttttattagtggaaaaattcaattttttaacttttttttttctctttttaccactaaatcaatttatatattcggtcgttgttagtgagattcttcaaaattctcataaggagaatgattagggtaaaaactcatatctcttcaagcgtccaactaaactcttctttgttggggttaaataaattttaatatgagagtattttgatgaaagtttatttatttttttatatctatgtgtcttagtcatctgtacccaatgcttctgataaattggtcaaaaccccctcctcctcttgtaaatgcgactttactattttaaggcacaaacctagtaattctctaaactagaaatagtcaccagatgtttgttaccgttataaaaaaaatttcatgaatcatgatttttgataataatgaatatcctgggaatcgtaatttcttaaaatgattaaaatttagtttatttggttataaatattattggaaatagttgtatatgtttgttgggaactaaaaaattttacgtttagttttagtaaaacttttccatttttattttattttattaaatgacctaataaaagcaacatgatattttatttcaataaactttttttccaatacaaaaaaaagttaggttctttttttttacactaaaaaaaactaaattcgcacctctccacattcccgagaaataatattttctgagtgttattttttaaacaataaaccaaacataaataaaaaagcattttcagcgtcatatttatgagaaacgaaaaactcccttataccaaagcttcataagaaattagaaatgttaatcaggggtaaagtccaattacctaaaaaaatgtgatgtaaataaattataaaatcccaacaaacgtaataaagaatcaaattgaatcaaagcccaaattaagaattccaggagacatagaacgaaccttaatgtttttctcatttgaattaactcaaaattttttgtgttcttgttttctaaaaaaaaaaagcctcaactttttactgtacttttcagttttaattgtttttttcttaaatcaagttaaattcaaattttcttttattagaattattttagagaaatttcctaataaagaatcatggacagaaggacaaaatttcctttcacagggttgccagaataagaaaagtgaaaataacgcgtattttattgtttcttagaaaaaatattcggaatttattaatacacgtaccgatttttttagaagaaatatagtataatagtaagttataatttttgcattttcttaaaatacattaag

SEQ ID NO: 541 - DNA, 1200 bp, Glycine max
  Soy_ogl_5772 Gm17:39150701..39151900 Cluster 2
gaactcttactacacacttatgtatgattatatagaaattatatatctttgatcacagtaaaaaaaatccctagttatttatacttttcatgacaagatttattaattaagttgaagtgtagaaactaaattattattgattcacttaaactaagatctaaccacgactttcacatataatgatattttttattttaattcacaaatattaatttattaatttttcttataaatatcagtgagaaaaatttgaactctgacgttttttttcttctctcttcattcttaaatctttatttttaactatcaagtcaatatattatatctattttcatatataatcatatattgtgcttctgccactaaaattattaccgacattgatagaaggaacactcacatgcatggttacagggatcaaatattggagagattagagaattgcttacgagggagtgggaggctaaggtgtttaccatctcttcttgagaaatgaacgtggttggctgattctcgggtaaaatgttttttcaacacacatacacatatatacatggacggatctatttattgaagaaagggggtaattttccccactagatttttattttttcttagtatatcatgtatgtatagttataaatgatttttataacttaaaatttaattaaataaataaattataatataaattttgtcctcactaatttatatatgagttttgctcccaatactaaaatactctgaattcgtatataaggattaacttttttactacatgcttaagaacataatcatttgtcaattatactactccatgttaaactatagcaactttaaagcatatttataaattcaatgtcatatttataatatccctgaaattcttctaactttatttaaacagtattatagacctcctgaagacggtttacaaacaacaaagtgggatgcttttttgtcacggatgaaacaaatcctatatgcctaagccatccttgaccacttaaccacgtgtagtttcatacttaatccacatgcaagatattaaatattctttagttttattctaattcataaagtatatgaatctcccctaaaaaataaactatatggatccataatatggatggatccaattgtgttgattataaaaattatttatatatgtagttaattaatccgtaataaaggatatat

SEQ ID NO: 542 - DNA, 2512 bp, Glycine max
  Soy_ogl_6522 Gm19:42842389..42844900 Cluster 2
agaataataattacaaagtttttatctatagtaaaatcatttgacaataacttaataatagtatcatggaacaattttaaatataaagtataactatgtttagtaaaattagttgaaaaagttgactaaaagctaaaaagttaattaaaagttaaaaatttacacaattgatagctaaaaattgttaagctggcttattcaatcgtggtaaaaatattttgtgaagtaactgatataaaataacaaaaacaaatatatttatatgataattttatataaatttcagtttgttttactgataaaaatataaagtatttgcaatttttgttttaactaattttaaacactagtaatttttatgtatagatcaattattttaattatatttgtattcaattattacatttattttttgcaaattttgtattcattattcatgttatattatatcctaaaatgtttatcaacaaaatttacctcaattggttaaacagatcacaaaacaatcaaataaataaacttttcaactaactagtaaaaaaaatattgccaaacataaaaaagtacatgaattataaacatttattttaaatatttcatacatttaagttaaaatattcaaattaaaatgcatcgaatggtcattcaacaaaaaaaaatgtattataatggtgataatcaatcccatgcattaatttaaaaggcgattcctattttttcatttatttctcatttaactgtgattctaacaactgatctgtgtatttgtatgatcaatttatttattataaaatgcttaatttatgtccgtcgcattaattataaaacgttatgcattttcatataaaagtaaaataaaaagaaaaggttaatttaggagctagtttgttttgtttctgttgttttctttctcactaataaaaaaaatgttagatcttattttaaataagggtatttaagttatgattttttacagttacctctctttttcgttaagaaaaattattataattattattttattttcatatgaaaataaaataaaactgattaatttagatgtgaggtcttgttaatcctactatattaaattaggatttttgagttgtcacagtttgataattccaacttttttttggtacgaacaagttcttatgattattatattcattgatattttcttataaaaatgataaatttagacatgacatcatattaatcttgcaattccggttgcgataggaggggtagaaactaatattataaaaaccaaaatttgcttgttttatcaggaaaaaaaataaattttagagacagaaaaatcagaaaaatatttttgaaatcaaaattcattaatttaacaaacttaaaacttgattaaaaaacataaactaaaaacatattcaaccttattatcaaatattaaaatacacgtttaattatcacttgattcaaccttaattaaccatggttagattacttaatattctcataaaaaaataacttaattactgctgcaaatgaataaaaaaaaattacttaatgtgaatttatttatgctttcaccgattcaatgacgtgtgatcaaaacataaataaaacaaatttatttttggattgggggatggatattatgcctcatatatatatacatgattgcatagaaaaagaaggactaatcccacaggcaccaggaaggcttacaagctttgattttagaaaatctaattgtggtccaacaacatgcaaacaattacaaagatatcttgtactttccctgttatggttggctttgggaaacgcaatagttgctgctctacaacaataagtacttggattggacttgacaacagcaaaataagtcccacagaacgaaagtaaagcttcatacccatagcacgttttagtaatattatgttgatcacatgcagtgaatgttgttactgccaaaccataagccatcacaagagcaaaaattttcttctcccccatcttctcttgaatatgtatgcaactttgttttcagtattatgacgttttgatcaaccattcttaacatatatatcagtatatatagggcaaattctgagttttatcattttttgttttttgaatattaaagaaacataattatgactcttttttagtgaggtcggtaagctattgacatcatggtcaatgttaattgcccggcccaaattccatttgtagtaactaatgactaactttaaatgttcattgactttttttatcatttatgatatgattttttttgtgtgaatatttatgatatgaataaatcaaactatttgttaaaatatcactttatataggttgtttaaaaaataataattacttcagaaaataaatgagcaataattatattttaaaattgagaaaaataggtatccactaaattaaaacatataggatcaaaaaggcatcacgcttaaattaaacgttatacatttttaaggggaaatttgaacataacaaagcatcacattttaaa

SEQ ID NO: 543 - DNA, 1958 bp, Glycine max
  Soy_ogl_6747 Gm20:34529643..34531600 Cluster 2
ctctgaaaaataatttataatgtgtaatatccgttaaaatgaatatttgtcaccgcctcacgtacaataaattatataaataaagtttagaaatttaaattgttatttccattaccatttaaccgtaaatgtcaattcatggaaaatttgtttttaagagaatccacttctgttagttctaaccttgatcgtcaacttgaaaaaaaataatattcgtagcatatattttccttttcgttgttccagaattcaacgtaatttactgccttctttcacgtagatacttgcgcttaattaatctaaacagtacgaatcttaatgttgaatatgtgttagtgtatagatgaaccttttggtttttatagttataaatctgtgggctatggagattcaaacttcgaagctccagtaacttggtgacggatgggacacggtttttattgaaagatattttcgttaatcgcttttgttacaatttgggttctttttttaacgacccaaaataataagaggttattctatgagtcagcaagatatctatggatgataagacgagactgaaaaaccttatcatcagcactttctagctagtgctttcaaatctttattcataaatatcgagtttatcttagtttctgtcagtgaaaaaatatgtgtgaacaaaaatgtcatggaattacttcttgaaccagagagaatttagaacgaaagggaaattcgttgtaaagaatgtcatactacttgcgttatggcactatatgttgaatgattgaagctacccttaattaattggacaatttatgtcaataaaggaacatgtccgatttccaaaggcatgggtctccgctatctgcatcctcttttagcatatttgtgattacatatactttaagagaaattttttttatcttgaaataattaatattttagctttccaatctaaatttttccagttatatttttataatatatattaatagtcaacaacaaaatctaaaaataagttaatgataatacaatattaattttataaaattattattctattttatttatgttttattttttcttggttcgtaggattacaattattttaagaccaaatgaatagtataaaatctttttatactgttaatatataattattttttcaaaaaataatattataaagacgttataaaaatattttatatataatataactttttattttatttatcacgtgacagacaaattaacggtgagttgtttaaacttaaaagaataatttttaaataaatgttctttatataagtattttttaaaaaataaatatgatgtatttcttaaaataagataacactattttttaagtaaaataagtgcataaaaaaataaaaaccatttgttttattaaaataaatacttattccagtaaataaatataaacaaattcacgagttattaatactgccagagaggtgttggttcatttccaaatcttgggtcctaagtgaaccacgcctatattagctgtcgccgtaaatccaaaaaaatgtgtgaacacaaatgtcaaggaaacagtattaacaattcattggcactgtcacagggaaagttttacaaataaataatgagtgctccaaaaagaaaactaagggacaatacttcactggagcatgaccatgattactgtcctattgttaaagctcataccattaagtggggagaatttggggaccacttaggacgaagatgacttctatcaatatctgcatgctaaccctgcccttctttaagattttgattctcactttaggtgccatcagtcccacgccatggcacacatctaattggaaaataatgattcaagtattgtaattgcatcaaacatgtatatatccaaacttttttagttatattttttatataatttgtttactttttttaaaaaaataattatactaacaatttttttt

SEQ ID NO: 544 - DNA, 1559 bp, Glycine max
  Soy_ogl_1726 Gm05:38097560..38099118 Cluster 2
aggctagtaaaatatcaaagcttggttgataaccaatagaacggtatacaactccttaggctcagtaaaatatcaaagttctattgataaccaattgaatggtacatagctcattgggcccaagtgcgaagcatgaagtgactaatcaaatatcaaagctcggttgataatcgactgaacggtacaataatcatgttactagtatgaattatccatcaaaattgtgaatgattaatattcacctgaaacttgattgaccgcgataaaaaaggaccaagcttaattccattaattaagaacaaagacttgttagtccatagtacatatactatataaatatatttataaagatacatttatcatccataatagtttctacataatctgggaggaatattcaaaccagagtaaaaaatatatatttctaacgattgcctacaagccaaacttacctacaattactctaatatccaagcctttgggtggccaagaagaagataaagtgtataaaatgggtttgctactagcctcgatgccattgttattggctccgccgggtgaaatttattttatttttctaaaaatatccttttcaaagaatcatggttctgttattgttttaaattttgtatgcataaatgtgcgtgtgtgtgtgtttttttttatgcatgggacatcaatccctcaattggatcctccaaggaaattcacgaacaagtatttatcttgttatatttcttttgtagcatattatagttctacatgttttatgtcgtatcgaaaagtgaaaaattcatgtgtgttttcataagcaaaattaagtaacaatttcattaaaataaacttattccgcaatgagagtaattggtccaacgtgatgttatatataggacattgcattttatgatatcaaagttggtaatatcttttatgagaaaaactattgggaatagatgcattgcgtctttgttgtgtactttatgtagttatttccgcaaggaaaaaaaatattggttgacattgctgtgaatttttgtattattgtgccatcctctcgtagttaattacgttctatgtcaccaataccaccctcaccgaatttgattaccccaacaataaagtttggcatctactagactactacgactgagtctgtggatccaaaaaaatttgtcagtgagacaaaaactaatttataatattatcacacaaaaaaatgtcaccaattcataaaatatgtaatatcatgataaaaaaatataaaatacttatatttttacatattgcaattattttttatgaattgttatacttaaaaatgttctatatttttttattgtcaatactatcaaaaattaaaagaacaaagaagtaagattaatatcaatttattttttcttttttatttcttatattttcttttactcattttagaacgattcatcttatgggggtaatatctatttttctatggggataattttttttattatgtgactggagatcaattaaaaaaatcttgtgtgggcaatttcccccacaccctatgacctggatcc

SEQ ID NO: 545 - DNA, 1900 bp, Glycine max
  Soy_ogl_2270 Gm07:8003401..8005300 Cluster 2
tctcatttttaagaataattgtatcctaaacaaactagaattgatgtcactatcacaagtctagatattctaaaccactttgatcatttcaattctttaagatatttggatagattacttgttaataaaaattcggtcactatcatttacctaaaagaaaatcagtcatgtaccaaataaaataaaaaccgtcactatcacatgatttacatctactaaggaacttgaattattgtttggtggctagtagaacttatccacataacaaattaagggaaaaaaggggttgctagaaagggtgaatgtacaatgtatagacaggaacataattttacatgtttaaattttaattatgttaagatgtcatttttttaattatgttaaattaaaatacaaacaaatatatttttaatttcaaaataaattatttacctttaattgaacttcaaaaacataattgaacttccatgcgtatttttatttttatattataggtattttctattgagactattagttaaccttgcgttaattaatttatatacattcagtggtaaacattattttatttaaagatcacaatacttaaatatttaattaatttaaatcaagttagcgatatgtggtaattactagatcggggggtttgtaaaaaaagcacgtaataatgacaaaatcttaacattggttgataaaaaaactgtgtgaccaaaaaagaaactaatatatgcacatgaaaaatccaaaaaaaaagatacaatataaaaaagataaaatacaaacagtaaataattaattctaaatataataaaaacaatagcctcatcaaatattgattttcagcaaaactattataattactgaaaattaaaacattgaaaacttcaagaatattacatcattttgctagaaatatataattaaaagggatatattatcaaattctgaatatatcagagagacttcttgcatattcttcaatatatttacctacaatctccttctatttcttcaattgtcatggagatagtgtttgaataggttgggatgatgaatcaagaaatcatatctcgtagccttttgaaagtaacttagaatgtgtttaaaaatccggtgaaaaatgacttttaagacaaaagtaattttatcaaaggatcatcatgatctttgttttggaacgtattacaataatttcaacattcacttatttgttcaaattatatatgcgtaattctcattttgaaattttcattttcttgataggtcaagaacaaccatgctccaaatttcaaattataatgtttcataatgttgtttattccataaacgaaagatgcattgctatcaaacttttgcataatgatacctattcaagttccaatttcatctataaaccaacattttgaaggaacttcttccttatatgattaataaaaactccaaaagtaacagaaactttgaccagttcataataaaaaaaatgaaccaaattaatactaaattaaatatcaaatacaaattgaaaatcaaattagaaataaactatacaattgttttattaaacatgaccaaattccattaaatagagacttaattaaacacttactacccactgtttcaatatttctatacttaacttttatcataagtgagtacttattcattgcatcaagattgttatatcattcggcagaataaagttttaaatttattgatgaatattgtcaacatttatcccaacttttatcataagtgagtaaaaaacaaatggaagaattttttatttttttatcttttttacaacaacaaataaagggattttttttacgaccaaatgaaaggagtttaagattacatatacattggtaatttgtctcaactaaagtattatctcttgcat

SEQ ID NO: 546 - DNA, 1823 bp, Glycine max
  Soy_ogl_3501 Gm10:42780878..42782700 Cluster 2
tgcaatcaaaacccttaatcaaggtaggcaccattttactcgctaatagatataatctgaccagagagaattaattaaatatcaaataaaaagttaaaataaaagtatttatttaaaaatctttaaaataataaaattaacatttatttcctcaaattaaatattcatttatttaagcctataagaaaagtagcttttggaatgtatgaaaaaaaatttggattagattttagagatcttatggaaaacaaaattgtgttttgttagatccctcccctttcaaaattgtcagatatcttacttttcttttaaactctgatattttaaaaattcaaataaatacattaaaatcttttttaaaaagtagaatgaaatgattttttgataaaaaaaataaaccatacaaaatctaaagtgcgtatatacacgctaaataagagtcactgatatttctcttttacaaaattgattgattgattttttaactttcagacttgattgattttacaaaataatgacgttgcaaatgttttttttttcgagttacattaactaagattgataaaatcttatgttggataggtgacaaatttaaatcaatgtataataattttattttgaaaactaatcatcataaattcatgcattaaatcaaatcataatcaatttattgggattatctcttcatatttataatcttttaaaattatatattcaactcaaattttattcaaggttaatgtaaatagaaaacagtatcttatctttttttaacaatgttatgatatttttttatacactaataccattgttttttttaggatgatcgcattcagatttaaatgtacaactttatgtattttatttcaacctctttcactagatcgatcctagtgggttacaatgatattagagattttgtatttcatttgttgttatttataatattcaattgattaattcataagattaaaaaaatggttaattagtccatagcaataacattttccaaaatttataatttttttcaaaactatcattattaatactttttttttttaattctttgtcaatatattctatctcttttttaattaagaatatcttaatctaagagtaattaatataacgaacattataaattggatattatattacacttttatcttataaataaaaatagagagagcattaattaataattatgcgtcactatattcaattttagctaaatctatattcctatataaagaactgactttattaagcacgtggtttttgagatagaaaaagtcgtccactatgttgatcctattcgtatctaacaattacttaatatattaattaacttacctctttttgtctcaaatcaaaatgtgggtaacttaatgacattaagtaattaattataaaaatgtttaattatatattaattaattattatacaattagcaaagagagagattttattagagataacactttctcattataattttttttatcaccataacattagtatctagtatttatcaatttgctaatcattagtttccgctaaaaaaatatatatacagttaattcatccaaattgctcagcaaaattgataaatattgaattaattactacttaaaaactactttttattgcatatgtaaataattgatgacactaaatattttgtaacgtttaattgtttatataaaatataaaaaatattaacataattatttgaatacattgatatataaccatcgaaatcacaaatatttgaaatgttattgaattgttgaatgtataacaaatattctacaacaatata

SEQ ID NO: 547 - DNA, 1656 bp, Glycine max
  Soy_ogl_3511 Gm10:43087445..43089100 Cluster 2
gctgttgcaattgatggaggcaaaacaatgtgtaatgtgtatcattgcaattcgtacacaataactacccagatagagaaagagatcgaatgtgcaagctcacctaatgaaaaaggttacttaaacttaaaagtcccaccatgtccccaatcgtgtgggattctgatatattacgaaatcaatcttttagtgctagtttcattatgaacagatttataattaacttcgattcatttttattgcaaaatatttaactcattgtgttagtaaatatttaactataatagaaatgatcgtttgaaaacttaaatggtaacataatttttctactaaaaaaataaaattaatctctttatgaattaacacaaatttaataacagcagaaaaagtaatctttaatgtattcttaattttaaaagttagtttatttttttagaggattaaaaatttatgagtttagtgtttttaaggtataatctttagaagtagatatgagagtttaatttttcagatggtgttatgtttgtttcgtcccgaatgaatcacggcttgacatcaatatgattaattattgattttgagtttaagttcataatgatcttatttttctatcaaaaaattaatgatcttatttaatttaaggtaattaatgattaatatttcttttcaacttttacatttcaatgaagctgtcatgtttgggcagtttagctcaatcaagttcattaattatttttttccaaataataataataataatatacatttgtttgtttaattttcactgtttcattttttttaattaaaaactaaccggttgacccatgcacgcacacgtcgctctttaatttatctttgttattgtacgttagttttttgaataagttgtattttctcttaatattaaacaaacttattaacatgtagtctatatgtaaaaaattatattaaaagttacagttataaagtataataaaataaataaatatataaccatttacataagttatcgaccagagtgagtgtcgttcattacattgctgtaaccgtacaaattcagtgataactattttcattttcacctttcaaagctacaacactacagtatgattttttttatatcattgtatatcattcagtatattcaatgaaaattgagccagaagaatgacatatacagctaaaaaaggtaatatatattaaagaagcaactactagtgggaacaaaaagtagaaaaagaaaacttttgttgatcaactatgtttctggttattatcttcacctggtggagcatggatgcggctccttcgttcttcaaaagcttctatgctctctgtatcaaagcctcctgcaaactgaaaagagttccactccaattaactcattatttttgtattcctaatgtttgataatatacatttcatatatttcaatttaaaactgtttaatgggtcgggttggcctgaagggtcagagggtgcaaagagggtcaatcggacaagcccaaaaatctcttatgacttctgggtggcaagctggcttgccggaccaggtcaaattgacccattaattttaaaaggaaaaattagaccaggccgaatggagttgctattggtcctactacagttgctaattacactactcacgaggtacct

SEQ ID NO: 548 - DNA, 1724 bp, Glycine max
  Soy_ogl_3740 Gm11:26877..28600 Cluster 2
ctcaaaatgaacatctatccaccaattgtcgaattttcttactgccatccaacgctttcgtaatttgctcgtacttcatgtcgcgtttcctgtacataaaaccaaataaaacatttttgtctcgaatctacgacaagatttccatgcgaaatcttgtcttcttttattcaactaactcttttgggattagatgggtcacgtctctgaatttgaatgaacttttgtattaaaattttcaattctcgtttgaaaatttatgagttatgggtgtttttattctgtttttagttcaaaaaatatgaacaaaatgtccaagagtggttgcatgtggtgatttggtatttgtgcattgataaaggccaaggcaatggaggttctcgattattggatggattggctgaaatgataaggtggttgttcagagtggaggttgtttgtggattatagtcatggggataatgcagacaccagaacaaagcaggttactacattactagccatggtgatatgcccatacactctttagtttcctttattatttattactggcggatttgttcaccttttttttggttagagagatgagaaaaataagaacaattaatttataatctaacactattttaaaaagccaattgaaattgaaaatcgtatagttacaatacattaataatagtgtaaaataaaaagttaatatgtctttatatgatgttatagatgcaacaagctagtatcaatatactgaattatatcaaccaatttaatattatttattatgcttatgatttaaaattaatgtctagtcagtttggtccggatatttttttaacatataagttatcaatagtattattaaatctatccagccaacatttcaacatacatgtgtcaccatttaattcaattctaccttatatacttttttcctatctttgcactatgctttttctttgttttacacaccgtgccaagcacaggagctattctagtttttttaaaaaaaattggctggcaactccacattttaacaagaggagtacctactaactatcattatcatatcatggatttagtaataaatgataatgtggtaaattagtaaagaattatgacattatttaacgcatcatgattaacgatagatattaaaatcaaacataaatatatattaaagaataaaatcaaaataggttatatttcagatataaaaatatatttaatgcttaattattttattataaaaatgcccttaattctgaacaatttctcttagcttaataaatagtagataaaatacattattgcttttaggcgttttgcaagtctaactttgcattatagtagtatagagtattttgggaaccttactttgcctcttcacatgtatagccaataaatttaaatatataattatattactaatgatttttttttaaataaagcaaagaaaaaatagttgagaaaaagcaatatacttcttaaaagatagtagtaattttttaaaattaacattacatcatcattaatttaattctaaatttatagtttatcattaatatataagagatataagtaaaaaataataattaatgttacattaaagttaaaatgataattattttgggataatttttttcttataaaacaattataataagatggacagagtatgtaggagataaaaaaacaattttaaaaaccattcaaattatactaataataag

SEQ ID NO: 549 - DNA, 1783 bp, Glycine max
  Soy_ogl_4508 Gm13:37202501..37204283 Cluster 2
ttattacacgagatttattatttaaaattatatatactttttgtcttctctaactcaaaatcattagtgatggtgttaattttttctgaaataccaaaataatccttactaatttagctacatagattgagtaatttaaaattcccaaatcctctttgttaggatttgcaaaaattagaactattagtgaagttggtgtacatcattctaatacgtgaaaggagtccaaaaaaggtaccctctgaaagtgggttgcacgtgtggtggttgtcagtgttgatgacgattgtcatctaatagtgggttgtgtgtggtctaatgtgattgttagtgttggtggtgatcgtcatccttatttgaaatgttggtgatagtcgttgtctaaaaattagttacaaaaaagttcatccaaatattgttttatcctcacttatttagaattgtaaaagctatggaaattactataggagtaatttatgaaagaaatccatggaagatgataagtgtaatttgttctataaaataaaactaatgatgcataattaccgtgtcagaagtattttctattaaatatgaccatctgggttagtttagagaaaaatttcacacatttaaatctcaaaaataaaatctaatttacttaaacttaattaagttgagtaatatttatataaaaaaaatcagttatcttgacccgaattaacgtgatcaactttttgtacacttgctttttggcattatttttacagtatttgaaattgtaaaagcaacatttggtgaatatgctagaacggaatagagcagctacatataatagttttattttaaatttattgtgatttaagaataaaatagaaaaacataataactttttcccttggttaacataaaactttcataaaacataaagctttcataaatcataagtatatattttttacattatttattaataaaaatcatattaaatataacaattattataaaatttaacaaaattactgcataatacaatacatgataaaatagcaacataaaaaactttacactcatatcacattctatatatataaaaatcaaaattaaaaattacaaaaataatcaaaaccaaaattcctcatatttacatacactaaaaatatacttgaacattcttcttccatgtctctaaacaaatagctgcaaactgattcaagggttgaagaacataaacgtagcttcctcagttcgttcacatgcatgcaattgcaaatatgaaatatgcaatccaagcaacagaaaataattaataaaaaggtaaaaataaaaagaagaagcaaacccaaatatttattaagatctaagagcaggtgggtccccagcaaatcaagtgcatgacattctcagctctctccgtctttctcttctcatcaacaacattattagattgcgttgcattaccactgctcccttgtcgtttgattcgtttctccagcaacaacgttttcaatgaccacatcctcatgctaccaataccattcatcactcaaattgtgatcccaaattcataacttcttaagaaaaattaagaacgtgtgtctctcttgctaaataaatattgctcagtgatggattgattatgtacactcttccatgaaaatcaggattcagctctcagattttgtaacacccgcgcttttctaatccacctttttttgttttttgggctgcggttaaagatagtagctcctaacaaaattgacttccaaatataatttctttacacattatatatatgatgtca

SEQ ID NO: 550 - DNA, 1768 bp, Glycine max
  Soy_ogl_4631 Gm14:3898527..3900294 Cluster 2
ggagttaattttaataagtgaatgacttaatagttgacacataatttagtataaataatttttaattggtttataaaaattagaatgtactccataattgaagttaacttcatcctcatttatatctaattaataatttcattttagactaatcataattatcttttatattataaagatttactgcgttagtgttttgtttccttttcttccctctccaaaaaataaaggttcattataagtgcagaattaataaaaaaaattattattaatgttaaaattaccaactaacaagaaattataataactaacaaatataaatttaaggaaattattataaaacttaataaatttattataaataataatttattattgaataaaaatataaaaaaaattattagtgcatgacatatactgtttaatcaaatttataatgatgctataagtctaactacaaaattaatatagaaaaggcaataccacaagcatgagagtttcattgacaatatgaacgtgaaaatcattttggtgacccatgttgaccttatactcttttttcaactacgtaattgccttttctaaatacgtgggtattacttctttttagctttgtaaaataatagtttatttagttttcttttctaaaacaatactccttccgactttatttttataatagacaaatctccatatgaatatactgaatacactgaagctagcttgtttcttataaaaaaaaaatatcaaatataataattttttaatctatttttttcaacaatattcctaaacataattaagaggataaattaatatttacattaaaaagatacatcggctataaaactaagttaatgagtagtaggatgtatttgtcattggtggatagtaggatagtttatgacaagagtatacttagttgaaaaactaagagtattctttattatttaaatttgtatcaactttttttacagctttaaatttgtatcaagtagtagtattttggaatggagggagtatatttctcttataagactttgtgcaattaactaccttaatgaggcatatggtaagcatgagttgctgggattttggttggttgtttcatctagatgttcgagtaacttagggaggggtggaattgtatatgttttgtaaccatctatgcttgtgggacattactctttggtctgtgtagatggattaattatggtatcccttgtaccatcttaattatttatataatatttatttgctgacaaaaaaaaaagtatgagtggttcctatccatatcaattatattagaaaatactagagtttctatctttcaaccaaaaccatgtgtctactccaaagaccaagctctaattaaggatactctcttcatagattttggacaatcaagcacctaaaccgaggaagtgaagaatgagctagaatgctgagaagcattaaaggctggtccgcaaggctgcaacatcttcacaatcacgcaaaagatgcgtagtagttttaacttttaagggcattatggcatatggggaaaaaatagcgctataagacatccaattctatgcctaccttcatcatttgtaagaatgtttgaagagtttttagttttacgtttctatatccaagagctgcactctcctcaagtttacaaatcttctctcatggcactggcatttcttgtgcaagttagccccaatgaactcacgacacaacttttcaatatcatgattggcagatacttataggaatctta

SEQ ID NO: 551 - DNA, 1531 bp, Glycine max
  Soy_ogl_4680 Gm14:5438801..5440331 Cluster 2
gaatcgagtcagagaccgactctggagtatccatatacacactcttgagtcttgcggacctaacatgcttccacaaggccaaacccttttattactttattatggtagattagtaggtctagactttgcttcaatgaattaattgatatattttggtatttgcatagcacaagttaaggaggcagctattgttatttgttcataaatagaagtgtctagttgttaacttgttttgtcaaataaggggaattcatccataaataagattaattgtttctcttgtcgtgttgtgttgggagtcaatgaccttaaaatagatatgacttctttctgctccactggaccgtagtagaataatggatcaggttctttgtttttttgtccacaattaggtatctgaaaaacactgcaaatcctacccataaccctgacccggacacatttagctactttttttaacagataaattattcaagctgaaaattcactcttttttagacatgacctgcatacaagttctattatgttaacgtaatttatatgtaagaaaagacttgaaactcaaaaagtacagactagtaaaaaaaagttgcaaggcacaaataaaaaaacagaggcaaggcaaccaaaaaaaagttcaataaatgaagctaaacttgagatttctaaaaaagaaaaaattacatgattaggtaataaacgaaaacttgcgatcaagtccaaaaataaaaactaatgagaggcacaaacttgaaatacaatctctaacttaaaaaattaaataaaatatataagaggatcgtgaatttaaaatgacaaagtaattttaaacaaacaaaactacttaaaataagagttcattctctcattttattaagatgactctcacataaagttaaaatggatataattaaaaaagaacatgccaacccacatatccaaggcatgatgatgatgatgatatatatatatttgaaaaaaataataattaatttaactataaaaaatgtccatgatttatataatagtacgtcgtctaatataacatagaaactaattttgaaaaccaattttattaatatgagactttataattaattttaagtaaataaaaatacaaatattttattgaaagttgtgtattataatgttttattttcgataaaaaatacttattttcaataaaaccttttattgttaactaattactaataataaatccaaaagtttatgctaacgaaatcttaaaaaaaattaaatgaatgtttaaatgaatgaataattaaaaattagctttagttcgacttaatataaaaattcaaaatattatcacaaaataaaaaactataattacataaaagtacgtaaaatttttatttaatttttaaattagaagttaaatttagatgcaagatatacgtatgcaacgaatgtcacctttagcagctaattctatcttatgttctctgctctcacctcactaaccccttgtttatttgggtgaaatagagtggaagaaagtataaaaaaa

SEQ ID NO: 552 - DNA, 2219 bp, Glycine max
  Soy_ogl_5219 Gm16:1053582..1055800 Cluster 2
caggtcgctaatatcctactaaattgatatgtgatgggtacatcttatatgttaaagaaacgaagaaataacaaaccagtagtatttgttttttttttttaaggagtggtatttgttttgagttgcgtcagactgaacatatattatgtttagtttgcctcactaataatatcatgcttggctgtttcaaaaaaaaaatttgttgagttagaatcttaaaaatataattaattaaaatttagtgaaatgaattttgacattttcattggttctatccgagctacatatttttgtgtgtatctgagttaaatatgaataaatcaagaaaaaattaaataattaaaaaataacatttaagtgagcaactacatatcatatgcatatctttattacacgcataagttcaaaatatataatttcatgaaaaaaaaatcaaatccaaaatacttatgttttaaattataattattctgtacacgcttttatattttaaaaatattgtatgattttttcttgcaaataccaacaaaagttagaaagatcaagtggtgaaattaatatccattaattctctgttttaactcttataactttttatattcatttaaaaaaattatcttatgcaagcaaaaatatctttttagcaaaaataaaaattatcatccatattcacataaaaaaaattgtgcaggcaatttcctcattccttttaacgtggattcgtcccttctaattgtttaagactaataagattattataatttataagcagtcaaactttattttcaaatatttttaaaaactacatatgtttcttaaaaaaactacatatataaaactcaaactaaagcattaattaaactgaagtaattttacactaatttattagcactctcaattatattaactacgattacataaaattactagtagtttaagtttatataaaaaaactcttaagttgaatatttcctaatttatctagtcttacgatcgtttcaagaagaataaagaaaagggcattttggctcatgactattattcaaatcatccactatgattattatcattgtaaataaataaagcgtttacttcgacaatggcatagaatattaaattggagggaaagaaaaaataaattgagttgattccacgcagagaaggaatatcctaatgtgcccttcggatggcttcgaataccaagccaccaatcatttatgttatgctttatgcttatgatattcacattcttcttttcttcttcatcacgttttcgcccaatttctcactctcgctttcctacctctcatatcttgttcaaatctaacatccatcttttcaatataggtatcaaaaatctatcatgcatctattaaatatataaagattaattaattgtatacccaaaacttgtacgataagataataaaagggaaaaataaacttctacatcagtttaattttaatattttcttcttctgaaaaaaaaaccaacttcatataatttttagacatttttattattattttttagtttgagatacccccatttcatcgtccttgcaatttcataaatctttaattacttttgttctgtcacattgtacttaactgatatttcaaataagtttatggtaagtagagttttgcacgttttgcttatgatggaagcgccccacattatgttggcatgttgccacgttagaatcacctatcttaacccttcgagtaggttacttgtaattatgaattttttttttgaactggtcaatgttgtaagccgatttcatatttttagttttgagtttcaccatttaaggcgcgttcatataaataatttaattaaatatttgttaaaaaaataaatatgaattagtttaaatacaaaatatattaaaagataacttcttgtgttacatatagaaaataatacgtttaaattgatcgagagaataaatgtaagggctttcaagcttctggccagaatcaaaacaataaaataatatgtgaaagaaacatgcatgtctgacctctttccaaaatgcaacgttccacgcaaataaatcttaaatataatgccccaaacatttcacgcaaataacagacaaataaatgtttagggctttcaagctccaattgaaactaagtctcaaatataatgcctcaaacatctcatgcaaataacaaaacaaatacagtggtttctttgtcttgggctc

SEQ ID NO: 553 - DNA, 1700 bp, Glycine max
  Soy_ogl_5234 Gm16:1552901..1554600 Cluster 2
ttatggacattaaacaacaaagaaaaaaattaaatgataaaatttgacttgataattgataatatgggtccaacccgaatgaatgaattaactaggaatttaaaaaataaaataaaaatttaagcccaaagtttttcgaccaatctgattggattcagctatctcactcataatccatccaatctgaagacaaaaaattatcaaaattaggcctgttttgtaacatattggattggtccgaattgtcagagttatacccgaacccgacccatcctcaaccctaggttataaatattaagaaccgtattaatattgatttgatttgtatgtaatgcaaatagtccatgttttcacataaaacaaaaggtaaaactcaaattatggctttcaatttaagttaagaacgtactttaattttgaaaattctaatgcacattgaaacatatacacgatataagatgcatttagatttttaaattatatgtataacatctcttttctaaaagtaaaaaggcaatataaaaataatcttctaaaaaaaattctaatttctaaaggaaattaaggcgaaagctatttttaggttatttttttaaaaaaaaagcttattaaaataacacattttcttaacaaaaaatatttcatttgaactttcttcgaaaaagcacacaaactaaagcctagctataatctacctttaatttgattagccgacttttggtcaaagcatgcgtcgccgcatggtagtggactcatatccacgctgaaaacatccatctccaactttccttaaaaattgcgattagaaataaagtattgcagtttaaatttttttctaaaaaaaaagatttatatttgtttaattagcgtgacataattagcaattacttgtttatcttaaaatcttttctcattgtatactcttcttatcatatccacatgaaagattcataaataaaattttgacgttaagagaggctagcaataaaaaaaatgttaatgggtcaattacttgggtgaggtttaatttgtttgtagtttgatggcacacaaattaagtggagaggctaatataaatataattaggttaggttcctgaaaaccatatagtctgagtagtctcagagagaagatctctgcctctctgtgcaatgatctgcatgcctcacaattcgaatctctgacccctcttccccacactcacacgtcctaacaccccaaaaccaatggtcaaagacacacagacaaaagaaaacaaaaaacaaatgccctattagctagttagtgcgcaattcaactatttttattttgtacatatataatatgttggtttctgatcaaacctcagaacagaacctagctcatttctaacttcaaataagtggaaagtggaagctctaaacatttttaacttttcaccaccgtgacgctgtaactgtaaagttgattgaagaaagaggccaaggtcagaatcataaaggttctctttggaatttgaagcgcctaagagacacaattataaccagctagatctggctgttgttgctcgtgctctatggtacgatcactgtttacccgaattagtaccaatttgcaatatccaatcttattatcattaacattttggtaactctgttgtcaaaaacacatcaacaagaatggttggtgcagatgcctttgtgtttgttgtgcacccttct

SEQ ID NO: 554 - DNA, 1700 bp, Glycine max
  Soy_ogl_5300 Gm16:4715501..4717200 Cluster 2
atcagacaatctcacggccctaccaaggtaaaagtatgcaacttttttcttcctggttgaatttgcatatttgttttgatcatgtttacgtttgttcaaacaaacttaattatatcttcaagtcaatggaaatcataccacaaattcgttttcttttcacaccatgttgattgcaattcatcttattaaattagaggatggagtgtatcgaattgaaaacaaaagtctaaagtgcaattctttgaaggcatatacaacgaaattaaaagggtagtgtcataagccacatatataaaagactcaaacaaaggggtcagtactatgaaattctgaggaaatgaatgcataaacgtatttatataatatggtatatatagtaccatagtggctccaattagatattaggtacatgataaaccctagccatttaaaatttgttcctgagctagttgtggcacattggaaatcaactgagtcttacaagtcaaaagagtggatatggattctcatgcaagtttattgtgtctgaccgaccattgcttataaattgatattatattatttatttcctaataacaaaaggaaaagaaaaaaaaggggaagcctttttaaaagactatcctatatcccttacttactagctggttggttgttttatcttatacttttttagtctttacttgtttttgttccctataagaacttattctggaaaggactcccctgacaacttcatatttaatacagggtcgggtcgggtctgtctctcatatgtacatattgacaataaaaaaaaatccatatattactaccagctttaacaaaattaaataaattaatatgcaattatagaagtgtggtatatatatgtggaagataattagagctgggctggaagattaacaaaataaataatatgctgacatactctactagaattcagtttagtatgaggaattttcatccataaaaaataaataaaagtgaacctctcaatgatagacaacagttttttttttgaaggggataaacaacagtttaagcatagtttttttttttttttaattcccatagcaccggatggaagataattttgactaatcttattattaattctggacctttatctattaaattccaaggtgaccattaattagaaaaatgaaattaacaataaattattaaaattgaacagtaataatatgttattaagattagcatattgttactgtttaattttaatcatttatatttcttaaaagcttatttatacttaattaataatcatctgtaaaacatttatttaaattaaatgtaatacttttttatctttaacacaaggaaaatataaattttaaaattaaataaatagtaatataatttaagcttatgaagaaaggtatatttttcatacaaatgttgtcatcatgatatgttttgcagctatgaatttataaaatatttattttgttaaattttaatacgtaattaatttaggaatatgcttaggaaaccaaaagttaaattttttcattaaaaattgtaacaatatactcttttgtaatttcaaatatagaagtacaacaatacaagttttccatttattaatttcttgacaagtgctcaaacaatgctagttaataagactcataaatttatgagcatgctaggttgttccactccttttgaaattgacctct

SEQ ID NO: 555 - DNA, 1291 bp, Glycine max
  Soy_ogl_5607 Gm17:9552801..9554091 Cluster 2
gttggattcgggacgaagaaatgcgttggagatggaaatggattgaaacagaaacagtggtataagcaacttcacgggtttggttgtcttgttttacaagttgggttgttgattgtgatataggccaaccgcaacataataagcatggtgatggtgagcatagtaactgaattatttgtgtaagcaaaggtgttaggtaggtttaatacattatagtagtattttttttaagtttttacgtggttgagtaatatgatatagtgatattagagagataaaaacacactttaattagatataattagtggattatacaactaattatatataataaattcttatttgataaaaaaatatatctttcttttctaatagcatattactcgatagcacaagaaaatccaaattatacacaccacacatacgtacttttaaaattgagaaataaattgtgtaaaataattattaaaatgacacgttgtgtatgaacgtatagtacatgtacatagtaaaagagttattttttatttgaaaataaaaaaagtattaaaccttaactatttatccttcttatgaaataaataatgttaaaaagaaaatattcaatttgtgtgtatttattgtcatgatgaaaatcagttaccacttctagatgagattatttcatatcaatatatatatatactcaaaattattatccaaagtttacatgattttatatattagtattaatcattaaaagattctattaaagatattaaagatgatgattcatgtttcttaggaaaattaatcattaataaatatttgacagcaatattttgatgataatgaaaaaataaaaatagttttattgactgggcattgttgtgtgtctattgtttaaaaggatggggagaaaatattaggtgggataagaggattgggagctgaaatgtatggacagaaaaagcagagaaggaatagcgacaaaatgtgcggcagggaagtgtggatggtggtgggggctagacacaaggagaaatccctggtttgaatgaaacagtacctcaatatatatgcaacaattaagaaccttttcttcatctaacaaatttaaatttgtcgggtatgtttacccaaatttctctttcagaattgtattgcttatataacgaaaggctcataaaaatgcatagtcatctcaaaaaaattagtttgataagaatagaaattaggtgcaatactttaaatgcttgtgatattattttctacttaaaactgaaatattataaaacaatattaaaggtta

SEQ ID NO: 556 - DNA, 1859 bp, Glycine max
  Soy_ogl_5786 Gm17:39605442..39607300 Cluster 2
atttttgtactttcacctttgagatgtattggattttttttattaattctaattgtttaaaattaatcctaaaggattatcttaagtaatgccatgaaatcaacataatttcattaaagtaattctcactttttgttaaacgggagtttctttatacttgtaccttctaagaaatttcgggtaacaaactgtcaaaataaacaacatttcagataataataaaagtatgtgtttaagagtttgtaaacatgtagatttgtgtttaattcctaattatgcacacggagaaactttgttgaacgagataaaattcatctcaatgagctatattttgaaaagattaatctttgattattgactagaaatacctttaaataacacaaaggaatgtttaactattaattagagcaaacaattttctcttaacaaacaattcttatttaataataattcattttgtatctgtttaatagatttgcaaatttgaaagaaagcaataaatgtcagaggtttaaatgtgtgttcttcgttagcttaagggaaatgatatcgtatcttgtagttttaaaagatgagttgatttttctatggtggtgttctgtgttcattgatggttgagggtttacctacaaaagtttcaatgtctaagtcagggatgttacgtacaagagcttcaatgtcttggttagtataaatcgaagttaagagatggtaggagaaaaaataatagtgaccttttctcaaattgatccaaagtatttatgcatctctgttgaccttattcaaagtatttaatcaaagttacacggtttgaaatttgaatgcaagtttgttacccctgcgagtttaaactgttgtggtgggtgattgaatttgtttaattagtaagtggatcaacctaatggagccattatagatctgaaccgaggttcagaatttattgaataaaaatttagttatatataatagtcatttttttgtttaatatgttacacaacaattttgaaaaatactcatatttatattagtatggatttagtaagtaaattttaaggaaatatgaattcttcttatattaaaattaaaaattttaagattttacgtatatttatttatcacttaaaaattaaaaacaatattaaataatatttacttttatctctacttagtttttaaatattgacaaacttatcaaaaataataatgataataaaattatcttaagagattaaaattaatacataaaaatattaatatactttttagtctgtatattatcttcttaaactgacaaatacaataggaagaagaagaaacaaaaaataaataaaaatagaaatactagtgcaataccaaattgcctcgaggatatggtcctttgactcctttcaggtttgggaactaggaaggaacccaccgagaaagtcagaagcattttcctattagtgagtggatctataaaggaaccctcaataatttaattattattcttttagtagtagtttaaatatttataattataaattattttaagtgtaatttttaaaataattattataatgattataaacttaagattcatattaatttaaaattgaatgataatatacaagtcggaaccaaacaaatcgacgtaagaattataagaagaagaaaaaaataattaagaatgagattttaaataataaaaaattgtaatatctaaaaatttcgttttatttaatttttaaaattgtactaaaattaattataaaaatcatgttaaaaacaagttactacaagaacaaacatctagaaatatgtaataaaaagaaaaggagaaaggtaagggatgaactggcttagaaaacgacaaattg

SEQ ID NO: 557 - DNA, 1400 bp, Glycine max
  Soy_ogl_5796 Gm17:39678001..39679400 Cluster 2
tattcagctttttttagaggaaataacttattcagttaaaaactcaaattcataacattaaaaacgatttatatccattgttttagattttaataaaattaattgtaaaatgattgaatttaatgtaatggaaaattgtgtttcaaaagtaacttttagaagaataaattgtatttgaaggataaattaaaacaaactttaacgtgtttaatgaaacattttcttttagaagaattaattgatatatactgtcaaaataaaatattttatacatacatccataaaaaatcacttaccatcacctgtcaaaataaaaattacttcttctataaaaagtattcatcattaaatataattatatatgagttaattagtaaaataattatactgatttctaatttttctttgtttttggaagagtttatttaaaacttatttgaacttgtgtaagcatgagtgtacttataaaaatagcttataatttctcataagatatattttcaatttatttcaataaacattttaagataacgaacttataaaaataagttataacttatgtgaaaacagtttaactttatacataaatatcatcataatcataaatatctatattatactctttttttttaatgaagtgaaggaaggaaaggccaggataggagaccaaatcttaactaagttggcatctgacccctattaggctcaaagaaccccctactatattatacttatttaataagcagttagttgtttacagaaacaaatatcattgtatgttgggggaaagaaccaaacatcacctaaattcttgatatttagaagttactctcttgaatttcaattaattcaagtcgagtacgtcaatgaatctacttaaataatcaaaattgaaatttcttccaacaacttttataaataaaaaaaacaacttattatattcgattgaatgattaagagaaattttttttttaaaaatagcgggttcaataaaaaatattttctgccaagccaaataacataatatatcagaatttctcaaaaaaacagtgtttgcagcagagtggaaattcagaagcgtgcgtcaagtctattaactgagacaaaggcgtgcgtgtagttaattttctgcgcagataagttactttctctttttttttctttttttttccaattctattacatgcgtctttttataggctcaatctccaataaacgaagtgggggcgtggtggggaaacaaagagaaagaaatgcacagagaagaagtgactatagcaaacaagtgcatgcaatgcgacagggatcgatgatggcaagtgatggggtatgaaatggtagatgatacttagtatattgcggtggttgtggattttggaacctaagctaagctatttgtg

SEQ ID NO: 558 - DNA, 2000 bp, Glycine max
  Soy_ogl_6521 Gm19:42836401..42838400 Cluster 2
acccgcaaacaattacaaaaatcactgctacggctggctttgggaaacgcaatagttgctgcattacaacaataagaacttggactggacttcacatccgccaaataggtcccacagaaggcaagtaattctctatatccattgcacgtttcaggaaaataaagttgataacttgcactgagtgttgttactgccaaaccataagccatgacaaacatcacaagagccaaaattttcttctccctcatcttatcttgaatatgaatacaattaattgttttcagtattatgaagtttttatcaaccatttgtagcataatagtagtatatatagacttgttcacaagttttataggtttttattttttagtattaattaaacataattatgactttttttttatacatcacatatgttttttatgggagaattatgtttgtatcttgttacgaataaaaaaaataaataaatatttaacataattacatatttatcattcaattcaacttgagatatcttatgactcttgttcaatgcttttattcctttcattaataataattaatgataattttaaatgtccttattaactttcatggtcaatgttaaatgctcttatttctttcattaataacaattaatgacaattttaatcgtccattgctttttttatatcatttattactatgttatgttgcaatccagcccattactacctagttccgttttacatatctatctgttaaggctattttgtagtaaaaatgaaaaatgtcataaattttcttgattctaataaaataattgtgagattttttttttttactttttactccactataaatgtatttgtaaattaattaaagagaaaaagataggtgagaatataattgataaaaaaaattaatgtgatgttgaactttataaattaaagataaatagaaacagaatttattcaaaagtttgacaactaaaaagaaacaaataaagtattaaatttattagctattctaacattttaaatatactataaattatagggaactattgacttgagagacattatcgtctagtaaaggtactattaatgttttttatttcctaatatacaaatatacataaaacattaggaaaataaagctgatgacttgcaatgaatgttgtgattgtcaaaccataaatcatgacaagagccaaaattttcttctccttcatcttattttgaatatgtatacaactgttatcactattataaagtttttatcaaccatttgtggcatgatagtagtatatatatagacttgttcacaagttttatcggttttaatttattttgagtattaacgaaacataattatgactcttgttaaatgcctctatttctttcattaataataattaatgacaattttaaatgtccattgttttttaatatcatttattactatgttatgttgcattccagtacattaccatctccttactttttatttgtcttttaagattcttttgtagtagaaataaaaaaaattaatagatttttttattctaataaaataattgcgagcttttctattttaacctttttttttcactccataataaatgtatgagtaaattaattgaagataaagagacaagtgaaggtataattgataagagaatcattaattaatgtgattttgaacattacaaatgacaaataaataaataaaaatctcaaaaaattcgacaattgaaaaggaatggagaggatattaaatttattagctattctagcattttaaatatactataaattataggaactattgacttgaaagaaattatcgtaaactaaaggtcttgttaatgattttatttcctaatatatacaaatatatgaaaaattgtgggttaatcacatttatgtactgatttataagaggtgatactaattcatttcttcttatatatgcaatcattattaggtattcaaactatgaaaaacataagattc

SEQ ID NO: 559 - DNA, 1920 bp, Glycine max
  Soy_ogl_953 Gm03:38977081..38979000 Cluster 2
gaaaaatcataaaagaataaattaaactttttaagagataaagaagagaactaaatataattaaaatcataaaggactaaaagaatattttagtctttaatttttaatacatccctaaaccctaacttaaacttaaaaaaaagataccaatttatattttttaataatttgttttaatgggtccaaaaaatgataaattaataaaaataagatgaattaataaaaatagatagaaagttttaaaatttatttttaagaattagcttataataataaaatatatattttttaaattgaaaaatagtcaaatcttctttgaaacatgacagaaatgcccctggttgactgtaaacgctggactaaaaacattttagcccaaacaaattacaggaaaatatcaatatgataattttcactaaaaaatttatttaaaacaatttttttaagaaatttcaaaaattaatacttatttggattaaaagcaatttatttcttatttttagttaaacataatatatatatatataattaactattatttataaaaaaaatcatattttatgataaattgattggtccgggcgtgtgcatccaggccaaaactcattgtttcttcttaaaatcaaaattttaataaatcgtatcatttcgcattaatttttttaatattagttgttaattttattaatttttattagcaaaagattcgaataatggcctattatttccttcttttaccttttatcaccaaacagatcttatatttttcattttgcaataaatttaattatacaaaatcattaatataaacataattatttaaataaaaaaatatttttttttcattcagcaaacatctaagacttgtggactatttcagccaatatgctctcgggttcaaggtgaagttaattttagttagtttattataggatatccgtaagcatatacattattagaattaatataattactctatatatttagcagaatgtctctggataatattgggaaggatgataatatagacgaagaagctcttaaccaggtacttgtttctcccttttgacttgtaactatcacataagaattttgacatcttttttgtaaccataattttgaaggttttggtaagaaaccagatacgaaagaaaataaatgacatcaaattgattttgcattccaaagaagatggagaaataacaatatcagcttatgacacggcatgggttgccctagtgaaaattgttggggggttcaaattcaccccaattgcactcctgtcttgaatggattgtgaataatcaactacctgatggctcctgtgagacgctaaattattcgtagcccatgatcgtattcttaacacgttattagcttgtgttattgcattaagatcatggaacatgcaccctgacaagtgtaagaagggtaactttatattcaagaatttcattcttgcttttaaaaaattccttgtgcagactttgatattgtttcttttctacaatactttaaattcacgcctctatttcatagtaaaagaagaggagcgagaaaaatttctccttttttccatcgaaaaaaaagtgagaatttaaaaaaaaaaataaagatcgatgtgagagaaatggtatagtattctaattgcgacattaattcaatatgattctattatgcgtatacattcatatgtaacaacggatcacaaaagcattcatatgtaacaggaatgacattttttaaggagaatttgtacaagcttcaggatgaaaatgcagaacatatgcctatcgggtttgaagttgctttcccctctcttctcgatctagcaattaagaagttctaatattgaagtgccagaagactctcctatcttgaaaaacatctttgcaatgagggacctcaagcttaagaagt

SEQ ID NO: 560 - DNA, 2598 bp, Glycine max
  Soy_ogl_1574 Gm05:3417501..3420098 Cluster 2
tcgtatataaagattataagatctaaaataaaatttacttcaaattttaatttaatacactttgttaattttttaaaaaaaaattgtgagttgctattttaaatattattcaaatttcaaattgactcaattaaagatttaaattaatttatatatacaaaatatcaacatgaaataaaattttaactaagtgtgtgatcttataattaatattttttgcaaaaatatctttttttatatatcaaccatagacattaaatttaaattttatactaattttaatagatttttttcagataaaggagaggttaaaaataaaatagatatgaaataattttctttaatattttgaaataaaattaaaattttagataaatgatttaaccattaattcataacttaagattatgtagtcttattaatgaaaaaatgattacaaataataaatcatatcttaacaaaatttatcacttaataatttaaattgacaaaaaaatattaaaaatgtaaaaaaaaaaactcttgagggcttaagacaaaggtctcattggcttttatggtttccacgaccctgatccaaagtcttaagagtttttgtcaaagtgtgatatcaaattcagcttaccctcatactccaacatttcttatgataaatgaaaaaagaataaatgaaaattcattttatccacactttacagtttatgccttatgataaaacaataaacaaataaatgaataatcgggacaagaagcttgtgctctctcttcatcttagaagcatctccaagttatttttgtattttagtttttaaaacacttgtttgggaaacagttttcaaaacataatagatttcagacgataaattgattgattaattaataaagtagaattgttttagaaaatagtttttatataaaaaaaaacaaagttcaaatttctacacctaaggctgttaaaaaagaaactaaattgaattggtgtctatgccaaaaaaaaaaattgaactgttttgaataaaaagctgaattgaatttttccatagttcagtttttaatttttaaaaactgaattgatctaaaatcaaactgcttgaacggaacggtaacatatgagattaaaaaatgtgagaaatttactctaaaataagatatttattgagaataattcaaataatttggaacagttcaggataattcagaatcatttggaacagtttgatttagtccgaactattacctaattcagtttagtttatctgaactatttttaccgttcagttcatctattttgtccattggtcccacccgtctataccaacttataataagaaatgttccggagacatattattgtggcttggtagagcagttaatggaagaaaaaattcgggtggcttggtcattcatttatattagtatgctataattcaatagagtcattttatttatatatttgggtgactcagttcgcattgcaaatccttttaatatgaaggggtctaaaatctaaatgaaagttgggttacggaaccaatagtccaagaaaataacacaaatttgaatctttcagcactatctttatctgcggttgaaagaaaataacacaatgacgacgcctgtagcagcattcactccactgtcaaaacaatgatatgatgagactccaaagcacctccttaggtagatgaaaataattttgaattaaagatgaacctctgatagaagctgtttatattatcagtaaaatgaaacaacattgactgttgctcctagttaaggcactgaacttctataatactgtatccataattggataacaaccaagaactcgaagaaaactagcaaattcctgaaatggaaatcaaataaatagacagatgttaccaacaattagatctggcgtttgatttgaaagccaccttttgaagacaataatacattaatttaatactttttatttttattttttttgtaaaaacacattagtaaaggaattttaacaatgtgctaagcaattgatatggaaaaagagttaaaattagtgaaggcaaaaggctttcctagcaggattgtgaatatgtcatcgggtcaagcacataacacttaatctacaaacaattgtgaatttgtgattgtgggtattctacgtatctccatatatagaaaagctcagacattttattctacacaacttatattagtgaatgatatcccaccattaatacttgaatactcagatcaataggattaaatgtggtatgatacaccagagcacttactcgctttgagacatttcatcttatctcctaatccttttttggtacatacatttttctttttgtgcatatcttatttcttaatctaaacatcctagagataagataatattcttttaaatctaaacaatatcctaaaaacttaaaatttaaattgttttccaacattctatacaaatggtcaagaattaaaccttaggttagcatgctcaagggactaagtgtgtgtttgtataagcattttaacctcttgttgaatcggatttcacacattctcaagcactaacatgactgtaaaaatttaaagcttttacgttgaatg

SEQ ID NO: 561 - DNA, 1700 bp, Glycine max
  Soy_ogl_4475 Gm13:36155801..36157500 Cluster 2
aaggtaaagcattcggccaaaagacatgatttcaaggaaaatgggaaatttgtcacatacacatgaattaattaagttcaataagctaactaaacaactagcacgtgagatcccaagaaacagcaatcactgcagttattattatgtgtttaaatgatcggtaatatttgttttttttcccacagctactttctttgaaaacattcatggaggaagtaattttgtttggttggatactaaatatgaatatcttttttagaattttttcaaacattagtctttagtgaaagagaaatggaatgaagataaaagaaatataagaaataagaagctgaatgtgtttagtaaagagataacaacaaagtagagaaatttaaggagccccacacaaaattatatacatgccaatatacaaaaaatgtgtgaaattatgctcgctttttgcatttattgtactagctcattttctcgcactcgtgtttgctacttgttcatgctcattccgctagtagtgatctgctttttcttttctcaatcgcttgtaattaattttttaaccataattgggtgagttgcctgtgcgataatgtatttcaaatgacatattgaggacaggagcatgtttacccatggtatactatttatatgtacatgtaactatataatcgtttatttgattattatgtatatgtaatcgatgatatgtacataatcatataatccattatatgtacacataattaattatgtgcattaattatattggaaatgctataacatgtttagatatgtacatttgtgttgtttctttatgtatttttattaatatggcaatattgattatgcatcgttctgtttagataaaaaaatcccataatcaatataatcgattgtatatttatacatttgtttccaaaatgtcatatattcaattataccaatagttagtgtaatcgattatatgaaataatgaaatagtgacgcggtgatataagcttttgttgttgcattcatatgaataaaaataatttatttacgagagaatttatgttcaattttcattgtgtaaaattttcttggatcaacgataattatataccgtgaacatgattaaactatgaccaagtgaattaagggacacctgtgtactctgccttaggacaaaaagaatccaacctgatccaagataaaaattgaaaatcgtctaaaaaccaacaaaattaatattttttggatttgtttggattgatttttttttttaccaaaccaaatagttcaattgagttgtgattgacatttgtaaaaccgaatcaaaccaaatcaaaacacaaatatttacttattataatatttgtttattattgcatatatatttgtttattattgcatatataggattgaattataattcattttgtttttttacacctacagcacaaatatacaagatcaaattataattgattataagtgtaatttgaatttaattatacttgcatgtgttttgacattttttaaattaaatcttgtgtctaattgtcattataaaaaattatttataaatacttaattaaaaaggagcatacaatgctctgacacttcttaaacgtattaaaagtccaatcaaatcaactataagagttttatgcataaattaaccaaataaatataaaaaacttatgaaagaatacttagataat

SEQ ID NO: 562 - DNA, 1757 bp, Glycine max
  Soy_ogl_1952 Gm06:14924801..14926557 Cluster 2
atcacttataagtaatgtaaaataaaaaaaataaatatatattattttgatgcatatataacaaatgattattatggtgtagtggtaacaccttgggccacctgtcatccacttcggactggattttcactggttgaaccagactttggaccgttggcacttccatgtatttctagaaattcacttatctattaccaaataagaaggtaggattaaatatgactttagttcagggaagattacacttcctttgtaaatttatatttttcaattttagtatcaaaattgtaaaattaaattttaaaataattaaaattgaaaaaaaaatgtaaatttacgaagactaaattcatctttaaaccaaaaaggtattgtgaaagaaaaaaaaaagacaaaataacaataattttttttgttcactaaaataagtttagaagtgggaggtttgagtaaaatatgagattttaggtttaaatttcattgttactattatacaagtaaaaaaaaaaaaacttccttttttggatttaaaatgtgccatatggttacataatttagattatgctgtaagttaaattttgtatttttttttatttttcaccacattaattatttaaacatcataagaataatatcattatactcttttagttttatttgtacaataatttcatttcactacatttcaaatatccaaacattgtgttaatgttcatgcacaaaccgtgttttaatcacatattttaaaatttgatttgaattctaaatttaatatttattttgaaatattataaagtataattcttatttttttttcatttttttaatatttgataggaaattttaagttattcatatatactaagagttaagtaaatgggagaaaacagaaaattaaggagaatgaaaattaatttaatgggatccatccattccaaaaatatttttcccactgtgaaataagagaagagaagaagtgtgtcactttttaaatgtttaaaaataaaattagtttttataaataaaaatcaatgaaataactaatactgaaaaaaggccaataaaaagttcatatttgatttttaattcatataaaacatttttgcaatatttctttctttctttttactcatataaataaattaaaaaatctatttattttcttctaagtgttatctatttaaacaatgtatatttttactttattattctttttttgaatttgttttacttttaatccaaacaaagaaagatgtagacataagcaaatggtcttcttatggtgatctagcttccagcaagtccacttaacgtggagacataaatcaaatacccgtcgcaatcaaggattaaggaacaacgctgggaaaatgccacgtggaggtggagcctctcaaatgcttatttaattaatcacctcaaataatctgagcaaaaagagcaaaaccctgtggttaggcttctctcgtggaaattggttttcatagattgaagttgttgacaaggatttttatttcgtcaactattttttctcatgtattcagttttttgctattaattttgtataactctgggattgattttcacaaaattaattgaaaagctaactagaaaataagaagtaagttggtatctgaaaatttaaagttaataattaaaagtttttaaattaacttattaaatcataaatttttggtaaaattaattgttagaggaaatacaaaatgtaaaataacacatttaaaaagtgtaataag

SEQ ID NO: 563 - DNA, 1648 bp, Glycine max
  Soy_ogl_3197 Gm09:39656468..39658115 Cluster 2
ctataaatatttatggaaaaaattatccaaaacacagcacagtaagttctattatatttctaattcaagttatttcaactgccactgagaaaatctttaagcgtttaaacttgcctaatacaaatcaattatctgtcacccatcaaaaggtgagttaataaaaaaatttaaatgtgggataatgaaacgagttcatatcttatgaaaatgatttttgtgagcagattatataatcattttgtttctcccggtatcaaaatggatcgaacatttaagatatatacattctttaggggaaaagaaaacgacatcgacccctaatccagattaagggaaagccgagtccttacacacttcatccattcttagttaagcacgaggtttgatataccaaaaagaaatccattattgttgggaacttgtacaagttaattcagtttcaacttgattaagatttaaacataattgtataaaacgaattacgatgtcgctattggatggtctttcttcttacaacctatgcctgccacaataacatattccaagaaagtttacacaaaaatagaaaaaatatattcgagttgttatatatattttttaaaatttaacagaggagagataatattattcaaattccaaaatcatcccacatgagaggtatcttaaagcataatagataccaacatgtgattgcttttagtgatattgaattcgattttttaagtaaggcatgcttcaattttgtggatgaaaaaaaaacataattaaataaaaaaaatcttattaaaagtgattaaataaattattttgataaagattaattatcaataaaataaaattgataaagattaaaaatgatttaaaaaaatcatacaacatgtgattgatcttaaggaccttactatgtcaatactcaataattataagaataaaatatatatgctttaagtttatttttaatgtttatgaggtaaagtaaatcttgttcgtgcagtttttgttattccccaagtcttttttattcatgtaaatttgataggatttaagtggattttatctgacttaattttaattgctcaaaataatatttttgttgccattagttaagttatttaacatatttaatttaaataagcataatacagtaaattattgacacaaaatttattgaatttagctttaattatttcaaagatttgaaaattggtttcaaattaatccaaattattttcttttctttttgcaatgagttttacaaagacagttgattttctaataaaacagaattgattcaaattaaatacacattttttttaaaaaaattccaaacaaagaggattcgtgttatctcactaattaaataaattatttcctcatataagaagacagtaaaagcttacaccgtcgtgtcaatcttgaattatttatatataaaaagagattgcttgtaaaggtctttaaaaataaaacaaatttaattaaaatagaaaaaaaaaccaaataaaaattgaataaataatagtcatacaattaactaataattatatatatatatatatatgtgtgtgtgtgtgttagaacagtaaaaatgatttttaatttagaattatacttaaagtttcaatcaatatttcaacatactcgtttg

SEQ ID NO: 564 - DNA, 1131 bp, Glycine max
  Soy_ogl_5767 Gm17:39012870..39014000 Cluster 2
gatagtgtaaccaacattctgataatgtaaatgtaactagacttaggttctttaagcttaatttaaggttaaagtctcggggataaaaaaaaatatatagttaagagaatatacactatatatattaaaagataaacttgatgctaaagaaaaaagaaaagtcatttgtttgaattctccattaataaaaaataataattaatattgacgtataaataaataaaaaagagacactaaagatgaatcatgtttaaagaatacttcaaatctataatatgataaaaagatgtataatatgaaaaaaattagattatgaatagaattttaatgattttttttatatttataaaataggaacatgggaatgatgatgatgattgcaaagatgataattgggcccgttagggtagacccattgccatacctgaaggttgtcttctcactcaccctccaatggagcccactcctcacatgggtacatagtgccccttgtcggacctattgctttcacaaacacacaaatgggtctctctcatattgaaaggattgccaattgggctcttttacttgccctaattaagtagtaaggtatgacacatcataaatataccaataataaacctttttcattcatctttgaataaattgaagtttcaatcaatcaaacccccccttgattccaaaacaaactaaaatccaaacaatggcttaggccgaacgtccaattcaatcgaaatacacacaaatttgtgcagagacacggggtatgatatacctggaaatgaatcaacaaggagggagaagaaaacaaacaaaagatataaaaaaaaaaaagttttttttattattatttttgttcctaaacttgaaagtatattctttttaatgctaaaagttaaatattctcttattagactctggatttaataaattactcattttagtctctcacataataaattttgactcttatatggtaatttttaatactttatcggttttagaataaaaattctaactattaaaaataaaataaatttataataattaaaaattaaatcatgcgagaaactaaaaaaaataatttatgaaaattaagagtataaaaaaagcaaagaatcctccaagttt

SEQ ID NO: 565 - DNA, 2148 bp, Glycine max
  Soy_ogl_554 Gm02:14901501..14903648 Cluster 2
ttaatggctacttcatatcggatctgcatggagcatagtcgggaatcagaaaggatgaatggggccattgaccagagtcatgttaacgtgagccctatatcatatcgtgggcgccggaataaaacgaagtactcaattcttgaattgtgtacaaatctcggcacgaaaataggttccaagattgaatcggatgaaattatttccgaagtacaaaaccgaagcctaactcgtacaatttttttacagtaatttatttttataaatctttattgggaaatttataaacaagtcagaaatttactttaaagagtaatttaatttttttaaaaaaataaaaaattatcaaaaaagatattgcttcctttttaaaagagaagtaacagaaagcaagggaattaaagatcagagaaatattttttttaaaacatgtccctaaaatgaatttgataaaacgaaaaccaaagttggttttttttcctcataatttttgtgtagattactaacctacttcaactaaaagtaggtgcaaatatattagagttttttgtatttagatataccaattacatataaatataatcagattaagtattagaatggctctaaatgaacattagaagagaaatgaatagacaatcaccatcaataaaaagtaaacataaaaatatcaatagacaatcaccatcatgaattttacaaagtctagagatatatgtatagtttctccaagagacgcacaacaattatggtcagaagtgatgctgaaaccttagatcattatggattgactatgattctctttgtggttgtgttgagatgttgatgaagtatagaatcttgagatcttcgtaaaatcatgcaatctctaagtcttggattgatatggtcatccttaaacttggtactgatctaaatctgactatgagagaggttaagatctagataaattttttacgtcaggaaatacaatcgttgtaattttcgacttcagcaataacataatgttgttgcctctagtgatgcttatgatgtgcgtgacagacgtttgaagtcagatagagatatggtggtttcgcgaatcggtatagctagctttttgtgaaaaaataaattagcatttgagtatgccaatttgtactagttcatcagcatatacactttgtgatgaaataaatagcctatgcatccaattagcaaaaatagaaagaaaatatatatattatctggtaaatgcatgacaggcagagagacagatgatcagcccaagacatcgcaagctattcttatctaacttacttcatatatatgatctgacactgacatacccacgttgagtatggtctaagtgggacaccgtgaatataaacatagaaactcaagtgaaatcaaagtaatattaattttgctaatctaatagttaggctgagaatttgcggaagaaacgaaattaaacaaagtcaacgtgactagctactgcctaattaatctatatgcaaagacaccctgtgtcctccatattttcgttcttggaaatgttatatatcttcccggtatcttgataatcaaattaattgtgcaaaatcctagtgttaatttataattttggttttaaagccagagtacagaggcagagagatgctagctagctagcacggagcaagtacatatatatgcatgcttgatcacggttttacacaactaaatgattcttttccaccagtttggagcatgcgcaatagagcactattggtgcaggactagttgcccagtgtggacaaattaaattaagttcgcatgcaatatatactatatgttacaagtttacagctcattctttagtgtgtgtagatatatatatataatatgtcatgtgatcaatcttaacatatatgtatgtgaatgagtaacactggccaagactcttatcactccaactcctcaacaaaataatataattttagtgctaaaagaggagttagatattaatttagtatgatatcatctatttttttttagtatattcgttagtacatttatcattattcaatgaatttgctatatgtcacactaaaagcttgattattttttcttaaatatgtttttggtttcggtaagttaatctttttttttttttttggtttctataag

SEQ ID NO: 566 - DNA, 3700 bp, Glycine max
  Soy_ogl_307 Gm02:1164701..1168400 Cluster 2
ggatcaaatcaaccaatttattttacaaaaacacaaatcatctaatttaactataaaaattcagtaatgatataaaaaaacccttgtatacatttaattgacattcttcatttttacatcatatcacttatcacttctacaatcctcccacttttatcttattttatatatctctaaatgtaaattagtgcaaggtgtctatgaaccaattttcataaaaattacgtggtcaagctccgttatgaatcgcgttgcatttgttccaaaggaagtgaagaaaaaggagagattaggaattatagaaggggaacctctccttcattagccacgaggtttacgccatgaaaacgataagaacagaacataaaaaaaataaaaaaaatgatatgaactaacaaaaataccagtaggatcaccaaagatgaaagcctcaaggccattgataaatgaagattcttaagagtcttctggatgtgaccaagctgctcagtggatgtctgcagtggaaattcaataaaatcatattgatcgagatttgatattctgaacatgtgaaaatactccacgcttttagtaaaatggtaaaattttggcaataaggagaaaatatctctccagaatatctgatattctctgcacaatataatatattctcaataatccaaacttaatctttttcattattgcatctaccaaaaaataatacaatttaatttcatttatactcatgatcaaaagtgtagaattgggcatgcctatagcctttagcctgaacaatatttaaacgtagaatcaaacaattaactaagacgtacaaagtgccaacatcagatctctattgatttagatatgaagaaatatgaaaaggcttccatgaaagaatttttactttcttgatttttccttgtattattacagatgatctactgatataatattgatcgtctccgttcccaggattaggagaagaaaatctcttgaaaaacaacaaaaactaataaaacaaaactatgcattagaggaacatgcattaacctgaaagtgaaagaggagtgtatctaaattcctccagtcatacttgctggtatatatacttttaaaatgttttttgttactttttttttaatgacaaacagtatagtttaaactaatgttctcttccactttaccaaactctttaacaaaagctaaattcaagtgacttaaattttattgccttaatttatcagttttttacataattatggtttgttatttttatatactacaatctatgcagatttagtaattttttaatattttgatgatgacaaatgaaaagaataggtaatgacatatgcgtttttaaagaaattaaatgacataacttataagttttgtaaatatcagcattacaattttatacatggacatttatggaaatattggtaattccccttatttctaatactggagaacccgcacattatttcattaattcatttttcaaatctttttggttttttacatgtcctctttcggagacaatcccgataaacgattaaaaattaaatatggatatttcttttgactaaaatttgaactttacttcattacattataagaaattaaacccttccagctagacccaaatcccattggttaattttccaaagtatttatatttatttcattccaaagtgataaataacggatttgaacttgtgacttaattgtcatatacaagacacatcttgctccactcaattaaaccttgaggttatattatttgtgtgtaatctagtcaaactttgtatcagtttttaaataataaatatgcaaaaaaataatttaaaataatttttgcttataatttttagtactttgtacgcactttaaaagcatgcacacactagcaagttatcagaatattttacatgtaattttaagtttaagtaaaatcttaaaagattaaaaaacatcatcattgacaaatacaaagttgggtgagttttatttgcagaatagtaaagaaaagcaactcataagtagctttttatcataagaaacacacatatatgaaaggtattttataatatcatcttattaataaatatatttagaattaaaaataatattttaatttttcagatgataaataattcaaaataaatcataataatttaaaaggtagtgattattttaaaataaaggcacttttggccgggttataggtggccgaaagattataatattctattaatttaatttttttattatagattaatttttgtaaaattgcattgtggacctctaccaatggctataaaacacattgtgtgcgactagagcaagtagacatggaaatgcttccccaacttgttccatctacttcccatcccgctaaagagattaataggcaaacttttgttgttgtgtaatataggattcaagtacaatcatggattagtgtaaaaaatactttgataataatttttttacttaaagaaagctaacaaaattttaacagaaaattttaaaaaaagtatcatatatatgctctaatctactaaagaaggaaagtgtgtaatttaacataagaggggtgagagtagtgtagttctcacatctttattaaaatatagaagtgttatttgttcttagatatattataattttaatgaatgattatgatgttgataaaatttattatgtaatatttgttattcatttcatttttttttcactatggtcatccgctgatttttcaaacctaaatctcagagtatcagtataatttactttaaaaaattgtataatttaaaataagaaaaaaataatattaaaatcttttaagatagaaagaaattattacataatgaactactacatgtctatagtctcaactaaattccatgtgagacgtaattgagtttctaaatttaccagaagagttaataaaatttgattatgtgttacaggtaaattgctcaagattgtggtagtcccataacatttaataatttctgccaagttaggatagtgtgaaggatatttagttataaaattatttataataaataatttaaaaatataacaaaatataatttatttgcattactcaacaaaaaagtatatattttagctcgagacacgggaggacggtgtaatgcttatatttaaatatataaataaataattattattagattatgattctatgaatgtttaaataatttgaaagttggtatacaaactcattaaaacaatatcacataactaaataattgaattgataatttttactaattataaaaaatataaaaagaatgaatttattaaatttgacaagtcgcatccgttaatcctatcctgttgcatacattgatgtattatgcgttaaaataaaatataacgaaatatcaattagtttttataattgtttaaaattttttatagttaatgagaattttattttttccatcggaattttacttaagaagacaaagtttaatacctcttagattaataatttattaacttattggttctaataagaatgtttaatgtaatggttagattgaaaattttagattccatgcctcatacttaattttatagtacttaatcattaattcttgtgtttctagttggttgaatgttatgcctaatgaattaatttattaacggtgtattattttataattttttactattattt

SEQ ID NO: 567 - DNA, 2102 bp, Glycine max
  Soy_ogl_1935 Gm06:14008601..14010702 Cluster 2
ggactattgaatttctattattttggttggcataaacagtcaggggctatcgaataattttttcaaaggatcgtgaattcatgatgataagataagaaatggttgatgtggcaaaataaagagtaatgatttgattgagcaaattttggctcataaatgtaaaccgtatatttcatcgtgttacatactagagtgaatccatcaggtaaattaatgtaaggcattggctcatgctgatgagtggtaggattttgtagttctcctaaatttaattaaagtatttaatataaaaaatctaaataaagtattatatctcctatgagtcctaaagctgtaaaaaacatatgaattaaataaaattttgaatggatatatactaactatatcaggaaatcttctaactatttctcatgttataatttaattttttttactattttctattttaatattttgcatactgtttctatcatattacaggattttttaagtatatcagtccactaacccacccttaaataagatgaactatatttttttacccacatctcttgaacagcaggttaatcttcccaaatccacttataacagactaatattgaagcacgtacgttaacctattttgtcacacttaacttaaaagtcgaaccaaattaaacataccaagtaaagtgtttcaattctatatatatgactgttttgggattcatatataaagcaataccaacaccaacagataaaacaatgaaggagaagtaattgaaaaattttaggagttcagagaaaaaaatcacactgttcatgttcagtttaacactatgcatgtttgatttttgaaatttttagataaaagaattatgaaagtgaaaaattaaatatttcattatctttattttgacataacataaagtgaaaataaaaacatcaataaaaggaagaaaacaaatataagtcttgtcaaaaaaacaatcttcacaaaaaaaaattctatataactatttaccctttttcaatatatttatcttttttaatacttgtttaacttttttctttttagtcttttatagcattaaataagtaaaggaaatgaactttcttatttctttactttcattttaaataattaaaaaatgttgatattatttccttaatatttttctaatttcttttctcattattttttttccacgtccatacatattacatagtgatagtggaattatgcaaaagattctaaataaatcatcaatcatgtggcacttttatggtaccccacgcccgtgctggaatcatacgagtttttgttgaaggtccactggaaaagcaaagcaaataatgatgatgaccatgacatatgaaaataataggcaacattgagcgacttgtcagcgactcagccaggacagaaagccattctgaaatgagagaaaatactgtcgataaatttatttcaccaatttagattttaggtattgagcaaacactcaattatttgatctttcaaaagtacgtaagttatcacattagtctttctcaccgtcacgttaattctgtatggtaggtattgaaaggattaatttcatgatacattcaatttttaaaaaagaataatgtagtgatgaaatgtttcaaaaattaaagtgatggaaaattaaaaaagaattaatgattagtttttttaaaaaaaaagactaatgtagtgatatgtaattttatacattggtaatataaggattttcgtacttaaaattaattataattgaaatcactttacgtattactttttaaatattaaaaaaatcaaacatatattaaatttttcttattttctattttgaatttttgttttcactattttctatacaaacttataaattttaaaataagaaataatgtgaaaatacaaaatgaaaacaatacacatttcttatttttagaagtcaacttttctttctcttctttctactctcttttcaatagaaaacaaaatgcataatcagtcatgctttgtttttattttattttctttcctcacatccaaaaaaaagaaaaccattaaattaccaacgaagagtgatccttcacaataaaatttgacttgt

SEQ ID NO: 568 - DNA, 1400 bp, Glycine max
  Soy_ogl_3217 Gm09:40079001..40080400 Cluster 2
atttgtgaacgcctggttattgtgattataatactttgcccaaaacgtcagccaagcagacaaaataaacgagacattttaattttattttattatgttttgtcttactttttttggataatttttttttcaattgcttgtcttatctgttatattcttaaatatttgaaacataaaataaaatatattttgttacattttattttatcacatttattaaatactaactaaaaattaaacatgtttaattttaatcgataaattaactggctaacgcatttgcttcatttttttagtgattgttttgttgaattgattcattttagaggacacactacaattcctatatttattaaatttactattattgttgttgttatataattttcatatagaattcttagagggtgtttgacttctttttttttttttaagttgttggtgtgaaaattgatcgaccctaatgacagctaacaccaaacagttaattcttgctcaagtaactcttactcgagaaagagattttatccctgatcaggtttctagtctactccaaagtacttctgagcaatttgtagtttgtaaaaacaataaataaagattgtaaaagaaagtaataaaaggaaacaaataaatagaaatatgagaaattgcattaattttattatttacattttgagctaaacttagcttcgatctccttaaaaggaaaagtcataccaaacacttagtaaattattttcatataataaaatttgaaaaatagcttataatttagtaaggaaaacttttttacagtttacacaaaacttattcacctagtgccactttaaatcccaacttggcctaaaatactatttttaaaacttattttcacatgttttgcattttgaatacttcactcactttcccgttaaatagttctcacatattttagtttattttaaattatgtttatttattgtgaggctttaacttgtttttaaattatttattttagaaaattaaatttttttaccaaatcattttttttctttaaaaggtgcttaagaagagaacaaaaataaagagcaccgattaatattcacttaattttttttactgtaaaatacctttcaaacaaaaaaattaggtcaacataacctgctattgagaggtttcatatccgtgtgagtaataaaggaaaacatttaaaaaatgaattcataaattttaataaattaaatcaaaatattctttaaattgattttctttttaagttaaatgaaaaagtaaatataatatctcaaaatcattttataaataagcttctttcaaaatatcctttttcaccaatccgattcatgccttctgttcatccagacagacccacaaatcaacacgcagtcgaatggataact

SEQ ID NO: 569 - DNA, 2800 bp, Glycine max
  Soy_ogl_3346 Gm10:3242201..3245000 Cluster 2
cactttgcatgcgctgggaaaaattaaaaaaaggatgtaatttgatctcttttcattttatattttaaaaaaatttaaaatttgtttgttaaaataaaagttgtttttattttcttgtcatcaccatctctgctctccaatccttccacctcttcctttagcaaataaaaaataaaacatgtttgatggatttatttgcaatttaagttttgaaaactatttcaaaatattttttttttaaataaaataattgaaatatatttccttgtcaatctttttttttcttgtttgttattttccatagaattcttaagcttctttttcaactaattgaccataaagttaattagagtctagaccgatgttgctgaaaagcttccatagtggcgctatgatgaaaatggcaaaaattcctaaatttgttcgccaaaaaatggaaatggcgtggcaggtttttaccctgcacaagtgttcaaaggaacctagagaagagatttggacacatctttgagagagagagagagaaaatgaaggcaaccctgtaattccaaatgttggtctatgatttggacacatcaactagtagtaatgctataggaacaagaacattgctaaaaaatggccaatagatttggctttgtaaaatttcaaatattgtaattttgaagtgaaagaaggggaaactaagataggctaacatgtacatctaagaggcatatgacaaagaatcgaaggtcaggattcatcattatattgctcgttttttgtaccatgtcagcttatcattcaaccttattaaattgaatacctttcgagatatgatttcagcatttagtatttatgatccaaatggtccagctcctagttatcatgatattaaagtttcactcctcaataaggagctgtaatacactaaaattttgttgaaggaccataaggagcaatggaataaacattgttgttctattatgtcaaatgtctggactgactgaaagcaacatatatattatgcttgattattttttggtgagctctcctacagggacaatatttgtgaaatccattgatggctttaaatgtgtgaagacaggtgaaaagttgtttgaattgcttaatttctttatgaaaaatattggagaagaatacgttgtttaggttatcatggttcatcgataatgaagcaattatgttttagctggtaagatgttggaagataaaggaccacatctttactagactctttgtgtaacccattgcataaacttgatggttgaagacattcaaaaacttcatttaaaaaaggagataattcaaaggggagttgatcttgttgggtttatctatagtcattttagtactttgagtttgttgaaacatttcacaaaaaagatgaaattggtagacacgtggttataagatttgtacatcatttctatcattagaaatacttcatataaaaatgtttttttttctttcttaaaaagaaagaaagacttcatcaagagaaaagaaatttgagaaagatatttacttctaattatgaatggagtaaaaacaagttgtctaagctaagggggagacaagcaacaaaagttgtccttatgccttcatttctaaatcatgtggtttttactctcaacttcatgcgcggctcctcttgtttgagtactttgttttttaaaggaagcaaaagattaggaatatccacttttctagactttttccccccttctttttgggagattagaaatgacgaacctgaatagcaagcatacctcgtggagtcgtcgtcatgacttaaaagagaagggtaattttacttgtaccttttttttattattctttgcatctctcttttgatttttttaatattttgaagattaatttctaaaatgtagaaaataattctaaaaactaatttcagaataaactttgaaaaaatgcagaaaaaaataacaaaaagcatgtgtttgaacacattaaacagcctaaccaaatgtcaattgggcttttctctttccacccactatttgctaagtccatgtttaattgtatatcatgtcacaaaatgcaaacacaaccaaaacagaaaacatgttttcattttgttaattttttttaaaaatttaacactataaaaatatattattattgtaaatacaagttacgtttattaaaaaatatgtaaatttggttgggctaaatttaattcttaataatattctttcgatccctaattataagatataattaattaattaatttatgtttattaaaaatattaattaatttgattgttaacacaattttttttataattataatatttttttcaaaattatcctaccttctattggaaacctactaattttttttcaatctcgacggggaaaaagagaaaataattcaaggtattttagttataaaataattaatacacacaagagataaaacaaagtcttataataaaaatcaaaacaaatttattgactatatcttataaataaataactgtgaaaagatgtgtatatgctagtttaatgttaatcaattattttaatatgaatgatttgaatagtgtaccttgaagaggacaacatattgggcactgagaccaaattggcggagggctgggagggtgatgacccgaccagcgttagggttgtagaagtgagcacgcgaagggcgagcaatattctcctgaagcttcaagctacagatattttcctcaatcccgtttccatgtcgcctttctctactgggtcttggctcatcttcttcgtctttgtcttcctcttgt

SEQ ID NO: 570 - DNA, 1635 bp, Glycine max
  Soy_ogl_3499 Gm10:42756801..42758435 Cluster 2
aagttgcctcatgaagcccacacaaaaggggaaaaaaagttgggcctaccattgagagtttttgagttattacacatttatggacgaagagtacagacctcttgaaacccaacaaaattgagtttcaatataaactctcttatcttgaaaccctgttttttttttaaaaaaaaaatcctgttgttttttctagtccctaaagtaataatatatttttttttggtacagcctaataatatttgaagactacttaacataatttctaaaactttgaaaatcacttgtataatttttacattaaaaaatatttatagagagtataatattttaagaatgttataatgatcttcaaaaaaaaaaattaatagcttcagtacgatcattatatttatacccttaaaaaaatatttcatagatgaaattgttgatatattatttatttcacagtatgtcattttatatcattacatgtagatcattttagttattagtagtacctctttactgtcattggtatcactaaagttattaggagtacaaaatatttgtgatctctaagaatctagctttaaatatgttttaaatatgcagattttcttcaacatatgtgccagaatttaatggtatgacatgatcgagagcttgaatcttgtgtgtatgttgcgattacctgtttagtatgctacaagtctatcttactattagagtcaattttctcattatgctaccagtttatcctatatgatagtagttgttatttgttagtttttttttaatggaaggaaattaaactcatgattttttttaaccatcaaattaattttataactcttataagtttatcttatgaatcattcattcattgtagttagatatttactcataagataggctctgatattttaagggtccgggacaaaaatattttaaagcttaaatatgttttgaaaattatacctgaaaaacaataaacaaaatattacaaccactttaagcggatcctaaatttgcttttttagtcccttaatttataaaaagaaatacatttttaatccctcctaggatcctaagtaaaaaaaaagccacatattatgcatccaaattcataaaaaaatcaatcaattcggctagaaaggaacatttttttataattgagagactaaaaattaatttaagggacaaaaaataataatgatccaaatttaaaataccaaaaatttatttaagcctattataaaatataaatatattttagatgaaagaacactagctatgtaatttcattaaaatgtattattttattacataaaatattttctctactaaaaatataaaatattacatgcaaatagaagttttattttttttggaggaaattaatttttttgttaactttaatgctttgattaattgaaattaataattgaaaagcttttgaaaaaatcaataaaagtaagttattgccaaaagaattaaaaattcttttttttttctcaaattagagtgtgttttcttcatcccttcagtcataggattaagtgtcatcgtctctccaaacaatgttaggaccgagccatttatttatttattatgtgtccatggttacgtacattgaaaatataaatattttattac

SEQ ID NO: 571 - DNA, 1414 bp, Glycine max
  Soy_ogl_3507 Gm10:42961087..42962500 Cluster 2
aatggaaagtttaatttgagaattcaatattcatgtaccaactagactcaattatatagaattaattatgcgtttgccctgattagcagtgagtgaccaagtatcataaacaaacaaattaaaacggacgacaaaagctgcaattggagccttctgtctataatttattgcttacgcttgcgcatatacatagcttcatctacgtatcgaaggagaaaattaacaactcacacatatatatatataaggattgtcgtcaaagtcacctatgggcaatatatatggtccccatcaggaatattcgaggataatgagaggaatattattttaaatatcaacatctaatgaatgtgatagtatattctcctttgttactttatattatcttcttctaggtaaaggtcacaaatcaatctccaatctagacacccttctatgtgtaatgtgtgtgtggatggtgtgtaaatttcagaagcgaaggacattcctaattcgaattccttggaatacatttcaaagctgtaaagtcataatgaggtatattctgataaaattaatgcagaaattaaaatgttttttttttcatataaagattaaaaaatagtattagacatatgaactaaatttataacttaacctattttaattaattaaagtgttggattaacaaaaattgacaggttttttctctagatatatattcagctgatcatatacgagatcttaataatttatagtggttgaagacgtgaaggatttgttttttgatgactgattgaaccacgtgttgaccaaaaaagtattaattgtgtttgataagtcgatggtattataattttattaattgttgattgtatgacttggatcattagaacatggacttggaccaatggagattttctttttcgggcaagagtacagttggatagagtctaaatctgtcccttgagtggatctaaggtcaagtgacccttaatgttctcttaaaaattgggaaaacaacgtatagacaaagggtacagtgtatatatagtaaagtcctaattagagtttggttgatcgattctttctaaatatattaagcctcccttgataattatgataaggaatattcttgtaaccttaacataaaagcaaaggcaaaccaaaattttgttaggtttctcaagtcgaataattctacggtttaacgtgatcatgaatttcacaagaataatgcacactttaatttgtctctttctcaaactttaattttctttgcttcttaagttgcgtttcctaatcactattttatatacattttacactcttttcatttgtatgagattcactgaaaaggtaatttcatcaattcacatcttatattaattaattcaaaatttaattgatgtatttcaataatattataaaaact

SEQ ID NO: 572 - DNA, 1518 bp, Glycine max
  Soy_ogl_4146 Gm12:38234801..38236318 Cluster 2
tgggatgaatctcaatttcgataatcgaagccaaaacaaacacattctaactcgttagtgtttgtttcgtcagacacaaataaatatagttactcatgctttagctaggatgtctacttatatgctggtcattacaattcttactctgcctcctcaatgtattgttaatgaattgatgactgatataagctgttacttcctacgctagttcctacaattctcactctgctactcaatatattgttaatgaactgaggaataatatggtatataggctttgttctgttataaacaaataaatcttatttatgtagaaaaagaagaatctcgatcatgtaagattcgatcatattagatacctaatgaaatacttttttaaaaaaaattaatgtatgaaaataaaataacattgttattttttagtttgttatatttgggactactaatgaatgatgatggtgtagacatagctcaagacaaagataaacgcgtcgctcgaagaaaacgagatagctccagacaatcgaattcgatgagcgcgtcccttcagaccacgtggcgatcctacaaccgcatatataaattcaataatttgagtggagaaattgtattcgtaaaataaacatatacttttttttctgacatatgaaataaaatgaataaagtcataaaaagaaataaatatatcatttaaatattgtatacctaatattatttatttaaatatttaacattgatatatatttaattgtaatcttgatttttgacattctttgatagctttttttttactacagacaaaattattttttattttaataaaatcaattttaaattattaaatatataataaccttaaacacttcttttaaattaaaaggtttattacgacgagagaagttgttttgaattaaaatatataaacattgtcatattgataaataatttattaataatcatattaaaaaatactataaaagacttatgagtatattatcttgtaaagaatgataggacggaaaccccatttactttcaaatcatcagagtttttttttattcattttcaaaccatcggagtaataattcataaggttgatttagtggtggtgaaaatttttaataatttgcctgtgattttaattcaaacttcactattctcattgtatagtaaaagaaaaatgagtgatagacaatggaatcggaaaaaaatgagagacattgatcttgacatcaatgctccgtgcctaatcctaacgtagatgtcgtgtcacaccaattgaattcgtgtattttgcaattattagttcattttaggattcattgtgaataagacttttgacagaactttatgttttcagtgattattcgcatctgtaatgtacatatcactgaattaaattcataaaagcaaagtgcactgcaattaaagatgcaattgtatgtttagcactaagaagaaccttcaatgttttttttacattttaaacatcaatattgaaatattcattgcggcccg

SEQ ID NO: 573 - DNA, 1800 bp, Glycine max
  Soy_ogl_4507 Gm13:37191301..37193100 Cluster 2
tagcaaccagccaaccacaataatccgaatagtattaactataatatttttaattacatgataattaactctactcatattaacgacatattagtattagtcatagcttgattgatgatatgcatttatcattaattttcttgatgaatttaattaaaaatattttaaaagtataaaaaaataatatcatctaatcataaattattatgtaattaaaaatattaatatttataataattgttttaaaaaaattatatttaacggtatattaaaattaaaccttttcttactgaatgtgtgttacaagatttcccattacatattaaaaaataaaaaatacttaactaatttaattgtaatattaattttttttaataatttgtttaattctttaatagtcatttttaaaatgaaaataaaaataagatatcgtttttgtaagtttttaacctaattaattaatatatatttagataagtttttggaagaatatcttatttggatactgaaaagtgtatgtatgccgtcttcaatttatcatattagaatgtaaatatttaataaccctgtgccacatcaattgtagatttgtgttgcatctttcatatattgttgttagttataaattggcttgaatctgaggttcattataatggtacgtaggccctttttcagattttctaattaatcaatatctttaaatttttaattgaatcttaggccatacttgtatacgcttaattacaagtgttgtatatttaggtgtctacaataaacacgtatatttgactctgatgctgttacttaatgtctgtgtctagctcctctgcatcagattatgtattgaacaattaataattaatcatatccaggaaacagcattacatcacagaattttttaatatattacacgaaggacacttggaaacttggtaacttgaactccagaactttctcatgctacgtagccagtatcccacctacagtctagacctctagtttttgctttaaaaacaagatatattaagttgaaatcttcaacatgcagaaccatatatggaaagttaaatgaagcaagcaacatgcatgatccttgcaaacaaagagtttgttaatcagaaaatcgaacacgtaagcaggtgttgctgagtcattgtgtttaggtctgaaagtctcaaccacgcatacacatagatacgtgcactatgtattcaacaagtgcatttctttttaattaatgaactttcgaataaagttgtaaaagttgtcaaaatatcgcacaataaacatatgtgtgtgtgtatatatatactcacgaagtcaaccttgccttgcataattattaattttaataatttttcttttcaattttatattaactaacaattttgttggtaatgaacagtgcaatataaacagctggcccggcgttataatttgtcaaataatggcagacattgaagatcttctggtaataccaatatatagtataaaaaaattaattgcattgccacctacatatactttattgtcatctatatatacaggaaaaaaaaaaagacagcaaaattttgtgtccccatctcgtgtatcacaacctaataatatcgtctcatctttccctaaatatacacgccttatttttgtcttaaccccatttttcctttttaagtaaattattatttattagaagaaaaaaaagattttgctgaagaaacttggcctaagtcaggtaaataggtcagtttattgcgattggccttggccgcatgtagctctttcctttttttatgaatttcc

SEQ ID NO: 574 - DNA, 1400 bp, Glycine max
  Soy_ogl_5301 Gm16:4809501..4810900 Cluster 2
atgttttattttaacccgtggtttttgaagtgggcctacccatgttactcttaaagagaaattcggtaaaagtccacctcaagcccattggatgtgttttggttgcagatttttaggactttgtgtggaccatttacctttctgtttctgttttctgttcacagtttgaccatgaagaataaacatcgtacagtccagagcaattggaacttcttaacctccactaagttacacagcactgaaaaacaaatgggcaccatgtggttaggtttataatggtaagcttatgtagatggagcttttctcacaagatcaacttattcattttaaacattgcattattactactacatagctactttgaacaattataatatgtcaaaaaacatttccacatgtacatatcaatttggcatctccattaaaaagttcaaatataatatttagagaaaatagtgtatgtgttagttgtgtaaagaattttttacacgtcaattaatcaaaaaatgttattatgttaagtttattaacttatacaataactaattcaaaagtaggactgtgcatggtttatatttttaaatataaaatgaaataattttataaagtagattcttattttttttcataacaattcaatttttttgagttggaattggttatttcagttctttcatctatttcacactcatatatgattcaatttttttaaaaaaaacgattcaaaccatttttataaaaaggttcggactttttctcaaaacgatttgatttttataacttggatcggtttagttttttatacactcctatgtacaagtcatacataaaataatgtctaaatgattgggtgtaaaaacttttgcactaagaatgtataaaagttaatctctaatatttgtgtgaaaattatagcattctcatttttaaaacaatttttgactaagcttattgttttccagctttccttgttttctttcctaattgatgcatgtaagcatgttaatatttattttgaataatattaaaccatcttattatatcatcttaaaaaagattttactaactttttgtgataagtatagaatgaaaagtaaaaatatttattgtcttaaaaatataaaacatatttaaaacctatcatgaaaagaaggaggatatatataaaaaaaaaaagatataatagaaggattaagccttattcattctgtaattccaaacatggaccagctgaaatgaggagcaaagatatgcaatagtgggtttgttttttttacacttttttttccttttaagatagaagaaggactaagtgggtgacatcaccagaccatatgtgtggtcctctgttgtccctcattctatccatccatttccctcattcaatcacacctttttac

SEQ ID NO: 575 - DNA, 1300 bp, Glycine max
  Soy_ogl_5338 Gm16:31401..32700 Cluster 2
ttgcaattaatgttgttaaaattaaatatggcatttggttgagtttcgcatacatatacattacaaggctttcgattttattttgaaaaaaaaattcaattctagcgatttgcaatggtttagtgctttttgcatgtgtagttaatttttcaatggcattatatttaactttaaagtcttgtggtcaatgtgtatactgaacatatatattttataaaaagattataaaagctacacagcatatttcttttctctaggtttgaaatatacagtatgataatgattaccaaaatcaaccgtatacttctaattttgtgttgctgcaacaatatttgcttccacctaaagttatttcctaattgatattattggtataaactttatataccacattttagtattgttatgtctttggctatattatcatttttaattttattttaatttgggtgtgtgatatacatcatagccaattttatgcatgattagttattggtttttatttctgttcctcctattaattttttcaatattttttttaggcaacctatttcattttgtatatagcatcttgatcttttttaatcataatttaaaagaataatgtatgtcaaaaagattttatatatgattgaaaaaatctattgttaatgaagtagaactttatactttagtcacgtgctacactccttggcaagtaattttttgaatcctagagacattgtttcttgtgtccatagtatcatagaccacaacagttctacgtgtttaaaagtgagaaaacatttcgagaacttttaagatttgatattttgtgatttcttattcctagaaattgatatttcaagaactagggatcatatatataattgaaattaaattgttgaatagattatctttgtatgtaattattaatttgattaccttttccctcaaagaataaatacattctcattagatatgcatattacgattattaatttacattgatttgattatgtcaatatgcatactttagaattaatttcttgccttcttgtgtttgagaaaaataatcaacttttgatgaaatatcataagacccgcctaaccggttatgtttcattttcagaaatgaatgcagcaatagcaatatctaactattatgtttatgaacgtagtggaggccatggtcatgattgtggacatgatcatgaaagaagttttaaggattttatttcatcatgttcttgaatttatgatttatagaatgttttgtgttatttattatttaatgttattggatcttatgtaagttttt

SEQ ID NO: 576 - DNA, 1200 bp, Glycine max
  Soy_ogl_5624 Gm17:9999201..10000400 Cluster 2
tcgtctccatggcacctcattcgtacatctgttgctaaaactgaaagacttctgtccagggaatgttgatgtagatgcgtctagcatctcatttatgcttttctggctgaccattgtggcttaattatgctgatgttatggccttatctcatggagaggtccctttcaagtttcagcacttacttcaattgagttcattagctcataataatttgccacatatatgatcgatatttccgcccacaacttcgttttatacatatatgtttagttaataaaaaacaaataaaagaaaaggaaaagatataaagattggaatggttttgaatgctgtttgataaaaaagaaagtaaaaaaaaaacattaaaaaaattatatagaatgatacaaatttcttaaaaaaaatattatatatttttttgtcttgggtgatctagggtttataactcattcaattaaaaattaatctcattcataacacatgataagataagaaaattttgtaataaaaattggatacgaatatttttgctaaatagactattttcccacgtatatacctaacaaaatagtgccaaaaatagaagaatattatgttacaatgatacaatagaaaaaaaagtaagataaatacaaaattgtaagtttaaaaaaattaagttgtttataaaagaaaaagataagagagagacaataaaacaaatagagtgaccgtaaaagtattagaactttttatattatctaccccttctcactttggcacaaattgataattgttttaaactttttatacctttttattatattatatctgtttttggataaatttcttaataagctcttatgaaaaatgaattttcatgatttagaattaagttatgtattaaataaaagttagtttgtaaaaaaaaaatgctagaatttttataaaattaacttatgtatatttatacttatatagaagaagctttatcaattttacattcttatttttatcatgtgtaggtgttttcatcaagacctataatttattgtttttcacacataataatttcatacttttcccaacttcaaaatcatttttggtggattgattagttcaatttatcttaaaaaaaagagaagcttttttattttttttcattttggtggtagagacgtctccttggaggaaactgtataactcttgaggctatatat

SEQ ID NO: 577 - DNA, 2162 bp, Glycine max
  Soy_ogl_5845 Gm17:41511301..41513462 Cluster 2
attttctctaaagagtgatgttaatgtaatgcataattcttctgccagcagcaacatattcgtgtaatctaacgtgttgtatgatgcctgcatgaattgcttgctcaagagaagacacaagcatcaagttcagtacatgaggaggttgaccttgacgagttaatgtatgtatgctttgcaaactcttcaacctcatcttatatggagaattcagggaaccgagggtgatttcttaggcaaagtcacaggaagtgaaaaagtgatttgtcacttcaaccataaggagttctatagatgcaagtatgttattgacttaaatattattccttgtggctcattatctttctctgtctcttaatttctgacatgcatggttacatgtgcctgttgttgtattaatttccaggataatggataagcatttaaagtctttcaccaaagcatattgatacgaagttcatcaagcttgatgcagaggtcagcatgaaccattctatggagatgattttggagtttgctaagggattgagtcaatgtaactgttgtaacattggacatattatcttaatgcaactgtttatcttggtaaagagattgaatgaagttcacaattgaaaataaatttcagaatgcaccattctttgttacaaaactggctatcaagactttaccttgcgtcatactgttcaggtgaggcctaaatttgtaattgatcaattgggtgtaatgtttatcttcttcatatccatttggattttgggcttgtataatccatagcaatcatatagaagctatactacgctgcaactgttgtatgaatctgtccccttaggaaattgctaacgtttctcccacccaaggggtatcaaaagttagaacttcatttgtaacagaggaaattgatatagattttctaaaatggattttattattgttcattgtgagtgcattagaagccactaaaattgggccagggcttgaatggtaccaaactgtgagtgcatgagagaaagggagtatgcatgaaattagagcaccaaacttcattatcaccgttaaaccaaacttcattatcatattatttcattgttacatcaaaatataagattacacaattttaaatgaaatgccaatttaaaagatcatgtcaaggtaatttttcaagtagtataaagtaagttagttataataaaaaaatgaaaaaaaatatttgtatgaaataatatttccaactacatattttattaaatatttggaaggtcattaaggttagttttggatgacttggaattgttaaaaaatcaattgtaacattgaaatattcattgccaatattcctgcacgtaactaatttctctctcctagtattgcaactttatatatttttaattataggaaatacatttttcatataaagatataataatttatttttttccttttttattaaatcattttagactttagtatgcaattaatatcttaatttggtttacataattttcatcataatgatattttttttagaaaaatatggttttaatccctatactttcattgaatcttatttttagttactaaattttcatatcttgtttatagtccttcctggtaaaatctttactagcaatgttaacttgtgctctaatgttattaacttatgtccaacgtgacaaatttgtaaaaggtaagggtattatttgttttagaagggagtaactttcggacttgcatgttaaattataataggtgagggtattatttattttagggagcaaatgtttcggttatagggattttttgcaaaatggttaagtaccaaagtgtcaccatagaaaaatatttttatataaactaaagtggcaccataagtatcaccgttacaaagaatactaacactaccaacccgatgcaccattgtattaaatggttataaattttttttttgcatcttttttaacttttgcatctctaagacatttccccattatatataattactagttcttgcttttaacaacaactttttcccacacctacattgtcttcatctagggtgtgaagaatgagatgtgaaattcgaaccacagctcctacgtgccgatgtagtttttgaaagttagggtttaatatatttgggagagatatcttaataatttctt

SEQ ID NO: 578 - DNA, 2574 bp, Glycine max
  Soy_ogl_6540 Gm19:43834301..43836874 Cluster 2
tctataattttggaacaacagttaaatatttatccatgactgttaaaattgtactccctctggtttaataagtgactctgtgtttgcccaattaaccaaccctctaaaaaaaaaaagaaatagcttgccctatttcgttgttgaagggtgtgggtcatatatgcaatattaggccctttgatcttcttgttttgtctcttcattggtaaatcaacataatttttgttggttttttctacattgaaagtttattagggtagtgtagtgtctcaatgtctgatgagcaatatattaattctcctgttgtatgaatactcgaatgatgctgctaattagtatggagtacaagatattcaaactagactttggttctttaatgttgtatatgagagagaaagatacaaaaaccagtttaataaacctacataaaatgatgtagattctgctgaagttattacttgtgtaccttttcctctaataattaaagaagaacataagagaggatgcatgtgatcaatctgtttttattatttaatctttgcccatatttctattgaacgtgacagactaataatgcacttataaaagtacatgcttaatttcagggaattgatgcagctttgtttgcaggtgatcatttaaattttaacaacagtctcttctaattcagggagcgaagatcacccctagcttctggatcacgtacatggatatcttctgtaagggatccattattacatatatattattggaacacacttcttcctcacttatatcattattcagcaatcatttcattgcatccctataagatgcattaagtagtttatgacttcagttacattggataatccttggctatatatctatttaattgcttaacttgataactgatgatgaaaacacaagaacagaaataattgattcaagcaatttatataaaggcattagagaccatttgggtcatgttgttggttgcaaatcagattgcgtaatgccttgcctgcaggtcttggaaaggaaaagcctagtgtcttctatatgcgttaaaacttgtcaactctcttggaccggagaatgttcactttgagatggattgcaaaggggttgtcgatccacaagattcattcagtagatgatatttcaaagttgggagttattattactgagtcttggttttgcaaggaggcaagcaaatggagtgattaatgctctagcaaaagcagcaccatttatatcttatctttgtgatcaatgaaggtgtttaacaaaaaaatttggagaggtgaaaaataattaagcttatattatataaataaatgtaatcttttttaaaatattgtacttatggctaattttaaatatttaatgatattatttaaatatgaattattttttatgatattagaaagtatttttagcactttattaataatactctttagttttttaacgacttatatacccttgtttgctactaaataaaaaagtagaggatttatgtttcaatttttttgtaaaaaattaacaagacaaattaagttattttataatacgcaaaaaatgttaaagtttcaataattttttcaacaaatttaaggaaatattcatatttttgccaaaatcatagcaaaattgaaagaaaaattgtaataaaatttaaaaaaaattgcataaaaagcctacaagaaaaatatgcaagcaagaaaaagttgtaggtttaagttatatttgaggctttcctatacggattgagaatttaaaggtcataaaaaataagtttgaagaacgcaaaaaaaaattataaaaagatatttaattaaaaaaatagttcttgtacaaaaattattactaatgtttaaaattagccattaatattaatattattaatagtttttaatatatgtatagaaacataacatacagtaaattataaaaaaaaaaactcctattaagtaaaactcacagtaaattatcaaaacacaatataagcttgatgaatcctattaaaagtaaaactcacaagtcatgagtgcttgtcctaggccaacctattttgtagcttcccagcccaccttttacactttcagtttgtttgtggcaaatttttgtgtgtgagtcttatgataagatttgtaggttcagtgtgtttttttccctcctattaactcatactaacttaagatcggtaatactataaaccccaaaaggtttgggaggggccatgaccccttgggtccttttaagctccaccattgtctgtgataatgatcatgtttttttttttttttttatcgtattgtttatcagctattgataaaatgacttaagtttgttcttataaaaaaaaacaatttatataaaggcatgatgcattgattttaatttgttttgaccaatatatatagctacattttaaagaatatatttttgtctttcttttcttcttttttagttattttaatttcatttttcaaagaatacatcggcgctgttatctctgtcaatagaagtatttcatctataagcagggacggagggacgttaaagcgtggggggccttggccccctctc

SEQ ID NO: 579 - DNA, 1723 bp, Glycine max
  Soy_ogl_6750 Gm20:34603301..34605023 Cluster 2
gtgaactgagttcaattttttagttaatttgattttgtttttttattggatcgacctggtccaaactcatgttaattggattgacgtgtgaattttgaccgttttaaaagcatgattggaaactgttcattctttttttaatttcgcatttaggctctataaaaaacatgttggagggtgtttataaattatttttttccttttccatatataatttactttggaaaaaatatcttcccctctctctctcctcaaatttgaaattaagtgaaaacagcccccatgagttacgtattcgatcggtaataattgatgaggtccaccgttatccattacacattttcgttgttattgttattaatgctatcaaaatgcccaagtattatcaatgaatttcgtctttcgataatttctgatagaagagcgtgaaatgcgtaatgaaattgccacattattacataataaaacgtcagaaaaactaacttattgataagatttaatgacgactgtgttgactatctgaaaaaatatgattttcataaaaaaaatgactttgttggctaaaaaaatactataataagtacagtatttgcataaaaatagataattttacagttataaaatattatatatataaagacaaagtaataaaaagaatttaaaatatatttagttttagttattttaacacatagatttcggcttcaagtatcgaaagaataagattccaaattgacatgtgaaacggaagagagaggaagaggatgggaacgggtattgtccttatcacgttgaggaatatgtttccccatgagacaagtcctccatttatggcaaccaaattttgcatctgaggctagattttaactttgtgaaaagtctccacatcactataatatccattcgcttgttggacattttcatcatagccaaatccttatctatattagtttctatgtcactatatataattacgtccgttcgttttctttttctgttttttcatgagtattttcaccatgacttaaagcaagaacacgtccttattcaataaaacttatctgttatacatccaataaaagaaaaaaaagaagaagaaagattcagatcttttcacgctaatagaaaatatgataatatcgtgttggtgagattaagatattttcgcctataaaaaataataatatcatgctagaagattaaaaaaataagcataataaaattcataattatttatgtatagtttattaatttattttttataattttttctcttacaacatatcactgtcttattctttattaataccgataaatccttttaaaaaaatatactgttaagaaatatgtccataagatttctctaacctagtttttttgctgaatattctctaacctaattcttatcaagtcatcaaatttgtaatgatgtgtcagcattcaaccgaatacatccttgcttgacctaggtttcccgtttatccataaatgaccagacatttcctttttgtgtcattattttcaaacgaccccaagtatatactcgtaatattgattatgtgaaccacattttgtttatttttggtgaataaaaatggtagaaccgatcctgtaaaaaaaaaattaatgttagcacaggagacattctcaaactaacggatatgtgtcaacaacatgtcaggactactaagttttgaccctaaaacctattaaaggggttgat

SEQ ID NO: 580 - DNA, 1583 bp, Glycine max
  Soy_ogl_6893 Gm20:40657001..40658583 Cluster 2
gttttaagagtaaagtaaaatttaaaatcatcaatttaattaggttttttatttgttccctttttcataataatttattgctacattaaattaaaccaacttgataaagattgcattgatatagttgaggtcatcaggttaggttataaaattaacattattataatttcactgactattttttatattaatttactgtaaactaattaactaaagacatttagtaatactagaaaacaatagaaaaaataaaaataaaaagctccaataacaaaatttaaaatgtctagatttaaatgttaaaaattttaaaaaatattaactgattgagtttcttagatctagttcaaaaagttaatttaagaactaaaataagtataataactagtttggttcatatttgaagtaaaataaattaactaattatcagaacaatccaaaacaatttaatccactaaacacacacctaaaaaatagaaaaccaaaatagttatatgtagaacttcaaagtgaatctttatatttggttattagtaacgtaaaaatcttccacaaatatataaagggcttagtccataatccagtaagcattagagtcaaagactcatagatttaaggatatttagttgattctgtaaaacgaacaaaaaaagaatatttatttgatttagacacgcattgtttttttacatgatatcatttgttaaaaaaattactaagattttattgcaagtaggttttaatgtaacgtataaaagattaccctggattcatttgagcatctcaagccagttttgcaataacaggagttcatatcttataagtcatgttcccaattggatcataattgtctaggtcagtcagtggcgaaggaggccatggtccccccctaaattttccagaagtatatttaatatattataaaaaaaatattatgacctccctataatttatagaaaaaaattattgacaaatgatatataaaaattaccatattagttgacacttacagagcaaaataaagaaaaagagagaaattatagacattaacaaaatatttgtaacattaaaatgtccatatatagttatttaaacttattttatacatctcatttatcttttttctcttatactaattttagtaatatatatatatatgaaaataaataactaataaattaagaccaatacaaatagtaaaattagttaattttaatttaaaatatcataaatttaaattttactgtagaaatacataccaatataattcaatatttttagtagtggttatatttaacaaaattactgaataatttttctgcctatgaaattgacttaaatttttaataaattaataaatacattcacttgtatataaaatgattgattgtctcatcactaaatttcacaataaattaagtgtataaaaaatgtattttttttcttatataaacatataattaatatattaaaaaatgagcctctatttttataattacaagaaaaaaatgtatttatttggttattatatttatataaatcatcaaattagctaaatagctatatttttgtattggatatag

SEQ ID NO: 581 - DNA, 2014 bp, Glycine max
  Soy_ogl_1576 Gm05:3425001..3427014 Cluster 2
tactaatattttaatttaattattggtcaattttaatatctaaattttatggttataaaaaaatataaataattatttgcattacataattaaaataaataacagctaataaaacaataatctataaattataagaacaaatatttacatcataaagaaatacaagttatacctaaattatatatcctatatataattacataatacatatttatattaaaagatgaaaactttacacataaaaatatcaatacataaattttgtatgatttgtctctaaaagattaattagtttataatgataaatatttacaatgttataaaacagatagagagaggacatttcaggtgatagcactatattattgtcatagatgagagacaaccattggattaaagtaactttccagatttaatctactgtgaaacagatttcacgcagcctattctaacatgcaacgcatcactccgagtttatcccacgtttattgcttctcattttcgtgcctcccgcgcaaaataaatagagttcagaaattctacgtgaaattgatataccaattctttctctgcaacaacgtgatctgattcttaaattacttgatctggaattgtgatctcattctttatttacttgatctgcttatgatcccattcaccaatttataagttatctcattcaccaagtgatctacagcaacgtgaaattgaattcttctgaaggtctacacccgaacgtcttcacctccttttgtaaaccccacactctcccttctgaaaattaatggccactaattcggtatctctgattaacttgttaagggtccactgttaaattgaactcattgaagataggacaagcccttcactctgtggttgttgtgacttgtgagcaacttgtgagaagaactaactttgaatactgcacttttgtcaatgtatgcaaagttgggtagtctaaaagattcaagaatgttgtttgagaaaatgcctcagatggacattgtagtctagaacataatcatagcatacgtggggaatgcatgcccaaaggaatccttggaatttgtatactgtatggttagatcaggttttagacttgacttggtcatgacaatccctgcaatttttcgatgacatagttaaagtataaggaatggcgaaagcaaatgcatgctcatcatgtgataagaaatggttcagattatcaggtgtccattcacagttctcttattgacatgtattctgcatgtggtttagatgtttttagttgtacagcaaaatgaaactctcaaacattaaaccagaccaagtaacatttctgcgactgcatgtagctgtttggtgtaagaacacttgaatgtgtaatttgatcattgatttgtactattaaagagaactttatatttgagaaggcaaagttgtgtaagactcttagtactacacatgttgataattgtgaatgaagaccacaacaagtaactactagacttcaagacaatttcttctacagcttctaatgctgccagtacgatattattttctccaagataatttctttatttgatagaatatcctagtctttttctccataattcacttccctcatgtggtctacgactttctttgattcaactatttttcaaagttttttctttttctttcagaagctgcaactaaaatagcctagtaaacatggtttctggtttttctttttctctaaaagacatataactattataatttttttaaacaagtcttttaattgatactattattaatttttttaaaaatccttttaattgaaaaattacattttctgaaaaatacaagaaaggataaagcaaatggtccactgtttgcaaaattctaacattgcagaacatcaaatgtaaacattcaaaaccaaatagaaaaacttcatataatttccccttttattaaaaaaaaaaaaaagacatccaattagtgcgggtatagacttcaaaagatgatataaattggtgaggacatg

SEQ ID NO: 582 - DNA, 1427 bp, Glycine max
  Soy_ogl_3213 Gm09:40020701..40022127 Cluster 2
attcaagtctaacaactaacacacatgattgctagcatataataaaaatgctaagcttttgattattttcttgggttatttatatttcctgcacgttctctcgtccaccgtggagaattattttcttaataaatactactttaatttttattttcaaagaaaataaataaataagaataaaaatatgtttgtttaaaatttagaaaatattttctctttttagaaataagcccaaaactgaacgttttccaacttttcaaaattttaaaaataaaaattattttcaaaaaataaaaaaataaacactcaaatcaaacaacacctaacatttctaaaacgttggtaatggaattaataataatttcgttattaaaaatcatatatattactcatggtttgaaacacgctaccttaaaaaaacaaagataaaaagatcattaactttcaccaatcaattttctttttttactattattaatgaagtgattaaaatacatatttcatttgattttaacattctttttgttacctattttagccttaataatcgcagatatattcaattgtgtctgcacataactaacaaaaattatgtatgaaattgtttttccacatctctcgcatatttcccgcaaaactgggtgccttttttaccctagttaacatagtggaagttaaaaaaaaattataataactaaacaacaaaataacaacacattaaaggatgtttagttaaaatataaaattttatattaactaatactactaatttcttaatctatatcgatcaacctatcagtaacattttcagaatagtaggagtaacgaactagagagtagagacattttgtacaatcgtcaccagcaccggcccactgccgaagtagttagttaccttgtattgtatgattctgtgtttagtttccatcggaacttgaaaatttgaggtgtcacttttcatgttctccaggtcgtagaccaattcttcatacataatcaattcaacgtttaaaatatactaaaaaaaagacattaaatttcgtactgaaatggttttaatgttattttaaacgaattatgatctattgtcttaaaaaatgatttaaaaaaatatttttttcccacaaactttgaatctcaacaaaatcctaaatcttttcagctaaacctttgcaaaatcaggagactgttaataaatgttcttaagagttaagacattaattaagaaatttaaaaaaacaaaaattagtagatcgcgttaaatgtgtattaggaataataacttttaatatatttttcacttttgatttgcttaacaaatctctttaaggtactactagctattatatttacctatttactacaagagttactgctgtgtattcatagattcggggatgaatccaaaagtgtatcaaaggggattc

SEQ ID NO: 583 - DNA, 2000 bp, Glycine max
  Soy_ogl_3330 Gm10:2724601..2726600 Cluster 2
aagacgagccaaaaggaataacgtgcaatgcaatcaattggcaccatcaatttggataaaatcatcatagttatttttttatataaaaaaatagtatcttatactactataatatatacacaactacagtatagtaacatttattttgtattgcaataaaataaaatagttcttcaaattattataatttttttattatatcaaaatcttcaaaattatttgattttatgatgatttttcacataattattagtttgataaaatttaataaatgtaaaaaattactaaatataaaggttcttaaatcttgatacctaattctaattaatcttatttttcatatggtagaaatttacttacttcaaaggtaagtatggttacacttcattatttttttaagaatattgagcttcattaatccaatattatttaaaaataatagactaaatcagataaataaaatattacataattttaaaattaactgatacgtcatttgtcaaaattattttaacatgtaatattaaaaaatatcaattataaagcttcacatttaaatatttgatttatctaaaatttgatatgtataattattgagatattaatgtctcgcgataacaggaagatttattagattggtgttttataaaaaaatattaagtaaaataaccataaaaaacatacatataagataaggaatatcatacaagtatcaagagagcaagtctttcttatattattaaatcttattataaattaaagcatataaataatgtgcatgattttaacaaacttttaattctagttacttttatatgtacatgagagggtcatggcaaatatttaatttatttgaataacatatattacatgtttaacttcaaatacatcatagaaacgtggttaaattgaacaaatctagatggtatgcatcatgcatgtatgtattttcttaatgatcatgtgttgtaaatatgcaagatgactttcctcaaagctgtcaggttctttctctagcagttaaaagagatccaatttgaacttgccgtgtctaaggcattgagagttccttcaacttttctaaaggccgaaataataaggtgcttgccacacaagtcaatcattttttcaaacttgtaactttaattcactttagatagactataaagtgaaaatgcgttcgtccccactccacaaatactataaattaaagtaccaaatgtatagactaaagagtatatattgacattgttaacatgtctaaaactcaattttctttataacattaacggagtaaacaagtaaagaatcaattacttttgtgacagagtcatagagacttccgggaagaatgttaacatgatataatatatgatttatatagtgttagttgttgaacattttgatttttcacgggaattatgaggtatatttcacaattttttttattaattatgacactaatctttgatttgatgattaattatacttaaaatttttctttttttcaaataaatatataatgtgaagatgaaacaaaaatattttcccataaatataacttattgtcaattaatctacactcattactgttgaacatgttatatcatatattctttctaatctccattcttatttaaaagactaaaatttaaaatatttttttttgactaaaaataccactgatttagaaaaagaaaaaatatattcacaaacacttgaaaagaaagataactattaatcataagaataatttaaaaaaaattataaatttaaaataaatatattgttactaatcagttttttaaattttaatgaattaaataattgagttttgtaaataggaaaatggactatatatatatatatatattagtaattaacattactttccatcttttatattgtaaaaataaaataattaaaatataattaatagtgagtgcttatttgcgtgttaacttgacattaataatatctgaacctgtgcatacatgcat

SEQ ID NO: 584 - DNA, 1700 bp, Glycine max
  Soy_ogl_4137 Gm12:37836801..37838500 Cluster 2
ttcattttcattaaatatacaagttagatatcttaatttttcctatatattttgaaaaactattaaattaaatagcaaaataataaaagttatatgcatgcatgatgaatagcttttaaaaaaatatatatcaaagcattccttaaataattgatatactttaatttcttacaatacaaaatttataattttattatcttgaatctcgttagtacaattttaatgaaaaaaatatttgaatagtatttagacatttagttaatataaattttgactgttttattaataatatattttctattttatatttccttttttaaaaatatataaatgtaacacgtttaatttttctttattgggtgaaaattatttttcaataaatataacgcgttaaatttcaatattgaaagttaattaaattatatattattaaatattatacttacttaaacagtaatttttaaaattatttatttatcatataaacatatcaaatagattctgacataaaataatacttgtactgttcaaattaaaaatttatccagtgaaattattaaataaaattactttcttattataagtttattttatcttatatttcattagattgttaataataatatactctctttaagttttaaaaaaaatatgatttaagacgatatactaattaattataataaaatattgttcaatttatttgttgaacattgagatcttcggtagatctgtacttcttataattcttttaggatctagatcgagttaaataatcaatcatcaaaaaccaatcggtacctaatttcttatggcgtgtcaataaataaacacatggataatatactatcatttttaaattggagtcaagttcaatgccgtatattatctcagttgccacctacctatattttattattttcatttttttaaggtttattattgacttattgtcatctctatatatacagaaaagaaaacaaaaagatagcaaattaaattttgtgtatccatctcgagtatcacaatttcacaacctaataatatcgtctcatctttccccaaatatacaagccttatttttgtcttaaccccatttttccatttaaaataaattattgtttatattaatcaacaaaaaaaaagattttgaagaaacttggcctaagtcagggaaacaggtcagtttattgcgactggccttggccgcatgcaactctttccatttcatttgttaaattgtagtagttttgaaattatacactgtatacattcaaacgcaatatattcaacctttcctcaccaaccacaatcttaaagaatatatcattttcaggtacacaaattaaattatattttttatattcttgtgatagttctcaaattaaatcttctgatctagtttagtgtgtgttgattcatcaaatatatttttacatgttatattttaattaaaatcatattaactttctgcaaataataaagtaaataatttttaaataataataagataattatttttttaattgaggggaataaatattttatcaacaaaattttctaatttattatttttaattaaaaatttaaatgtatattaatcattatatacacaaaatgattgataattgaaaaacattattttgttccgtgtaaaaagaagtggtggtatggtggggtttcaaaatcaaaatgtattg

SEQ ID NO: 585 - DNA, 1570 bp, Glycine max
  Soy_ogl_4824 Gm14:48616001..48617570 Cluster 2
cgtagcttagctgttcgaggctttgccgcgcgttcatcatttcatcttatattagttaatttccctaaaaagaacatgtactaataaaaaaaaatgttattcgtttatattatagtataattcttatggatgtatgttgcataaaaaatgttatggatatatgttatcaattaatattaataagtatcattagtactgtattatatcttaacatagaactatagcatttatatactaacatattcctttttatcattaaaaaactatattaattgagtagattaaatctaatgactatatttttttgttagtgtgtaaattctttttgcaattttttcataatcaattttagttacatttatatttaatttatttctgcaaacaaagtatgttacatttttacaaaaaaaaaataaaataaaggaaaataccaaaaactaaattaattaatatttttttattaaaaaaatctattacataaacatttgtcaactactcttttgcaataatattttataattattaaatttgtttttagataaattaatttttttttacatatgagtcacaatttaattaagagaaaatatatatactatacaatattataattccctccatactcgtacaaaatgagttccgtgtttgttttattatgaagcctagactttttttaataattattatcggcaaaattatatattcaatatttatttagtcaataatttgactgcttcttaacagatatgatggacttaaaaattaaaatgacgatgtccaattggctttttaaatgtatgaatgaaattgattaggatctaccaagagatattatgaattgtaacaaggaattaataatttatgcatggttacaatgaatatgaatggaaatgctagggatctgtgaattgaccttctaacaactgcttaataatttatgaccccgttagaaacgcttcacacaccaatcacaaaatataaaacaattttctattagaatcaaaattttacacggtaagaactaagaaccaatgaacttgcgcgggcaatatccctatgcatacctaatcattagaagaattttcttcttctatctcacattaatcttttaaagtaatgcattttttaaaaattaattatacaaattacactactaggaattcatggttttttttttaaaaaaaaaattcttttaaaagtatttacgaagaagtttatacaactgtaaccaagggacttttgtgccgcctgtgttcaattgtatatttcatccgaaaagaattggattgcttggttgttatttctccctggtaatagacacttcttgtgttattgattaagtttttattaataataatctgatttttcctttaaaaaaagtatttgtagataaatttttctaattggattccaagtgttgaggtatagctacatgaaatctcatgaaaaggggttattgtatgctacataaatcgtgagattaatttataattttaaacataaaatagttgcatgtgtggcacaaaaaaaaattaaataatttttgtttgtaaactgacactgtataaat

SEQ ID NO: 586 - DNA, 1367 bp, Glycine max
  Soy_ogl_5781 Gm17:39409101..39410467 Cluster 2
ggatagaatctttcagggtgtttggatgcacatttttaactttcgttattctctcatcaaatccaaaaacaaaaatggaaagctactctcagccacttcaaacaagacacagatcccttaattaaagaagcaggtctaaacatactttaataatgagcgagtcaattttcttccaacatatcattcctttcacgcaacgtgacataaatgagcttcttccgtcatcataaactcaaaccaatttagaagcctttgattcagctcactagctgggaattagtagtaatgtaatatctatatcctttgcattatatatttggttttcaaaaaaagaaagagcgagagtatatttttaattcggagcgtgggcaaatcattatctactataaaaacttataatgagattataaattttataatatattgaacagattaaattaaattccacacgtgtaattcaagtaaaaaagaaatcactaattcagatttcttaaatatatattgttttaaagttcaatttcaaaatttatgtatgtaaacttatgaagaggactagaggagtattcggcttcagtgtttacaatatcgcgagatatattagtttttcacataaaggaaatatataataatctatgagggtctttttgttggagttatatagtcttgtcggtttgttttttgatatatatcaataaaaattaggataaacacggaaaaaaaatataaaaattaaagatcaaatagtaaaaggattattagttagtgaaattatactcttcctttgaaagttttacattaggtagataagcgaagttaaaatactttcatcaacatcgttttaaagaggtgtctactattgttttaaatatatcaattgtacttcctatttaatttataaacaaatacaagtcaatatatactgactcataaattatattaaaattagctttctgaactctatcatatatatgggtgagtgaaaatttattgctctattattctaatagaataaaaatataagattaattgagtagttaaaaaacaatggaataaaaaaaagtcattagtttaatttttttgttaaaaaaacatcaaactaacactttgtcaataaaaaaaactactccaatcaaatttgcccatatttttcgaatctttcccttacttttccttggtgttatgaataaactaattgatttgtatggatgttgtgacgttgaggcctagttattgttcattagggatgataaaatttatttgaatcctacgtgtacttgcaaaatatctgcaaataaaatagataattacatgtaatattagagctgaatacgaaaaagtatatatctataaatttatgtaaggatggt

SEQ ID NO: 587 - DNA, 1765 bp, Glycine max
  Soy_ogl_5908 Gm18:2714101..2715865 Cluster 2
ataagatcatcattaaagtatttaattataaaatgagttgatataatttcgttctcagcaacaattaatgttactttgattctcaaaattgtctgtatgtataatctaatctctaaatatatcgaattaatgacaacttaatacataatttagttttcaaaattattaatttcatgacaatttattttttaaaaaatttattgaattgatcgtaaatttattttgaaatttgttcaattttgggttagaagaaaacatatcacaaaaatatgtaaaaagaaaagatatcaaaaaaattataaagttggaaattacttatatacacattttttttaagaataaaatacgtacgtacaattaaagtatgtctttttaaaatgatttaaagttttgatttattgatttgtttctttaattgcctaagccgtgtacggaaaagaactacaggaatataactatgcagaggaacaacattttatccatcctcgagtcgacaaatggggtcccaaataaagggcactgtcatcaaattacatctattgtcgagtttcatatgtgactcctgtgtcgtgtggaagttattgctacccagcacatcatcataacatttgatggaataataatattaattcaatatttttaaaataataaataataaacatttgataacattatctttctttttttaagtgttcaaaatttcttatcgatctgttttgtaaaagctaaagatgattttacttatatttttattttcatttaattttaaaatattctatatacctatcataaataagagataaatgataatggaggttatattcaaaagttttttttaatattaataaaaatattagactaaacaaataataagtaaggatagtattttttaaaaacaaaaatatggatttagtgtaaaaatatttacactagcagggcatgaaaattaaactaaaatatatttttcactcaatcgaagaactgtatttaaatttgagagaaaagagatataataaaaataaaaagtgaaacttaataaataatgcaactagaaagagagacatatgcataagctaaatgaaaaagtaagctatgaagaatgataattatttaataattaataccatacaaaaaaatacaaatcataagtgtcgaatgatattttactttttatttatttatatgaattgaaatcaagtaattaaagatttacaactcacatatattcatcaattgaattagactttcttaataattttttaaaaaattgacatttttaaaattaataaaaaatatcatgtcaatttttttaaaaataaagtaaaattaaatacgttttaaaatcttaccaaaattaaattaaatttattttttgaacaagtcaatttagtgattacaggacttctataatatcaagtatttgagcttgtagggaatcatttgtaaagaaagacaatcctgttatccttaacagttaacattacattaaaaaaacgacgcctatatccatttatcttacatgtttaccacaaaatatatatagcaatttattaaatcaaacaaattaattgatatacatttggagagcaaactaattatcattacactctcttcaaacaaattatccatgtttgaattaccattacactcctttcaaaagtactttcagaataaataaataaaaaatacaaaagctgtgtttggatagctatttggagagctcaaacctactctttgtctcactaaatacagtttgctattatgt

SEQ ID NO: 588 - DNA, 1740 bp, Glycine max
  Soy_ogl_6786 Gm20:36396961..36398700 Cluster 2
cacgtggaggaatatggaatcatacaatttggtaaaattgacaaatattattttttcatgaatatttttaatttacgtaatttttttgaaatataaaccaagaaaattgcaagataaatataaataattaatttcaattacaagactgatggataaaagattaaaattacaatttacaatagaaaacaaaattatacttgaatattccaactaaattccttaattatattacaaattaatgtgttgttaacattactcataaattgtgagttattgttgttacaagaagattaaaagtaacaacaaataaaaagttatgaaactttgatccgttaaaatttaaattaagaactaaaaacaaaaattataaaaaaagaatcatacttaaaattagcttattgcgagtgattgtgtataaaatagttattttattttgttgggtagtaaataattttgagtagtatattcaaaatcaattgagtccatatgagtccacagattgattgattgtgacttttatgagtcaagcgatcaaattgaaaaaacatacataaggaaaaattgtataactagttaggtttggtgtctattaatttttagatccaattttttttatgaattatgttttaatttattaaattttggatttaacttaattggttgaacatgatatttgagttgttataaattcattgtcatttccataagatgtttgctaactacttatcatctcttgaaatatttttaaatttattttaattacaaagaaaagtataaaaataaattagaataaagaaaaatgagaagttattttaaaagtagctttcattcttatggaaatatagggttcccatccttttatatgggaataaaaagaggataacctatatgtagtatagattcttaggaatggatcatatgtgagaataattttttataatttgtatcaaatacgagaatgctacattttcaaactcatacttttgcaaaataaaagctaaagtaaatattttataaataaaacaattaaatgattaatcttataatttcagaggataaaataaagatttataaaataggcgccatgatataagaaagatacataacatactagtaatttttaagagtgaaaattcatagaggtagtagcatttattttgcaaatctttttggttggtctaacatttattttgtaaatctgaattgtcgatgaaagaggaggggtccactgaggaaaatggggccagaaaacagtgtacagttatgtagtaagaagcttcacaggcttttttgagagttagaaaaatgtgaggtgtgttgaacctcagcattggaaacagccgaagcatgagacaaacaagcattaacacccttggatagccaccacccactctcttcaatctccatgtaaccctttcacaattgtctacccctcattgctataattttcgttaaccatgtccttctattttctgtatccatataagtttagaaccataccccttctgaatattaattatttttatacactaagaaagttagttaaaattattaattaattttaagtaaaatataaaattatttctaaattatctttcatcatgaatagaaaagagttgtaattaaatgagtgatattttaggaataatatcattaaataaagataaaattaattaaatttccttatatttaagtatataaaataacctttttgtttatacatagatcaagaggaagtat

SEQ ID NO: 589 - DNA, 1747 bp, Glycine max
  Soy_ogl_1725 Gm05:38089954..38091700 Cluster 2
agacccactaacattaaaaaaaatcgatggtaaatttatcagtaaactgacagcatacaaacttattggtatatagaattttgtataaacaaaactttcaaaaattaaaataacaaaagttacaatttctctcaaattaaattatatattgaaaatatatctagtcgctaagtattggttaattcataattggatcttgatatatagcacctacgtggaataaaatggtatatgttttcagaagaagaaagttgtggggaaaggaggtgtatatggaggactcattccagtcaaagaatggaggttacatggctctttgaggaattctcagtgtaagagatatagtataaattaagaaacaaagttgctatcaaagtcataacgtttcacaggaagatatgcgaacactacattacaaatgttctcttacgatttgatatgtactccttgtttcaactacctactgatagttatgttgatggaattgtgcaaatcatttctctatgctttctgacctattttttgcagattagaatgcggttctttactatttaattgatgtaatttttatttataagagtttaatagacatatataaaaatatttatattattgattaattaattaaaatttatatttgtaacgacttcaaagaaagtaattacaaaaaacaataaaatatcatacataatattaataatttatgattatatgataatgtaaaatattttagattattacaatattattagaacatatatcatttattcataaaaaatagtaattttataattattcataaaaatggaaagaaaaaaaagcatccgtgtacgttgcgataaactaatagcgatcaggagcaatcttcaatcgtttttggcccaaacaacgacttgagacggagactactttccgaaaagttgacttattgtctgttggagttgttataaacgttttgggagaatagacaagtaattattgtaaaaaaatcaatcaatttttatttacataataaaagaaagatttaactataattttacttttcctatcttgtccaatttgcaaattttgtcccaacatttaaaataaagatatttagttattttattttatttctaaaaaatcataattttgatctaatttttaaattttatttacattttatttcttactttattcgaaaaaaataaataagacttatgtctccttagtaaaaaactgaagctatatatgcaatttcttattttattactatatgaatacatccattatatttcaaaccaaaccaccaagtgtgtaaattagttataacaaaagctgttttagcaaaaaaataaagtaaaattagagaaatatttttatttttattgtcattcgacttgatttggaattttggattgatgtagtatatcaatatcgatcgttgtaaataattatttttaagtaatgtatatgtattaataacgtaatataattataaattatgtctaaattattttaagataagttattttaaaagtgaataaatttatcatatgatgaaatgtgattgaatgattatatagtttttttatattattaatgtataattatttttttattgttattattccagtaaatataatttatttatacgggagctaaatttaaaaataaaataaaatgaaggtacatgaacaggaagtaagaagtcttaattcccaaacacaacgaatattttatgactatatataattagtcaactccg

SEQ ID NO: 590 - DNA, 1419 bp, Glycine max
  Soy_ogl_5783 Gm17:39501138..39502556 Cluster 2
agcatcatcattttggaatactttaatcagtgcagatccatgatgagagacatcttcaaaacatcaccaacctcggcatgcgctttaaaatgacacaacattacatctatctattaatatctttttgtattttattccaatataaaaaaaaaaaatactactagtatgtactagctagcttaaattatttatatatcaacactaatgcacgcctttttgagttatactatttttaaaataaaaaaaaatcagcaaaacttttatatatagttgaaacagagtggtacccaaataacaaacatcaaagccaatttccaacagtttgattagcctatttttgtgttatattagtactatataagaacttgaaagagcaatagggtttgcagaagtaaaagataagaagaaaagaaaaagaaataaagaataaataataaatatatcagtgatataataaaaatatataaaaagaaaatgtgacaaatatttttttattcgtaaattttaatttattagttttagaaaagatgacgaacataaaactagaagataaattaaatgtttgagtattataatttttctaacataaaaatgttattttcactgttttttacaattttttattatattagtcattctattatatatttcaatttcttttataatttaattagaatatattgatttgtaatttttttacatgataatttcagctatacttttgtaaaaatagttgataaactagttaaaacagtaaaattagctaaaaattgaaaaattaaacattaacctagtgtgttatgattgataaataacattatttttaagcaataatcggagatttgattcttagtatctctaggaattaatcatttactttcagtcaaataatatcctaggttcacccaaaaatattaaaaatttgtctatatttaaaaattattaattagttgaaagttgaaagatgttaaattagtttatcctcttttaaaataattgtattaaatgagagtgattttgagttattttttaatgaaagcatttttggtataaaaaaaatcaatgacagaattattaagaattattcttaatttttatctttttcatcttttattttcaaattgcattttattttataaaaaatattaatagttaaaacaatgttatcataatattatttatcatatatctaaaatttaatttatatattttaaaaataatattcgcggccaatgggaaagaaaaatataaagactctccctaaactatccaagagcaaaatagtttgaaggggagaaaaatgattaagctaaacagaaagatctgtattatgtctagcatcactatttgcaagtgggctgctttattgacttccctataaataaaactaattaagaaaagtgaggctggactagtctg

SEQ ID NO: 591 - DNA, 1657 bp, Glycine max
  Soy_ogl_2940 Gm09:1776142..1777798 Cluster 2
acaaatttactgacgataaacgactgaatggtcattttagtgcgtaccaggtaaaattggttttaaataaatttaattttagttaaaactaattttgaaataaaatgattaatttatatttgtatgttttcattataaaaaaataagttaaaatttgttttaattcaaaattaattatagatccagaaacaattataaactctttttcaataaaattaataataattgacaaaaatgtaggtgatttaagttctttaattaaatgatgtaatgttcgaatcttgattaatcctgaactatcgaataaatttttttagaagagaaatatttattttataaaaatcaaacatctgaaaaattatctaaaatcaattttagatacaaaattattattttttaacttaaaaaaaaatacttagatatattctagtttactattaacgtttagttttgttatacttgtaacttttatagaaaaaagcttttttttaattaatttaataaaatattatttagattaaaaaaagaagtcgtaatttgaagataaattgtaataaactaccatatgagcatgtggggtaggtgcattacaatgttgaaattccaatgtggggtactatactagtcatatatcaaaagaagttcagttgtccaagttatctgtatgaagcaagcaacttgccacgtgatgtccattctactgacaaaaaagtcagctcttgtactgcctagagttatttttcatttcttatccatatatctcagacgacaaaattaatttgtattcacccgttacatttatatgctctaaatgctgttttaatttacataaaatcatcaattgcattttaatttaataaaaaattaaacaaaaacaaagaaatagtatttgttaattagctattcatacatttttcttacttcatgacttgcaaatgttttatttagttttttttagtttaaaaatgtgcaattgctacttattaacttggtaaacaaaacaattaataattaccatggcaacttgcatagaatatatacctttctgaactcatcctgctttccaaatttgactcttgaacgttcacgttcttggttaaatttctcaacagtactccctggtgctcctttgctgttgccacagacaggcccacacaacacaaataaagagccatcaaaatagcatatgcttccccaacgtacatttaatttgtacagcaaacataaatgtaggataacgctcttcaatcagatccaacaacttaaattcaagtattataaatttgtttacactctttttttttttatatcaaatcaaattaagttaattagtctatgatacacatatgttacacaagtaatttgttagccagcttatttcaggttttaaaatgtttaaagtcctactgtttagcaaaaagaaaaaaaaatatcacagatcgagagagttttctttatatttttctatcccccctcctcacccttttttctttcacttttttcattacatatcttctggctgattttgtatgagatctgtgacattttttatttttattttacacaatccttaacgagagcttggaaggaattaaaaacataaagaatgaatcttttactttaagacaacaagtattaaatgtattttttatttttt

SEQ ID NO: 592 - DNA, 1511 bp, Glycine max
  Soy_ogl_3500 Gm10:42760301..42761811 Cluster 2
agtattaatttttctaaaaaacttaaaatatgtttaaaaagttatgctaaataaatgatttttaaaataaaaaaacaaagatttttttttatttgcagaatataaaaacacaaagatatattagcgaattttgtcaagttaaaaaaaaacctataaaatattgtaagaataatttctataaatgtattattttcaattagtttagatttttgggacaccttctgacaccttttacacgtttatttagtttttcttcttcttatccatatttgagtaaaatttacaaattaagttcgcttatgaaataatccaaaaccaaagagtctgttaccatgaaatgtgtggattattgtccgaaattgttcccggttagccatcacgagaggaatttttttttcaaaaatccctttttatttacttaataattattttcttatttatcattaaaaattatatatgcaatgtttattcttcagtcagcaccaattcttacgctttcaaacgggtaaacaatactatagatgctgggtacctacccttaagttaaggtttgaattgattagaaagtcatcaattcaaattttactaacataacatactagttgtaattattaatatttattgataaaaaaattaaattaatttcaagatagaaacaaacacattattctgtaaaaaaaaaaacgcattattcggtccccacacttgtacttctaagtaactgcacacgtgacatgtttttatggatttgatttcttcaaaggcgtttgatgaacaaaattaatgattgatattttgatatattaatatttattatctattatctatgtgtatataatatccttagttgatttcttattatcagatgaatttttttaatcctctggatcaagtgttcattccagaggacctaaatctattaccaaaagttggtataaaaaaatgataacaaaaaacaaactaattactaaatccgtttttataatattgcagtacttttacttttaactcctaaattctaatattcacccaaaaaaaaactcctaaattctaatcctaatagatgttatataaaatcttcaattgcattttgtgtgtttttttaaactccgtttacgtgttcgttcactaaaaagacatccatatctttcttgcacgagctgtttttctagaggaaattaatgtttcttgcaggaagctaaaaaccatttaataaagactcctgaatgaaaattgatgaagtgtgaattaaattcaggttttaatttatagtattatactactaatataaaatattttatacatatatttaatgagttcattttattgtcatataaaatgttttcgtacatattttctcctgttttaatagggatacactcatattcataagaaaatgttttaaatttaattagtagtttttttttatctttttcaccttttagttattttgtaaagataactgttcatgtaataaaaactagttgttcaataaatattaaatgtgtgtg

SEQ ID NO: 593 - DNA, 1266 bp, Glycine max
  Soy_ogl_4643 Gm14:4172539..4173804 Cluster 2
aacaaagtaaagacaattataaataatgacagcaaaagtaactctgatatatttgagtcaaagaaatcaacaccaataggccagtaaagaatgacttttatagtattatccaattctctattggcctacggtcacatcttattctgcaataagaattaattgtgaagtaaataaaatgtcatttttccaaaacatatagcacaaagtatatgcatacaatgttaattagttcatatatcaagaagctaaatcaatcatcaaattaaattttgttggaaaaatcgtgatctgcaaccatatttgcttaaataagagttgaatcacacagaacaacagaagtaaagaacacaaaaagggtatcaaataaagatcttataagaatgagaatgatttgagagatactaataggaacaattttggatacaataaatactttttgcatcgctataagtataatggaggtagaaaaaacattttctataacacatgagaaagtaaaaaatgactatcacttagaaacgtcactcaggataactccttccactacagatcaaacaagcgtcagaagccataaaatttattcttatactacacctttcgaataaattgttgtgtttggtaaaaaagtcgagaacataagtgttacgtactccccattaatagttagctacaataggttagtagttaccatctgttagttatattagtgagtgagttactcgtgtgagattgttggcttcttttttctataaataagaaggggtgttttgaggaagggatatcttgtcattttgtaagagggttgcgaccaattcctatatcattgatttatttggatataataaattaatttattgtgttattaaacacactgttataaaattatatttttcaacctaaagtttatgtatgtgcattgcccttgtgactgattaaattattaaaacttatcatttcataacttgatttttaaacttaattatgtttttagttcctaaaataaaaacatctattttttaatctctcaaataaaaattatttttttagtttctcatattcaaaaatatattttagtcttttttttaaaaaaaaattacattttttagtctttccaattttaaagatggactaaaaagagtattttttttttaaaattaaatggactaaaatgaacatgtttcaaattagagtgactgaaaaatataaatttttatttaaagtacaaaaaaatagaatttctaatttaaaaaattaaaaacattatta

SEQ ID NO: 594 - DNA, 1264 bp, Glycine max
  Soy_ogl_4923 Gm15:8695837..8697100 Cluster 2
atttttatttctggcgtataaaccttttttggcattttttttttactttactgttacaaaaaagttgcatcgcatttattccttgatttattcttttacttggaatgatttctttcaagtaaggaagagtctttccacttttatatcaaccatttgtttttatcttcattttagttgctattttttctagttaaaaatgatcattaattaaaaatacaaacataaaaatttaaaattaataactgcatatataaactttcttacattgtgatatatataaaatattgtcatatgattatgaattattaattatacaacaagattaatatctaactttgagggacattcgtaatctttgagacatgattaaaaaattattttaaaatgttaaattaattagttaaataatgcaaatcggtattaattaccaaccattagaaattactctttaatctttaatatattaattataatcaataattatattttaatatcaatttgcacttgcacaatatagaaacgtttaatttaatgaaaaaattcgtgttcaatcccatcattgtgaaaatcatttagaccagggacactcacactatcatgaatcagattaatctttggcttaataaattaagaaataacatagaaaagaaaaactaattaatcatcattatattgtattggacttttgtttagaatatgtaatgggttggactatttaatttatgttcaatgagaagtactgccttaatttgctaagttacttaattattgtcttactggaccgttaatacaaatatttactatgaatgaattaacgatgatgacaattttgtcttctaatttaaaaatataataaacaaactagagaagggggaaaatcatgcaaaaattatcgagggaagagagaataaagagaaaacgttatttattctcacgcaacgcaagttcctcggtcacagaactatgctagctagcatgtgcattactgtaaatatgtatacatctttacttataatctaagaaaatgacaaatggatgtggataggtcacaagtagctagccagccgggagcagattctttgcttttgttttcatcatattgagattaaaaatggaatacttgaaacaaaaaagcaccatcaattccaatttctttttttaaaaataaaatctataaacaccctaatgctagctagtcaagagaaatagtacatgtgatagaaaaaataaagagaaatgatgaacattaatagaatatttctca

SEQ ID NO: 595 - DNA, 1252 bp, Glycine max
  Soy_ogl_5236 Gm16:1713249..1714500 Cluster 2
tccataagatgctaagaaaataaaaatgaaaaatattaaaaataaaaatatttaaatgattttttctttttatatagtatttttaataaatcgtttttgctttcatttctttaacactaaatcaaattcctatacaacaacaataataataataattaatttttaattaataaaattataaatttgaaaaaagggctttaaaatttaaggtttctttgtattttttttttaccttattaaaagctaattttaagttaaatctgtttggtaaaatattttacaaaagttctgattttatttaaagttagcatattagtttacaaaaatataagattgacaaaattcatttaagaaataacagatataatgattttgaattaaaaaaatccattcaagactaacttaaataaaaacatttattttaaaattttgacaataaaagaaaatgtactataatatcagtttagatataaaaaaatcaactacaataattttgggatgtgagattgagaaagatccaatattatgtatatatgataaaaatatacccttttatttgttttgttcaaatcaatttcttgataatttcaacgaacaaatttgtatgtatcacaaaatcgggtctacaaatttgacatgtatcacaaaaaaaaaaaaggaagaagaagaagaagctctgaataagtttttttttttttaaaagataaggaagctctccgaataagttaaaaatcctccctgggtcatcttaaataaaacctccttgcttcaattatttcttcataaaaaataagtcactagttttttcaagagcttttatacaatatatgtttggcccagattttctttttttttaaaaaaaaaagagagtaaaaaaaaattggactaaacactaccttaatatccagattcaaataatttacaattcacgtatgttttattccttaataaaaaagttaaaataattttaaattacttttttatactataatatttatatttttatcatactaaaatagtacaaattaatttcagttttatttattttctattccattatccatttcttataacaggagtaaggtaaattaaatcaggagaaattgaagcacatgttgttagatatagttaatttgcaaaggtagaaattggccaattcaaaaggaaactttaagtacggactagcaaggtggtggggtttgagaaattcataatattattacaaatagcgaacacgattcaccatcacata

SEQ ID NO: 596 - DNA, 1189 bp, Glycine max
  Soy_ogl_3581 Gm10:46503612..46504800 Cluster 2
aattaaactagtacctaaagaaaactaatatgaaaatacaagttattaacagtgacaatgcatgcattaatatattcgtagccatatgaaagtgatgattaatagaaaattcagtcctcaacaatttacattgtaattacttggtattataaatttgaaattgttggttcatgagatgagatggaaatccggttgatgaattcagctgtcactgtgtgacccttctcataactagccttaattactcataagacaagttttggaaatctgatttcaggtggacccagtcaacaaatttcttgctttatttcttgacggatgtatcatccggaatagaaaccttcatattttttaaaattattattttttctataaaggaaacatgtcttctcttatcgtttataatttttttcatttctattaaattttctgtaaacttatttagctaattttgaaacaaatttaaattatattttcaattttaaatgtaaatacatcgtataaaacatagaatatttatttttaaaatgagcttgaaattcattcgattttaattcaaatttaaaaccatattttaaataagatactataagagagtttttataaataaacttttgtataaattataacttttttttttaaaaaaaaaaacttatttcatttttcttcttcttaaagaagcttatgaaaaaaaattatctaaaccttcattttttatttaatatgaattattttatgatctacgttagagttgtagatttctttatgattataaatactaactcataattaaaggttatgatggaatttttgtgtcaaaccttcaagtttaccgaacttaatatgattttgtgttctcgtttctattagttgattgattgactaataatcacactataaataattaattgatgaaactgtgagataaagttgatttaagagtaggatcaatcataattcttttactttcagttagttattgaatcaagaaacacgttattcttttttacgggaataagcttatatatcttatatcattcataagcaaaacaacaatatggtttattattattttttaaagttgttgtcttacatgatcatttagatttgggggtaatattttgataagagaaagaaagaaaaaaaaaaaaacagcataccacaaaacatcaagcctaaaaacaaacgg

SEQ ID NO: 597 - DNA, 1748 bp, Glycine max
  Soy_ogl_5634 Gm17:10420793..10422540 Cluster 2
gaaatgttattaacaatatatttcaggttgaaaaaaatatttcagtgataacatgtgatataaaatctaaacgaagtaaacttattttatatattttgagattataaatttttgaatgatagaaaaataatgtatgaaaattgctattgcacttgtcaatacttgtttatgtagtaacagatacatgaggtgcatataattagaaattagtgaaaaaaattaatttgtataataatggatacatataaaaaaataaggttatttttggaccatgaaaactcttttttcacatgctatcgttactaagtatttactaatttttcaattattaatatttattgaagaacctaactaataatttttagtctaattttttttttgatgtttttttttcatttacaagaatcaaatttaagacttcacttgaaatatttgtgcttaagttcactttaagcagcatggtttaggttaggacctcttctctcttttgttcacaaccccttacgtagtctttaatgcttttttgaatatgtatatagtcaacaaatgaacttttcatattctaatggctagaactttttacacaaaatttaataaaaatatagaaaatttctttagagaactttttttatatgaaaaaactataaaataattgtagaaatattattattttttgtaaaatttatcattcgagttttttttatgttatttcaataatagaaaatgtaaaaactatataataacacaagtaaactttagatggaaatattaaaataattttaaaattatttcaaaggaaataaaaaatgtaacaaaaaaagaataaaaaaggctaaaaacttaccatagaaaatatgaaataaaaaagacttaatcaacaatgtaagggataattcttggaaaaggaaataaaaaaacaaaataaaaaattaataagtaaagtgagaaaaacctaaaatataaagtgaataacctagtatgatggacaaaaagacatataagagtaaattattaatatatttaaattataaaatactattaaatgattatgatattttattaattcaaattattgtagtggatactaattggttaatttaaatatttatttttattaatctaactacaatatacattgttgaaattgattaatattgtattaattttctcatataaaaacaaattaacctaataacaatgtttaactaatattaattaattgactaaaattataacactgaatactgattaagtgagttatatatttactttgcttgatttataataatgctagaattataattaccgaaaaataaaattattctagttaggaagataacacttgtgatacttagttaaatctcttaaacaattctcttagagaaaatgaaacattttagtaaatgtatgaaaaactgatgtggatggattcaccttttatactttggtatttttaagagtaatattttgcttaaaatgaaacaactatttagtacaatggctatgtacaaaatctacaacaaaaaatattttcattgtagcgtagaaggtttgtacaaattataaaatagataatgcatgtacgattaaattgaaaagggaattggataatcaaagagaaagtggatgtaaaaattaggtcttactcaccattggtcttttgaatgcaaatgagtcaggtattgggttcaattcacccatgttgtaaggtgtccttcaaaggttttttttatgacggacaaacattg

SEQ ID NO: 598 - DNA, 1700 bp, Glycine max
  Soy_ogl_2667 Gm08:13741501..13743200 Cluster 2
tgtcttaaaaaaagataaaattaaaactatttgattaatagaattaaccgttacaatgttagtaaatatatatttttagcataaaaaaacataagcaaggcacctagtaaatacatcataaaaatttggcttatgcttgttcaagtatattccattcaaatattccatctttaagatttggtgttgaacacatatattactttcttttagggagaacacatatattacttaaaacattacgtgtcagtattatttttctcaaactattcatattgttctcccaaatataatagtaaaataaatacttccagatttcaggccagggattattttcaaatctaaaaatgtcttaatgaactttttaaaactgtatatataggtataatgggttaattttaaatttatgtgtgtaactttatatatacttgaatctataaaatgaaccaagtgatatgtagtttaagattaacgtaactcagcgaaaagaaaatagtttaagattaatccaaacggattacaatacaaaaattctttaacttcacctcatttatatatatttttttcaatttctttgctccgttgctcttttattatttgaaatagataaatcgctcaaaaaatcaatgcttagtatttttaaaattgccgcagggactgaatatattttaaattattttcagtgaacaatttaaaattaatataaaactgtgtatatttgaatgtttcattttttttttttaatatcatcctgtgacattcatggcaactataaaactacaaaagtaaaggtcttggcgtcttgctatatttaagctaaaagaaaggctatctgaagcattgtttcaatgttcgtacaaaaaaaattgtattttttttttattgatgattggttggtgctaacgtagacacatgagcaagaacatgaatttcacactttcgtaacttgatctttaaggcatggctttaagcacagaaaaacgaaattttaaagctctacgttcatataaaattaaaaacagttggaatacaattctggcgacaagaaagtgaaattttacattaaataaaaataaaaatctgaacatcatataaataaataaaaatatttataattttgagtcttataaatttaaactaaaatataatattaaatttatttatgtaatttgttcgagactcattgataaataaaatattctctctttttatgcacaacataactagaagataatactaacataaatttttatttacgtatgcttaaataaatcaatctattacacttaatttttattaatccaaacctaatttatttcctaagtctaacattttttagggaaaaaaaaaagcttaatataaactagaccataaactcctttcaaacatcatgactcaatttttcccagctatgattcaacccaaacgggttgagtaaagccaaaattatctcactttacaaccaaaaaaaaaaatgtatcactttacaattttgatgcttatctgaaccaggatgcaaaattaaaaacactataatgataaagacacttggctctatttaataagatcttcttttaaaaacttttatcgttattaggtgactagcataataagacaagagtacaaaacagattcctgtatattatccagcctttcaacatttctcattctatatttcttctttttatttttatccttcattt

SEQ ID NO: 599 - DNA, 1178 bp, Glycine max
  Soy_ogl_1761 Gm06:1295723..1296900 Cluster 2
ctttttttagaggattattacttatagttaaacaatattgaagaattttacttcattttaaccatatcccattcaggtggtaaagtttgcttcttttttttttttttacttgacaaaaggtggctttgatattttattcctatagaccacatgtattctcattcctccaaatagaaggcagtaagagttatctattttatttttaacgattagaattgtccgttttattaaaagttgttgtatttgttattgctattttctaaaaatttaaaatacaaaaatataaaaaataaatttaagttgatgtaaataaaataattaaaaggagtgaaataaatgaaggttaaataaattaattaagtagtaaattcaaaattaataaaaatgtcatttgaaatatttggtaaaataaatttaggacaacagagatagatggaatttgggaataagaatggaaattaatctatatgcactatttttcaaaaaattcttttttatcttgtcataaataaattataaaatctgtccaatagttttttgttttgctaaaatttgatttaaaacagaatggaaagagtaattgataaaaagtactctgatatttttttttaggggatactgtgatattattttaaatcttcaaaatgacaaataagtaaaaacatgtttctaaaaaaaaatctgacaattataaaaggacttgtggaagtatttgctgtaacttccaaaaccagaaatcaggatgtataatctgattaaaatttactacaggaaagaaaaaatcttgtgcccttagcaattgatacaagaagtttgtgtcttcctattgttggctgattcttatttgtaattatttttttaaaattgtctccgattcaagacatgtctttttcgatcacctactttgcttcacaagttccaactatcaacaacattggatatactagtactataatataaggtaattaaatgtttgtaacaagctatttaattgttttaagtaatacgagtatttcctcagttattatttataaaatacagtcaatttttttctcatactataagattttattttacatgcattaattatttttttacaaaaatatttaaatttttctttctcctatgaaaattaattaaatagattctttataaaattaaaaataaattttaaaaaa

SEQ ID NO: 600 - DNA, 1579 bp, Glycine max
  Soy_ogl_3354 Gm10:3771501..3773079 Cluster 2
gctttattttgtcgaagccttaaccatttatgtacaatcacatgcatgctcaactcctaatagtgcttttttctaccgacccaataaataaaaacagttagataataatagtcgttggcattgtgctggtggctggtgccagtgatcaacaattgcattttcatcattaatatcagaaagtgacctaagttcctgtatgcattgtatagcatttctagtagtgtaacttacgtacgtaaaaattcaatgcctagaaaatctgttgtcttaattagttaacgtaataattaaaaaaaaatgtctgttgccctacggatcagcacatattgcaaaaatacagtgacaactgacaagacgttgacacgtttatgagtagatattttgaagttaatcatgctgcttaacataatacgtggaaaaaaaacaaatttaaagcatgcatgcagatgggtttcagcagaaaatatctgtttatagaggctacccgtgcctttaagtagataactttaagtagttaattccaatattgatcagttacgagtcttgatttaattaaactggtttgatgatttagttttaaattaaggagaatcctattcgctctagctttttccaataaatagatacatacttatattaaatgataaaattaatttcaaatggttaaataagtataactgagatctatatatgcagcataataaaataaatttagttacagattttacaataaaggtatgttatgataataacataaaaaaaaaaacatttgattttaagtgtttacaaaatgagtaaatatagtttccgttttttgaaccactagggtcaatacagtggtgggagatttgaaaaatatgcatgagattaaatattctaattttagtgattattgtaaaacaaaagtctatgttcttaagaatgtttttaagatacaatgttgtttaattactttttttttgtttttttaactataagctaaatagaattagagaaaaagtctatacattcagttaatagatttagtatagttaatagacagctaagttcttaagaatgttgcaaggggttaagttttgaatcacatgtatagagaaaactttattagtattaatattttagtttagtgattcttaatcatgcttagaagaattcagtctttgtaaagttgattaacttttataatacatatctttaaagttatatttataatattttttaattgattgaccgtataaactttatacactaacaatatacataaactcataattaactttaaaatattaaaattaaagtaactgaaattgatgtttaaattaaatctcaattgtaaattttatattgttttaaaagatttacttaagaattggtttcttatatagaaaaactcattatatatatatatatatattatcttgatgtcggtgtccttaaaatattgatcaagaaattaaaatataaaatatttattatgaaaattaatcataaaagaacataaaaaaaatcttagatagcttaattttaaataatttattattatttttagttctttaactaatatcctaaaacactaatt

SEQ ID NO: 601 - DNA, 1178 bp, Glycine max
  Soy_ogl_32 Gm10:42951623..42952800 Cluster 2
ggtgttggtatcactaattataatggtagtgggaaagagaaaatagtacaactcaaaaaaaggggttaggggttatatagggtcttgccgttgtaatttgttgatagttatgggttatattaagtgctacttaccttgcatctttacatgtctatatttcttttcccctattcgttacatttttcaattttttttctctttctttcctttaagctatatacagcaatcttgtgtctaaaatattttttctacaacttgggtatgaaaattgggattgtaaaagatcgtgttattttcttggttgcattggaaaccaaaccgacaagaagaaatttttggttgaaaaacagacaaaatttgaaggcaatggaactctatcggtcgtgccagatgggttgcatatattcaacaaaaaaaaaaagatgcgttggatattacccaaggcttgcccatctaacgtaccaactcaagagggacagagaaagagctcagtatttttagcctccaagaaaacactagtgggcttgatcaaatctgtttgacagaactgatagacccattacaaataaatctattaataatgcgcaaaaataattcgaccaaaacaaaatgatataaaaaatttaacatcttgtgaaaattttggctttttatattcaaacaatggtgttctgtagatattttggacttgtcaggtgacccattgcccagaataactacttaattttccttcatttatcattatataagacattttatgcctacaaatatacatttgaatctcataattcgccttttatattctctgactttggcatcagactgtttgtgtagatgcatgcaagttttattgctcaccataaaattgaacttctcatataaattatgagttgacccacttgggtcatgaaagtgggacattttcctacttcctcaaggaaaaccaaatccatcataactgatagtaattaataaagtggtagctccctaagcctatgaataggcctttgatggaaactcgttgcttgttagctagaacattttccatcattgtataggcaatatatgagcagtttcttctctctctctttcttcctttatctatcttctcttcttcgtagctcatctgtcttttttctaataagctcatttctagctctttatattcattctatttt

SEQ ID NO: 602 - DNA, 2000 bp, Glycine max
  Soy_ogl_4632 Gm14:3900701..3902700 Cluster 2
ggatatataataatgtcatcggtaaaaaaaaaaattgggataaattttggaccaccctaatcattagaggcaaccccatcttcaatatattgtagcttaatctttccggtttccatgctagcccaaacaaatagaggtatgcatgatcatttgatccccttatatatctaattcctcttgaaaggaagaattttgttgagagagagccaatcaaatttacaaccataataaccgagctaatgcattggttaattaaatatgtaaggtttctatctagccccactaattctagtgtttccttcacgaaatcctcgttgactttgttgcaattaagccgttttgattcacgaccatgaagcctttttagcccaaggagaacatgaaaaaacgagtaatacatttatcacttttttaaatgcttttactaatttgtatatatagcattgattaaatataatataatattttcttatattgttgtcgaattgtaatgttttagtaaaatacagatattttctaccgaaaacaatcttattccattaggttagaattattataaataataatttttttctaaatatttaatttaaatatagtgaagttagaattgagattatataataaatattagtatttttttggtattgatataataaatattttaaatttctgatagttatacgtgtattgatgatgcaaaatggcatgcttcattcatttaagaatttaaatcaaaatacattgccgacatgaagaaacgatgggtctaccactgacttttgcaatcaatggctgattcatttccacgtgccgcctatccaagcttagctttctatatcactttaacgcgacgatttttcgcaacacccataggcttatgccttatggcactgtctgaaattacttttcaacccttctaatcactcccttttacacgaatgcattgtacgtaacttgaatcagacggccaagtcctcttccccctaactggacgctcaagatcttccaaaagaaaattgaagtcttctattttatttttctttaatgaggatcactagtcacattgacattttttctggaagactttttatatgtttggttataatttatatgaaattattaattttgataaatttttctttttatttaatataaatcagaagataatgagaaacaaaaatctataaaaaattataaattaataatcataaagaaaatctttaaaaaaaaaagtcatataacatacggctaacatttctcttaattaatatatttgattttgtttgtttttgttgaatggttatggcaatgtccgaactatgaagtgctcctgccaaagaatatgcgggtttaaccaaaacacaaaatgttaaaattgaccaccaactgttgggcgtccgtaaaatctaaaagtcaaaatgcaagcaaagggcatatatttttttataaaaaaaaatattaacttttaataataaaaaattattagctaaatttattactaaaatttatctttggatcttttgaatcaacagatacagattcacaatttattctgtacaatataacatagtttttatactaaaggaactgttaatttttaatataaacttcaataaaataccaagaagtctaatagtgtttttatttcccccactctccatcactcaaaagtaagttgatttaaaagtaccaaaatgttacttctcacaaaactgttccttggaactgagccaataagatgaaatgagtttacaaatatgttataactcaactaaattattataaattgtttaataacttatcttcaattcttacaaataaaaaaataataaagaattatcatttttataaaatccaacaggagtaattttattaaatgataattatatttaattaaagattaaacatgtttttaatttttaaaatatcatgattttgtattttaataaattatttatttttagtgcttacatttaataaaacaacatacttttagtttt

SEQ ID NO: 603 - DNA, 1196 bp, Glycine max
  Soy_ogl_4678 Gm14:5415101..5416296 Cluster 2
aattaacgcacaactatagctccagtgacatgaattaatctatgtagcagacgtatacggtgacataaaatttggtaattgtagctttggataaccttttattcacaaattttgtttcattgtccttgaaagtaatttgtaactagtaagtttgtgatgataccacgagtatcgtttagtgatcaacaagttgattgatgtatagaataaaataaatgctaatcaatattcttaaatattgattaataaattaaaagaaattattgagatgtataaaattacattgattataaccttttttatattcttttaaataactatttatttttttaatttcttaaccaatatgttaagaagactaattaaccagacttataaaataatacgaattgtaatctgaggctgattaaactatagaatcacatttatacatcaatgttgctatataggattacgataactcatattatttattacgaaaagttcacgcattcagaatgtgcatacacttcctttttatattctctttgttgacattaattctttttggtgtttggtagagtggcgtggatatgagaatgtttcggtgaatgagaatatgatataaaaactaaaagtcaatgatcaatgtattacggagaaaattaaagtagcactacaagctgataacaacttgcctgaagtggcttagtcacgtgagaaagagtgaatagcaaattgagactttagtgaatcgaatgataagtttaagtatgtgtttggattaatatagataaaattgatttatacaattaattttaattcaaattgattttgaaataagatgatttatgtttgaatgtttttattataaaattaagttaaaaataaaatttaatataaaattttaaatccaacacaaactattcaaagttcaaactataattaattatgaaattttttatatgaaattaaacatgtcaaaatttatctaaaattaattttaaacacagaatcaattatgcactgtgaaactaaacatgaaccaaattatttattcttgtaccaaattatttatttagtaccggtaccaattatcattggaaaaaaaaattcctttataggattgatgagcctatttcttttatagcatagagacttcgatatcaatttgatacgtactaaaagaaagtagccatatatactcaaattaagta

SEQ ID NO: 604 - DNA, 1800 bp, Glycine max
  Soy_ogl_6875 Gm20:39661301..39663100 Cluster 2
ttattgtaaaaattgttatttgaagactcattgtaagaagtgattttttttcaaaaaaagcttaaaattgaccttataaagtgatccttttattttattattgatttgctggagaggtaagtcgtgtaccaatctttgtttctaaaaatattagtgccaaactcacatgctgccagatataagtttatacttttttcacatgtaatattttatactctggatcgagtttactcacatgatgaaagtttttccattatcgatcgttaaaaattaaatgtaatatcagtatatcctctttttattttttcttttactgcatttcaattatatatctaaagaaatcaaatatgaatattattacagtaatcaaattcatacacttggatgtacagtgaagctaccaaaatataaatctaacgtggtcagttgcaattattttatggttaatggctttaaacggactattgttcagttattgattctattatatatagagattagtgtattgttaacaagtgttttgaaatactgtttaagaaataaacaatataaagttttattaaaaatcaatagggacatatgggaaattacagtaaagatacacaagtgatatttaatactaaaaaatatggttttttttttttatcagtatccttaagatactcattatgatttgtctattttttaataagctattagaatttgtctatagatcattaattcaatttcaatgattcaattattgactgctgtgaaaaataaaccatttttcttaaggcaaatcaaactatcttttattcaattatggttttatcagttttatagagattaatatctatgacagaagtgggtcaatttgtgatcacatgcaagagactgacccaccagccacgtttgacctaatagtattgggtatagggtacaacattgagcgaacgtgttaagaacaaaagcaatggaaaagaggtggacgaacccgagagaagtgggagatggagaaaagaatgaataatgaatactaattattaaatttaatttactaaatctaatgaatggcctcaaatattggcctaaattttaatttgggtaaggatttgtgaaattggtagggtttatttatttatttttgataacaaaaacttttgaactatattcaaaatgtttgagtagggttgaattaagagatagagttatatatcaaatacactcaataaaactaattatatatttatgataattttatgtgtcttttttttaatcagaagaaccaaatttagatattaataaaaaatttataataactcacctatcatttaatgtaaaacgtgtctagtaaattaattgaatcttctggttaaaaaagaaaactaaatctaattgaatgttggaacaaattaaaaaaatctaattgaatctaatgataacgatttagtttaagttaagcattcatgaaagtgtaggatctattagttttgagttttttaaaagggtgaaatatataactaatgagtattagtggatttcaaaaaagtgacttttctacctttatacttaattttcactttatattgcgagcttatagttgattcgaaagaagtttttcttaagaaaaaaattcaccagttagaactaaattcatttgagacacataaaatgttgctatatttacacttcaaaacataatcaaaaaaattatttatttacacttcaaaagtaatttcatgtaatcattcaaacagagttcttccaatttattttttaaatatgaatcaccatataatagcaaaaccatattttcaa

SEQ ID NO: 605 - DNA, 1200 bp, Glycine max
  Soy_ogl_64 Gm01:2770301..2771500 Cluster 2
aaaaatacttttatagaaattagttttagtatgttttaatatatcacaaattaatattcataatctaatcttccagaaagtagttttcacaatccaacattgttaatttcattgtagtttttgaaaacctagtttttttaaaataataataataatctatatatcaatatcaataattatctttaagagatgcattttatttctcaagctaatattttaattattaattttattataaaaaaacctgttataaacctacctatttattttaaattaataatcaacatataaatacaataataaataagaatacacaagagatgttcaaataactaaaacccattttagtaattacgtacccaatatcaattttgatttaaagtatccaaacaacattctcttaaaaaaaaatcatttttttttttacatttgttatccaaacaaaaatcatgttatcttataatcaattctgaccataattaattttgtaaaatcaatttcattcaaaatcaattttatcacccagaattcaaagacacagatgcttaattactatctcttaaaatttgattattttacgggagcactactttggcgtgtaaactttcattgtaataccgataaatatcaatcaatgttattaattaaggtacttaacatattagttaagaaactataaataaaagtaattattataaaatcatataaaaacttaaaaaaatataaataacataatattatatatctcaataaacaaatatttccttctaattttttacccaatagcttgagatattctttagcatttgccattaagtgtcacttgtcccttgattaaagcaacttaaaaagagaaaatgagtgaaacccgaggaaggtggtgacataagcgaagacaatcgattaaataacaagcatgaaagactgagaactgaaaaagagagaaatatgggtgcccgtaatagtagctgaccgtcgggcaggacataatagagagcagcaattgggttttggcgccaagtttttagggtttcgggatcaccaataataatataatcaatcctatgttattcttaaaaagcctcatgtgatgcgatacaaagcacttttcttttctgtatctatgatttcattggagggaccccttttgaacacatgcttttgattttgaaaacaaatcaaaagttttccaaagaattt

SEQ ID NO: 606 - DNA, 1000 bp, Glycine max
  Soy_ogl_934 Gm03:37690901..37691900 Cluster 2
tcttgtgtgtatatatatatatatatatcaaatcttaaggtcataacatataattgaaacgcaaatgtttttatatatacatagtagtacgatactgaagtaaattcttcctttggatgctcaaattaaggtttgatatttattaattgcaaaaattgactgttgattgtgtgggaatatgccttagattttcaagtgggacaattggaatgtgccaaaacaacattatatacacccaatatatatatatggagtcagagagaatgaaatgcgattactagcattgtgtattatggtgtaagaagaaaaatattaatctcatatgtgtttaaaattcttaaagatttattattgctttcgtcaagacaattttatattaatattataattaaaaaataacattatgcatttactatccaatttagcatgccaaattaaagaggctacaaacataaggataaatagtttcgggtaaaaagtttttattttgtcattcaattacatactattaaatatgatatgtttattaaaatttataaaaagtatattaaaatttatatcaataataatttctaattagataactatgcaatttagaaattaaactccaaacacaaatcttaattttatcgataaaattcaatatcaatgaaaatattttttttatttatgagaataaaacataatactaaaaaattcacaataatttatatattcttccttaagtgagtgagttatattcgtttaacaatatcaatgaaaataatgattccaaagggcacgcatagctttgatgtctttgactgctatgatcgatgtgccaaacaaatactcctgtccgatttcgcacctaaacaattattctagtctacaacttttttaattattgttacagtcttcattagtactacaataaatatgatgttaatatatgattgactttattagtaggtaatcaaacatgatgattatctataagaggaaaaagaaagaaaaaaaa

SEQ ID NO: 607 - DNA, 1769 bp, Glycine max
  Soy_ogl_1232 Gm04:5425501..5427269 Cluster 2
atagttggaatgctcctcttgattttgctgccttcatcttcatttttaattttttttttttacaaaacactttaattcaataacttatttaatatcaactataaattagcctctatcagttagtttttaccaaacaaaacttcaataacaaaaaaaaaatcctaaaatatcttccttttaagaatgataactaacaaatataatatgagagtgaatttgtaatgtggtaaagtaacatttattgatgcgacattatcaaagttgttacatgataattatacctgtttgttcttttcatcgattggcttataaaaatttgttatgatttagttattattaagcttaagatattaattaatatgtatataaattgaaacttcatccttcttgtttgtcaacacaaagcacagcaacaccacccaaaaaaaatattgtaggagaaaatgtgtgtggcttctgaacagagacaattttttgctgaacttaaagaccctgaatctaacacataggtgactaaggtgagatttgattgaagtaaataatcaatgttgtttataaacaaacattaaacaaactagaaattttaagccatgatttgatttgaacttttccctaatttgctatatgtctagttgtttggtaattcacttattgtttctatgcgttttttcttcttcttcttcagatctttataacgtgaactgtcgtcccatttagaagtgcaaatagaaggtcttatgtggatttagctcttttattgagggaagcacatagtattagtctataaaacttagccatggccaatcacaatgctatcccctttgtctttgagaagtggcttgccatgcactcctccacctttatcaccactccacttaggccaagtgtgtcaccatctcctcgcattattctcgtcctttattttcaacccaaaatagaggcaatcacaattgtaaaattgacgaaatctctattcggtgcatttaaccatcttatgtaattttaagctcttgtttatgaagtcttgtcatacacaattttatgaagtggtgttttgtgtcctatataattcatcgcatacttatcataaattggcttttgtagaatttttttaacaaagaaaatatgctcaagagttagtctaatataactaattgtccatattttgtttttattgcttttagctatcaatttattaattaactcgattttttttctcactagacaatatggatagtttattaaaattatattgcaatataagtatttcaaataagatttaaattattttaattttaaaatttttctttcaatagtgaggtcaattactaagatacgactcactttatcgagtaaaataataaatcttaatcgttgatgagaaagtcaataattgataatgtgcacatacattacaaacattatcaatagtgtgcgcatgtttatcaattaagtaacacctccataaattaattaatatattttgtgatcctaacataatttattatagaagttttatgtactgtgatgctaaaatacatttactgcatataaattagctaacaccaaattatttcaatgatctttaattttagtcaaataatttttttttctgaatcgttgaataaattcactcccatgtaatttgaaaattgaatttttctttctttctcaattttcgcacggacatattttccttattttggaaagcatattttttgaatttgcatgtccaatcaattttttttaatcagtcatttattcaacgg

SEQ ID NO: 608 - DNA, 1240 bp, Glycine max
  Soy_ogl_3216 Gm09:40058801..40060040 Cluster 2
aaaaatatccaaacataaatagttttattttaaaattatttttaatcaaaatcatttttacaaataatcccacaaacaaactaaataaatttgtaaattccattaacccaacttgacatgaatcctataaactaatttggttggagtatattgaataggaatttaaatccgattaggttgagatgagttttgaattagtaaatttttacacttgttaaaaccatttgaactcatatatatatatattctcaaaggaaaaataaagaagaaattcatgggtatgtgattcaactcgaaccaattaagtctaattggtcaattcaattcgagtcaagcataaaattttacacaaaacccattcatactaatttgattggtattcaccttttcaaacttaatcaaactcatgaatatccaaatttagtcaatacctattaatattttctatttataatttaaattagaaaaatagtttcattaaaaataatggaattagtttgcgatactaatgttttaatttattatattttaaacgattcatttttaattaaaatgcttatttaaaaaaaactatttattaattaacgatataattaaataacttctttttttgctaaaagcttgattttaaattgataaagtattcatccgagaaactttaaaatggaaatatcactagaaaagagataatttattttatttataaatgataaatagtcaaaagaataaagaaaaacccaatatgaaaacaaactttaaaaaatcagttgtttacatatactataatatggatttacgaacagaagtaagatataattaaggtttgcgagtagtagtaattagcggcatcagatgagaagaataaagcgagctgagacatgattattagtactagtaatttttgttttttagggtgattattagtaaattagtgaggagtgacgtatggtgatgataggggtagtgcgtgaaaaatgagaaatggtgatagctagaagcgtagagggtagtataggtatgaaacataaagaagaacatgactacactctagagtcaatagagtatagactaggcaaaccatttctgagagagagttggtaatgatgaaaaaagatggggtgatgagagtggagacacccggcaaacccatttcaattgccccattcttgtctcccctcaattcatgttttcttctgtcccctctttttttcttccttcatttatttttctttctgccctt

SEQ ID NO: 609 - DNA, 1023 bp, Glycine max
  Soy_ogl_1717 Gm05:37851133..37852155 Cluster 2
tttataaaaatattgtcaatcttaaaaaaaatcattttgaaaaacttattttcagttaaacacgtaaaatcccgataaaaacattcaattatacagactagcttttgtaaattatataacattgaaaatccaagcaaagtgtcattttctatttgcattaagcttttgtttatcaattcttttaacttattatcaaactattcattgtataaagaaattcaattatagtcaacaaaaaatgtttaattatacaaaatcatataaaaagttgaaattgggagaaagaaaaatcacagtataacttctattattcctttttttctatgatgtgataaaaagttttttttaattttgataaataataagtaaatatgtaaagtgtttttttatcatttgtagtaattgattgaagtcataatattttatattttttattcacaaatctgagacctttttttaattataccaagttcagtttcattccgataaataacaggttggtatgaaaaaaatgttaacatggtttaatttattagcatattcttaataaaactatattttaacccctctttctatttccattgagtatcctattttagcaactgctagtgctatggcacaaacaactaactttccagttgcacgatattaggtaggcagaatgtatttttctgacggtttcagctttggtgccacaacttgggtgtcacggggctaggaataggatcataaaagtaaaattcatgaggctattccagccttatggtggtgtatctttactttaatgctatggtcctagacttgtagattctttgaccttttaattttcttcttccttaacttcacttttctaaagtaaagaacacacctagttgttattttttttttttttaaataactagttagaattagtaaaaacactaataacaatatagcataagataacgatgaataggttgtcagttcaaatgatattcaattcaatttatttaaataaggttttgaatttgagttttatgtttg

SEQ ID NO: 610 - DNA, 1200 bp, Glycine max
  Soy_ogl_3503 Gm10:42793601..42794800 Cluster 2
tattttcaacaatattatattatttcatagtgaaacaaaaaaaaatagaaagtgaactcatttgatctattatcaatttgcaacaaaattttctaaaaattaaactcaggactcaaaattaaaattaaatttgatttttaaaaattatacagtactaacaagtaataacaaagacaaatactatgtttaaaagttggccatgattatgattattggcaatgagcttgatgctcctggctgacaataataactcagaaacaaatgcttcgaagtttgagccaggaggggatccaagagtcaaatattaggtacgtagtctattccatgtaaatgcctccagcaatcacgattcccgattctggccccccaacgtttatctctccctcttccatatataatgcatttgccttcatataagggaaaacgttttttttcttcttcaatcaattactccaccaattattattttcggattaaagtgaatcatctgtacgtaaagcaaaaggatcgatgtatgcattatcaattttatttaattttagttaattattaaaatttaaatatgaataattatcatcattgttctggaacctcaattcacatgggaagtccacctctcggtcaaaactaatggtctgcgctcgctaaagtgttggttggaatcaatgtcacactcatgtacgtccaagtttcttataatatatcgagttcaatccaaccgtaaataaaacttaaaataaattttaagatatttattcccattttaaataagaaagttacatgctaaacttttttttattaatatatgtgatttttctgttttttaattaataacaaatatttttcttttaatgaacttaattaaaactcgattttcaattgtttttttatctttgagtcgaccgcgtgaatacacatgtgaacaataaaacttctataaatacgagacacctatagatttacgctacaatgttagataaatatttattatatatcctccatctaataaaaactccattgacttagatgttagaatgtcttctatacgtgtactcacccttgtctataatatatgatcaattgtgtcgaagtgccacactgatgtccatacatctcggatctcgatcaagactttttctttaggctacatcttgtagaaacttagcactggcttggcacaccttgtgcttcttgtagtca

SEQ ID NO: 611 - DNA, 1595 bp, Glycine max
  Soy_ogl_3509 Gm10:430718..43075700 Cluster 2
ttattagtacaaatagaagggttgaaaaataagagtaaaataaagtatgaaataattaggattatttgaataatacactatttacttgatggtacattgtctagtcacagatggggaggcttttctgttatctttaatttttacacccgttcttacaaacaatgagtatccataattcaattttaaggatgcgcgaaaatgaactagttccatcacacgtcctaaatggcttacacttttcacaaaaccctatgcttcatcttaacctcaaagaaaaaaaaaatcttaactcttcagctccaaaaacaagcgactgcatgaacaagaaccttatatatattaagcaatttttatgtgcaggctccaatgccaattcgctgggccagaagtcaaaaatcactggcaagtaaacaactcaactgatatttttctgctatctaatgccttacattcaatgaagctcctttttgccagcttgaggaaacagcacgctgtgaccatatgatggtttaaatgccccaactagtatcctagatgttttgcttgcaaaataaattcttctcttagaagacgatttgttaatttcacggctttgacaatattcctgagaataatattcataaaaaactattaccgaaaatattttcctcataaaaaatgtttcatactacttattatcattaaatggaatgtcttcctgtaaaaaaatgaaatgtttttaaatttattttatattaaaaataaaatataaattaaataaataaatgagacataataagagaaaagtaaaaaattattttagaaaataactttcattctcataaaaatataacattgtcatccctctacatagttatcagaagaggaaaaaacatgtgtaatataagttggtgaaaatgaattatgtcttcaaatattttttatagcttgtaacaaacataagaatgttacatttcaagactcacattcttggaaataatcctgggaagatggagccagcattgatcaatgccctctgaagctggaagcagttttttctgcagcaactcttttcttttgacgctgagaaaaatggaaaagaattaatcttaaactaagatgaaaatatcatacacaaaaaataaagacaattactgaaagggcaaaaaatagggggagagggaggggggacaataaatttcatgagctatataagatactatgatttgggattgcagcttcttatttagggcatagtcatctgaatgtctagaatttgatagtgactcactggagacatacaatcactggttcagcaagcttttctctctctgtaaagcagaaattttaaaaaaagctagttagctaacacttggattagaggatcagttgctacactttttaatcacgacttgtaatgccaagaaagtaacagcactaaacttgtaaaaagggcaatgagctaaggggcttttctttcaaggtatattattaagtacattctaaaaaatgacattaatgtttttattgggtaaattcatagacatgtttggttagaatataatattccaagaaatatttttcaaattttaaatgaaaggaggaaaaagtaacgg

SEQ ID NO: 612 - DNA, 2000 bp, Glycine max
  Soy_ogl_5925 Gm18:4429301..4431300 Cluster 2
caattttttttattaaacactaaaacaaattttcattctatttcaagtactagaccatcgttatgtcggtgagttaatgatttttttcaattagaattctcaaagattaagttactgtattattttttaaaataaagtagagattatttctgaaagaatttaatattctcataatcctaacgtggaaattaagggaagttataaagaaaaaaaatgtatttataaatcatttctgcacaaatttttatataataaagagaaaaataagaagagaaatataaattacaagactattaatgtgatggagataaaaaaggaattttttttataaaaagtactttaataatttattatacaaataatataataactcaagaattcgtatcttgtaatcttgtttagtttcccgaataggaagcctggttattatttaaaattaccaacacagtccgcattttcataaatccaacaatttaatttatttctccttttctataattacttaaaataaaatgaatttttttttaagggatgagattttttgcagtgctgaccacccaaatgcacaacttttcattaacaaatgctgacacactatttacagtctatttcaaataattctttaattcctagcatttgtgcagcttgcagttgcacatgaaagagagaaagtgccattgcctcattggcagttgttgtttgtctcttacttcactcattcgacccattcttgactacaagataaagtgagcaaaaagcttattcagtataaccattttgaagtggtggctacatgctgttgttaaccaccattcaatttctcaacttgttcattaaccatgccaacaacttcaatttttgtttttcctgtttatacactgctttagatatcttatgacttttctctaatgaataatgaacctaattaatgtaattactttatcactttttttttttctaaaccttacactagaggcctatatataagataatttccttacgttttttattcttcatgtaaaggtcaacaagacttgagccattatattctcaagtggccgagaaggagacttgacctaaaaagtgaattccaaatatattttaaaatattctatgaaattttggttctgaaatataaggatttctgaactgttattgagaaactttctctccttttcttttagtgtgattaaactcatttaactatttacccaaaagttaactataccaaaacttagatttctccagtatcatatagcaactctaagatattttattcttttttaagggtaataagagaaaataagcaatgatcttattgggtgcaagtaaattaagcaaggtacgttctaagcaagtagaaacaaaatcatatccagcgctggacatgtgacataattacaatttcaattacatttttctgtgttttcctatgcttgggaaaataggtaactagtacattatttttaaatagcctttaatggattcataggccaccttcggctgtagcaatccaagtgttgtactaggtacctaatctgaaggaacacccaattagatgtgttggagagtcactgaaatgctgacataaaagtgaggagcatattgatggactagctatcatgtaatggcacaaaatcagtcacacacttacactcacatgatgagagtttttcacttgaaattgtggtgctaatgggcggctaccatagtaaaactttaataaatactcttaccacatttcctattgttgtgaggtcacccaggcatggcaggtcccttaattattaagttaagttcaaattttatggttggtatttattctaagcctagctttaaataaacttgttgctgtcataattaatttagttttacaagtgaaaggattgatttcagctctttttacaaatgaagtgaagaagacatcaaaccatctgatttgaatattagttttggtagtagctagatagagccaacggattatatggttcgaaggtttt

SEQ ID NO: 613 - DNA, 1600 bp, Glycine max
  Soy_ogl_3231 Gm09:40454401..40456000 Cluster 2
gtcccatgtacttgaagaggaagaagaagtaaaaaaaaaaaactgaataaataaagtagcccggcttgaatgctgggcagacaaagactggactagggttgaatagaaagaggggagaaagaatggtcactatcgcatttgagagattctctctctcttgcccgcactgcccgtagatgtgaaataacacaaagctgctctctctctctctctctgaatgctaaaacgacagtgcggtgcattgccatgtggtcagagaggcgtcaatcataatgcaatggattgctaaatgattttgcctcgttccttgtgttgtgaattctgtttcctaccttccctttttcaagactgttttattactcacttgggttatttattattcattatcaaccccttatgcatgtctttgaccatgccctagttattattatagctactatctcttgtttttatttatacaacttaccctttttcactcttttgacatgtcacttccctttgtcacgtgccaaggatttctttaagacatatattatgcacactctctcctcctctaaaattattatcccctttgttctctacctatgactatgttgctatttgttatgtttccacattctctctctctctcttgaaacgcaacaacaacagaatgatgcctttggctcccgcgagaatctcgccttattatgcgtcgtcttgtattctaacacgtcgctagcgtcaatttttgttaatttctctcttttgtcttttctcccaaatcaacttgcttgtagttgtatcgcgcagcaccaacacatgtatctatacatcgctattccacttccttattctcttacactgttaaatatccttccacccctttatatataccaaccttatattattataccaaactctttatagatcacacacaatttatataaatcaatttagcttagtccatcaaatgcaaaataaaattaaagttagtttagattttagattcattttttttacaactttatctttgtgcatgattctttcttatatttaaaattttcacttttattaaagttttaaatcatcatttgcaactgaaattattggtgcagtaattgataaggctttaatataaaataagcgtaatgtatttgccaacaaatcaacaacaattttggtgattacgacgaaacaataactataaaataaaatttatttttaatcaaagctaccgtttttttcgaaccatttagttcatatgatttattaatatcacacatggaacgttttgtttcacaagataacttttttaatcttgaaaatactaattttgggaataaaatatgtgaatattattcctggatatttaataaaaaatgtttgattaactaaaaaattagttgagaatagtttttaaattcctgaaaataattaatacttaggttaaattattttttcttatgaatatatattataattactaaaatatccttattatgttgaagatgttatttttttttcataaaataaataaatttattataagattaataaatgataagtcaattgtagtcaaaatgttatatattccaccttcatatgataaaactcctct

SEQ ID NO: 614 - DNA, 1314 bp, Glycine max
  Soy_ogl_6912 Gm20:41731701..41733014 Cluster 2
attttgattatttacccccaaaaattattagtcaccttgtgagtaatgaccggtaagaataaaaaaatttgtttagattataaaatattacaaatattgtgtatcttgttcaaagtttaagatgcttagattatgactgtatctacggttcatctccaaatgcatgtgttcatgttccaacataagtaaattgtgcattagattattggaattgactcttagctaactcattgtatcaatgaaaagaatgatgttaaacaataaataaataagtcaaataggatgaaaaatgaaaaattaaaataagtcacccacggaagaaaaaaggccatataaaccaatttatcaaaatcttgactaattaatttttttaaaaaaatatgaacctccttttctttttttccgtacaagtattttttataagagaccatcttattcaaataaaataagatcgtcatgattgataaaaaaaaaaaaaatcttttgagtattcaacaaagcaacatacgcataattcaaaattaaaatccctatattaaactgaaacacacatcccatgacagggaattaattcacgcaatcagtcatcttgtttttcttatttaacaagctaattgaaatatataaaaaaatagggtagtgttgcattgttacattaattatgtaacctatttattatcaaaataatactttaaaaatagaaaactacaaatttacgaatttgtataaacatgttcggctcttataaacataaatctatgacattgtattttaatttttaatattattttgtagataaatgtactttaaaattaatgtgctatattcctaattttttttaatactaatgtaattaatcacttaaaaaaacacttttttgttccgaatgctgtaattatatattacattattactcttttcagttgaaatttatcatctgtcatattcttaaaatcgtgtagcctgaatcatcttattgcaaataatgttaccgaaacttaattgtaaggatttaaaaagaaaataaaaaaaatgatgagattttaaatttgaaataactattatctgttcattttttttttcacaaaacataagaaaaataatttttgctttgattatatataatatctacaaacttaacaacaggggaaaaaaataacgacgtccatcacgtatgtattagcatataaagtttaataactattgaatacattgatgttacgcactaataaagataactatgcatcactcactatagtctacagctggctgtatgcctatggtaaatcccctatcttttaacttttcactttc

SEQ ID NO: 615 - DNA, 1247 bp, Glycine max
  Soy_ogl_4425 Gm13:33469054..33470300 Cluster 2
gataatttttaaattgctttagaaaacaaatttttatatcaattttaataaaaatcgtcttaaaatatatatttttattttaaaactataaaaaattaaaaattttaagatgattttcaaaaaatcatgttaaaaaatagaatttttaagttgattttcatgaagaataatgttcttttccgtaacatactaacatgtgtctcacataattcgcgttcattataggtttagaattctaaaagacgaaaacatattttaaatgctttgattataagtttttatttaattttttcaaattctaaaattaatagaagaaattgaatttaagaaacaaaagtctaaatttttccttcctttttttatgttgcatatcaaattttaaatttttgcttattttattttcatacaactaaatgaaaaggaagaataggaatgctgcgtggagtagggagtttgaatgaaggcggaaatgtgatgttgagtgcacatcccatttgccatgcacgtgtaatgcaaaaactgtgggacccactattccaaccacggctgctgcttttggtgggaccctacctctgcctactgcgtaatcattatctacgctctcccttcttttttcctttttattttaagcttcattaataatctatttttaaccaattttaattaattaattaattatacaagactcattttaatgtaatttatctttttccattaaactaatattaattatttacagtttttatgtaaacttacaaaataaataacagtataacaaatgcagaaatattaacttaatcaagcgttatttgtttagagtataacaaaataaatatttatttttacagttaaaaacagataatctcatatcttataaaaatggcccattaaatgattattttaaaaaatcatgattaatatttgtttgataaaatgcagaaagaaaattttagataaatttcatatataatgctgtaattattaatcaaattgttataaacattgtgtaacaaaaaaaaaaaataacagtggtggtattataaaaaatagtatagaaaaaaatataacaatcgtagtatattaaccatcatcacccttataatcaagagtacgtagtagtatatgatccatcagcaaatgaaaaaatactttcttggtaaaagaaaaagacattttatgtaacaaatattaattgagacaccttatgcaatggttgttactctttggttgaggcacaaaaaaataca

SEQ ID NO: 616 - DNA, 1764 bp, Glycine max
  Soy_ogl_2621 Gm08:11903837..11905600 Cluster 2
gagatcaattagtatcctccagaaagttaaaccaatccttaaataaaatttataatggtgatggtttagggtacgctaaacggccaaatgaatggtgaaagtgaaaacaacaaaagagcatgaaacgacaaggtctctaaaataagcataagttaactcaaatagaaattaattgataataaaattttttttcaagatgagatcgatacttcagtcagaaaatcaattgagagagactcaattcgacatactcctctggtttcgattaaaaaaaaaattaatatttactaaaaaaattagttaatttcattaaattgtgttatttttaattaaaaaataaatactatttttaaattatcatatattgaaacttaatgccaaacatacaaaaatctttaattttattaaatgaaaaatattttagaaaaaatcttattaaataagatataattaattaaaatttacttctttttttttaaagaaaagttctctcaatcattcgaatatccgaggcctcgttgtgttctttggccaacgtactcctaggtaatcaagatatccgagacctcatcctaatgtgttcagatatttggatctccgacacctctagtataaaaatcatacaattcattgtgtaaaacaacataatttagtgttgttttacacaacataatcgattatgtaactacctaaacaaatagtgaaattcatctccctcaccgttgctgctattgtgcacaactcctgcttagcatcatattgaatatagttgctgttactcttttttttattactcaatttttattagttattactcaacttataatgttagataatacactatgtatttatgttattattcaatcataaattattatataccataaatttattaatttttacacaaacaaatccaaggatagcaaacatggctttgcttcctccaatcctttatgtatatatgagaaaaaaaggttaaaattaaaaaaatattaataaaggaaaatatataagaaaattatatttttgagttgatatttgtttaaaatttttctagtggtagatcatatttctaattttattcataaaattaataataaatatttttaaaacttattatttatttaaacttaaatatttaaataattatgtaaaaaatatttggcctcctcttgatacattctcgaatccgtcgatgcatttacataattatcgtaaaagccatttcaatggtttataattcattgagtgtaaaaaaatttatagtgataatgcatgtagattaaaatattataatatttacttatatttattcaaaagataccagtataataaaaaaaaattctaactaaacacagaagtcaatcccaataagtaaacgattgttgcgaaaatgggtcgtatcaaatccaaaatttgaatacacaaataagaaataattttataggcatgaagggtagcattattgttggtacaaacacgacagacgcagacaagatgagtgggaagagcatgaagttttcagaaagaaaggacggtggagaaataaagaaaaaaggtttgtacattccacatgcaatcgcggaacttgcagcttccaattagaaaatttgaaagcgaagatggaaggaagtggaaccagtgattagatgtgccacttgaatggaagcaaacgcatgccaaccctacttgctttgcctatggtatcatagagctttgtagaattttctgtaattttgagttcttcgttacatcaagatcaag

SEQ ID NO: 617 - DNA, 1643 bp, Glycine max
  Soy_ogl_4405 Gm13:32228901..32230543 Cluster 2
tgacggtttgagatgtcactgtgagtttagggccaaagtatatttacatgttgaaaacaaacaaattctctgatagcgtattctatggccgctcattgtttaaggttatgcttttattggtgttttgtatgtgtgcgcacacacatgttgaattgtattttcaagactgagtacagtattgattagtttaatattttttgggagaaaatggcatcatatgtaattaattttatggttaaatgatgatgaatacttgaaaattgaacgagttaggataatggacttgaagaaatcgaatggtatgaaataatgaatattttttatagatgaaatacaatttaccttctttattattttcaaattaggaaatatcaatgtctttcatgtgacatttccagcattgaaggcaaggagagtcatcatgatgtaaaagaaattcataacaaacttttaaccaacaagatatattcatattcataatgagagaaatctagaaatattttgatcgtgtaaattatttttttttactttcatctgatcataaattatttagtacggtatgtttattaatttttctaataattattgaacaatcatattaacaatcatttttaattgattcacaattttttttattaacattatataggtgttaaactcatgaaacaattcttagatgtccattaatgatttggcctaacgcttaggatatgtttggattctgtcaacaaaaaaaagaggatatgtttggactcataaattagactcattacatatttaaatcatgaatttatgtattttaaatttatttaatttgttttttttttaaaaaaagatgttttgaagaacatattttatgttcaatttttacataacaagggtgtatgtaagttttgttttatctctctcatgcatgatagatatcaagcatgtgaaatcttgtaaaataataacgatgatgaaacagacatagatgtaaaacttatacaagatcaatcatctcatatgagagaaaaagataattttttacatgtacagaacttctaaacaacaaatttgtatgaattcaaagaaggtgattttttatcggttaattaattaattaaacaacttcaaaatattaaaaacttaaatgcaaatcagccggaaatttcatgtgacaattctcatctccaatttcttacaacataacatttttggttgttatatattttaaaaatataattatatatgagactaattttcagtataagatagttaaaattattaaaatcataattttaagaatctactgatacttttaaactattgcagttaaaatctttgactttaagttctataagttatagtcttttaagttatgttgattatatagaactaatttttagtttaagatttagttgtatttaaagttttcagtctttatttaaagatttgttatgcaagagtcacccacggattcaaggggagacaaatagggacatttacccccttccttaaaagatcttttatgtatgtacgagagaaaaaagaaaattaaaataaaaaatactaataaatgaaaatatataagaaaaataaatttttaaattgatatatattttattttcttttagtagtaaattgtatatctagttttacac

SEQ ID NO: 618 - DNA, 1200 bp, Glycine max
  Soy_ogl_1949 Gm06:14723101..14724300 Cluster 2
tttaaaagaaaacatgcacaactcaaatactaagtggaaacttgttcatgatttcataataatattcatttctaacaacaacatatatttttgggtacgaatgtcaatatggttgtacattcgaacaggaggtggttgatctgccaaatttaacctacgcacaaattatattttcattagtacgaaaaactactagctatttgaataaagtattaacgagtaaacaatgatatacgctaaaaaataatatattaaaacctagtttataaaaaaatcgttaaaatattttaatatgcacttcttaaaaaaaaacgaaataatttaacctgcgcatccgcttttatataaggcatacgagtatcagtcaaaacgtaatgaatttattggagtgcaaaaaaaaatcatagaagattccatttctttaaaagtgaaaaacttaacattacatctagccaacaagaaatattcctagaaactaatgttgatagtcattgtattttaattattataatggtaatgggcattattaatttcaatggtttttcaacatgttcacttgtgtttgtaaaaaaaaattaactagacttattttttacctcaagtgtgaatcattaggatgattatcattagaattcacgtgctttaaatacttgtatcactattttgatacaagaaatctacaacctaaaaattcatctaatatcacactttaacaaaaaaattttaatatttagatttataagttttatcatcatttatatgatatttaatcttttcattcttacgtcatattgaactttatgtcacccttatattttaatagtatttataagattaattagatggttaaaaaaatgagaaattattttttttcctggctacaaaagactaacaaactaataagttacaagtaaagacaattgttttccctttcacatagaagcaaaagcaaatgttgggggacccttgaaatccagaatatcattgatcgaacaaataataatatagccggagagagttttattttttttcttcctctatgtgtccttttaggtgtccctatctaattttcagtatagattcctacaatgactaaagtcgaagcattttcaatggtagtttttttcttttctttttgggagaaccactctatcagcccaaatatgcttaacagcaggcatgcatggtggaggagatgac

SEQ ID NO: 619 - DNA, 1925 bp, Glycine max
  Soy_ogl_3540 Gm10:45114006..45115930 Cluster 2
tattttaataaaaaatatttctgatataaaaataattaatataagacatcttataaaaaaaacaaacatcatcttaaattttaatcttataaatagaaacgaaaaaaatatttagtttatttcactccaaaaatatgagtagagatattcacacccgtattctatcaaccatcatatactcatatatgtgagactttactttattccacttgaaaaatctcttgaaatttatataatttagaagttattttaaacaggaaaaaatctaaattgaattgagtaactttatttaagaaaataaattaagaaaaatctttttacaattctttcatatataaaactttcactttaacaccttatttaaagaaaattaaactaattactacttaaatagacacacattctttgagattaaatgtaggataaatataagtatatttgtaattgtaagttttttttaagccgtgactttcccttccatgaactagggtccctccccctgaattttcatgcaccacgcatgtctttgcaaactgcactcctagttcctaaaaatctcataatgaacagttccactttgagaaagtataattgataatattatataatataaacttgatgatatttgacaaaatactagtcctgaaaaaacaattaaaaaaatatttttaaaatatttatattagtatcctatgttgcagtaaaccttatgaataatttagatttttccacccccaaaaaagttagattctctaattttttttaataaaatgagtgcgaaattttacctaatactaaaaaaaaactaaagatactttgttaaatattcttctaaaaataattatgtactaatgaagaaaaaaaaatctccagggtgggcagcaaatctaatattttattttgatgtttgtaaaaaaaattccaacttctaatattcaaagttggagataaagattccttcaatcgggtccaaatccgactacagtattgtgatgttccaaacggccacctagatgcaaacatttttacttcaaacattttaatcgtgtgtattgtgtaatgttactaagaatattatattattatcacttaacagttaaattcaaatataaatcaatattatataaagaaaaccctatacaaataataattaaagtacaaatttaaaaaaaaagaaaatattaaattcacttaatgaattcgaactgatgtagcaacgaagcacacatgtcgtgatttcattaatataatagtttttaaaatttgttgtacaatggttaagaaataaaaataatcggtgtttggtcgaccctgcacatttttctaaggcaaataccaatcgatttgatattggccttgtcaaggccaatagtagtatatatcttacttttgatgttattctttctaacgaatataaatatatattactttcgatccttcataaaaatgagtaatatatttttttgtcctaattataaaagatacatgattaattcaaatgtattagtcgttaatttttagagaatcaatgtacaatgatataaaaaaagggtcttgtatcaatttactcatttatatatcaatattaaacgttggttattagatttatttttatcgtattatcctataaaaattattatcttacttttgatgttattctttctaacgaatataaatatatattactttcgatccttcataaaagtgagtaatatatttttttgtcctaattataaaagatacatgattaattcaaatgtaatagttgttaatttttagagaatcaatgtacaatgatataaaaaatgggttttgtatcaatttactcatttatatatcaatattaaacgttggttattagatttatttttatcgtattatcctataaaaattattatcttacttcatatgtctcaaaaaaagta

SEQ ID NO: 620 - DNA, 1645 bp, Glycine max
  Soy_ogl_5285 Gm16:4248001..4249645 Cluster 2
tcagttttttctgtcattttagataagtttcaatactaaaataagaataaccgatgagagaagtacatatatggtcaccctaaaaaaaagtacatatgtgatccttgttcgcataaactattttctttcctattatacatacatcatgtgacaaagaaagttacttggattaagaaataacatattttggtttaatttttaaaataaaaattattgtaaaaaacttttccattaaattataaataaaaatcattttataatagtaagataaaaaaaaacaagaacattgtgcttacaataattttttacaacattttttaattttttttttcattacattgctcatcttatttctacatttttctatctctcttcttgtaaaatatctgggtaataacaacattgaatctgaggtcatagttttcttgtcacaattggattgtccaaaactgatacactgcactttgtttacacctcatcaagaactaacgtgttcttgtcctcactttagtggaagctgagtttcctagctagcccctttgacagttagacttgttgttggctagcttatcactgtttggccaatttaattatgtctgctattttatcaccgtgcataaaatgtaattaaatactaatcgtatgtaggaattaattaacaaattgtgtaaactaaatcaatactagtttcctttttatttggtaaactatatcgcaagaaacatagctacattcaacaggagataaatccaagagataaggccctaagcccattggaagcaagaagccttgtaactaattagccacacaattttctcccttaatcttttacgtaatctaagtccgaagatgacatagacccaacccaaattgaccaatttcccctctcgcaaaccctgcattacagccaccttggaggagtacagaactacgttagagataaaatgcagaactccattttgtttgatgtatattttcatcacaaaaaataaaagaaaagaaggagaattgatattctatatattcaaattttaaacagattacagataaaaaaaaaatgtataaacagactgtagatcgaacttcttaatttgaattttcaaaccattaaacaatcttccacaaaagtaaaacaaattttcctcttaacatccaaacgcaccgacaaagtgaaataatttgacattagaatcagattgcacaataattgtaaattgaacccatgctgcataacattgttcctttttttacgttgtttactaacaactttttatgaaacgtcaaaaaaagtcatgggcgcctagattgtgtaggtaaacgatggtccaccacgtttgatttttgaccatcaaataggtgtaaggtggcagacaagtcctccatagtccacagcaatggatgtccaccaatattcaaacttccaaattaacaacaaaactctgcaatcacgtggtggtttgttttatttgcaaaacataactttcatgtttacacgcttcaggtaaggataaaaaaagaaaagaaccttgattatttgatgttattttttggattaccatatatcataataaaatatctattaattttattaatgattggttttgttaaaagttctaattcatagtaaaaaaaaaaatctaattat

SEQ ID NO: 621 - DNA, 1061 bp, Glycine max
  Soy_ogl_5302 Gm16:4818601..4819661 Cluster 2
taatatatttgaacgaattttagagtttaataaatgtcttttcatttacattgatttaataagagttttttcatttattttgggcataataaatgtattcacttgttacataattaaacaagctatttaatgtgggttaaatatgatattttcatttaattttgtaatgtgtacaacataagaatttcatgtctagttaatcacctaggttaaaacaattttatatgcaaaactcatttgatccagaatcgacaagttcataaaaaaatacaaacattagttctcaatcgccaccaaattcttctacattttagcatctcaattaatcgatgattccttcctccttctaccttctagaatatttcctcgtccccaaccaagatcatcttcatgctctgtctctctgacattaactttcgtgtcaccatctaggcaaacaccaatgccactatcgtcaaggtcacgcctaagattgacgacacaccatcatcacgcttaagtatattccatcaacaacttaagatctacgaggtagccaatagaatagaaaaattcattcatatttgtttcaattggagcccaatatggtgttgcacctttagatttgtgaaggtaatcaatcgacgaaggtgagcactgatgtggtttattgccaaggagggagatggagagaaagacacaaggtcttctgattgagaataaacattaataaagagaaggagttttccaaagcgacaattttggaaaagaaaaaaaaaagttaatcatagatttaaaattaaaaatatctaaccgtctataaaacttttgcaccataaatgtggttttattcttaattctttgtacaactaatatacttttaccgctcaaatttgtatagcttatgttaagttggattctaatcaatactatctattttgcttgtaacaaaaaatttattatcttttttatccttaaaatttttagaatttatgtttttagttcttaaatttttttatttgttttcagttttttaaactttttttgttcttcaatatttttttatccttacctttaattct

SEQ ID NO: 622 - DNA, 1500 bp, Glycine max
  Soy_ogl_5623 Gm17:9971201..9972700 Cluster 2
atatagaagaagggtcaattagtcaatattcccagtttggcaataattaagctacctcgttttatctgtcaaaggaaaatgttccaagttgggttgtaattaacaatcaactattcattggcatgctgacaatgaaacgctacagagtacagaggcatcgcttctagctctttattttatgcatgtctaaatatatctagtaaaatccacgaattaatgtttgaatcatgaattagttagttgatggcggtgattatttcattttctatctatctgaaatcaattttaacttgtgctgtaatttgtcttcgtatcagaccaagcaaaaaagaacaagggtaagacacaataccctttcgtataggacatgaaaagacataactcctttaaaagcacctatcattgcaatgtactaccgttttctttcactatcttcccagaaagaatttagcgtcacacggttcttaattatggcaaagacgataaaaataaataatcctgtaattaagtatccataattgacactactacccaaattaatagaatcattccttatataagtatcatagattccctacctcctaatttataacagaatcttaaaaggatgatatacatgcagtaatttagtatacttgctgatattgatatatataaataggaaaatatcttttcatggtttaatcatgaattatgattcgttatttagtaatttttaagttatatatacatgtattggtggatatcacatttaagagtgacaattatctatcaacccatatgtttcataagagataattaagtttgacataaatttgaactgtgattcgtccctttttataaatttacctcttcaactaaatctaggtttgtatttggatatatttcctactttacttttaatacacttttagagcgataccgaaagaatatatcagcttataaggaattttaatttaatttaactttttgtaataaattattctaatgtaggtttctttgaggatttgaggtgacataattagagcattcaacagtgtgatctatctacatctaccttttgacccatttaggcctttatccatgagtgattacattgatttcggtatgctcgagatgggaagttggtttctattatcgtggagttgacgctctttccttagaatgagtttcatatataatccaatgtgatcgaatggatttgggttcctattggaaaaatacatagtcctccaaccttgaactagttagaagggctaagaggctaagggtgagcgaatcagattgagtttcgagccaggaagctacacaatcttataacctagagctaaaagatcgaagagattaaggatgaacagatagagccgatccacctgtaagtgaaacttaaaacaatttttttttaaaaaaattactttaaatgagataactatgagactttttttccaacatatgtcacctttttcataataaatgagatattttttgctttataaaaat

SEQ ID NO: 623 - DNA, 1400 bp, Glycine max
  Soy_ogl_958 Gm03:39024401..39025800 Cluster 2
tcaacaattctgtctaaattgttaatggtagaatcctacatgattagtgatctgtcatcttcttgtggttgaatccttaatggtgttagaccaaattgatagtaaaaatctaattaaatctattttaaaaattaaaggatctaatgaacttggaaaaaattagagattcaaatcaaattaaaggagaaaaaattaatttaaccgtgttataatcaagaaaaaaaagttaagtatcactagaaaataaattttaaaggtttaattttttttggctaaataaataggaattaaaatcatattgactagtaagttatatgactccaaaagtactatttgagcatccgagagatgcggaattggacatcttatttcacttttggtccaatggatctcgaatatcaaacagttgaaaggaagacagattatatatgagtccacataaacttttttttctttttaggattgagtctacataagtttggggtgtattccacttaatataatgtgttttatctaagttctctgtcttgggtgcatgtgaataattctaattctattgtgtgcaggaaattttcaccgacaaaagatttgtcaaccccaacaacttcaatatgtgaagtagttgtaagtttaaaaaaaatactcgtaactaatagttataataaagttaaactctatctctttttctttatcaactccacagaagctttaaaagaatttattttgaccacgttaaaacaagtaaaaatagatattatgttatctaatgtgttgcctacttgaaggatgataacgaataatgaattttacgggtatctacaaaaattacttcatgataaggtagttagttattcatataattagtgagtgagagtataggtaataacttattcgtaaaattgattagaatgaatgagtctggatacagatatcttaacacacatgttgtcccatccgcgttatatatatataaactataaaatttatgaaaatctaatagacatctacctttatttcttttccactacactcaaaccttaacatcctttatgatgactgcatgagatgtacattactgagttgtgacgtggaaccaacgtagcaaacttcacaagttgccacatcaaagatgcatcattatcacattgaactaaagtttataaatttattgttgcaaaagtttattgtaattttaatttttaatattttttaattaaatttgtgacgttttataaaagatctttgaaaattattttaatttaattatcattgtattttaaccaatatttctctattaatttttcataatttattaaagcacgagtaattaaccatcatagatatataagaacaaaattaaaattttcaaaaatataaatatataagtgaatactataaga

SEQ ID NO: 624 - DNA, 1276 bp, Glycine max
  Soy_ogl_374 Gm02:4339000..4340275 Cluster 2
aaacgtgaaaatcattaaacatgttacgttatagagatttcttagcatcaaaatcataacagtactgctgcacttttttcacgataccgtatggctagtcttgacattgggaaaccgaaaagtacaccaacgttgtacagaacagccagtcgtaagtttaccttatcatttttagatgtatggacagaaagaagataaagaggaaaaaataaataaaatgaaagtgaactaaaagaaaaaataggtatatattaagcttttttatttttaatatgctatattattaggtaagtttaatcagactcttattacaacatctgaatttaaaatcaattaaaaaactattcgatgctaaaaagtgttataaaaatatattacaagcatcgaattacattacacgtgggtgttgaaataccagttgactggtttctttattatagattttcatgtgtttattttcatattatagacttcattatgggtctagttaaaataattttagataaattttgtattagattaaaatatctataaaatttttactactaagatcactttaaaattaattttaaataaaatttattttatttaaaatttattttatcaatattcatcaaaacacacataattttgtctaaatatatgtcgtaaattctaaatttgatccttatacacaaaaacttattgaataattttttatgcatttaaacattatcaatttggtcattatctcaattaagtcccttgtgcattgttgattaagctcctatatgtgtattgcattcttaatttggttggtatttttattttgtagatatcaaattaaaaatgtattacacatatagagattaaattaaaaatatataaaattttttaaatgaatatataaggatgaagttattttttaacatataatgctatagaccaaatcaataatgtttgcatgtataggaattaatttaataaatttctacttataaggacgaaattgagaatccattacacatatagaactaaattatatatttaaccaataaaaaaattgtaaacacctgcttttttacctttggataatcctcttttaaaattattaaatctgatatgttcggataaatttgttcatgcattgatagcagacaagaatcgagctgcaatttcagtggtttagatagtaatataagtgtataactaagcaataatcagatttgtttaaaaaaagcaataatcgcatcattcattgcaacataataaatttagtgtttattttttatattag

SEQ ID NO: 625 - DNA, 1400 bp, Glycine max
  Soy_ogl_5231 Gm16:1419201..1420600 Cluster 2
tttcaaaatgaactttctgaaatagaataagaagtgcaagaaacaacactcgacacatgctcccaaagattgattgtgcaatatttccaaaaaaagaagagaaatagggacatatttctaacatttatttttaatatttgttttactattatttaaaatgtgttagaaattataaaatcacaaaatgagtttattaaataagaaataaaacccataaattttttgatttcaaatgaattttaatcaataatgaaaaactgtgtttaaaaaacgtattgatattattaccatttactaaaaaaaggttaaaaaataaattttctgatttctgaaatgagtactatttactaaaaaataggtacaaaaagaaaaagtctccctcaagctgcacggtatcagtgccaaaagaaactcgctatactgtgcatagacaatttatttatatgacatttttttaaaaaaactattacaataacataagggaatagataacaaaacaaattatggattctatatgtgcaaaataacgaaaaatactttcaaattcttgcaaaacaattcaataaaaacttaaatcacacgaattgctgtcacaaaaatttattagaataacttgcataaaaattatgtgataaaatttaaattttaaaaatatactttacaatttctcaaaaaacaggtataaaaaagattaaattaaaaaatgaatataccttacattttctcaataacttttctatttatatttatcatataactcatgagaaaatactaagcataattttttgtataccatagtaatgatacaaaagttattttgtgtacctttattttccttactattactttttccaaaactgaatttactcaatttttttcttttatctaaactttgggagagaaaatacaagatcaaattgttttttttttctttctattttcagttctcataaatagatacaaaaaaaaacatcatctattaaaaaaatataaaaaatatttttcaaaccaaaggagctattattttctcttgattctaaaaatcatcatctttatttttaactttaccaagaatgcaaagtcatttacgcggagtcgcggactttaagatcctgcaccgattttcacggtcccaaaagtatagaagcgaaaaggatgatcgagtctattaccacctattaatttcattttcgtgaatatcacttggaaattgttatgactctacaaccttgaaaaatagcacaaactatgtaatcatgtgctaatctattgactatatagtaggacataatgagtttgtcttagagatcatgcagatattgtagtggggggcataacaaatcaacaaaacaaagcaaaaaaagcatataaatggactaaacaagactcagttgttttgt

SEQ ID NO: 626 - DNA, 1400 bp, Glycine max
  Soy_ogl_6226 Gm18:57222001..57223400 Cluster 2
ataaagtaaactaattttaaaaattatgagaaatataacatattttcgcatatatttcctaatttttaaagattatgtatttcctaattttcacatatcggactcacatatttcttaattttaaatattacgtatttcacaaatttgagtccttaatttttaaaagaaaactgtctctactaaaaaaatacttgtgatttttactgaataaatcccattatttaaattgataggaaataaactatgttgctaataatatgactaagtaggcgacgtaacaagtaaaaaaaaaaaaaagatttgtctacaattatgacaaaggtaatatataaaaatatagcattgcctttagtgtgctggttatgtcttgtcagaaacataaaatattgatgattgcaaaatttgtggctacatgttgttattggcttcttgtgtgacgttaccttagtgattttgggttccacattaagacaactattttttattttagttttaattttctgcgatcgattttaaaataatggtcaaccacctagcgtgattgaattgtatggaaacttttaaaaagtcgacctaatctttgaacgatccaatgtgtggtcaaaactgtaccaatcattcatgcaaatggccccatgtcatattggtgtcaatactgatagtggcaggagaaaaaaaaaacattttactcagtccgtcctaaaataattgtggtggtagacaaataaaaaaaatctttacatacattctaattaaattcttttaaatttagtcttattctcagaacttacaaaataaaattggaagtactttactaatatatgttttaatatatagtgtattttcctaatttattgaaaatgaatacacgttgattggtaatttataataacaatggaaggttagaaaagaagaaaatttgagaaaatataaatgaaagaaagtagaaaaaaaatcctaaggaaaatgaaaaggtattctatgtattgttcaagtattttttatacctatattggaatattataaaagtaatagaaggtttattcaattgataaaatattatttataataaaaattaaattaaaaataaaaaacaaacatttcaaacttttggttttaataaaatctgattcattgacggtttgcaaatgttttattatgttatttagtttataaaaaaatgtattaattaaactatatcatacctatacattgacagtctcaatatttcaaatactctcgttaaccatttttatttctctcttttcatattacatcatatcatttatattatatttatatttttctcttttttttctctctcaccagatgtctaatatcattgggtgtcaaaatataattttccaaataaaaaaatgtcattaagctcttgttctatt

SEQ ID NO: 627 - DNA, 1786 bp, Glycine max
  Soy_ogl_3253 Gm09:41081715..41083500 Cluster 2
cacaaccacaaatcacaaaccgattataaccaattcatttgagaaaaaaattattcaaacaaatccaaagaaaattagtttgatttgattttttattttgttttagcaaattttaatttttattttagttcaatttgaatttaaacactcttattaaatggcatgagaaaaaagcaagcaacatcataaaaatgaatataactagctaaaacattagctacccgttttcatagagattgtatggttacgaggggaagagaagaaaaatatataaaaaagaataaaaataaaagaaaaagtatttgaattaaagcgatttaatgggtaagaaaataaaaaaaatgaatattaaataaaaatattattattatattataaaacgtgagaaagagacggtgatggcacaccccagtaacaaaaatgaaaccagatgtcaaattctgctaaaatcttcctcaatcttctcaaattagagtatataatttttgccatgagacccaccagattttttaaaaatttccatcctcttatgtgccaccaaatcgtgcattcttctcaaaatcatcgccaatccttgtcccttctctcctctttatcggtaccaaaccaacccttaagatgtgaggctccaattgagaggaatcatagaatattgtgaaccagactccaccaaggatgaactctagcctaaccattctaaagtaagttagtagcaaatgatttcaatccttaatacactatttttgttaaatataagaattaaaactaaatattttttaattaaaaacgatgatattgtttgaaatcaatatcttattcgtattaaataaaatcaataatttatttatcaccaaaagcgtgaatcaaccattgtaaaaattattacatcttaacctatttgaatcaaaatatttattttaactaaacacatgatgatttgatcagattcaacttaagttaatctcaatctgtttttatctaaacacatgatgataactgcaaatattatttttcatttgtttttattagctattctaataactgtttttaaataatattttgttgagtgaatcattatgttggtctttaaaattgtagcataatattatttttattaaccctgaaatcattaaaatgttaaaaaatacttaaaattgtataacattactttttttcccttaactttcagtttgttagggtgagagactctcattaatccgagcttcggttggaaaaaaataagtaaaatttaataaattatttttaccaggaatcgaatttaaataataccttaacgatttaattttaatttcatcgtattaacaagttatatatgtcgaatcacttgtttaaaacattacgagtctcgttaaaaaaaatgttaaccaatgtacttaggacattagttaaagaattaaaaaaaaatattttattagatagtataaaattatatttttcataactttttttaccctctcatataatttttataataaatatatatattttttaatttcttaactaatgtttatagacgctggtaaaaaaaaaaatagttagagtagtccttcaattactcatttaattaagcgagtccaaaatgctagatagagctcgttaagtatcatagtggcttctatgtggtagctagaggataaaagtacagtgtctttatttttttaacaaggctaaaattaaaagaattttgcaactgtgacggaagacattgaggtaattatttttcctttttaattcctcgtcaaagccagaaagcttggtaattgca

SEQ ID NO: 628 - DNA, 1400 bp, Glycine max
  Soy_ogl_4638 Gm14:4061101..4062500 Cluster 2
tagatccaatcctaatttaaatcataaatcattaggttcattaagtctaaaaatggattaggatctaaatctgatcaaaatttaaaaacaaaagattaaaattgaatttaacccgaccccacccgtctcttgttcacccctaccatccaaacaattgatgagcattttaaactctagtattgaaattctgcaaacactcatattaacttgatcattataagcacacaacaactcttgactattgagttgggggttcatcctcattgttcgaacagccgatcgatatcgtctcagccacttccaacgaattagcatctccaacatgctttgttcttgcaaaataaaatcatacttgtttatcaaatataaaaggatacaaaataaggcgtaatatttatggaggaaacaaggttttatgaaaaaaaataaataagagagcttggaatgaatgaaacaagtgaggggggggcatcacattaattgaaaataacatgcctacaacatttaatgaaaatttaataatgttaattttcaagaactttgtttgtaatatcaaactatgtaatgacattaacttatatcatgtaagaataacgtgctgaaatttattgatgtatcatgtcataaaaaatatgataagtcaatcatatatatatattattcaaaatagttgatactatataaagagattaaaaatattgttttaaaaaatatatgtgattatcttgttaaactagttatttgtttcaagatattacaaattattcccaaaaatatgaacacatgatatcacatttccatgattgttacaagttctaaaaattatattttcagacatcgctgattgtagaaatatgatatacttatatttatctcacctcttattttcatgacgaaggacaatcgagtatatatattcctatgaaaatagaagttaactatccattcctgctatccttttttcatttcttttattttattttttttaataaaataatattatgaatttatcaaataccaaccaaaaatatttatgtgaatcctatattctcagcatagtatttcaaagaatataataaaaagttgtaaattttatagagattaaaaataaactttaaaggaccaatacaaaaaataaggtattgagtagggaccaaattgttatttaagtcttaaagaaaaacatacaatttgatttctaaattgaaaatctttcaatgaaagtgacatgtaaaagaagttaaaaatataaaataaaagatttacgtatagaatattattttctctcattgaaaatgaacttatcccattcctttcttaggagttaaaacataaaaaaatataaaaaccactctttttcctaaaaatatgcgtcccttttttttattttttatttataa

SEQ ID NO: 629 - DNA, 1574 bp, Glycine max
  Soy_ogl_1102 Gm03:45543301..45544874 Cluster 2
ctttaccgaatgctctagttcaaaagaagatagatacaaaagacattttaagagtttaattcaaagccataaatgcaataataaatgtatattatattaacaatggtctttattgggagattctatcatttttatactaactgagtcttagaccttagatcagaatgtgctgattatcatctacataataagtcctctaatcaggcttaagtgaaaatgattattgttaagtgtgattatcagtttttgataggatcgaatgaatatatggctacaaatacctatgtgataggtcattccattttcttatggggccgaataaatactcagtattctatccaactatctatctaatataaacttgaacacaaaatgtcttggtgattacttgactttaaagaagattctagactaaactaaggaattgcttttatatttttcattatctaaaagatcaatctctaagttactataagctttgaaaaaagcaaaagattttttgtttcaaatgatagttagctctttgaaggaaaaacaaaagtgaacttcaatgtattacatgtaggtagacataatccttcttttttttaattttaatttgctttcagagaatgatattttaaaacgagtttaaaaaatattagtagaattacttttcaacacgaaataactaaaaatattaattaattattagttaatataggaaatttgtcgtatattgttgaaaaggtctatactctataccaataaattaacaaggttaaacagaactaatatttataagatgagaggtgtaaggtgagagacagaaggaatattttgaaaatataataaaaaaaaactggggccagaagaaaaaaaagaggggtgtaaatatcatgggacttggtgtgtgtttggataacatccaaaattatgatagaccatggtaaaggtggatcaatcttgattttgatctgcacatgtttaaattattttcaaaattatgataaaatcaattttgataaaaaaaaaattatggtagagttgaagaaagtatgagcagcttccatttctaccaaaattgattctatttgaatttagactaatttatcctcacttcactatcctcgtgtatatgtttattatttatttatttattgatttcaaatataattagatctaaaaaaaataaaaatatcattaaaaatattgctatatttatttaattttgaatttattttatctaattttccctcacacttatatccttaatagtgtgataaatcatattaaaataaccatcatatcaatgccttcaagcatatgtttattgttttaaaatatagtaaatctaattatatataaaaactgtatatagatattaaagcctattttgatcattataccataaatttttttgattcaaagtatcaaaataatatatatatattttgagagtgaataatattctctaaaaaaaatcactttttataatatccgttatctaaacgaaaattacttacttcataatcaattatgataataatcaattgtataaaattaattttattcattgtcaattcaaatacaca

SEQ ID NO: 630 - DNA, 1380 bp, Glycine max
  Soy_ogl_5474 Gm17:3399221..3400600 Cluster 2
aaacatcttgccagccttcaaatcatcattgagttatagaaacaataaaggaaaggttatagaactcagaagttaggagtagttttccaagtacaacatataaacgtggaagttgtcaaaattagatcaacataaagccattgaaatattgatgagatgttttcgtcaagtttgcaaagtgttatcaaaagatggcaacctcctcgcagttagacttctgaaaatatgcaacatgttgcaagaaaaacgtcgtcagtttctctattagatacggggtaattcccattttctagattttttatttttgaaaaaaaacataatttagtttaaatgacattttaaaatcactgcagaaaatcgctgaaaaattacatagaaaatatgtatgttaatttaaatgataggaaaatattttttaacagaaagagcggatcatattcccggtaaacaaaaaataaaaaatctaccataaaactgtattatttttacgactatttctgccaaaaatctcataagtaattgaggtggtggttgaatttatcttcccgtgatttccttactgaagaatatgatttaataatctgttgaaaaatctcaagagttactaaaaagggaaaaagtaaatacaaaattatttttgcaattatagataaaaaaaaataaaaaaaaatctcaaattaaataagttctaatggtttagcttagttttttttttatataattttagttcggttgattaagcgtgagttgttgtaaaaaaaaaaagactcataaagaatctatgattttatgatattagatttatgtcatcgagttaattctatttattagtaattaagttgagttaagatttatcataatctatggtctaattaaaaaaacaaattttaagtgatttaaatgttttaaattaatctttataattccttaaaaaacaatctttacaatatatcgatctccttcaattctatgattttaacttttatatattttttgtctctttcaatctgtataacattttatttttcaaatttagctcctaatattatttttttagtccttagaaaattataattttctaaaagaaatatttgttttattctctattattcaagaaatattatccaatatatgagggagacaaaaactacaaaacaaaacttaatagctagaaactaaaactgacaaaaaaaagaggctatagagattaaaaaaatcataaaacagaagaatcagaaacgtattaaataccgccaaagtccaaagacaagacgaagaaacatgattgacagctatgcagaaactcatttctaaattgactatgaaagggagagtagcttttgggttagtaactatcagtactgcattgcacactcctta

SEQ ID NO: 631 - DNA, 1152 bp, Glycine max
  Soy_ogl_5613 Gm17:96291..9666352 Cluster 2
acaacagtaatgtgagctgtcgagcggcccctcccacaatttattgtttagttagccaagtcaaaatcacatcggcaatatatctcattaaccaaggtacgaactaccaagtattttaaactattaattaatcaaaaaaaaaattaattcaaattagaaataactttatatataactcttatagttatcattacaaagtcaataattttaccctacaccataatttataattagattttttaagtaacaatttataattacataataatataaaaatatttatattatcaagtgtcaatgtattataattaaattattattaatatatcaacatttttaaaacttgaaagaattataaactagtatatagttaataaattatttatatgatttataaactttatattgaagtacttggaaattacaattattaatttcaaaaaattaagaattattgataaaaaaaattgtatgtgttttttaataaatgaaattatatacaaaatataaaagtatattataattatacataaagacaaatcaattaatcaaatgcaacacatttatcctttattatttttaggaagtcacaaaatacaattaaaaaacgtcttatattaatttcatattcctttatatttttataaaacattaaatcacttaacaaaaataggaaaatacttgttaagcttatataagagatgaactggttcgatatcttatagagcagagagaggcaaaggaactttagactccaaattgaagatttgtgttatagtgggtctaaaaaacccaaacttggagagccaaaaaaattagttataatgtaccaaaataaaaaacagggaagtagtttaaatataagttttttttttcatgatgtataagtatagcactttaacagcataatagtgaccgtaaatcctgggtaactagctatatgttacctatcctcatcctacgataatattttgaaacaaactacactaatggagatatcccttcctcctttagtactgcaaacttttttctggtacatattgctgcaaactttttttttttttttttatgtataggcccaaaatgtaaacatgcgtaattttaaatatacttgtgctttaatccaggtcaaatgtttattttattgtaagc

SEQ ID NO: 632 - DNA, 1200 bp, Glycine max
  Soy_ogl_6948 Gm20:43243801..43245000 Cluster 2
gtgaccattcaaatgacacgttattgttatacagatcgataatgatctaatctctatcgtttgaaagtgtgcacttaagagagtagttttgattcaaaatttagcgaacaaggaaagacagtagccgcaccctgacccttatgaaaagacaagatcattttgctgaagagggaaaaaatcatggtgatcgaaagactttgataatagcttatcaattttgacgaattatttgtctgttgatataaaaaagaatcgattatttaattattgagatgcacaaaagattaatttggtttttgtgtttttatttctgttgtctcttaaattattaatttacattgtagtattattaatgtaataccttgcttccagaaaaaatgtaaatatatattgttagtgtgaatttaaaatatttatatttataacttactttgtaagataaagattatattaatgtttaatattttttagtagatgtattttcttttttcttttttatttaaaaaaaaggcgttatgatactatagtacagccagctcaaggtatagttgttactttagcacaaaggttatgatagaataatagcatgtgtactattataatgtaaatctaccatgtgcatattttgttaatgccaaggtatagtaggagacaagatggatacgagaaatgcagtggacacgggcaggacacaaccggcaagtacaccctgtcatgcaagtaacatatatttttaatgttgatttcatggtaaacaaataacagttatcggattctaaaaaaacttatgttatctagacaaccgaaattttagttgacacaaatgagtaaaatattacacaatcacgtgagaaattatatgattatgtaattttgtatagaagaggagtgcttaacaaattttttttattattgattaaaatttggtagaaattacaaaaaccatgctcataagtgaggctcattaaatgaaaagtaagactcataattttttaaaaatttctaataaattttagtcattaataaataatgaataaatttttctcttacaaagaaatgattccttgataatacatcatcatataaaatcacatgatgctactaaaaaacttacactcatatgattgtgtaatgctaacaacaattattctttggtagtactcgatcatgtaatatctcctagttgtatttatgtgaatt

SEQ ID NO: 633 - DNA, 1330 bp, Glycine max
  Soy_ogl_4476 Gm13:36160801..36162130 Cluster 2
ttatcataaactcatgtctacattaaatatctaaacattttctaattaactaaaataaaaaagaataaacaataacattaaaaaaatgttgatatgaaagctaacttaaaggtgaaacaaaataaaaggttaaaaaatagtttaaaactcagattaaatttagaggataaaatcacaattttatcctgataaaaagacctaagttttactttccttttcatatttgcaggtaagaatttcagctattatgtatttattattatatacgaaaaacatttaaaattggaggtggggtgtataatatggtacagcaaaatcattttcatccaaattcaacagtaagggcttctcattggttaccgacaattgcagcctgctaagtaagtccgtttgtacctggtacttcccttcatcattttctacatcatgtatatatgataactcaactgcacacataaaattataattttttttaatagataacaaaaaaaattagttgaattaagtctccatagctcatctgattaagatatattttaaaactcatggaacatttataaaattatttatagtttatctagcaataaggtttttatattagcagtgaatttaaatttacattcttattcctatggaatgtgaattcgattcttattaaacggatcaacatttgttggctaaaattataaattataaaagcatattgtaaaatataaaatcatatagaaattaattccaactgtgtaactatataatggtctgaccgacgtatgagtgatttgttatttttgttactatcttgaaacaaactgatagttgaatttatttcgtactttgaaaaaacataaatgaacaagtttcattgatacaacacaaaacactaaatttgtaaaattaaaagtaaaataattttgactataaaccaattaacttcaactgagaaaataaacctgaaagtatgagttattgagtcctctaaataccagtcatgttccaatattttatactaggtaactttgttctgaatggataagccatacaatgaaagttaaaaaatagtacagtatataatttttctcaggtatatttataccaacataatgttatgagttatgaaattattgatcacgagccattccttattttcaaacctaatatatggcataatgattgttccttctctgtgacaaatcccatttcttcataacttaggtagtgctgtctgaatcacagtccatatcatgaggccactaaaaccactatatatgatagacaattaacacagtaatcacaggatactgtaatgattaacataattatgttctgtcat

SEQ ID NO: 634 - DNA, 1255 bp, Glycine max
  Soy_ogl_4931 Gm15:8999901..9001155 Cluster 2
tcaacttgtattactatttttaaatgttaattcaattcaattctgattacttgattttcaatattagtgtctttttaattaatataaccaaacaacggtagaatgtcggaatgatgattcatgtttcagtcatcattcaaaacattgctagaaattttccctactttcgatcaaatgcttggattacccaatatcatgtgatttttttttttttagcaattgtaatccaaacatcttctacgactattgatttattgtttttagagagtaaggtatcatgttactaaataaaattctatcgattacaacgatcaaatttaagtaactaagcccacagaaaaatcgggagatgcagtataggagtaacaaaacagattgaacccttcttgtgtttggtcctttttggggattaggttggagtttttggattataatcccattttagtcagtcaaaaaatagttgacagaaaagtcaaacaagccaattcaactcattttttttaagaattaatatttattttaatattttataaatatattaaaaaaattaattaatttattttttgtccaaataaattattattcaaaacttaaggtaatacattagattttttaataagtatttattatttgatatttataaaagataaaatcaattaaactatatttattatttaatttttttttaacattttagctttgacggattaacctttcaatccaatcaaaaataggatgaactattactttcaacccatatatgaaatacaaacttggacaaattaacccatttttatggattggtggcgagatgagctaatctgttttgccactgctgatgtgggaggagggaaaggttcgaaattgataatttagtgacaagaaattggcaaagcaaacatttaagcttacgttcagaattggaattaatattatcttgatatcatagatgaccattattatgaagatccacgataatgttttataatttcatgatcaacatgatagtgtcttagcgcaaaggagcaataagacgtgtaagggttaaaaagaaatataaataaaggacaaaagctaattttgtattgtgaaatgatccaatcacctcacgcaatgcatccctttgtaaaactacaaaataatattacggtacatatgcccacatttattaatggtatctattttgttatgcaattagtctttaaatcatttttttatgattcacgataatttataaccaaaatgttatcacata

SEQ ID NO: 635 - DNA, 1600 bp, Glycine max
  Soy_ogl_27 Gm01:1590901..1592500 Cluster 2
aatgcctaaccagtataattaattacctaaaaattataatactgaagatgaatgtctttcctatagctagctagagtcgtccaaccatatgtggcggcactaagaaaagttcgagcgccacttaatcaatcttcaattataaatagtttaatttataaatattatactattttatttttactcatgtttttcttcacttttttttaataattttgttatctcattttatttctactatatcacttgtctcgtatttttctctattaattataaagagacagctatataaaacatgcacaagaatagaatttttttttacttttatttatagtataactaattggtgggtctgagcagcctattatggtatgtctataaggaactcggattctcctatgctttaccaacagcagtcaaacatttgaccgtatattacattctttcttctttcttcggattattgtgcagcaataagataatgttcgaaaaattgatgcaaaataacgtttgatataaaaataattttaccaaaaaatcaaaactttcaattttattttattagttgaatctacatttaaatatataccataacaattttaactataaaccaaacacatgcattaaacatgtatttgtatttccatccctacatctcaaacctcctttcatttcaatccaactagagacaagtttttccatttatttgcattggaatgtgggcagactgttattcaaacactgcctaagtgataccttcaagatattgaccggagaaaaactcagaaaaagaagttcgagatggaggtctataaagtttaactcagaaagaaagaaaaagaactaaacacttttacttataccttgttttttaagaccacaaatattcttttacagaagatgtccggctgaaattggacaaaattatgaatgacaaaaaatttctatgaatattgaatataattactataaaatcttgaactgcagatatatttaatttcctttttcacttgctcaattatttctcttgcaattttcacgtaaaaatttatccccctctgtttctgataagtatagttgcttaaaaaagcaggtttgcctccctctccctcttcatgttgcataaaaaatattgttttataaaggtataaagaaattttacgttaatataacattataacacacttgttttttttatccattaataatgttaatggttaattttttttaatgacttcaaatttacaatatttttttcctttatatttttttatcatcaaattaatcttattattccgataatataacgcacttaatatatttatttgtataagtgaattctaactatatgggaaagaaattaaaaatcacaaataatggataatagatttgcgaaaacttgttttaattaattgatcagatgcctagctccatattctcttgtaagtgaaatcttgttctgagactcttctttcatactctttttaatattttccttttaatactgtattactggatttttttttttataacttgtaatattgcatgtattactggatggaattttgtttgaatatctttactagtaggatctgattgagat

SEQ ID NO: 636 - DNA, 1900 bp, Glycine max
  Soy_ogl_1141 Gm04:548901..550800 Cluster 2
tggccaatgtgaatgtgagcaaagactgaaccgcgaggagcccacaagttatcaagaatttacacactgggcccacttaattgcaatctgatccccattgtgggcctcctagcatataaaggaaattcagatccctgggccccacgtttcttttattattctcctcctatctggtccattactcgtggccctgcctcactctcttccactactattctcaataaacaatctccaaaaaatatcaaatttatatcccactcaaataaaattattattacaactataaaatatttatgttctaaacaaaagtattattaataactcaaatttaaaacaaaaaacgatgcacgcatttttgtgatttagtaaaaaggatgtcccatgcctcacatcttatgcatgaaatctttcttttttaatgaatttctagcgtaattggtaagcttgaaatatttaagatatgaacgcaatgtgattgttaaataatttctttatcacgtcattttgtttacttcaattgagagcaatttttacatatttctttaatttaatattataatattaagtgtaattttaaaactattaagaaaaatttgtcttcttatcaaagtgatttgcattgcagaagaaaaattaagatagaatacaatcacccgcagtttaccttatatgattcattttcaaagatgtcattttttaaaaagtttttctaacaataccatatgataaaatattattattatggttttctaggttgaaatttgagcaaaacaaaacaaccaaaagttgtctatgattcctacgcgattattacacgctgccaccttggtacagacactgcattcaccttgctataattacaaacagagctaacccttgagattcgattcgactttttatctggcgtatggattcttcaatcctattcgcattagcttattacactagttattttcaacaaatataaaataaaattattgtttaaaccttattgtggatgcttcttataataataacaaaaatgaaatatcaaataaatctacgtattttatttatataataattgtatcatggaatgatattatattctcataaatcatatttctaataatatgataaccattaatgtttatttatgagtatattcagaaactgtgtttggttatgttttcatatttttagaacaattttttaaaattcaataaaaataaataaaaaataagttatgtgtatattagaaaataacttctcatgtttctgtgaaactcacccttctttattgaaataaaaatataaaaaaaagatatctaaaaagaaagttacaatgtttctaacaaccaacgatttcaaggaataaattttaaaaaattataacagacataagaatgttacattcccatgttcatatttatgggaataaaattttgatttttgaaacagatacattctatataataaaataaaatttgtatttctaaaatgataaaaatatttgttatattatgatttattatactgtttattgaaaactagtttatcgtttttttttaatttcctaacattatcatgactcaagatgttacactattaaaatggtttattatttttttatatttgttaaccattggagtttggctttttagcccatagtaattttattgtatttttcattttaacgttactcatcaattattattctaattataatataagacttgttttaacttttaacttgaaacgaaccatatttcatattagattagtagttaaaataatttaagttaaatgtattaaacgcataatattataatcacttttcttttttaaaaaaatatttattatttttataattttaataataaatatgattataatcaaattatagacttaaattaaacaa

SEQ ID NO: 637 - DNA, 1414 bp, Glycine max
  Soy_ogl_1150 Gm04:907279..908692 Cluster 2
cttcatgtgcacacacatatatgggtggttgatcttgattccatttttttttcatccacgggaatctaaaaaaaaaagcatggttacttggttagtatctttgtagtaattgttataaaagtcatttggcatttttccattatataaaattcccaattttttcatattttcacttaaataatagatcatttagggtaatgtaaggttacaaaattattctttaaaaaaagttacacaatgatgctaaaagttcatatatgagtttaaaagttcataaaatttaaacagttacatgagatgtgaaagtaaggaaaaaataattttttactttattttttatgaaatataatgggtcaatttgttacattttttttaagagaataagtttttttttaaaaaaaaaacaataacttcgtttagttattcaggtatttattacagcttttcaaactaattaaaagctgaacaaaagctaaaatatgattaaaattataagttattttaaaatcttcccataaaatatctatttattaaaaaaagttggtttttagtattgtaaacaaacataaattagattcttcttctatcattttagaaaaagtctccaaacaaaaaccactaaattagtttatatcaaaatcacttcttttttattcttaaatattttaatttgtgatttatgagtgaaaaaaagagttcaaattaatacaatttattaaaaaaaactgagactaaaaatgatagcagttaaacaaaaataaagaagaagaatactcagaaaaaaattgattatggaaattaaagaaagtgggggattaaaattgagttaaaaaagttattaagtgactgaccaaaatctcctactaattataattgaagaataaaaatgtaattaaaccatttgatttttaatgcttttatatagttagagttttttcatttgtatttatatggttagtgttaaaataacatagatgatcatatcattattgtttatttatttattatttttattttttcttgatatacataaattaagtatatgtgtaagaagtaataaaatataaattttaattagaggcattgcccataagtattaaaatactaggatgataggactactgcagaaaacaaaagtctccctttatattttcaataagaaatgtttcaaccttagattcttttatattttctccttctctttcccatttcgccctttattattttctcaccatcgtggttgtgcaccaaggcatctccctcacagcgtcgtcgaccaaggtcccgctcattagcgcaaccaccaaacatcgtcgccagattcatatctggaggcgtttcgacatttcgatttttctttgtgttgcgtttttagatcgggatgtgttgttattattgttctggacttgtccgg

SEQ ID NO: 638 - DNA, 1838 bp, Glycine max
  Soy_ogl_1411 Gm04:45098863..45100700 Cluster 2
aaaattatgtatactttcaatacaaaataaatcctaattttttttgctgttaggaacattttatataactattatgtacatgattttagccagattacccgaggataaatgatatcaactacatgtgcgcacttctaacatgtgaaataaacacaaaattcactttattttttactacaaaaataaacacagtttgagtagctttgtaggaaggaataaggacagtagggaactggtttaaaggaatttggcttctttaaaatgaggaaggataaaatattaaataccagccaattgttgatgagaacatcaacttgatattttaacacatttatgattattattccaactaatactatttattttactcttacttttgaagaatcaaaccgtttcaaagttacctcatctccattgagaagatgtaaaaaaatgtattcccatctcaagcctgtaagaatatcaatgcaaatatatatggtagggattcggagtaatatatttttatcgtaatttggattgatcattttatggaaataatgtgtgtaatacaaaacttagcatttaatgataaaattttattgtaaattcatttaataaaattattattatcaatgcagtaatatgaacttaggttagggtcaagtgtgctgttataatgcatgcctttcggatgttatatggacagttattaatattataagagagtaattaaaatgttgtacaatgaatagttttttaaccgggcagtgtaacgaaaattatgtatcacatttaggaaatatgaaatatcaatataatattgaaattatggaatggttatttttagttctcgtcgaataatttatttgtaacaatacaagattaatttgatataattttttttattaacagttggttgattcaagccgtgagaaacagcaatttttgaggcttcacgttaagtaaatacaaagttaaatttgataatcaagctataaagatcttttgccaaattctctttcttggcaagagttgtaacgaaaacaaaaaggagcatcgaaattatccgctggagccctatgatgcataaaagacaacatatttttcttaattctttcaattagctttgaccacttgctaccattactgtgattgtttttattagaataaatttttaatttgttgccgtatcctttttaaaaaaaaaaaaaaagaatctcattagatcactctttcaaagataataaataaaatttgaatttattcttttatgttattatttttaattttaataaggatgaatgtgacgacattctaaatttttaagggactgaatcaataataaaaatatttaaaaactaacgtagccgcgtacttattttctttattacattcaaagaaccatcaatatattatcaatgtaaaagacataatgtttatgaatgaaaaaaaaaagaataatgatgcgttcacgaatatatcatcaaaagttatgctatcattgtctttaatttgatgtgttccattattttattgttattgcatactactaattgtacgtaataaaaaaatttatcgtgagctactcgtaatcttattcataaattcccaaaaatctctaaattagcataattagaattgaatactcaaagattatagcttgagtggggaaaagaatcaaacttttgtttcagagtatctctgactccgtaagtaatctctggttttccaccacactcgtttgtctttggtttgcttttccaacggctagtattgcatgggtcgcttctacaacaaaattggtggcaagtatagtgttcaacactttcttttatagattatggcatcttcttgga

SEQ ID NO: 639 - DNA, 2286 bp, Glycine max
  Soy_ogl_1423 Gm04:45820631..45822916 Cluster 2
gtttaaagttctgccattgaattgaaccgcttagcatataatgggcatgctcataattcataaagttaattaaaaaaacagaaaacgtgaaacggaaagaacgtcgctgttgaaacgggtcaccctttcgtcagctgtgatatcaccaaaatacttagctactaatacaactaagcaatttttttagcttaatttgcttaattcttaattgcgagtatctaatgaacgaaaaattatatgtgcaataatatattaagatttcatttttttaaattacattattacttaaaagtcacattttaaaagtttatatgacttatatgtttgtataatttgtgataagtcaacacttatatatatataattctgcaagtgttatttatgttgtttttcaattaaaattgaattttcacttcgaaaatatgcttaatttttttattatgaaaatctttattttgctattatcacggtgaaactgtccttctaattgaagaatagcacaaataatgtttataaagctacatgtaagttttgtgtttgtgacaagataaaatgttccatatttatttatccttctcttacagaaatttaggttctctaatttaatatatctcttttacaaaaaatgctagaaacatacgttttgtaaagctttttcgaatattctcttttatttgttaaaattattgagaaacacaattttttaagtctcatatctttttaataattttattttgtgattttttaatttttaataaactttaatcaataaaaaagcatgttgataatatttgtctctgttatgtctataaatgtatattagcatttttgcctatctggcttgaagctgaatgatcatgtattcctccacaatttagcatccaagaataacctttggatattagtctctttgtctttttttactaaagactgaaggattatttatgtatcgatccttagtttaagcaccttggtcgaacttaaatgaaattaaggcttattcgatctaggaccagtgtggttatatatcattttctctttactcgatacctttgggggatcacgttggcccataattgtacttattatttgtctgtgcttagatgtattccaagtacctatattttgtggtgccttttaacgattcaatgttcaaatatcaataaggtctttcggtgattttacgggtatctaattatctgctaagaatggataaactgctaccccgcaagatctgacatgacctggtggtcatgttttcatagagtatataccccaaaggcgatcgaaatcctaaggaacacgagacaattttttaatgctccattcatttgctagccctaaatcagtaaattatctcttggggtatttagtcattgaaacatatatgaaagtaagaagaataaatttgaactcatgataattttaaagtttttttgtatcccgtgaaaaatataatatttctactaaattaatttttgaatttttttttgtctaatcaatgcactttaacattgattctatttttaaaatacaaatacaaattaattataacaaaaaataaataaattatattttacaatgaatttgatataatttgaaattacttataaaagtactaaatgcttttccatttttacactctaaataattaaatttaatatttttattttaactgatttggggaaaatgttaaaaatgattgtcaaggatatataacttcaccagctagccaagtaaacatggacgtacgaagccacgaaggaaataatatgagaaatggtattgctagcgtgaggctaacgtgccaatgatgtcataaggagtacgtaccttagtaataggaatataagatgattaaaggattgcatcgtctactactctctacagaaaaaccccttgtatattgataaattatgtatgaattttaaatgatcatgctttttcctttttcggattaagccctgagtgagttaattggagaaagggcatgcagtggcaaacatgcatcatttctttatgccactgcctataggtggccattatagcattcgaactaccacctactaatgattaatccacattcttctcaatttattctctctctagctctccctccctctctctctgtattcttttttggcgcatcctagctctctgtattcacagccaacgtatatgataagtagatgattacttacatactttaccaaaaattaattaatatcgtctttgaacgtaattttaatcatggcatgttcaagtagatgattatttttttgtcag

SEQ ID NO: 640 - DNA, 1855 bp, Glycine max
  Soy_ogl_1472 Gm04:47594746..47596600 Cluster 2
gagttatgataaatatactttaagtgacaacaaacatatactatcagtaatattgagataaataataacgatttctatcttttaactaattgattaaaaatttaaagtttaattggttgttgaatataaaataacttatgttgtgaggaatatacgtatcttatgtatacgtatggtatccaaccaatattagtcattattttttactaaataactctatacttataccatgttgaggaattacactccctaatgtaacttttattaaacattatgtttatttatcttcaacaggcatcttatttattgtttgtgaggaataaaatgtaaatgaataatacgtacattattggttaagattttgaatgcgcagtaggcgctttataataaatattgacagaagaaaaaatatttttttttgacaaatattagtttttgttggaatattaattttgttagtagaaaggattgaatttataataattttttttctttttatatctccgatagaagaaattgtataaaagcccgaaaggaaaaaggaaaaaaaaaagaacgagaaggctaattaatgagtatcgaagtattttattttaaaaatttaagtttgatttatactacatgtgagaaataatagaaaggaaatttccagttgggtgggaaagtctggtaaattcagaggtaattaatgaataatagttttacctgatgatcgagcttgaagtaagatgataaactctttacttttttatacgccacatgtttgtatcatgtaattaatgaatatttggtagtgttagtttcaacgtattaaaaatgatattggaaaaaaaaattgaaatatcacatcccatgtttgatacttttaataaatcttttaaaaaattatagattctaaaaaatataaaatattcatgttttttattttaaaaatagtcatagaattatactgtgaaatttcccaatgtgcgcgtaccaacaataaattcgtatatcgccccatttattgcgggaaaaaaaagcaattgaatgcaaaattttagtaaaacttttaattgcattcgagaaagcaacatatatgtttgtgtggctccacgctgggtagcatcaacaaactgcactttagggaccaatgtgttgatacaatatacatatggggaacctgcaggatgatcattttccagatatgacacatgccatgggacaccaaagcaagcacataactatgcacttatatatacatatgatacaaagacaagatgattttcccttttaccaaccggcattcaccacaaaatatagcccaacttctgcaaaaccaaccacaatggtgggaaagagctttcggttcattatgtccacacacaaacaagctcatgtaaatttgaccagctaatctaaagccatgtctttaactagtgtcatgtgtgtatgggcatatggatcccatttggcaacttcatcaaatgggaagaaatatcagtatttatatcaaattcaaatatagtacgtgactattattttttcccaaaataagatatatacataccccgctgactttcctattttaggctgtaaaatttaaaaatacaccaacgccaatataaaaaaaattgaaaatttcctttaatttaattaagttgatcctttgtcgaatatgcctaattttcactcattgtattatccctagctaaaaccactgcaataacataaatcggggtttgaatagtctcagtttttaattgataatatgggagagaaagtttaaatattgaaaaaggaggacatgaaatttaaatggtgaagattcccacatgagaagattcaagggaaaattacacgtgagaggaaccat

SEQ ID NO: 641 - DNA, 1900 bp, Glycine max
  Soy_ogl_1531 Gm05:1908101..1910000 Cluster 2
aaattaaattgacctgtacagattgaaactttacataaatttcttataattaattcgttttttcttataacacattcaaaaaaatataatccactatttacacctctaattaggtagctctagttaattttttataaatgaaaatgaaatttaaccctaatattcagttaggacctaattagatgggaggacctaaatcttttcgactgattaaaaaaagacgggaggacctaattgaaataaaataaaaattcagagactcagttaaaagagaaaaaaaaaaggacctacttaaactcaaactgaacaatagataaaagtgaaaatcttgttttccgcgtgatcatttgatacgtaaattaagattaaaagaaaaatcggttatatatccgaaaattttatatttaataggtattgtagtatcgcatgcccgcctattcttgtttcttattccacgtgccaaaaaaatgaaaaatgttcaactcatacccttcaatttttacatgaccctacactcattcctttcatagcaaaaaaatgggaggaaagttaataaaatttctttctcattcttttttatcataaaatataggtataaccgaataagagcagtgtaaaaatttttaatgtggaaaatatattagtatttctcaaaaaatatgccctcctattcccaatgggccggtagttcaaaatttccttgacttggccaatcaacagcatgaaagccagagaaccacttggttatgtttggataaattaaaaattaggcactaaacaacctatgctaattctaagcatcgtactcaagttcaaaggagccttttcctttttcatatggccactttcccattccttccactggctacttaaagccccataaataaaatctttgataattcattattatatggaaaaactcaatataatacccgtgctgtaattaattaattagctagggtgataggtatattgccgcgaaatgagaagctaattaatagcatttataatatatgatttcttaaatgaggggtgtattttaaatttgcgagtcctacactttcgtataaatttaaaaactttacacaaaaatttattttaatgctaaagttgttaaaataagtgtttaacttgagtcacattaaattttacaactgaaaaaggattttttaattagtaagaatgaattacttaagcaatatattatcaagttatttattctaatgataaaaacttattaagtaatgttatttaattttaagtgattcatgaagcactcatattgaagatgctctaagccattattgttcatgaattatttaactttttattaaatacaagagagaaaaatatcatatttatgacttaaacaacttgttaatagaaattgatacccattggaaaataaattaattgagttgtttaagattaaagtaacataaattgagttgtttatatcaaccatttggagatgccaaaaaaaaaaaactcgttttgttggctatattttatgttgaaaattattcaagataattccttctgttacattttgatattacacctaccttggtacgtacgattcgtagagtcttgaatttcttaagctattaatgtaaaagagcaaccaatggtttatgaattctttttatataaaaaaatggtttttaattcattggcatgtatctgcatgtacttgaaactttcaggttgatgtatatgggtttgagtaccccttatacaatttttttgatgaatttcctttgcttttgataaaaaaagcacaagagaaaacacctgttttatattcaagtatattttgatttgttacaaaatatgattggattacatttatagtcaagtatattgcttttagttttaatttaaattaaattaattttaa

SEQ ID NO: 642 - DNA, 1945 bp, Glycine max
  Soy_ogl_2145 Gm07:3103388..3105332 Cluster 2
aacatttagtaatagaaaaaatattgcaaatgttcaaaataaaagagaaaggaaaataacaaggtagaaatatgtacagaaataatatgaaccggagagctgaagggttaaaatatctataaaaatatgggaaaaaaacaatggaagaatatcgtaagacatccaggtaatttcagtttatttgaattttatatttagcttttacttttatttttaaaaaagaggattaattcaaatatgacgccttgttaattttgtattttggttagctttgttattcgtaataagaattttatcctagattttaaggaagtattcaaccttttgttttgtcattttcttctgattttttacctaagacacttacatgctttgggctttctttattaaccttaaatcactcccctaataaatgttgactccactcatcgattcttgattggataatgctgaattgaatatatagggaggtgttcctggcaccccctacacgttgttatcatttgtaatgatgaaaatgcttcattataacccatttgacatgtatgtatatatatatattcggtttccattgtgtacatggagtatacacgatataaataagtttttgttgtgtttttttttaaaaaattaatacaatagaaatgtatttctattgtgttaaatttatttaagtttcttttaaaaaataaaaaatgactcaacaaaaacttaattttgttatgtaaaaaaaaaaacacacacacacaattgaagcttgttttcattgtgttaattttttttgaaaaaaattaaacaatgaaaatttatttttgttgaattagattttttttattttcaaaaaactttaagacaatgaaaacttggtttttggagtgttgtttttttttaaaaaaattaaggcaacggaaataatttttcgttgtgttaattttaattaatggatatttctttacataagaggtatttttgtctaatattcattagattggggattatatagcataaaaagaggtgcgaatagcatttaccttgaatatatacttgatcggttagcccaaattggctaacaggtccagtagacttcaacttttttggataaatcaatttaaaaaaaaaaatatgattctgagaacaaaacaaacataaattaaaattcatttcgattttttttttcataagcgcttactagaaaaaaaatgaaaaatatattaaaacaagtttctctcataatttaaaattaacttattacatacgttagcttagtttttgaaaaactataatgaaagcattgttgtaaactaacttatatatgtgttagttatggaagaagtttatttcattttatctttatatttttttaaagatatttatctatgtaacattaaaacttcgtaagtttaattcgatttagacttgattatgaagtaaaaaattgaataaatttaattaattctgttaaattaatcaaattaaccaaaaactaatgctgtgctttttcccacagaaattaagcataaatggttatgatctttctcaaaagttagttatttcacatcacaatgattttgacgacgatatgaaaagcaggatttcagtgttaccttgttctctctgaacagaacactgacatatatgtatgttgtcgatattttattatacttttcttttttcttttttgcgttgttgcggaatagtagtggcagctgcctcgcacgtgtagcttagattatttaccctttaatttctctgcacacaatattaacgtgcccaaatatgaaaagctgtttgtgattctttctttgaacaaagattttgaagttcggtcttcaatttttagttctttcttaatttgtagtacttcatccataatgcaccagaagaatgtcggaaatgcaatcattatactcatggcataacaatttgattttgagtgtagatggtt

SEQ ID NO: 643 - DNA, 1300 bp, Glycine max
  Soy_ogl_2193 Gm07:4679501..4680800 Cluster 2
tacattccaataatatagaacaattacatcactacatgaaaatatattcttgaacttctggtacaataaattaagcatatgttttacggtatactattatgcacacatggacaaattaaaattaatagtcggctacatattttacgtattgagttttatcacacgcactatgatcaaattaactagctttctactttaagtctagtcaaattaaaattaatggtagactacattatttgaattaagttatatattttattatacactatcgtcaaagtagctttcttttttaagccccactttgtaaattgattgtgtattcaaatactaagtggtatgtagagtccttatttacattatgactatatgactaatactactatacaagacatatacaacgatgattgtataagacaatttataaatctaaaacaatttataaacatattataaaccctcccaaatatttatatatgtaattatgtcataagataaatgtaaataaatcataaataaactctttaaatacacctactaagttgaaaattatattaattgatatataccaaacttaaaaaacaaaaacaacttctacgtaaaactatttttttcttaaaaaacgacaaatataagaatcaaagagaaagtagtatacatttaattactttatttcatgtgtagtataaaatccctctatccgaaaatattgacttatgaaacactcacgtgtatagccttgaaatttgcttgtgactttgaatcttacatagttgttttttttttttttcttttcaattatcaaaacggattagtaacacgtacacttaaaagttaaattataacataaatgtttgcttttgatttagatatttttataagtctctttccgtaaatgcaaaatatatgttcactcaagacatagcaaaaaaagctgaaatgatggactatatgttagtttggaaaattttctctatagccattttttaaagaaaaaataaataaaaatcagtaaaaaaataataataaataagatttctataagataaaatttgattatgcataaattaatttataaaaaattatattaacttttctaaaagatatttttaaattgagataagcaaaattttaacttacaaagaaacttatttcatttttttattttctcctcctacaagtaaatatggagaagttaatctgaataaaccctagctaaaacaatgactcagtgactaatgatgcaaagaaaattgataaaaataaatgttgttttaaagtttaagttgtcaaccccttatgt

SEQ ID NO: 644 - DNA, 1947 bp, Glycine max
  Soy_ogl_2671 Gm08:14065754..14067700 Cluster 2
aaactcaaatagtttggttgggtttttggattggagaatttgaaacccatataaagaaaccaaaccaattgatccgaacagtacacaatattttgctttttattttagttttgttgtcatattacaaatcatatttttattttataatttataatgcaatacaatttttatttcgttttgttagttgttacttgttagataattgaaggttgtaagtgttttttttggaaaacttactgatattggaaaatatattatagttgttgctagtgctagtattttggctactactattagatagctactattgtaatttttttaaaggaaaaaactttatgatattatagtttcctattcatgagtatagtcttttatttaacaatctgattttttattattattaaatctaaaacaccatcggaatcaaatcaaatcatccgattggtttggttctggttatgataaattgttagttttgatcggaaaaccatctaagttgtatatttttttaataatatatatttgaatgattatactattattagttacataatgacttataaatgagatatttttttacttcaatataaaagaatgagatatttatttgacacagttttaacatattttataaaagatgtatcatattttcatctaatttactcttcttctattgtctatcatcaataaaatatattttatattcttaaaagtgttagttataaattggaaagcaaattaaatatataaacgatcataaaacgtatagtttctttcaaacattttgccatgaaaaatcattaatatatatcataacatcaacattaggacgtagaagggatacttagtactttttttcagcataaattatattttctactatcttattttgatactcttttttccctttaaaatatagaaatacaacaggataatcaatggattcttataatagcaatgaacagtcatcaaacttttactctaaagaaaattaaaaaataatttgtgactcactgcaattgaatgattagcaaaattaaaaattaaaaatactaaaaaattgagtttaaaagaattaagttttgaaaacttccacaaatcattcccattaagaagtcaagaaataaatttcaaaattaattgattattttaaaattgtatacaattattttgggtctttggtcgtcatccgtttggcataggcccaacaccggccttgaagagtagccaagataaaatatacatcattttaatatctatagactaagatatatataagaattgaattaaatattaatgtcaaaaatagacttttttttttcacagaatgctaaaaatagagtttaatattcttaatgcattgttaatatataatttttttatattattatttagagtaaattataccgacatttcttaaaaaaaattaaaatgatacaggaacttttggtttttaaattgtaatccataacttcaattgtggctgcaatataaagtttttttttaactcaccgtaattaaccagacgtatcatcggctacattttcctatattactcgtaacgtaaaagtttttttctttttcttactgcaaccgaccgcaatgtaaaatcatggatggtgcgtgctgaaaattggtaagtattgtggatgacgatgcatcaagttaggtaggatttcatggtgcagtgtggtgaaggtatgctttaattaattaatttgttcatccttattttatatttttaataagttttaattaaccatttagaattgaaataatgtatttaaattagtgttttttccaaacactcctaacttgttgatatttggacacatatccaaaaattataaatattttattaataaaaaaaagttgacaatcacccctaaatagtaaaataaactctcgaacacccagtgaagtaatataaggtatactattttatta

SEQ ID NO: 645 - DNA, 1774 bp, Glycine max
  Soy_ogl_3191 Gm09:39311301..39313074 Cluster 2
aaaaaagattagaagtagtagaatttttatcctttataaaaatagtttgggttttatgatttaattaggttcgatttaatttcaaacaaaatacttcaatttttttatttattataaacagtccatatagttttttttaaaaaaaaatagttcaatggttataattcaattcaattctaaaacaattgttttagtttttttagaatccgaataacaactctcatttttatgtatttttttctattatactttttttctttaggtgtgggataagatatcgaatgtctatccattatttaaatttttttaacacccgtaaggaacaaataggattagttcatgtatgtaggagattaagttgaagaaagatctgacagattcagtattaatgtgtttgcttgtgcggcttttagttttaggcacatccatttgtaatttcacgtcagatgagaaaacagtacacgaaagatacttcttcagcaacatacaaatattaattggcaagtaacttcgcatttctctgattgttaattttaattaataaaaaattcgagtccatgacttttctttttttctcttttctttaattaccaagctaactttatgtgttcatcttttacatatctttgaattacagttttaattacaatttgttcattcatgatgttaaatgggttatgcaatttgcatttcagggtgctcgtgctcaaacctgtggatgagaatagcatttttggtcaaaaattggccaagtaacttcgcatttctctgcttttttattttatattttatattttatacttggatttcgttttttaaaattctttttacttggatgtttaaatcccactattaatttgagcaatttctttttggctatatttcagatacatatgcaagcacatttgctcctattttcccataacgcttcacataaaagaagcaaaagcgtttcgtccggatcaagcttatggtttgtactttgtaccaatccatggacttaattaattttcacattttttatgttttaaccattaaattttatcataactagtcgaaatgaaaatactttaagccatgtatttttttataaaaaaatgtcattgtcatcattaaatacaaattaatgtgaatttgcacttggacacacacttgacattattttttttggtgaataacacacacttgacatgacacgagataaaaactaaaaaatcttgtttagacttttttagaggaagctggtagtatagtacctttttaatttgttgagtgatggatcttgggaatttgcactctaggaaaggggcttatgaggaatatttactgagatcatcatgtcccttttcccatataatgggtatttaattggtgagggatgcgtcaagtttaacattactacaatttatggaaggggttgggttggggaccattggttcagaaaattgacacttttaaccattctctattcacattattctttttgaactgctttttattattctcattttaaaaaatgcctttgtttttaatttcttgaattatggtcaaataagatattgtgttaattatctgatgatgagcttatgggatttaactcacttaaaattttattttaaaaaataatatgttaatcaagatttaaacttaattatcaatacattttaattttaataaatgaaataaatcaagatttgaaatctcaagcacaatagtataaacatatttgctttttagtaagctgaatttgaatattaagtgtgttggtttaaac

SEQ ID NO: 646 - DNA, 1900 bp, Glycine max
  Soy_ogl_3199 Gm09:39740101..39742000 Cluster 2
tgcttttggtttttcttcttaaagacataacagtcactcaactatgtccaaactttttacagtacgtacttgaaattcttcatgtagaacttcttcttgttaggccccaaatattaggatatgcattttcgaccttcttgccattattgggattcttggtatatatatattttttcacatcctaaatactaagtgttgtagggcatagaagcaaactgaataatataagatttattcttcttcatggacttctcctcttgagtaataatagccacaatatccatcaatggtttacttatgattctaagtgtcataagagaacttcaaattaaacgtcaaaattgagaagatagtgaaacaaaaatcttcaaaaatcaggtaattaatgatcatcaatctttttttcttttgtatctaatgatcatcaatcttcaccatatgctaacgaacacaactaactaacgtaaaaaaaatgcattgagttattgatgaatatggagaaataatgacttttctgattctcatcaaagtcatgaacttgtaaccaacaaactttaaaaagtgttagcatgttcaatgattccttgaactgtttgagagtttccatcgttcataaaaatcctgagtagcagtagacttaatagtaagagtgtgaggctcttcttccctcaaagtcgatgttgataatgatcaaatacaaatccaaagattccctcaattctcataattgatctcattcaaagttatcatgaatctgacataataactactgaaaaacaataaaaaaaaaaaaaaaacctagtggaaaacagttaaattattttaatatgcacaacaaaatatgtccaacatacacaatttcttatctatatcatgatgttgtccaaaggtctgaatcacaattacagtaacaaaaagatatgaaataaataggatgtatacaaactcatgctataaaaaattcattaccaatagagtaccaaaaaaacaaaatacattatatcaattacaaataacattcataacaatatattgataaagtataattattatcaatataatataaacattaataaatgatataaataacacaatttgtataattgttcttgtactaagtgaaataacaatcatgtcaaactagtaatccactacacatcgggccaaaacacagtatatgcatgtttggattttcgttgcgacaatttaaacctttgttttgagaaacaaactcctagcctccttcaatactcattcgttgaagttgtataggacttcgtgttgtaataaaatggtcggagaaatgaattaaacatacactatgttctataaacatgcactatatcattatatatgtttttttttctttttaattgtcttttctttcacttgcatcctttcaaaggaccctaatataacataccagaaaaaaaatattttgttttcaattttgttgttgttaagataaaaggaaaaacatgaactaaagtaaatttcttccttaacctaaacaaaaaagtaaatctcttcctggtccttatttttcaagttgaatggcaagtttacattcgtgtgacagcaatatgacaagcataattgacgctaattttaattataatcaatacactacacgacaaagttttcgtcaaagttcgtttatataattataacaattatttaatatggtatattgacagctcttgccttgttataattccaaactatcctaaatctaaaggactttaaaaaaaaccctcaaataatttcgttgttttgtttaaatataatcacatacaaaaatctctttcttgaatcaattaaagcaacaattgtttaaacttgtttttttcaatgcatttctagaacctccaaccctaacaaaattgtcgcatatcaaaag

SEQ ID NO: 647 - DNA, 2138 bp, Glycine max
  Soy_ogl_3241 Gm09:40621501..40623638 Cluster 2
ttcatgactagtacaatgtttaacagtaatatataccacaagcaggagatacgtacgtgcaaaatatataccacaagatgcaactaagtgcaaacaaacacaggcttaatcagatatatgatgagctagtgtatatatatctctagtcaaatatgactattaatctaataaactattattacgacaatataataatttcctgaagaattcacatgcctcagccacttgtcccaatatatctaaactgcttaactccaacgccttgaccagttttaattaccacttcctttcacttgatatatgttgcattcattgtagaattgaaaatctcaaggaagaagtgaagctgtgagggttactaggacaataactggaatactcacaagtgacatggctgctattatgagtcactgatatcccttcagcatcatagcaagtgaagctcaaaatgctcatcattgccaccaaggacaagaaaagtgtcaccaggccgcaaagtaacttcaacggcaatgtcttgaggaaatcctcactactacaaatttgacttttaacgacaatctaatggtggtattaaagtaattgtcactagttggtagatcaaaatttaatatttaccaaccattaatgttaatggtcggaaaaattaatattagaagtcaacaggggacaactaatattagagagaacaaaaatctgacaaccaacttttctatcactctgaatgtttctcaaattcttttctctcatgctactcttctctcagtcgtaaaatttttcatctcctttctctagtgcgtgtttttctctatctgtgagcatcaattataaatttacgaaggttagggcttatttatcttatcatttgtggttttgattgaggctttgattggaacatcgattcatattcagattttgacatttcaaaattcggtgtttttggtttgtgatttttctggcggatgttatcagagataggaggagcataaaagttctcttagtttcaaatgaaacaggattgggaagtaggtgcggattgtgttcatcgagttccatggtttctgattttccgatttcaatctctggcgagaattatcgtttgctcgtcatcaaaccaatctcaagtttcaattaatttctccacaattgttctcggtttggtaccttaggttttttttttttttgagattgttgttttatctttgatgtcttgtttattatgtaaatggttgtgattttgagatccttaagattatctccatgtgtttcataagttacttaaaattaagcaatgttgcttaataaatttttaccatttgaacaaatgatttgaaagtgtgttgcttaagcgagttatctatataagtagtcattgcttaactcattcttaccaattaaaaaattattttttaattaaaaaatttaatataactcaagttaaatactcactctaacaactttggtattggaataaatttttaagtaaaaattttaaattattgtgacattataagacctataaattttagataaataatccatttaaataattatgtattatagatgctttatgagagaatttcaatttttaggagtaactctaaatctcattaaatatatgcgttcaccatgcaagatgttaaccatgcaattttgatgttagccatttaacctctgtttcaatataattaggagccaaattttatgagaatgcacttagtcattaagtaaaagtgagaataatcaatttctggcataagtgagaatgatgtggcgtgtgattttgtttttgtccgctaggaggctaatagagatgtgagcacttttgatggtgagtattccaagtgtaatcttgtaaggtcattggatttgaatgtgacgtgttctattttagcaagatttttatgttataatattatggcattaatacaaacttatctttctttgtcctgatgtaaaaattgcttgtgttaagaggtaagagaatggaacaagctgcgataggtgaccttggaccatacaacagggagaatggaatacaagtatgagtatgaatattgatctctaatctactgtgttgttagcatttttgagcaggttcaaaatgataaaatatttcagaaaccacgtaatttatc

SEQ ID NO: 648 - DNA, 1647 bp, Glycine max
  Soy_ogl_3784 Gm11:7075944..7077590 Cluster 2
tttagatttttttttgccttaatcttcttggtttataaaagcaaaaatatgctaattaattcgaaatttgatggtaaggtaaataaaatctgataaaaatttatttttattaaaaatcaaacttaaataatatccaaacaatttaattttaatttcaaacacattaaatcatttggttattcttcaacttggattgaagtgtaaattattaaaagctattattctcgttgttgttatctacccaattcatgaagtgttgtacacctttgtttagaatgatgttccttgaatatattaaattcagtaagagtgtccttataacatgaaagcataataataaataatggtactaatatatatagtctctcgatcataaaataaaaaataaaaaatcagtctcttactcttgaagaaaaatctgatactgacataattcttaattttccatatatcttacataaatttggaattgcaaaataagacaagacgacattaaccttagatggtgaaggtgaagaacgaggagccggccatcggtccaagctccagggagttggagttatttaattgttgatagcatctttagttactatttcaaatgaataatagaagcatttgcaagttcaaccaaaatgggttcacaaatcacaaacatgctctggctagtggactccgttgtgtttggctggtattttgtgtcagcggaatattcaacgttgttttaaggattcttcgtctatctatgactatgtgagtttgcttccaataatgttggtagaaactagaaacacacgttgctggttctgtcttctgtcatgccatatgcttcaaataatgaggccaaacacggtaggccaagacgccattttataatttctttagaatgtgaaaattaattcgaaagaaaactaaattgaattttatcttttaacaaacacaaaattttgttgtatttagttggcgaggacattttttttaatattgagatttgtattttgtataaaaaatataacaaattattttaatttatatttaataattttttgtatttgatctctatatttagtaaacaaatgtttttataatccttcaatacaccttcattaaaaataataattttaaatatacagtgtagatttaatctaaatctttggtgttatattcgatgtaaacatattttatctctttttttttattaatatttatacattgtaaaataattttacatagttatttaattacatatttaaaataattattttaaaatttaataaactaagtatacatagtagattgtgtgaatcaagacatccgcctaaggttaaaactaattctccaaactactaagattcatttaaaagatttaagtgtttaactattttgacaaatatattttattcccacgagtcaatgatattattcaaactaaaccacaatctttttattctcttaacaataatttttttttataattggatcagataattttttatttcaaaattaatttaattttaattatattcaacaaaatattttaattaatttttatattttttattaactgaaaatttgatttgattgttcaataaacaatttttaatattttttgaaacatttgaagtaacgttttttaacatgcattctaac

SEQ ID NO: 649 - DNA, 1829 bp, Glycine max
  Soy_ogl_4488 Gm13:36495901..36497729 Cluster 2
aaatttgagatcaatagttaaaatttagactaccaagaaaaatactacaaccctcaagttagtaaaatttttagtagtgttctattttaattagtcagtagtatgacaataaatgtcataaatgtgtagttgacatgctaagatgacttatttttaaggattttttttacaggaatttataaggatattctaagatgaactaaagtggattgtgcatggcccaaagctcctcgttgatttttttttttttttttacctatttgagggtaacatattattaatttactcccattgaagtatatgttcgaatgcactaattaattaggggtatcaaattcacattgtaactaggtcttgtcatggacttcaacccaattgtcatcaagggtcttcaactagcattttcagttaaagtaaataatctttcatggattgaacttgtctttgttcagtttgaaacgataaatatttaaactatttaaaaattaggtagtgatagttaaagacaaaattaaaataataataataatatttaaaattttaaatagacaaacaaataaaaaaaagtttttcttttagacatgagcatgtaaaaacaaaaaatcattataaatctcttagttacatattggttgtatttgagatattaaattttaaatacatattttatgcctaattattttttagtctctcaaggtctatttttttagttctccaaataaaatttaatttttttagtaccacaaattcaaaaagatgttctttttaattcctccctcaagttataaaatatattttttggtccctcgaattctagcagaaagacgtactaaaaaatcatttttcgaatataagggaataagaaatgcaagattttattttgagaactaaaaaaattagacccccctaatttgagattcaaaatgtaaataaacctatattttaatttttatatttagctcctctaagaaagatattaaactgaaataattgaaaggtgtaaatgtttataacttccatttgtctttttcgattttcaacttcaaatcttcttgttctaaagtatttaacttccactgccaagctatcaaatattcaaagttaggtttcctttaaaaaaaatggaaaagacaactaaaatactatttacgtaggtgtagtcgtataatctttttagtattgtctttttaaatttggtaaaatattttttctaaattttttaaacatatataacctaactagtcctttaaatttgtgttaggtacgagtgcgtataggactgtaaaaaatttgctaaaaaaaaggactgtaattttttttttggtagacaggtgacaggactgtaaaatttaataacaatagcagcagtttttttttttctaacatatgaatattaccacatgcactttaacattttaaagaactgaaattaaatataaatgataaaatttaaatatataatagtttcaaaataattttttatgaaaaatatagtattctaaaacaatattaacaccacactttttaatacactcttataaatatatcattaactattgactaaattaaattaatcaaaaacaaaaaaattatataaacatgactttctatttaataattcaactaataattttatactattatttagtaactttttcaaataatactaaaaatagaagaatggtgttacgacgtctaacaatagtcaataaacaatattctagtctacacttcttcttacacatacttgcaaacatgccatgaaatttttaaatgagagaaaagatataacgattaatgaaacaaaaggatgcatttttgttatcaat

SEQ ID NO: 650 - DNA, 1866 bp, Glycine max
  Soy_ogl_4489 Gm13:36535301..36537166 Cluster 2
aataaattattataacaaaataattcgaagataatagtacttgattgaaatctttaaacatacttaattacttttataagaaaaagcaattaataaaggtgaaaataaaaaaaaatagcactgtctctcaaactattcatataaaaataacgatataactaatcaatatttttctttaagaataattaatttaaactgtatatgaaaaaaataatgaagtgagtaatagtcaagaaagtgatttggagtggcaacaacctcggtttttatcatttacaatacaacaacactcttgaataactttagagatacaactacagaactactatacaagcttcttagagaaaaacttgattttttttttctacgttatcttcttttgaagataaacttgttcaaaacaaggttagaaaataatgggtatgtctcttagtaaaaaggtttaattgtaacacttttattagactcggcattttgcaatagatcttggttccaattccttcctatgagagattccttagttttgttgctgcaagtgaatatggaggcaccctaccataaaatattgatgcatcagcaagcacagagttttcactatgtttctgaagatgaacaggaatagctgcatttacaattgcaatatcatcatcccttctatgagactgtttaaattctttcacaaactcaaaagtcctattaattccaaggcaggaatactgactgctaaattcactttagagatcaaattcgtgagctgagataaataaagaaattaaatttataattaaacctaccaaaaattcaaactttcattccccacattagcttcttccacattattactacgtatttaaaataaaataataaaaatattcactaacttttaaattatacaaatgtattatttgtattaatttatgtgaattttaaaattaatgattaaataattttaaaaatatttgtaaaattttaataataaatatcaattgatcttattcttgcgtataatactttatcatctgtggggtatacagtttataggggcatttagttgacactgcatgtgtttctaggtttcaaattttgaactgcaattcgagctacaaagtgtaggattgctgtgttgaaatttattcactcagctgcattatattaaggcaagtggaatgtgattttgaagattccgaaagttgaatttattcatgctttttattttcaacatattcatgcaaattttgaacccaacagaacaagatgaatgttaacgatattcttttttataatttttccgtgatatgttaaaaattattaaactttaataaattcaagaaagaaaaatattaaataaaaaataaaatatattaaaatgaatgatttttaataaattctagatggtgaagagtaaaaaaaagtggcaacagtgcatctcataaaacaaatacgaaaaatgttggaggtggtggaatgcacgcaacggagagagcgtgggttaagttgaaggacggtacggtgggcaaacgtcacggggaatcagtgagtcctgatcattaatttataatattttaatttaattgttgaaaaaatggcgtgtgtgatttgatttggttggattgggtgaactactactgaggctagtgcctgtgcctcctactcacctcattccattcaatcaatttcaattaacctctttccttttagctccctttcatatactctatactattttcaaacaaaatacaactactgcacctatctttttattaaaagacaaatcacaattattattttaaggatatcggttaaaaaaattaaagtctaaatatttttattgaaagatgaaaaattatgttactcataatttatttt

SEQ ID NO: 651 - DNA, 1800 bp, Glycine max
  Soy_ogl_4823 Gm14:48613401..48615200 Cluster 2
ttatctcctctctgttgggagttttaaaataaaaacatttcctaccaacttcacttcttctgaatcgctttttcttcttaaaaaatcatatctacttccctctttgcccaatccataggtcatcaagagcttttattcccatgcctctttatttttctatttgttctaatctctgctcgtgtttctgtggatgacatgaaccctacggtgcgtccttttcacatgtatattgttttatacaacactttatactacacctgtgcatttgttagtactttttcatctattactctcgctcgtggcctttatgcatcgcatttgttatacatattgaaaatggggttataaatatcaatatttaaatttaaatttgtttgattactttattatgataatctgtactgaactttaataatgattttcaatatgtaaattattaaagtaaagtaaacaagcgaatccaaatttaaatagatttttatactgatgtattttacatgaaattgctaactttattttcactttgagttggttggctaaccccttaaacatcatattgttcaatggggaagttaattatttcgcaaattgcatgataacaaaagatgtttcttctagccccttgtttgtttgcttgtattcactatacaaaaattccctttagcaaaaaaacagccatcgtttttattttcttttcttttaccttcattttatgtgttttttattccatacattttatagatttggtatcgttttctgtctaccttgtagcaataaatttcaacgtagacttgatggattttatctttctattatgatcattgtgttgttatatatatattgagctgaaggcatgcccgctgttatgatcattgtgtaaattcagtcttcaaataactttttaattactcgaatttaattctttaactgtggttttggaaggattacatgttggaaaattcaacgaaactttaaagattttatataaaattatgcttttcaagaaagacaaattatgaaattgtttgattttagctaaagtatgatattttaatcgttaaacttttaagaggaagatggtttgaatggtttatatatattgtgaaaattttgagaagaaaacgagaaatcatttttttttacgggacgagaactcatgctttatggagagaaaagttggtgaaaggaataaatgaatcacattgaatattttttttgattcgtctggaagtatcacattgcaaatgcatttacatttcaacctcaagaaatttgaatatggtaagtgcaaaaaaataaaaagtacaaatcctatcaaagaaaaaacacacacagggatgtaggaaaaaaaatagggatggggggactttatcaaatggttaacaaaattagtagtggttccgttgcaattacactgaaagagaatgcacagttaaaggcaagaaatttttatagacaattataatgatgtgattgaatccatatatatcatgtgatacagtcacacctaaattttttcttgcactatatccagtctgagattttgcatattattacttgtttttcattgtcgaacatataaatactcaaacatcaataaattatagaaaagatgaaattaggaatgaaggatgaagaataccatcagaagttgacaaacttttatgaatttatgtctaaatttttaggactattttatttacaaacaatcatacacataattattttctggcaaaagatagatatatgtttcaatcttcaaaattagaataagtaattataacatttcaataataatat

SEQ ID NO: 652 - DNA, 2800 bp, Glycine max
  Soy_ogl_5031 Gm15:13008901..13011700 Cluster 2
tttcattcttacaaccatatttttaagaatcaattttattaatttttattttaacttattaaaacatagtattatttcaaaatatcattaaaacatcatcactgatggactcaactggtactgaattccttaaactggttgaaagtttgaaggttaaccttgtggtaccaataccaaggcaattgcttcccgtacctcttaattgctttctgcacctttttaagctcttttgaaaagactgttttggaatgtgaaattacgttccgaattagtctttctggtctggaaagactaatccaggatataattttacatattggattaggtgcattaagcagatacgaaggttccttaagcaattttacaaatttataaattggccttcaaggaagcagtatccgaagatgtaagcccaatgtctcaaaatttcactcagaaatgacaaatgagtagcagtaatatagaaccctctgcaacaaagttccacacatgaaattaataaagaaaataactcagtgagatcggggaaaggtttaaccccaccattcaaacgagaagagcgtgaatagacgaacagcaaaaccaataagccaaccagagataaaaaaaaaaaaaactgtatttgcaatagaagttgtaacatgtatagaggcaaaggtataaaatgaagcaagctcactactagaaaatcttgtttcaacgatggttatctaacactttcaacgacagttgacaaatcgtttttgaagcttccatcgtgaaaagtgctcaattttcacgacagatcttgaactgtgttgaaacgtattgaaacggttcttgaatcaaccctaggtcagccaaacaagcagacacttgaataatatgaatagaatgaaagtattgaattatataaattaaagaagacagaataaatgagagaacacaaaacctaggagcaagggtttggttatgagaagagatacgcatgtaacaatttgtacaatatcattttttttatctgtctctccttattacgtcatttattgcatctcaaaattttgtttctttatctttgttggatgtataaattgttgtataagtaacatttatctttggttattaaaacacgctcggagtccctactcttgcatttggattcaatgaggtttggtcatagcattgacttggggagtgcatcaaaaatgttatggctcatcaggttgaatccatggcgcttactctgctggtttgctgatgtggttcgaactctcgtgcatctggctcaagtttggagtggctgcgcagtgaatggtctcggtggatggtggttggatacatggtacataattgggtggtgtctatgggggctagcttaaaagggcctttcatggtttttgtgagaaagaagagagggtttgagagagatgctatattaaattaaattaataagcacatcgtgttaatatgctaggtttgcaaaaagtattaaatgaataatcctaaccgtatgaaaattggaatttttatgtcaaattacctcttgggtaaacacattttcaggctctatgatcccgattttaaattttcttgaatattttgatgtaagaaaataaagatactctgattttgaagagtgctatagtaatatattttgacccttttttattgttgaaagtttactaaaaattacaaaagtatgagtgaaattgattaaataaaaaagtgagaactacaaaattttataatttttttaataaattacaattaatgatagaaaatgtgttcaacataatatgttagtatattatattaatgtttttcttaaattttacaagagatgaatgaaaggatatcctataaatctaatgctggtataacgtaatgctctaagctaattaataaagtattggtacattgtgaatatatatatactagtaaacatattatttattttgacaagaattgacgataatgcatataaattagatatatacactaagcacatgtttagatatatgtactctatctatttaaaatcaaattgaaatataatgaaattttagatgaatttttacatattttagtcttagagaagttaattttgagttaaagcataacttaaggaattttcgcattaattaatagcaagttttattctatattttactgtaaatttaattttaaaataaaaacattcaaatataaattatcactttactccaaaattaattttgtaaacactttcaaacacatgaatctttgcacatgcaccacattttttgtggggttctcgttcgtccttttaaaagttatcaatgacttgcttctgtacgtacacatgccttcactgtaaagaattgccagtcttgagtacacactccttttgtttgtattttcttaaaacaaaattatttgcctcttcctctgagttgaatttctttagcttatgacatatttccaataaattatttgccttgtgaccttcagctctaaaatatttcatgatcacaatattcagatattctatccacccgtttaatttgttgaataccttctaatataagatacttaggcttttaggatgatttgcacttcagttttgcatagctggtgatgcttcatttcctttcttctgcattacacttaactatatggccttcacgaaacaccatggagatggtgccaagatcaggaacaccatgatatctgcttcagcaaaagaaggtagttttgcacaaaatacaaagttagacatgacttgaaaagaaactgccacaagcatccatgtccctgatcaactgtgctaggtctaagtaga

SEQ ID NO: 653 - DNA, 2000 bp, Glycine max
  Soy_ogl_5035 Gm15:13168301..13170300 Cluster 2
atgttgcatataacctaatagtctaacaaatgtgttgatgtttacatgagagtaagaaccaaaaaattagacaaccaatatcatattagcatagtatcaaaccgacatgtcatttatcatgttagtatatgagtgttatgtcattatttagatgttatattaataatttttgttaaaaattgaaaaagactaataatgaactaaaattgttaaatatttattatattattttttatgacatgtaaatatttgattcttgcagtaaatttaattgtttgtaaataattaattaactattatttatatgttctaatccactgtgattaattttatgcatccggttgttttccttcttttattggataaatttaatttatttacattattataatgataaattatcattaagcgcatagattaactgaaacaaaatcattccaagtaaattaccagtgatcttagagtccgagccttaggtatacaatgatgtttttatcataaaattataatgataaatttatttagtttcaatcttatgtaaatttatctaattatacataaatgagaatcttattgttttattttgtttgttttagaaattactttattttggtagattgcattcttcattattccttttgacatttacattaattagtttgaatatttcttatattattgaaattctaaattaatacaattcatatccttgacatattatattacataatttatttatttttttccatacatttttatatatttactttttaaaaaaaaattagtcagcttattataattcacattacacattttgactgttgatttatacatatataatatacgtacatattttgttgttaaaagaaacaagtcaagttaagataacactaaatcttgaaaacacttatacataattttgttaagaagttcaacctattttacacttgtgcctataaattgatgcttatttttcttaaaatatctcaacaagagtttaacattgaaattttgagttagattttagagatttagagaagagttatggtaaagaacgagatgaaaattgttggatttatgattatgatcatgattgtgtttaactttgcacaagcttatcacaatctttcatttgtgcaaattgataaaaacaatatgtctagtatattaaaatgtccttacaaatatgacctagaatgtttaccagcactcgcaactggcttggggtatacaatatgtgttacggcttgtattagaaataaatgcattaaaaagtccaccgatgatgttgtccatgattgtattgctagttgctgcctcaccaagtccaatgacatcaatattggtattgattctcttacaagttttgattcaatttaaggttttataattattctttataattgattaaatatcttttatatgcttcacaattaatttcatgtgtagatgctcgtggtcttgcaccctatgtggttgattcttgcatgcaagagtgtcagaaaaaatcataatttgttacaagaatgttcgagaaaaatgttattaggagaaattaataatattatgtatatgattgtaataagaaatcttaatcaatgagtaacatatgttctataaatcttttgtccaattattttccttcaatttttttgtgtatctttcatatcaatgaaaaaatatcgatcatcaacatatcaaaagcttaaaaaattatctttttactaactggatcaaaaatcttggtgcatatttcaggggtgaaaaaaatatatttcataggcatttcatcattacttcgttttgcgtggcaattacaaattaattcgatcaatggatgtgttagcaatgatatcttttgatcgcaagtggtgtgtgtgcatatggcatggtgcaataagtgtatgatgagattcacgttggttcctggattgtattcaatgatgggtggattattgtaaggtgttttttattagagtaatgatatataaattatcact

SEQ ID NO: 654 - DNA, 2370 bp, Glycine max
  Soy_ogl_5264 Gm16:3161701..3164070 Cluster 2
gagtttaaatgcaaggatgtgacataaaagtagacctgcataaattcacattgatgaagaagaaatgaataaaagaagagggagagagagatctagagagttaaggaagggacaaaagagaccgtgagaaccacaaaagatgtaagttttagaagagatccaaatgaagagtcaaagatgtagttgcccacttcttagacgagataagataataataccaaagcatgtgggtgtgcatgcttaatggcaagtgagatcgatcgggagacatagatcaaacatcttgttcgtgtattgggtcccttcaatttcatttatgttcagctagcattggtcattttataaaataattcatattcatgtatatatgacataaaggaaaaatctacctttcaaatcacgacattatctcaaaagtttctcatttagctccacattacgggtacaattcttggatatttgatttctgggtttgtttgctttttttatatataggctagttggtttcttgttaatttcacaatctgatcctttagtttagttgaaaaaacaaagtcatataattttaggataaacaaggatataaaagttattaaaatagtatataaatttatacaaaaaaataaaacagcatgattgtgcataaatttttttggaaaagatatattgtgcatgaatttaaaggatataattgatagaaaaatcataattattttatataaaataaaatacattcatgtacattttactattagacgtgtactttgtactttgtagtatgttaacgtcattttcttctctctgttcaccaatatatataatctgcgttcattgtcatttaacaattgttcttatgctaccccattttctttgtggtacataatattattgctgcggtaccgtcattgcttgaaaatgtagacctcacgtatctactttttcaataagcaatatccaagacctaagacttaaaacttgtcaattaattcaatcaacataaatagatgattttgaatagaataacattctggtattggttggctttccttagagagaggggaaagtatataaagaagagacaactcacgatccctttttccccatttaaattagagaagtgtcggtaataaatttttcaacacacttctcttaataaaaatcttttattaattaagatttattaaaaatcataaaatcaataaaaaaaaatcattaattaaaatatgattcccacacatttttacaattttttaaaaatttcaatcaatattaaagaatgaattttaaacctttcactttaaatttaccatacattagctcaatcctaagggttggtttgaggggtgatggcaccattaatatccaaaattaataacattggatacttattttccttttcttagctatgaaatttatgatcttctctttttttcttttaggttgatttttcttcattcacctttttcttttctctttggttaattccacgtgtaaaacacatcacctaattgctttggatttttctttttttttctctgtttgcctttttaaacatatctttgtttggagttatttgatttgctaatatggttatttcaataatggatatgcatgacaattttagtatatattgtgagcatgcagtgtggttacttttttttttcttttctccctcattttttgctatatatctctgtattatcctagattgtgtgaatgtttattcatattctgatttacaggtatattgctttcacatgaagcatttttatcatattggatagaaaatactaagaggctttgggagtatatatatgaagttcaacaaataatcttttgttgaggaacaaaaagaaaaagttgaaacacaaaaatactgctttgtttctttaacttatatttcctaatatgctatttattcagtattttatttggatttattttattatcaattcatttaatattgtttacttacatcgacaaacctttcttgattgatagattgtagatacaaaataaattgtagatacttatgacaaactttcattttatatatgtagactaatttgtaaaaatatatcaaccatagcttagactttcattttatgcaaaatgcttaggaacatttgtaaaaatatatactagactaatttgtaaatatatcaaccatagcttagactaattttttcatgtcttagaatattttgtaaaatatatcaactatacatagctccataatccggatgagacattcaagcggcttgaaaatgaaaagcatgatttttctttgtcttggtcattttcaatgtatatgtctacacaaattagttcttaaaatattaagactaatttgtatattccaattttgtg

SEQ ID NO: 655 - DNA, 2500 bp, Glycine max
  Soy_ogl_5325 Gm16:5565301..5567800 Cluster 2
aattgagttcttaagtcaagcaacgaaaccgttttaaaattaattaagctgaatatattctttaatgtctgggttatgcatgcgacttagtgcgtacctgaagagttaggggctgcataccctccattatcaatttgtagattctataccttattttaaaacctatttggggaccaaaagaagcatcattcactaagttttttcgagtcagatcctgaataacccatggtgaagaaaattatcttgcaaaagcaaagcaaatcatgaaaataaaaaaattgacttggcaaaaatgttgataccttccgctaagtaacaaaatgagatctatttcctcctctgataccttgaatactcaattaatactccatttctctagaaggttacctacaatcctagctcttgtctgtctatgtccaatacaaaaaagttagccacatggtaatggaaagagtatgtggaagaagacgggaatcataataggtacctgaggaaaatatagctaggggttcttctagctagtgtccaagcttcttcatcaagctttcaaggaatctttaaaaacaaatcaatctttagttagggactatttgtagcccctgcacaacatttttgccagcttgtataacatagtatgcagaaaaattattgttgacaccttttgggtgtagacacttgagagattgaaaaagaggagagaaaagtgattaatatgatttgatgtaatgtaacaaaaagagatatattaagaaataagaagttgagatatttgcactatttggatctccaaaaatagaaaactagtatgaaaacacaagtttatgttatagagacatactattctaggctgcaaaagctcccgtaaacctagatctcaagttcaatattaaaccaaaaatggttgggaaaacaatttaaattttcaattttaaatctaagatgttatttatttaaatttaaaatattatctttattttacaattttatttcttcttttaagattaagatataattcataaatataagttcttgagatgaaaaaaattacttaatctaaaaagagagtcaccaccttaaataagaggaaggtgatataattaatgagaagtttatcagatttgtctaacaaacttttaatgtgatttgagataacaaatgaataaatattgaaattttttgtaaaaaataaacaaaatgtcgaactacattaaatttaattatattcttttgtattttttgtttttttgatgttctttgtattctctcattattatgtgtaaagagatatttgtttctcaccataaacttaacaaacatagtgacctaaaactaagaagtcatgcttattttaagaaatgtttgttccatgcctcattgtaattcataatatatagactctcttagaatttgtttttgaggcataactcaatccaaaaaataacttatactcactatttttttaggtggagaatttatcgtctcgaatgtaaaatttatagaactatacatataagtgatctaataaccgtcccataagacataacctaataaatccaaaaaataatcattcgaataagctataaaactattttaaaatttggattttaaatataaaaattcatcccaaaagttaatttataagataagaatattgttatattactagctaaccaatatggggtcgccaaacaactcaaataacaacccctaacatttttccttatgtgtaggactgtaaaaaggtccctaggaagcacgattaactagctaggtacaaaaatcctaaaaggacttcagcaattaggatgcacaacgacgactttatagtacatattttgagctattgtccattaatttgctggaacgaaatcgtccttgtactcaaatgagtcattgcatttcaacttgtaaagatgtatttgatttatcgtttgaccatttaaattgaggttgactcttcatagaaagttatgcttccatatttggcaaatcattttttacaaattcacagtgaagttgaatgtgattttcattcaaactgagaataaatccaaaactacttttatttttctataaaatgtaaaaagttccaaacataaatcacattatatcaaacatacttttaactaaatttaagtttacaaagtagagttcaatgaaattccacttttcaactgtacacatggccatgccagaaaggtctgaaccacaatttcgtgtcataacattaagattattgggtctccataaccgcaatgtgactacaattgaaattcaaaaccttgtagcttcatatgatacacaagaaaggaatagaccaaaattgaaatgtgacaaataaaatagaaacaaatagaaaattgaaaccattgttaacaattaactataagccgagttggctccctacactgacaagaatgtttacctttactttaatttcgcacaaaaccagattgtttttgcaattggcatcatcagggaacagaactttacacttaac

SEQ ID NO: 656 - DNA, 1895 bp, Glycine max
  Soy_ogl_5815 Gm17:40312206..40314100 Cluster 2
tacagcattgctatttggtaccaactagtatatgtacgaatcacacgaacaacagcatggagggctctccttttttttcaaacaaatattagttgaaaaattaaaaacatataaaacggaatttgatagaaaacatgcaccttcatgtattttttacgaaaataccttcgtaacttttaacattttccatattattaattttgaatatttttttttatcattttgaagaatttattgtttatattactactactaatggagaaaagggactccgtgcctgaatttgacaaatgagaaaaatgagggacattataagtggtttgtagtagttagaggatacatatgtgagtccttttaaaaaaaaaagatacatatctgagagacgtgtgtagttatatttttcttttagtcgtgtgcaaacaattgaataaatgtgcaattgtcaaaaggaaaaaaaaagagtaaaaataatgtagaaaactaaattgggttatagtcattattattagtatagatacattaaattttttaaaacagtaactatctcagtatcccactattaactgttttttatttttagtttttgtgaaatcactatctactattctgctacagtcttttttgagccaactgctttgcgctactatctgatatttgaaacactgatttggattgtctgcggaaaatctcctagccattaaaatcataataattttatcataaacataattacaaaactaaaaattgaataaggagcattatataattatgtaccataaaatataattaaagcaccttgtgcagttaattttggcttgatccttttgtgtgcataaaagaaacaaccgcacaaaatgactggttgcagatgcaagaattcggtagcttcttattgcaaatttgtttttatgagatcttgttgtcctgtcctcgtgcctggaggaggtatcattgtttgttacaaagcacttttgaattgaaatagacaattcagcaaccacattgtccaaagcatatgattaccataacttaccttaaacattgtacatattttcgtaattagcagcatacctttcattatcctctttgtaattgtttttgttattgagtgaaattttatgcactcaactaagagcatgtttaataattcattgtaaaattacgtttgaaataaaaataattttaataacagatcaggatccttatttttatgttcattttacttttattcaaacatacactaactagtaaagaatagaccctggaggtggggcacgatagaattagaatttcaccaaatagtaaaatggatattataaggagaatgttaaaaatttgttactataacattctttttcattctcccctagtaattttagcttgctgtaaacataaggaggtaacacattcaaaactgatatgatgaaatctagatgagacttggattaaaaataaataaatagcaaagaaggacaacaaaattacttaccttggttttaaccattttctgacattttcaaatgaagattttgagatcgataattactctgccacgtacaactctggagaaagatttggttgcgggaacaggacggtgcatgattggaaaaactgacgaccgtattcggaccctatctgtctaaatcatctcaatttgtttttttgctcaccgttacaataaagtcaacgtacataactctatatttgactatttaatcttgcattatatggatagtgttgattaatttttttgcttcgtgttactaattgataatttaccgcagaatatcgttgtattttagaggtattccaaaagatatgagtttgatgttgtgcagatatttttattttttatatatcaacctgtgattaagacttttaaagtggtcagtaaa

SEQ ID NO: 657 - DNA, 2400 bp, Glycine max
  Soy_ogl_5905 Gm18:2599001..2601400 Cluster 2
gtttcaatatatggagcagtattgaatttagtgaaagggtaaactactttgccatagccggtaatcttgtcacgtacctgactaaagtaatccatcaagacctcagtacagctgccaagagtgtaaactactggtcaggaacaacaacccttatgttcaagactttgtgtcaattggtgagctgctagtctcatcctcactattcccatggctctcaccaccatagctttctatgcagggaggcctttttataggtacaagcagccggcaggaaacccttttaggccaattttacaggttttagttgcagcgataaggaaaagaaattttacaggctaattttaagtacttttcttaaaagtataaattaattaaaaaaatcttataattacagagaaagtattatatataatagtctgaatgttagaattcagctgagcgaggtacacgtagttgaattgagtataaatcaatataaaactttttatgttatagtataaaatatttatgaattttattaataattaatttcaaattcaagattttacttaaaatatttgagtgagactttaacacagatctaagatattcaagttaaattaaaagatacatgtacactttacggtacacaaaatattgatttgttagttattgatatgagaacattaaacgtgataagagtaattcttttttatatgtgaacgttataaaacgtgatggggaataagaatatcgattcagttattttttgaaacaaaatcaaaactttctcctagttattgtttatctagtgaaagtttttttcttgcaatataataattgttatttccttgatacatgtaaggtatctgattttgactttagggttatgtgttttaagattagatcttatatatgatacaagaatagatcactacaaataaaaaataaaaaaatacctcttgcaaatttatgaaaataatatgatttcgatttggaagaagaacatggggaatctcttgtaaatcaagacacgatattttaaattttttattcaataaagtgcaaaagtcgctatgtaattgaagttgtgaagcacaccactactccaagctgtacttgctttagtcatcctggccctttacaatttacagagccacagtgtatgcatgtgcggcctgtgattgaaatcaaaagttactccaacgtatataatttagtgtatgtgtgtggactagggttcataaataaaataaattttaaatatttttattttaattaaaaatgattttaaagtaaaatatcttatgttgtattaatacttttattggaaaaaaatacagttgaaagaaatggatttcattgcagaagtcacgtaaggtttctttggcttagaattatatattttgaaactaaaatcccgctggagaccattaactcctcagtttgaaaacgtgtacaaataagtttaaaaggaaaaaatcccgtattgtttctaactttctataacatccaagatacttcacatctttcttgaatttgttatatatacaaaatgctcgttattttaaattacacaaaattcatcatataataaatcactgaagtatctctaatattcatggagatgttaatcaacagctatttttcttatgtaaaattaatgaaagtactcatattgtattatttgttgttgtgtttttatcctcactattcaaaactaacttcatttgtttttaaagctgcggtaaatgaattattaaatacttataatctaaaacattaaataatatcgaagttgcataagagaatatacgacaaattaagttatagattcaatcttcaaaataaaaggacgtaaattattgcaattaatattcagtttaaaataataataaaaaattgaaaaactgtagtatatctaaaactatagtcagataacttaattgatttttgtcatcttacatttgtcacataatagttaaataagatgcgtcaaatattatgtgacaaaaacacaaaataacaaaaaatcgattaattatcagcataatttatttttggctaagttaaatttttgtcccttcttataatttctaatcaatatttcatcccaatttttaattctacaatttcaatctctttttttaaaaaaaaattcatattttttgttcaacagttaaacatttgtccgttgacggttaaaacctaacttttactgcaaggcgacatttattagatgatgttgcaattaataatttaagttacatctcactttcggtctccttattttttattatctgaagtcttccattgaaatttataatttcaaaaataagaaaagtggttaagtgggaatttcaactcatggctttctctttttcttgcaccatctaaataattaagtcaattaattttctt

SEQ ID NO: 658 - DNA, 1658 bp, Glycine max
  Soy_ogl_6216 Gm18:568221..56826532 Cluster 2
atttaaggactgaaaagataatttattttaattaaatatacagaaaaaaaaaacacccagcttattttataaaataagagattctcatgaatctataatttttaataaatttcaaataaaaaaagaatatgcatgttaaatagaatgtgttgctaaccttctttaaaaaaaaaaaagttattaatatatattgtcacttttgcctatcataacaacgataatataacacctaaaccgtatgtgagaatcttaaacgtgttctagtgtttggattatggaaaattacgttagttccactaccgaccaagatttctcgttgtttaattaagagtacccaaccctttgtcatgtgtttctcttctcagccacccaatccaagaggtcattgctccttgaaaaagacaaattaataatatcattttcaaatagttaataattgatttaatctccttatccattatatagatatatataaaaagagtctacactaaaattagattaatataaattctgacaagagtacaatttagtgcatcaagaaaaggaacagaaggggctctcgtgatggttttgaagagaaaaaggtgtcatcttcatggaatcacatccacaaagacccactaagggaggtgtgtgcgaccatggatgaatgcgtttgtgactcgtgagtgactgagtggaaaagaaaagtttcaacatatgtaatattatatcctccagaagcctaataaaccaaagaaagaccctaccacttagctattaatcaaacaattaaataatatagcattgggtattttaatgttgaatttaactttaatatatgcatagtgtaaatttttttatattatcatttaattatagaatgttacataatatataattattagcttatgcagatttaggtaataattattctaaaaaatattaataattagtttgtgtgtaaattctttgctaatagtgtattaaaattaaatttttaatttaaaataaaactaaatatattctaacatttttttatggacaatgaatatctttaaagaaaagtaatttgttctggacgaataaaattattatgagcaataagttatctttccaaatgcaacataaatacatacacataacaaaaatatttaaactttttacaatattaaattccaagtttaatgaaatcaaatacttgattactcttcaaagaaaaaaaaaaagtaacaactgaagttgatattaggtagaagtaaaaataagccaagcgatctaatgaaaatggttggaatgtttattttatgcttgatactaaaccaaaccgcaacacaaacactctaaatttaatccacaatattaaagttgaataagggataatcaacttttaaatattaagtaaatctaaccagactatcaaagtatttactttataatatactattttataattagactatacatatatcctcacttttactttttttgtgtgttacttatcacatttttaaaaaaaattctcttcatttctctctttttttaacctaatcccacacattacatggtggggatttagtaattttgtttgaaatatagttagcggctgaagcagaaagaggtggtgctgagaattgagattgagacgggcataggatttgtgcacccgtgaagagggt

SEQ ID NO: 659 - DNA, 1787 bp, Glycine max
  Soy_ogl_6606 Gm19:47122401..47124187 Cluster 2
aaaaatcataaaaattttaagataattattttaaaaattaaaaaagtttattatgtataattacaactaaattatagtgtaaaaaaaattacactatactccatatgtattatttattaaaaaaaaaaagcatatgatacaaacctataaagaagcatggtgtgttccttctcttcacgttccttttattctctatctttgtgcttttagattagagacgcacatggttccgttcgttagccatggaagaaaggaatatataatcaagtgcgcactcaaaatagaaacattatgtgcagtgctctaagagcaaatagcaacatattttcatgacgagaaattaataaggtgaagtgattttccgatgctgccaaaaactgaatgttggggaatctgatcaagtcgagtgattctattctagatattaaacattgtcagctcagtgcagaaagttttacaaaaaaaatatattaattatctcattatggaagataatggatataggttgacaaaaaaaaccacggtgatatagaataaattaaagaaggattatatttaagtacttcagacttcagaggaagttaaagtcataagtaacctcatattgtcgttgtaaagtaatgataaaaaataattgtcattgtaaagtaaaaaacataaatatatgaataacggttttattttatttttaaaaaaataaaacagcatcaggtccctagttaagttgagtagacgcgcgtgcctctttacattcattttgtaatttaaatagtatgtgattttctagttgaatttttaagaaaaaaattatcaatgttcgaatgaattttattatgctaaaaataataaaatacggattgttatttactttttaaatgtataccaaaaagatattctctaagcgataattaaagaccaagtttcagacgtacgtttttatacatacaatcaagtgtgcttgaaaacataactatttttgtgagttcctctcaaataaaaatgttgtgttttgtcaaaaaaattctcactgttacataaaaaaaaatctttaacaaaagatcattttatctaattttttatattttgtctttagattaaaattagcaacaaatatactgtcaataaatttgaagaactcataactaaaatttaaaaaattaaagaactcaaatattttattatatagaaaaagtagactatattttaccttatcgtccaattgtaattcattatttataataaaattattcattttaataaaaattatgttaaaaattatatcaaccatattttataaataaatgagaacataaactacaatgcatgatcatgtattttataaaccttacgtgtcaaacgtgattaaatatatagtagtatcaacgtaaatttaaaatttaactacatgaattgtcaaactataaaagacgtgagacctaaacatgacttgagtttgcagagataaaaaagatgtgacactgattcttgataaagaagcttacgcagaaatcgtgacactcagacaccaaccgcgtatcaccgttacgtgccaatttgcccaatcttttgaggcttcactgacaccattgacacacctatgattattttatttcattgttactctctttacttctttcttaaatataagacttgatttatattttttttaacaaaattgattaatataattaatcatattaaatttattaataatttatattattttgatgaaattatctttaaaattattaaaacttataatttttttctttctatttaattatttt

SEQ ID NO: 660 - DNA, 2109 bp, Glycine max
  Soy_ogl_6994 Gm20:44641201..44643309 Cluster 2
tgtaagtttatttccatttctatgttttgaatatatgttagattgttagggagtccttttgtctgtaacttacaaaatagttttatagaaatattgttttcctttaaccctaattacagcagcacgttcgcgtatttactcaaatgagaaagtcaaatgttaacaaaagaaaattcacagtattagtttcagtgcatcaatgtgacacagtaattgttgtattcagacatttaattgatgaagaatctttacacccaaggtgggtgattcgtttccgacccccgcatcagccggtaaaagtcctagttagcaataagccaattctcatgtttaattatgggttaaaaaaattgtttgaggaagaacacatttcctaaaagaaaaaaaagcattggatcaaaagctttcactctcgtttctatataggcattaatccttccactgttccactgactcccgtacatttttcttgtaaatcgatattaattaatatttccctataagggcctggagaaatggtctattaatctccgattaaggttatcgaataatatcaactcacataaaccctttccacaagataaattagttgaaaacatggagagattataattataatgataatacatcacacgtacgcctagctgtaagaaatagacatccctcttagtttggggtcgataaagttttgtctctctctctatatgttccattcttttttaaacttcccatctactaaatttaatagttattgtataagaaaaaaaatttaatagttattgtataagactcaaattaaaaatttagtaatactttctccgtctcataataattattgtataagaaaaaaatttatcttaaaataattattattttaattttttaatgtaattttaatttttcacttatatccctcataatattaattaataatatgactataaataataaaaaatgaattaatgataaaattaattttgtaaaagtaatattatctttcatccatttattagtttttcctgatttgtaaaaaaaaaatcttgagtgacaattataatggaatcaatgtttttatgaaatattttttaattaattttaagttttaaaatattactttctctattgtaaaataagtgttttcttaagttattttacccaaaaaaatctaataaatagatgaaagaaaataatagtttaacaaaattaacctctattaatattaccttgaaaaattaaagtgacacttattaaaaacattaatagcaaacaaataatgaatattacattaaaaataaaatgtgatacttgtattggaataattttttcctgaaacatgacacttattttccgggggaggaagtattattttaaaaataatcacaaacttttttttattaaaaataaaaaaggcgatggaatctttgtgtctaataagcttacctaatttctgtaaaaaaaaaaagtttacctaattacccagcttggattaatcaaatctgtataacatggctttgggttccacacaataaaaagtaaatcatgacatttaatttccctaaagaagattattaattaatttatatattattgtaattttttatgcatatattattgccaatatatctagctatatatatatgcgcatttagaatttaaatgatcacatgctacattcatgtttggtgcatattataatttacgtagaattccatccagctagctaatcaattagaatcgttcatgtgatttaagaccattttagaaaatgactataaaactagaaaaaaagacttggaatcaaatgactaccattcgtctaacatttaaatatagttaactgcaaagttgtaattttaaacaagaaaataaaaaatgaaaatgatcaaaactagttaaaataagatcttgaaattgaaagttaacgttgtttagttatgccattttatttggtcatacatatcagttttcattccaatgtaatgaaatttgaatttaatcacgattcctgtttataaaatgtgataactagagtaaagtccattatttaaatactttaacgattggctagtgatgcaattatttacagataaaaatatttaagaaattgtg

SEQ ID NO: 661 - DNA, 2000 bp, Glycine max
  Soy_ogl_719 Gm02:47507201..47509200 Cluster 2
ataataatttatgtatacgtaatcccaaatgagcaattccagattagagtgagtcacttccactatgagacaacatgagtggcctttttataaagttagaccaagcacgtgactaaaaaattgttgtcattgagtttttcttatgatgaaaaccttaataaatagttgacaatactgactttggagctctacaatattcaaaacagttatgcttgttttgttgcgtgataaagctcactggtgacaagaatttattatgcaagcatgtgagttttagtttaagaacaacttttgtgaatgctacgttaattaggagcaattaataatccactttgttgaacattttttactggcttgatttttttattcataaaaattaaaaataaatatatagagtctcatatattaacaattataatttatatattttatttaatcaattgagtgagattctccttaattattattgattatgttcgggagaattgaaaaacaaaacaatttattatggttcatgaaaaattattatatgatttgaaactattatttatttacaactatagtcaacttctgtattacgtatcgtcaaaattttaatttataagaaaaaaaaaataactcaattacatgttaggtatatggtgatctacctagaactatctaataaattttcttaattcatgaatccatttgatgtaaatttcttcttcttcttttttttttcaattaaccggggaatctcgctgtgtcatacaatctatattattcattgagaatcagcaacccgtcaccctcaccacaaaataagaaaataaataaagaattgaaaagcatttgtcttgtatcaaatgcaacggaggaagttagacattccatttccacatattaaaaaaggaacaataatttgtttaataattttgataactatgataaagaaaggacacatgtatgaaagcgagcatgaaattgtgacatgcagaatcagatccaccacaagtccacaaagaaaaaaggttatatgctcgtgaaaaaaattgttaattagatttgttcgaagtattagtattatgaatttaaattaataataggttgtatcaaattaagcattcataccaggaactaacacggacctattatatatataatttacgtatttctgttaaacaaaatttataccaatacaaaaatatttatcttatacaatatacacaaattcaaataagataaactaaatatttagtctgtattttttttaaaatccgattttatttcttaaacaaaagtttaacggatcattcaaagtccacaattcttttctattacgaaatgtttgatacaagaaaagttttttatgcctaacaatattcatttctagaaatcatgaacttgagaatcataatttttaggaataactaaatttttatttgatttgttattaatattatcatataagtacgtttcttgtgaataaaagagtaacatagtaattttatcacaaaatttaattatttactacattaaataatgagttaataagtgtaatctaatattttttattgtagtaaaacttgtttttttaattcgaaaaaaaattacattctcactttctctatgaaaagatttttatgagaaacgtaacaaaaaatatcccggtaaatattattttctgaaaatgttatttttttaaaaaaataaacgttctcaacttaaggttttgttaaaacttaaaaaagttctaatattaaatgcctccttaagatttttttttttgtcattgaccaaattttttacaattaagttctctaaactttttaaaaactcagtttttaattcctgaaaactcattaaataaatataaataatgaattcatatttttatttaagaaataaatattaaatttttaataagtttaaaaactttaactgattaatttttttttcagaaaccaaaaattttagcaaaaaaactaaagacattggtcaattaaatttttgttcaa

SEQ ID NO: 662 - DNA, 1877 bp, Glycine max
  Soy_ogl_1532 Gm05:1910824..1912700 Cluster 2
gatataaagttagatctgttgttaagggtatataaaaaaaatattgattataaatagattttttctttaatatttatagaagacttttttttaccgtgctcactctggtgtagatattctcaatttagactctctattgtctccttgaaagacatatttcacacactactcttgcaagtaaaaatttatttcttttaatcatcttctttcatctttaatcttataagaagtgtcgacggaactacattctttaacaagtctcttttaacatttttctcttattaattaaaattcatttaaaaagtataaaatcataggtgagatttattaaaaaaaaaaaaaagaacaagtcttatactattttataattttctgacaaatttaactttgggcaataataaaaaagtatggtaaaaaaatgttggtaacatttttcttaactatctatctattttaatttaaaagtaaacttatatgacacagattaaattattcattatacatataaaatacactcactcctgatgatccttaatgaggcaattcggtcaaattcacacagacaaatataataattaattcagttgattctattgatttttttaaaactatgtaccattttcattcttattaataatcatttacttattaaattattataaataatgtaaaaatatttaattctaaaaatactatgcatcaatatcaataaaaaaactaataattaaagtacttaataatgacaactagtaaaaaaaattactaattacttcatggaaattgtaaaatgtcttcctattaaaaggaaacattaattatttctaaagggtggcttatattaagaatgtgagagagtaatttatatatttaaaatatttatttattatatatttaatcatgtattttttataatagacaattacacctgaagccgactaatagtgtgtttggataatatcaagaattaatttactccttaaaatgatcgtgataccataaaaaaataaaaacaattatttattatattttatcttcactataaaaatataattaattatttttcattataattctaatccaaacacactaaaagaagaaagagattgtaggaagtggtccagtagtgttgtatctgcacttagtccttatcactttcccaaccctttgctgttatcgctttcagctcccatgctcccctagccacatcttcgaagagtccttccccgacgatttggacccatgtgttgcagttgcagaggctaaccatgggacgacactcattttcttctgctaccacggcttgatttggaagactgcatgcactgccactacttgtgatgcgcttgtcccataacaggcattatttttcatctcaaaatcaataatagaacttcatctttttccttttatttatcatttaataaggttatacttataatacatagattaaaaaacataattatttttctcatttatttgtacttttcctctgccattttttgtacttttgtaatatgtcatttctctctcatttattataattgttggctatttggtatgaacagttactcatgatttgaggaataaaaagaaagaatagaaaataagatgatttttttaaggtttttaataaataaaaaaatgttccattaaaaaaattaaaaggaaatgttgataactttttttttttgttaattttggcaagtaaaaatttataccaaataggatattaatggaatacaatacttaattatttttttctctgtttctatgtgttttccagcctttttggaagtgatgagaatgcttagctgaacaaggatgaaaacttatctgatcttttggtggagatcattcgtaagagatctaattttagt

SEQ ID NO: 663 - DNA, 2500 bp, Glycine max
  Soy_ogl_2203 Gm07:5079701..5082200 Cluster 2
ggtcccatgatcatgcagcaccgttgcgacgttgggtggccccttctctctttattgttgcttcatctcttcttattggtcttttgtatctcttcttgaaaccatcaccattgccaaattcaacccattatcacctttcattttctcccttaccgacatgctttgcctcttggaatttgcaacccattcacactattttattttcccaattttacatattaatttttatgttattaaaataattttaattgttttttaaaataaataaaattcattctctcgtcgagtgcataaatcaactcttgcatgattatttcatttacactaaaagttttgagtttgactttatcgttcatcatgataaagagatgattttattatttattatgattttattcaactcaaataaaattgtaggtgaaagatatatgttatttagataaaaaattatctctttattttttaaaccacgtgtaataaaccacatgtaataaaagtttttatatatggttattgcttgttttgtcttcgcttgtccaagtatgatatttgcgatgttagatgtttataagcttaacaacaagttcgcactatcgcattgcttaattatgatacttcatccaacaattaagtgtatgcttaattagtttttttagttgagtaagaggttaacgtacgtttgttaaaaaacaattaattattactttttatttaaacaattgaaaattcgcattaacaaaaaccaagttcactttaaaaagaatggtgcgtgttttgttcacaaagttaaactaggagaaaattcaactatacattaattatatatctaagataattttttaattggcactttactgccattgtaaaatggcactgattcttattttgctacaaatttttattgtgttgcaatgatactgttctgcatttgattattattaagtgtatcacatataagaatgttcaccatttcagaggttaattcttcaccaaaagaactccattggtatatgttaaaataaaaatactgttctgcacagaaaatttaaaatgaatgcttcaatataaagtatgtttacaagtcatgtcattatattatactccaacaattagcaatctttgtcaatctattaagtcaactctaaaattaaaatacatcaaattcaaaatgacctttctaccatccacccgacgacctacccatgtgtcttgttcttttctctgcattaattcttcatcttcatctccttttatttattgatttttggaacaaactctcatttccattattttaaagatatatcggcatcattagtttaggtggggaaaaaaactgtaattatttcagtttcactataatttaaagtgttagtatttggttaagaacttttttttaaggaatcgtgttaagaacttgtcacttaacaaatacatgcatatccatcatatccatcagcaaaagaaaatgtcatacattaaaggcataaaagatattaaatattaaaattattattttttatatataaaacttacttcatggaaattaaattagcatataaatagtataaaattacatttacagtatgatatgttaaattaaaagtataatctgcaaataatatattaatttaatttcgtatatttacagaattgactttgaatgtgatgtatagtaataacaatagtaataataatcgttaagtttaagtggtatcccaaacaaaatttattaaatggcttaccaaacatttttattttaattaaaaattataaaataattaaataagttataacctaattaaattgatttatcaagtatacttttaaaggacaaaaacaaaatttaattatatatatatatatattttttttttctttcataaacatgtctttttttgcaacaatttccatgtcttttttgttcaataaatacttacatatagatttatagattatccaccaacaaactcatatccttcccaatccccttaaaatgctattaagttatttcaaatcaattacagtattatattttagttaggagaatggatcaaaatattttatttaggagtctcgtaagtcaaaagccacgaaagaagcttataccgattctttgaatagaaaaaaccttttcaattttggcgggtcttcaaggtttttttcccattatattgaaggaggaaaagggtggatacttcaatatagtactataattacgacagaatgtgattgatttgattgtcagatttattgcattataagatcttaaacaaaaaaacaacaacttgtcggcaggaaagattaatgtttttttggtaacaatattaataaaaatgagtaaaatgatcatttttaattatttcggaaaaaggaaaactataagccatttccaaaattaaagttcaaaattgattttaaaattattttttcaattaatttccagaatttaatttttgaaagaatattcaacatattttaaaataaaattttggtaccactg

SEQ ID NO: 664 - DNA, 2299 bp, Glycine max
  Soy_ogl_2429 Gm07:38567401..38569699 Cluster 2
gtatattagcattaatcttattattaccaagtttatacaatttatataagcttttttttagaggaatttagataagctgttgacgaattattattgcgagtataattaacacaaatgtgtacgacaaaaatctaaaagttattatcgtgtagagaagttatgtaattttttttattaatcctatataataagttatcgcataagcaatcctaaatatcataaacattaatcctaaatattttctgtgccttaacgacgcgaatttctgtctgggagttcctgatatgatatgtgaagcaatcccaccaatcaccatgcaacaacaatagtcatactgccttcacaccacgtgaaaagatcccacgaatctgcaggcctcagttcatgttcatattacttttccacttttttgtacactgacaaattacatgctcgtgatcttcatctagctttgctattttagccagttcatcttttagcaggttcgcatattctcgacatatcatatgtttatgggcaccacatgatcatggaaaaaaaatccgtacaaaatagaagtgtgataactttgaaaatgaattaaaaattattttaagcaaaattccatgctcgatcgaacttgtatacgacaaaaaaaattgagagaggaaattccaataattaatctgatcttttttactgaaatttatcatatataaaattagaattagaagatattttgcacataatataatacggtaacaaaagaaaatctcaatcagtagtgtttgagtctattatatatgtatgtattgcgctattttgtaattaaaataatttatggtttttttaatccaaaataaaataagttataattaatttattcctaatttgtaatgacaaaattcttaaaagtcaaacaaaaccaaacattattaaattcattgctttgatgatatatagtttgcaacacaaccgacatttagttcagttttgggtggcctttagtggtaagttttttaaaaaaattagaaaacaacaaccagtttttatagtttttaaatttaatattataatcattataaaccttttcataacaataataaattgaacattacttgatattcaatactattttttaacaatatatccttttctaacatatgatgtaaaactaaaatagacaccttgattacaaagtaaaagaaatgtaataaattatttaatatttattattaattaatgcaaaaaaaatcacatactaattacaaaattattatagaaaagtaatagatcacatactataatcattaaaaattgaaaataatactagctatataatgctaaacatctattaaataaaattaatataattataatgcgtaatttagtttgattttttaacaagaatggaaatccaaaccaaattacaaaaagtatgtgctttttgagattttggcttatgcaattttctatttagtcgatttttaattttttggatccatttgataatttataaatggtttgatttagttctaagcaccgtagtaaaatatagggagagtattttttaaaaaactaaaatcaaattcaaatatcatttttttttaaaatgaacgtaaatatgctttaaattcagttaaaaattatttaaagttcatttttattaaacacaatttatttgaaaattacatttcaaaaccaaaataaagaaagtcagccaccaccctaaacgggcacttctatcaagcaaatcgaaacactggagttccaactataacaaactttgtttttgagatgcagataatgaattttgccttttttgagcaacatatttaacggactcaactaatggccaattatagcaaactttgttagtctagatcagttgccacgttagggagagctttagttaaatactactcttaattgcagggttaattgcataactgtactataggataccttcaatgacaaaagataattacataaaaataatgtttattctttaaaaaaaaaatatttaaattattattaatttggtctctgaagaagaaaagggaaaattaagggatgaaaaaactcgataccattttgtttttgcttggagggacataacacaaaagacttcacactttagaagttacagagttaagttagaattcaataattgctgctccttttttcatcataacattagtgtcaatatctactaaatttgataataactaatttttgtcaaaaaaatccatctaattattttttaattatattttttttatttataagctacagatcaaaaatctcatttaaggagatc

SEQ ID NO: 665 - DNA, 1372 bp, Glycine max
  Soy_ogl_5477 Gm17:3449406..3450777 Cluster 2
taaggaaaaataagtagctaagcttgagggaaagaaagagcataattaagaaaaagtagaattgaaagtataaatagttgtgatttgagacgaagaaaaataaattttaacataaaaaaattaaattaatttaaaattggaaggaaaaaagagaggaaattcttaatataaaagtgaaatttaaaaatagttaacaatttcataatttaaaaattaaaaaaatatgtgtgttaaataatgatgaaactatctttcaataaaaagtatatttaatagaaaatatgccaacatttaaaaataaaaatccatatttataatatagtaattgatgtttattatctacatatatatgccagacacaatgattttttttttccaaatttagaatgccttaacacaacacaatacattgtgtagtgtttttatttccctttcatgttgcagtaaaaaaaatttccttcatgtccttgacaattcatgaaacttttccagttgtacataaattcaattcaaatccaaccaacttaatttggttctaacaaaaaaaaatataatgcaagttttgtttaagagaaaagtcaattaatgctggttagtttggatattcaaattaaattagattgtaaaaagcacgactcgagcacggagcatttgtctcacaccctatttatttattcgcaagattacggaattgaaattttttatcacacatttattacgaggtattaaaataattatcgatgggtatattatatttatgaaaaagctattattgcatattcaatcaatatttatttcctaagcatgaggctggaaaagtttattcccatttcacgaaaaatcattttcgtgagttaaaatgcagatgcacctttcctattataccccactatactctcatttacgttaacaaaacactttttttaaaaatatatcaaagaataacattttcatgttataatctcaaaaataaataatccttaaaacaaacgtctactaattattgatgatccactctcaatcttaatgaaattatgtcctttgatcttttaattttacaattaaataattcatatactttttttaacggtcattcaattattaaccctgatatattgtaaatttatttatttttataataattattttaaaatatatattaacgataatttttcattggcttgataatgtaatttttattattattgatagacatgaaattaaactaattttttttttattttttaataatatatatttaaatatatgtgtgatatttttttatactttttataagtactttcttttaaaatataaaaaaaatgaaattttacactaatccaggaacttaatccagtttgacctaaaaaag

SEQ ID NO: 666 - DNA, 1861 bp, Glycine max
  Soy_ogl_5873 Gm18:1754740..1756600 Cluster 2
gcatgcgcgcgcatgagttaattgaagtgggattaatataacttaattagtgacctcgattctagatcataaatatgcaggtatattaaatattagaataaaaaaattgttgtttataataattgtatatatgtcgctagcaagattgctttttttaaaaaaatgcatgtaatttgctatttcaaaaatttaaaaatgacatgtgatcaatatacattattttttaaaataaaaaaacttctttttattaatgattaaattgtctaaaattatgattatacatttattatttgtatacttttattgactatgttttatggttttatgtgttaagctttggtgtatataattaaaatgagtttaatatttatgtattaatagtataaaatttatcatcattgatgaatggtgaaattttgaattatgattaaataattatataaaaaaatttacatgatgaatgaataactttttttttctcaattaaaattatgatcctttgtcgatatgttttactgtgtcgaccttttttttcgggggagaggggaccagtaggagaagtagtatttagtaaaagaagggagagagaagttgacttatcctttaattagtttagagaaaattagacgagaaggaaaaaaaataggcgaaagtcactttttctttctatctctaccaagaatgttgatgaaaaagtggggagcagaattttaaatttttattttcatatttatccttctccacatttttgttttcttccatttttttataaaatgatttattttagggcatagttaacttttcaatttttttcatttctattcgatcaaataaatagaaaaataattttacttttctttcttttaacctttttcatatttctctcataacgaacaacttattaatttacctcttttcccaccactttttgtctatccaaattctatctttgaattttcttccttttcattttgtttctcaaaccaaataaagaagatcgagtttggataaatcataaagttatatacctataaatagaagaacattaaatgatcaaaggacataaaattaattaattaaattttgacataatttaaaataaatttataaatctcaatttttttctataaatcatttaacttttttataaatacttataaacttaataaaaattaatatttttgtatatataaaattcttaacattgtaaatttataattaaaaaatctataagtgaaaagctaaaaaagagttgggcctagctaggcattataattaagataacgatttaactaataattcattcgataagagttgcttttgttatatataggtgcttttaaataagtttacattgatagattaaggtaacaaaaatgacttttggtatcgactcatataatttatttactttattttaatatcttttatatacaatttatcagaataattacacggtttttaaaatgaaataagctcaaataaattttctagaaggcttttacagacatcgatccccaagtatgtgtttggctttacatttgaaaaattccaaactatgattattggcaaatttgttttttgtacgaaacgtttgtttaaataatgatctggagattacaatgaaacactaaacatattataatttgataaattattaggtgacgtaagcagagttagatttcagttctgtatgctcctcacatgcctctaatatctcaattgtttcttatatataaattgtaagaggctgacacagaagattttctgatcagtcatcaaataattgaactctaaatatattgctcgttatcatatatgtaaaattttatcttgcctatgcttgttaattttgtactct

SEQ ID NO: 667 - DNA, 2700 bp, Glycine max
  Soy_ogl_6251 Gm18:58656601..58659300 Cluster 2
aaaatgaaaaaagaaaagtgaatctttatgcatcaactaaaatcttttttatgatacaatgaactgcatgccaatacaacgcctgaatcatgatcgatagtgatcacattcacttttacagggatgagtttaatttacaaggatggggcaaaagggtattcaaatgtacaagaaaaatcgcatgggataagagtgtgtcgtttatgcattgatgaagaaatcattaggtgctttcactttttcaatgctaagcgtatctatggaactgatgagagagacccacattagcatcatttgcaatcacaatgtcacatagatttttgtgcaagtgatgatgatggtggtggaaggatggggcacgtaatgggtatcattagccatggccccaccatcttttctgctttagctgggcctacaacaaagcttaccaatagaaaattgattgcaaacgctttgaagtaaggtgcaaatatatgttagtccttgttgctctcttattctataaattaattcatgaaaaaaattgttttgaatcttcttcacatgttttcctgctcccatgtgcctgtacctgcaattaatttttcctctcacattctttcttctttaagctgtgtttgatttaagataagaaggaaggaattggacaacaattttatacttttttatataagtctcacatcttttataattataatcttatttcaaaaaaaaaatctttttattttcattctttctagtttcttcctctaaactaaatatactctttgttttgtaaagtagaataatttataacataattatattcaaattaaacacttacccacatgacagtatatcgtcaagaacaataagttctagggctctaccatccatgcacaaccttttctccaatacataaaaaaattatatataactaattatttggtgcttaattttgtaatagtggtgtatgtgtttgaacgagcttaattacattttatttagacttattttataatataagtacttctatttaagaaaacctatgaaaaaaatactacctgtatgttatgtttataaattattcttagcattttcaataaaccatccaagattacttacgaaaacaacttacaatttctatgaataatgaaacagtttaaccatatttttctctttgattatataataaataacttcttatacataagtgcttatatgataagtacttattaaataatcacttcattaaaatattaacccaattggaacctagatatatagagatgaaaatagaataccacatagagtaattcttctcctgttatctttttcatgagattttttggttaaattttacacttgtatccactaaattttaattaaatgttaaccaaggtagaccacatatttttaggcttaaaaataacttcaaattgggcgagaattcatatattaagaaataatctatatatttagttaaaattaacaattaattggtttttatgtgagagaaagtaacagaaaaattagggctcttgcaaaagaaaataaaactattttttcctccagcaaggttcgaacttcattcactatgaaagaacacactttaattatcactataatttataataaaaaatgtataaatattataataagtaatattaataagttcaattattttaaaactcataagccattggattcctttccattctttctggccttgtcgccatcattggtccctagcctccttcgccacaggtgtttgagcatttggacaaacaatatgcttgatagacgatcttgtgatactatatgataaataacataattcatcaatctttaataaatgccatgctataattttcatttgattattgaatattgattttcaagactatcatatcctttgttaaaagaaaatagttctgactgttgaaaaagtatcaacatattttattaactcctcaccaaataattccttcttcgcatagtcttagaaaatatcttcataacattatttctcccattaaaatatagagaacatggattggggaagaggcaaggttctcaaagcataaattagaatggttgcattcttacattagaaaatacaatgatggtcctgaaaattttacatttatgtacttgactaaaagtaatacttgctaattaaacccttgtcattttgtttgaaagattatagctatatttgtaattagaaaaacatgatgagcaatcaagcaatcaaatagaatttgtgcagattaaaatgtgatattgttaatttcatacaggactattttgaaacgttggtttcttattaggactaaaatgtagtatttattttatatagaaacaatatataatgttaacttcatgtatggactaaaacataagaatagtttaatgaatcatatgccacatcaaacattcacaaatatcaatacttgtttaacattgttgtaacatatccaaatctgtaagataaaaaaatataatataaaattttcttagaaattaaaagttaaaattttcaatatagggactaatttataaataaatattaaatatatgaactaaatgatgaattttacttatgtagaaagtttgaaaaataatgctaagatgtgtgtcctgtttattgaacgaggaacagagacagttattgatttatgggtgtttttcctgcatagtataaaaatttacaagcac

SEQ ID NO: 668 - DNA, 1960 bp, Glycine max
  Soy_ogl_223 Gm01:49282441..49284400 Cluster 2
cttattatcctttctaaataaattatgatttttttattattttatacttttcaagttatttttaatttttaactatcaactaatttttcaattctttttaattttcaattatcaactaattttcggttaattccttcaaacatattattagttttcatcacaggaaaaacaaagtggttataactttatgtctttgtccaaatttcttttacacctaagacaatcctttctgtgtggatggcataaggagagctaagatcaagatggctttgaacttgtcgcatgctaggaagttgcggattgggacccctgcatatatttattttttatcagaaaaaagacacccaaatgacaatataattgctgggtcatgtggctaaaaccattgaggaaagaagcataattcattgtacagttgcatttatttaaagaatagataatatattaagtgtaatattttttacttctacaataactatttcatatgtatggtatatttgtatgaatgtatcctaattttatatgtatggcatatttatatttatatgaatgtattataattagctttaaaattattttaggaattacttttatgatttgcattgtaaattctttttatattgaaaatgcatgtctattaaacttgtatttcaatattagaaaaacaaaattaattgaaacgaaatgatagcataaatatcctattaatattagtacccaaaactctacctaggattcagattttcttatcactgaaaatactgtagagatgcaacgacaagaataggtaaaagattttttttatttttgtataatatgttatagataattggttttaatgttctaaaatcattattataatttgtaaatgtactttactggttgcccaccgacaggcttaggacatccttgtatcccattactaatgttatatcacttctataccctctctaaagtggttatggtcatcaaggaaaatctgttacaagacacccataatatcaaattgatgggaagttaagtgcaaggatgactgttactaggttggggaggaggatccatgaataagaacctctaagacagagttgagaagacaaattatgattctctcaattgaatgttcttaggttaaatcttgttaatcatgtgtaagacttaattacaagacaagtaccatagcaaatgtagaacagaatagattgaatctcggtttgtgagtcgtttagtcaaagacattccttagcttccatcattctctgaactattatccactttctactataaacaagatatttttttctaaaaactcaagcaaagataagtaaataaatcacatggttagtttcaaaacattacgttgtttttagtgttaacattgcgtttacggcagggcacaacgaaaaagtggtagaggtttaaatgccttcaaaagttgttctcttgtaattgagtgattcaagttggtgcttcgcgttaagaaattgcacattgaatttttctttttacgaaaaaaaaaactgtaaaaaaatttcaacctgagaaccgtaattatcgtccattaacatgggtggacctttacaaagcatgtcatcgtccattgacaattggacatcaatggagctgtcgttttatgattttccaattttccttgtcgtggccatttggttgatatcacaaaggaattcactgaccttttgaactgttataattagcccatgagatggtgtagtgcctaaaccattatgtaggtagaataatcgacaagaaaggaaaattcctgaagcatcattggaaatcaatgtccttttttattggcccctcctcgtcctatatagggcaatcactcacaattttttttcttctttgaagggaatcaatcacaaagttgaaacaaaacagatgcataaatttcggcaatagactatattcaacaaaaacaaaatccttaaaatacaaaatt

SEQ ID NO: 669 - DNA, 1800 bp, Glycine max
  Soy_ogl_1489 Gm04:48401801..48403600 Cluster 2
caacaattcaaatttcaaagtctcaaactagtgtccttttctaaaattaaaaaaagaaaaaagaaaaaaaagatacggacatagaattcaattttttttttacgatttgaggtagtttttggttcccttaattgtcaacaacgtaacgcgtaaacagaatctaattcttgtgaagctcatagagaaaaatgaagcatttgagggtccccatacatacaatacagcatgcattgtctttgttcgctttgtctttttgcaaactgaaaaaatggctttgtaattgttttcctttgctagaaagctttgaacatgaattgtttgaccgtttctcaaacatttattggggacccaatttcagggttagggttttagttgtaacaacagcaactttagcaactaattaacagtaacttttacaagtaatttatcaaacaatattaattcaaccaactagtttataatttcagtttttcaacttctaatttataaggttataattaattcaattaagtttttcatcataactttaaacactcaattaattttttttattgtttttctctatctctttttgttatatcacattatatattatgtttatcacttttttttcttgaaagttgttagtcgaaagttgagttaaggttgttaaattaatttattgaatttaatgtattatagcaaatttgatataataacaataaataggctttaataaaaaaaattatctgatttattttctgagaaaatctaatctgtcccaagcctgatgtaacttaagtcctaatccttgttgagcaacttgacttattttcatcctttgtcaagagcaaagaacacagagaaagttttggattaagaaattgataatattccctctcattcaagccaaatctacagagagaagtgcatgcaatttggtccaagtgatttaagctgatgaagggctcaatgtggggatataatttctattttatttaattatgtaatattgtgaatatttttacacttttaattacttaaaaaaatatgttatatatgaattttaaagtaactattacacgaaataataattttcaatcttatgttcattcatggtttgatagaataattatatatatatatatatacgcacattatatttcgattaaatttaagaaatgtactcttttccaattattataattgttgttactaatttactatgcatcagataagagaaaaaaaagtaagaaaaaaaaagtagagaaacattgcttggataattgtaaattttaggcaaaactacaaatctaaaatatattgatgggccataattgaagaggatgaccaaaaaacgtgtataaattgagaaaattaattacctttgtacgaaaagtcatccaaaggaaaagttatgtacctttgtttcattttattgggctttggagccatgataaaaaacgtagcctagcagcacctatgcttctttttcgagtactcggatgccctactacaaacactgtcgaccaataaaagaacgaatcgatttttctttttagtttaatttcatagcaaaacattagacaaattttaaggtggaacacggaatatttgcaccaccaatagtttatttgttctcatccgtcgttgatatatctttttaaataataaatgttttaaatcaactaaaaaaacttttaaaaattaataatcaatccttgaattattttttgtttgatataagacttgtttgctggttaaaatattaaaggataggagacaatataagagtatgataagaatataatataaaaaaaa

SEQ ID NO: 670 - DNA, 1535 bp, Glycine max
  Soy_ogl_1562 Gm05:2930101..2931635 Cluster 2
aaaattatttttatgttataaaagataaaattctaagtattattcaaacaattcgatcttaattttaacaaattaatcatttatgttcaaaataaaaaaatcattgttgctcaaaccccaaaagggttggcaaatttgactttaaacattgcaacagtattttagtcacaaatttcattgacggtttcgtcactattagttgaacccataagaatgctttttttccctttctttatgatgttgcatatataagcaataaagtgtgattgtgaagcttagacggggaagaagggtccacccatgcccacaaatactaaagcaagtcaagagaccgaaatttttggttggtaactgctcccaacaagtgccgtgtgggtgatctaataaatgttatatttaaagtctctcgatcactatcagatttatcataaggaaatgcatacattatcctgtgagatttattcaaattgttcgtgtttaatatttctattaaataacgttgagttagaatttactatataaaaaaattgttataaaagtgttaacggttaaagtttgaaaatgttttgtcaacaaatatagtcacataaatatttgaggaatgaaataagtattatctttggtgggtttttttttaatctttcataggtcttttatcatgagttattgtgtattttttttattaatattgaagattgaccatgagaataaattaagtagagaaagaaagtaagtaaagtacgcaaataaaagatgttgaaaattaaaagagtaacaaattttgaaaagaaattgagattgaaaggaaatcaagatttaaaaaaaagtgtaacaaatataaaagaaaatgataaagttactctaccgatcaaaatgctgaaattgaaatgattggaaaaattgtaataacatgtggatccgtgatcatggacataacagtatatatgtgagtgtttataagtttcaatccttacatagtacaagtctcatatttatcgacaaagatatttagtttttcataactgcagtaaacttcttcaaaatctttatcattgataattttgatcttgaatctttgttattgatcatttttatctttaatctctgctgttaataattattttttatcttgatactctaaatctttagttttcgaagattataatattattttaaaacattatttcgataatcagtcaaaataatatgagcattaacaaagagttaatctcattataatgtgaatatttctgtcatgaaaaagattactcctacgaaagaaattcttatttggaagaattcttctgacatcttcatcccgggaaggatacatgcactctgataaacacacgagaaaaggaaatgttttttatttggaagaatttcttgtctgcatttagtgtacccaaactggcgtaaatctgagtcaaatatttttaacaagaataaataatgcatatactgatgttgtaaaaggttttatattattattcagttaaaaattatcatatatatatatatatagtaagattatt

SEQ ID NO: 671 - DNA, 1602 bp, Glycine max
  Soy_ogl_1903 Gm06:11489501..11491102 Cluster 2
tgaccacttgagttacgttgtgtgaatttacaataagattgctatagtattcatttgaaaaggtttgtgaaagtatatttaagtgaacgtatagaggtgaaaatacattaaaaaactttcaaaagttgataatattgaattcaaaacttagagaaataagaatatgaactcaagaggtcaggataatcacctaaagaaccaaaagtactcggtacagacttacataagtgaccataccgaattcaaaaacacttcacagaagtctgagagaattctataataacttaataagcctctgaactatttaactattttaattaggtacctaaatgattttcttttttcaattgaattcctagtatttattttttaattacgttcatctggttaattttttgtcaacaaaactaatataatagttaaacaaaaggactcaaatgaaaaacaaataaaaaaaaattcaagaacttaattaaaaaatatttaaagatctaattaaaaattctcaaatattcaaaacttacgcaataatttaatcttaacttaattaaatacatttttttaatagatactagaatattcattgttacgaagagacttaattatgatttttaattttaaccaaatttttgtgattttcaataaatcgtgaataagttggtgagtagtttttgcatttttaaaacatgaagatatcaaattgcttaactttaaatgggtatttttgaaaaaaaaaatcctttctaatatttataaaaaattagaatattttaatttattaataattgattcgtttaattagttttttaaatgatttgattataaaattattgcaattagcttaatgtgtgaatactgctttcattttgtatttttagttatgaaatatttttaggattaacgatatctttggttcctgaactttttgagattttcatttttagtttttaaacaaaattttgatcactcttcatttttaacatttttatcggttaacatgtttaatccttcatcaagttttgatgaactcatttaaaagtattaaattatttctgactattaaaagccgtcaaaaattacccctagttataaaaccactcctgcatctgcattgttataaacacatagtgaaactaattgataaaatagaagaacttttgaacaaagttagatctatcaatgaggtgcgtaaagcaacattgaaggaacaagtatttttaatacctttacatgtaataaaatatttgaaaatgataaatatttattgagagcattatcttttttgttgagaacgaaaagaaatagcaagacaaaagaaataagaattgaactacaatcgcaaaatcagccgaatgcaacaagccaacaacattctatgatcttaacaaaaattactcaaattagtgtaactaatgattctatatcattttcatttagattaattgagaatgatgaacctagctacacaattaacccaaagtgaaacgcgactttgaaggttcttcgtctgccactggcgctgcacgacgatcacagaaccaacagtactcgaaaacgcagttgttgaggtgcaggtgggagaactatgatttgatattgggg

SEQ ID NO: 672 - DNA, 2285 bp, Glycine max
  Soy_ogl_2921 Gm09:867916..870200 Cluster 2
aaaatcatctcataattaaatttgatagatcaattttaattttttttataacattataaataaatttatattttcaaaatctcagtaagaatattttgagtataagttttcaaatagaaaatgttaattcaaacttgttcagacaataaatttgcttatcaaattgaaattttaaggattaatagtgtttttaattctgtttttttttaaattgactttcatctctttttaaaacaaatcgtttttgtctctccatttttcaaaaaatatccaagctttaatccttaaagtcaacatcttccccttatactgagactaaagttagtgtattttaaaaaatatagactaaaaccaaaattcaaaaaatttcaaggactaaaaataccattaacccacattttgaagtattgtgaataatttaaaataactagtaataaatatatctttatttctctcaagttttcttttatatcctttttaatgaaatttgtaattagttaaggaagactattaaatattttagagttctttttttttagataatatttttgagttcttaaaagtgttagatttattagaaacatatatagcactaacattccaaaataagagatgagctatactcaatttttcccagcagagtccatttgccagccatcagccatgactcatgaggatttgcattttggtgggatagatcaattttagatacaagtgacgctgctagattctgaatgaatactccaaaggtttgtgttcttatttttaaacacacgttctatgactataatgcatcctacttctactactacactgtgtgattccaacgggcctttgaaaaacaatggattcctaaaaatctccaatcaattctcataattttttgctcccactatcttcacgattagattcgtaatttgaagagaaataaaatctctatttgttttatttctgtctcaggaattgggcccaaactgtaactgttctttatgggttgcagattctgttctgcattagtgatgtagctgtcatgttggactttttgttattcttctacccgcaggaaattgctaaggattaaggaacacaaggtatatataggtgtatttctttaataagctttatttatggcctataaataaattaaaattttgatttaggatatagaaccatttgatgctgaataaagaatttgtaattgatgtgatttttttttatacaaaatgatataatctttttctgtaaaaagaaactattgtccttttaatgaacataacaaaaataaacagtttcatgggaacaaatgtttttttttttctgactcatgggaacaagggtagtatataaagaaataaacgatatgaattagtttagcaataataaaaacctcgtggattaattttacatctagtttcctattaatattccatgtgcaattttggtcgccctaacaatgatgtgaactgaatctgataagtggggaggttatatgatttagaaaataataataataaagagtggcagaaacagaagttaaactcaaagcttacaaggaccaatttttttttttagagaaacaaacttataaattataatgactgaaaataaaataaaaatgaattataacttccttcatatttatctttaattcttgtggataaaacacaaatttacatgaactaaattcatatttaagtgtttaatttaaaatagtacacggcactgcctatttttacttgtaacccttgataggtgaagtgtcggtgagatataaaaacaagcgcagaggagaacacgggagggattggttttgaacacggttggtacgaccatatagagtgtacggaaataatttctttttacagaatcgtaaggtctattttcctaactcactattgatgtgaaagtgaactagattgccaaaatttagaataaaaatcaataaactcatcaacaagttcaattttatacttattttttaattataattggattcgggaaggataaaaggaagagcaagaacaaatagagagcatgcaacactgtgaaaaccaagagcagagcactattttaaaattcttctcaggtcaatagcacatgcacagaccaaggtaatctttaacattgacctccattttttggttgcacgggtgaaccaatgtgctgtttaatgagatggttatctagggtaacttgtttagaaggaataataagattgtacattcatttttattataatcgattctctcaaggataactagggaatggtgattctttgatcaaag

SEQ ID NO: 673 - DNA, 1800 bp, Glycine max
  Soy_ogl_3221 Gm09:40226001..40227800 Cluster 2
actagcaagtagcatgtgtgtgcccctgcgttctgcggagtcaaattatgtatgattaattcttttaaacgatatattgagttacttatataatcaattcataaaatttcttaataatacacatgaaaataaaaaaggatgagcatgaagaaaatataatacttattaatatcatggacactatataaaattatataaaatgtatgtctaatatttcaagtaacaaattaaatgtataaatggaatatatttatttgcaaatggtaactattttgactgtgaataagaatcaattttattcatataatttaaatattaatatttttttatagaaacattccatccttatatatctattcatttaatatgatttagatattaataagctttcacttaaagtttttattcatttttttatcaaaagttttgatttatttatttaaaatgtataagattgatttgaaaataaaggataaaaggtggaaaataaatgatgaatttaaatcccttcattaataaaaagtgaaaatgaacatttattaataaaaataattaagaatcaacatacttgttactgggtattgtttatacaatttttgaaaaaaatcatctatacttttgagctggatgaatgacgcttctcgtaaaggagattcactgtacatccgtcatatagcaaaggattcctgtcgtgtctgacaattatttatctattttccacaaactttttggatttaaaagaaaaaagggactgtacattcgtcaatctgtgtgcgtatgtatgtctgtcgcatccggtgacacggaatcctcagcccaaaaacacgtttaatgaaaaagtgaagtcgtacgaaggagagacaaccatgatccaagatccacgcatatttatccagaatcaactaaatgccgccaaaacccaagtttcattgcaacttgaactaccccaatccaccgtggacactttcacatgtaatatgggtcagtgagcacatgagatgttctgcctcattgtggccccgagtcacacaataccctgccttattccttatggcctgtacctatgtccctgcatctaccttctctattctattctctaataaatatttttatttgaattagataagattataataaatgataaatttttcttttttactaaaataattcttagttgattctgattcgggagtttgatttgatttaacatgaagttaaacgatgggagaccttcaaatgaaaaaattgaacaccccctaagtctcttgcatcttcccgttgcctttccttcaccagatccctagatcgatagttaccattcactggggactcgctgccaccctctgtctcctgccccattggccataccatgatgcttgtgttgtgtgtagtagtaaaagtgttggattgttcagcgtgaggaacgagtctagcattagataaaaatgaataagttcactagtgtatatatgacaaaaatccatacacttaatattcttaaagagttggatgtaatatgatagctcatatgttttttgtcacttggcctggtattaaatatcccccccttttctgttttagactctcttcttatgtcaccatccaataataatggttgaaagttatacaacattttccatgttgtagtgttccattcacttatgcaattcttgcttgatccgtctcccaatctaataatttacttatgtagcttttgtttgacctaatattattaaagatcatctctctaatgttttagacttttctcgtctatgtaaaaaaaaaagcttttacttttcc

SEQ ID NO: 674 - DNA, 1606 bp, Glycine max
  Soy_ogl_4689 Gm14:5672301..5673906 Cluster 2
ttttcttccaacattcttgtttttttggagcttttaagccatcctctcaacccttttaatgttttgtactgaatttgcaaatggctctagcctttaaggcttacaggcttaaactttttttttatatttgatttccttaattgtttattgttttgaataggcaaacaatgactactttctttctattttggacatgatgatatgttgttatgcaacttttgtcgggaactgttatgaattatgaactctgaatgtgtttaactttaggtattttctttattttacagtatatatatatatacacttagggatccaaatagcagtcattccgccacctattttgctatatgctattaactactatggaacaagctcacttattatcagattctccttttcctccaattttgggataaatctttataaaacctgtcatatgaaatcacggactgactagaggggggcgtgcaaggggccctctcctccctctctcttagaacttttcatatatatttttttagttagttagtataaaattgtgatgaaattgattgtgtatattattattataatagttaaggttaattagttagtgtaaaattgtgtagaactagttgtgtactgtagtgattaaaaaaatgaatttcaattttatgtgtaaaaatagtaaatattttaaaaaaatattatttatttgaagttaaacatttaaataattttaaaggaagaaaaaaaggtttattttcgctaaatttgtaggatgttgaatgacttgtacaaattttaaaggaagaaaaaaaggttaatttatgatgttgaatgctcttggaacataaatgttgaatgacttgaatcccgaaagctgaccggttgagtatgatgtgattcgtgtgattctctcaacaatcaacattggatgcgcatgactcttcaccaaccacaaaccagacaagtaattttgatatctaatctgaatgtactttagacagagtaaagcaagaccgttagatgttatattgcgtctaacctaccagtctaaataaatgttgttcggtagctcatagcttcgaacaaaaaattgaaggggcaaagctttttttttaccaagggccaagctaattaaggttataatatatatagattaaattaatatcactacttacgggtgattttaaacctttgatgatatttttaaaatattaattatgttctctattaactgtgtttttttgttgaggaggaagagcccaaaaattgaattttatgatgataaaatatttttttttctattttctcaaaattttcttttcttttttgacttttatacctttatctcctactgaattaaaaaaactaaaaaaattatttgttaagttttttttggaaaataatattgcaagaaacattagttttatttatataaacaaaatatgtatgagaatgcataaaaaataaattttttctatgaattttcaataaactttaaggaaataattatattttttatatcaaaattgtacccaaaaattgtaagaaaatcagaaaattaatggcagaaatttgcatgaaagttctgcaagaaaaatttcacaagttcaagtcgtac

SEQ ID NO: 675 - DNA, 2200 bp, Glycine max
  Soy_ogl_4926 Gm15:88131..8831900 Cluster 2
tgtattcactagcacttcacatttggaaagacatttacctgttcaacgaacgatgactaaagaatggaataagatcctgttaaatctttaaaatttctcgagtaccatgatagtccagttcaacctaaaacttggatggtaattgcaatgctagcgatgtgagttctaatcaaaattgatatgaaatgaccctgcacctatatattctttcaaactactcagtccgagttacaataattaatcaattatcctttcctctttccactaatcaaacaagatcgctttataggaatggcatcagaaaagaaagaaagatttgtgggagttcaggcgtgcttagcttcgtgttatttttcaacttttctttttagtactctaaattatctgctaactgtttaagctctcatgctttaacaaaagacccctatggagattcaatttcctattggtatttttgatcttttcttttataggtaaatatcaattattagtttttgttaataagagtaattcgaacacaagatctcttcctcacttcttccttcaaacatcaaatgattttataatttcttttgtatttttttatgttgttccatattttatttttaatgctttattggctgaaagttaattaattatccctccacagtaggagacacaatctgccactgccattatagaaagcaacgttgcatgtgaatcaagaccgaaagttgataaatccaattcccgtcactctgcagcccatgcctttgcattggctagtagacaatataatatgagaaggaaaaatgtaaaattgaaaaatttgagagaaagtatataatataatggaaagagatagatggaaaataaaatgaattattaggaaattaatgtcttaaaaagatgttttaaaaataaaataactcgcaaaaaatgaaaacatatcccactattgtttattatatatattttctgtagtagagagacggatcatttttttggtcgaaaagaaaagatagcacattgtctagtaaagcatgtagaaaagcaacactaattgtcagtgactactatgcagtagcaggtaaactcaagaggttctttgtttgcttgtatgctcaagttgtcatggaggacgttagaatagaagtccactcgctctaaaaagcatgaaacgcacgtatgaaaacagtcaccaattgtttccgtgaaacactcccaatgtttggttaaatggattatcttcgtcctcaagaaaaaatatacaggatatattccctttatttggttaaaaaaaaggataaaaaatgtttattttagatatcaaaattaaaattattattttcttttctttcctttaaaacaagagacggtctaatttatcccaaatagaaatgagattagataatatcatctaagtggttcaataaaattaaaacaattgtattatgagttttttttatacacaatttttttattagttatatacttttcctattattttttactaattacatatttcctcaatatttatacccttttaatttggcttctatgtggtgtttgtttttcatcactctcatcatcgcataatctctctttcaccttctcaataacacttgtatttacactctcttcaatcgtacgccaacaccttaatgtagtcttgcaccatcgtgtctaattgtttcccccctaattttctgctacgctcggcatgttctactagtttagagaagtttgaatataactgcaaattggaactaaacaatttccacgtaagttgaaaaaattactctgcattattatatcgtctaccgtaccccttaacagagtaacccatcgattttcatacacatatgaacctgtgatatatattatcctacacacgttcattgcgtttttaaagtgtgattaaacatattaaggtaaggtatataaaaatcataaatcatttatgcttgttaaattggtgatggaaggtgagtacttttatggcagtgcgtaagcactagcctgtgttgtcatcattttcttccatggatgcaacattggatgaaaaaattaggtttcatcatttttttgtatgagatggcataaaaacaattgcatacaaaaaaaccctaaatttaaatgtgggcagaatttaaaattagtaaaatataatgggaggaatatatagttactcaaaattttatgtataaaaaaatttaaa

SEQ ID NO: 676 - DNA, 2600 bp, Glycine max
  Soy_ogl_5837 Gm17:41347601..41350200 Cluster 2
atgttcgaagcattgcgttcattcgaatcctttgacgaaatgtatgacgacccaacccaaagaatagtattgctgtcacaatcaatcatggctttgatctttaagcctaagtgctcaagatacggaaagaacagtttccacgactttacacacatttgttttctggtgccagaaaaatcccatagagaaaattaatattggtggtggaagtggagacccttgtcacttgtgtaccttggaaaacaagggagatagaaagaaagcaaaagacaaattgacacgttaacattttttctgtaggaacctgaatcgtaccaataatttagaatttggaaggtggtggtggtgacccaattgacattccaatttagaacacacctcaagatatctatcgcaatcagaattcaatttagaatcattcgtaatccatcactttatttttgtttgagatgacaaaattaaattataccaatatagaagtgttttatttgtttttaaccccactaaagtggaacttatttttcaatacttcctctttagttacttgtttattatcaatagttttaatttagatttatccttcaagtttaggcttgacagaccacaagggttgtttttatttattgtttggaattgttttccatttttaagagtttagagaccagattttttttttcattgtcttgggcataaaggttgtgatccatgaagttttgattttttaattaaatcaaaactacttaatttgtttttaatcataagaatcaatttcagatttcaataagtttataataactgacgtacacatcacaccagagtcctcaacaaactgattaaactttcttggtgcctgagaatgggtttatgaattttgtgcaattagctcaagtggtttatttgttaaaaatgtctcaacattttggacttttaactatctttcttatacactattttatttgtttctaactcatcaccgtcaagtttattttctaacaatactaaattacatctatttttgttctttcaaatgtatttttatttaaatgtttactaaaacctattttaactcaaatgtgttattcatcagttcataaataagggtcagtttgtttaaatttagaaaataattttttttatataagttcttatttaatcataaaatcataaaacatcttatttatttaaaataaaacatttccttcaaaattaaaaaaaaaagcttaaacaaagtagccctatatcttgtatggtaatattgtgaaaatataaataaaaaaaacgtagatataaaatatggataatatgattaattcataaaaaaattatacatatatttacgtttgatttagtctaatttacattaaaataaataaaaacaaatctatattggtgggatctatatcggtcctagaaagcaaactgtctaaagagaaaaaacgggatgccaatagaacgggccttcagtaaatcatagcttttgttgaaagagtccagttctattgggcattggcattaatggtggggatgtgttttttctgcaattcggggagtgcaggaaggaatttcctaactgtggttatgaccaaattaattagaagaaagaaagcctgaatctgaccacattctgggctttataaaataaaatggttccagaaaactcctcctaaatccaatctttgtttttttatcgtaaaaagaataaggcttaggagaaagaaacatcactattttgggccaatattaccctgtctccagttaatgaacagatacgggattttcttccggtgtaggaagaaaatcccacagttgacccataatacaataggtcgggctccgttacgtggataatgtaaaattggcccataatagaatagcaaatagaatattttttcattttcaatcaaaaaaaaaaaattgcttcggtcccctttttcatgggtcttgagctccaaactcataagcatgttgcctcgaaatacaagagttttggtccctcgccaatcaccatgattgaaacttgcacaatgccaaaactgttatcctggtaatgacaatcgtaccatgaaaatggacgtatcctcagccacgtagcaatatcacctctatataaacggtgaagaatattcaaaattgtttgtaggtccttactctggagtataagataacgtgttaatagacttttaactgacttatgtgcatagctttttttgacactttaaattcattatcttattagtacttttaatttattaatgtgagacttattctcctataaagaagatgaagtcaaattgaaatcaggagatgaggagatataaaaaagttaataatagtttttttctaaaaaaaataatagtaatagtctaatagttctattgataatttcatatttaatcctttgctgaaaagggagaaaatagatatggaaactgaaagtatgacccagaaatggcagaaattatgatccactaatgatgaagcaagtagatggaaaaatggtacgaaacaattcatggagtggggtacggtatattaatcacaatgctggttgtttcagaaccaaaggtgcaaggtgcagaaaatcccaatgttgcttttct

SEQ ID NO: 677 - DNA, 1822 bp, Glycine max
  Soy_ogl_6528 Gm19:43070701..43072522 Cluster 2
tataaattccatattattttatactaataaaaataatatatcacttttgtaattgtgatttgtgaatgaaaacatgtagattataaatgaaatggggggaaaatatcctgttagatatatctcaattatattatcacggtttttgcgattctgaattagtttcatatggtaaaagtgtgatataaaatactaactttattttatgaataaaaagtataaccctaccatatcatcagaggcaacggaccactcaatccaagtatccaaccatatcaatatcattactccaaagttattattgataaatgagttattattttgtgtatgttaaatgggttagtttttcaatttcttttatttttaatgggctggggagccttttaagctagtaaaactttaagttgaaaatgatctcttttataaaaaaaaaagattaaccagtttgagttttgttagttttaaaatataatcaaaccaattgattataatcaactaaagtctgtattgatttttcattccaaagttgcatgatataatttaatttgttaaaccattccattaggtatgacgtactaaattggacaaaattaaaatctcaaatcaaacttttcaatacaaccatattgcttccatttaatattatatctaattaattaaattaaacttatagtataaaatacgaatgcaatgaatgctcatttcagtcataatcattaatcataagacatgatgatttgaaagtcaatatagaaaaccaaatccaaacgcgactgaaacccattaaaagaagcatgcggcctaggagcaaatggggtaaatgtccaaaagcaaaagtaacataataggatcaattgggctcattataatgaggcctcattccaagtgtgaacttttccccatgcagcacaaaaagaaaagaaaaaactgaccaagtaatattaccaggcaagtgtcaaatatttcctacctagttaataacatattaccaggcctgtttctcataaatgatttgtaaattggttcaccttgtattcttttctttggcagattaaaaaaaactctaaacccttgatgaagacattttcaagctaggaacatttaccaaagtaatggttaataacttcgaaaagtgtggctaatgtgttaaaaaacatatgactaaattaataacaaaccactctttcattaaattaattctcataattgcgaagcattcggtaagagttccgaaattaaatttttggttcccgctaatctttatagtcgtagctagagtagaaactttcatgttttgaaattttgcaactatgaatgaataattgaaagctagggagttagtctgctttcacagtcacaattgaagttgaagggatggaattaaaaaacaagacaagtgaataggaataaagttgacccatcacatgggttgcacagagaagtgaaagaacctacgaatctgcttctatgatatggggtagttttccttgtttctatgtgggggttatggtttctttagaagatattcattagaaattttatttttcttactttcacttttcattgtacaaatgtccccatgttttatcattttgttgactattttaataaattgcataaaatatagtgacaaaataaataataataaaaaagttattttagttttttcttataaaattttaaattaaaattgaaaataaaatgaaaaaagtgagacattcaaactcaataacctctggtttgggtaataggtttttttgttttgaacctgtgaacccaatgaacaaactcgtgatattttttcttttttattatttatataatt

SEQ ID NO: 678 - DNA, 1653 bp, Glycine max
  Soy_ogl_6547 Gm19:44020548..44022200 Cluster 2
gttgtaaataggaagactaaaactactcacaacatgtcataactttcaatataatatataagcaattttacacaaaaataatcattttttctaaaattaatttatctctaaactaagctttccgtagtttgaggttgcacaaaccattgatatggttacatttaaaaccagccactccacatttcaagaatttgagatgtctgctttccatttaaaatccatgtcccaggaaaaaagctcattaagatcaaatatgtcgacctttttttcttcagaaaacacaaattgttttccgtagatcctaaattattttaacaagttttgattttttgaactatgtgattaatatttagtccaaaatttagttacatttaaaatttttcatagttttccaataatatattctataagaatcaaactcaagttgtttgccataaactcaaaatgcagtgtgttgctagaactacctccatatttaaagatatgtttgttatcaatgaaagttggagtgaaaattggtgggactgaaaagcagtgataaagaaaaggatttaaatttgttattggtgaaacacaactaaattgagttaatttatagtgaaatcatgtgtagaaattttcatctcaaattaagatgaaacaagataaaaaaaaaatacaagaagtcattcatttttcttcctcgaaattgcccctcttattttattcatgcatctctcgcattggttaaaaagcataaccaattatgttgttgtatgaggttatttgtttttttttttttttcattttcagttgaaaggcttttgatttttacaaaagataatcgattatgtggtacgaggtatataattgattatgttaattatatagtcaattatatgcctttaattaaaaaaaaagaattttaatttttgtttctcttaaagcatcgaaagtcattaattttctttttatttaattattttaatttaaatatttcatatattttacaccttctttcatttcaatcaatcattcttactttttattccttttcattccaaaccacatgattatttgatatgaaaaatagaagtagaggcgtacaaaaagataatgtcctgagatgttctgagatgacaactggacctggattgactttgtaatgattgataacaaatttcgaatcactctagatctagtcttcgaggtgaatgtgatgatctctctgtgcagtttcatgtcatgtgtgtaacaaatcacaaattcatactgtagcttaaattaaagaaaaattacaggtaaacatctaatatcttaataaacacctagtaagagagagataaaaataaaaaatataaattttataaataattgttttgatatatgaaaaagataaaaaatatttattgaatatataaaaacacaaatgttcatgtattattccttggaattaaatactagaccgaaaaagataaaagtacgtacgcgcaacaggtgagatgagatataaaaagctcctccgatatgatacgcgtaagaggaaaccgttgcatgggatacagcagccagctttcagcaagaatggaaagtgattgagagatcactctcaacattctatcatccttttcggccgtatttatgacgcactaatattctttaattcatatttta

SEQ ID NO: 679 - DNA, 1492 bp, Glycine max
  Soy_ogl_6554 Gm19:44181809..44183300 Cluster 2
ataaaactatataatttatataatgttttttaattattataaaaaatactagcaacagattttttttatgtacactactgtttattattaattaaaatttattgaaaaattataattttatctgtcccacgtcttattttttttatatcatattgctcattttattcaaattttgtctctttttcttattttcacctacttatataaattattatgtatttattatataatataatttctctctacatacagtataataatacgatcaatatagacaaagttcccttggaattaaaattaattattccaagtggatcatcggagtggccgagtgggagtatgaagatgacaaagcatgctgtttcttacatgtttcctcccaaacgggaagtgggtgcatactttgtgtttgtgcacttatccacaatagatacgacacagatcacacactaagaatctactcttttttcttatttttttatgtacataatggaatctactcttaataattacttaattgtttgtatactttttttcccacttcaataatgtcatattttattgttcatgtatcgacacttgttgcttgtatcatacatgtggaaaatagggattccataagctgggttttcagtacatgttaaatttatattaaaagttgatgttgattgaatggtcataaaatacattgatagcatcaaattgtctcaataaaagattaattttaaccaatttttattggtcagcactatcgcatttttttgtttttgttttctattcacaagtatttttatgtggagataatcatattcaatatatgattagatattaaatgtcactaattttctcaggtaagatctaggtccttatgttacaacttattttatattgtaggtgtccaatttttttcaagtatttttttttacttgccttaattgttgtaggtatccaattatccatcccctacttagctattatttccaagttagagccttttgttgtaattttgtttttgaatattcattttacggtgcatctggatgccccatatataatccatttaattaagcatttagaatttattcataaaagttatttataagcatgtgtggtcgtttctgtaaaaaaaaaaaaagtaggttcgtttgttcagcaggatatttataagcatctttattttttaaaaggaaataaacatctttattctttctacacacaccacataattcatgaattttagtacataaggcttgaaacccaattcaaagacactgatgtgaaagcaggcgagcgcaacatttctttcctctcttaaattgaattttgaattggtaggtttttaaatttaattataatattttattaaaatatttatatatgtttttaaattttttctttcaactttttatgaatgcaaaaaatatttgttaaattaataaaatcgattttgtttaaactttcaggtttacgtttctttgtttgttttgataaa

SEQ ID NO: 680 - DNA, 1857 bp, Glycine max
  Soy_ogl_6744 Gm20:34405322..34407178 Cluster 2
agattttctaagaatcaaatataacttatttataatataagtacatatcttaaggtttaatatagtattcatgatagtttatttaaaaataaattttaaaataagacatttattttcaataatcttaattattagcttcaacttgactctttatatatcaacatgataaaaagataaataaatctaaaatttgaatgtattataataaatttaatataataataatactaataataaatatttatttgtaatttttgaaacaggataacttgttagactttttgaatggcctaaaatttggtttgtttaactaactaagttttactaaaagttttgattggacatcttttatgaaaaaccccaaactaacctagacctgatgtaagttaagtcataaaaccatatccatttatctgacctatttcccctgcctacccttgaacactataagacgcatgataaagccaccataaatcccatcaaatactctccgacgaacgaaacaaataacaaattccaatagttaaaattttgaatcaaatgaccgtgccagattcaaaaccaactgaacaaatattggaagtcctgactaacttgctaaatgtgtgtttgggaaccaattatgttgaatgtagttgacaatctttcaaaagtaacataaaagttacttctacctttgatgcttcgaaatgcacaaaatgacgtttagaagctttcaaacataaatccaaacacattcagagtctctaaatgaaaggatggctagaaatcaggtctgttttaacttgtaaatgtaaggatgctcatcgacgttaacctcgtgtgctgaattatttctttatgtacacggagattcattgtgattatttaaagaattaaattattttgacaccaaggattatctccttaagtctttgtaatatatctgtttctttgtaatatatatcataaactctatcatttaatcttggttttgtgtttcgaagttaaattatttaacatcagaatcgcaagccttctatttttcacacacacaaaaaaaaacatttctaaagtacaaatctttgaaaagaaaaagctcgtcaactttttatcctttttcgttttccttatatattttcttcatcaacaagtatacgagaattcaaattttgtttaaaataatcagtagaaggaccagatctagcatgagattggtctagttactccattgcctgttaacttgacttcaggtaatttactaataaatgatgtataattttattataattgttatgttgaagttaacgatattttctaaacttagaagggcgacgagtcttctcttgaccttttcttttttatgctgacaatcatagcagacaaaaactactagtaagtacatggtaagaaataaaactaggaaagtaataggtttgacttttccaaactatttttctagataaaaaattctaattataattattaattggaaaaataaaaaattacaaccatattttatttttaagacacactttctttatcttaaaataaattaacttaaggtacaactgaaaatttatatttgcttcagttttaaaaaaattaagcgttctcttatatagagtcgatttgtttaaaattaaaataagtaatttaaaataaaaggttttttaaaaaaacttttcttttgaacatataagatttacttatcaaaataagtaaaatattgattctcaaaataagcagattggattttaaaattgcattttgaataagtagatagaatttgcttattaaaataaataaaaaaatatttttaaaaaatacttttttcaataaataagtttaaggatgagattgtttaaacttaaaata

SEQ ID NO: 681 - DNA, 2700 bp, Glycine max
  Soy_ogl_68 Gm01:2888801..2891500 Cluster 2
gggagcgctaaaaatgattctatatgagtgattgatcacaacattttgtcagagaagaacgtgtgtgtgactttgttactatatgccatggaatttcattatgtaagttttcacatcttgatcagagaatggccataaacaaaaattagattgagggaacatattcactgaggaaaatatatactcagaattccaaggctgcaaataagaatatgagttcagatacttaatactattgatgaaagaactcttcctctataggaaaagatttccttagtttttcagtcttgagcatttttttttggctcagtatctcatgcagacattgacattccataagctaactacaagaattttttttctaaattctaaaccttctgatgtgtcgttatcccatcctattgatttgaaatctcagtcatacaatacatcaaagttttgtcattttttctttcattccatataaggcgctacatataagagacctttttaatgcattatgtagtcagcattgaagttctcaattcattaagggcactgtgcaactgcactgtagttggtgggctagtcagtgactcacactcacttccttaacgcttatattcttctgatattcttttgtgcagtatatcctaagtggggcctatgcatgtaatgatgatgtctccttgttgaagctgtgtgattagcttagagggatgaagcatatggaaaaagagaaaaagaggggggaaagagccactttgtgtggtatttatgtgacatttcagagtgggagccgaagctcctctttattgacattattattagcagctggagggttgaatgaatttcacatcacatcttagttgtaccatataaattagtgtcacccaatttgaacatgtctaattccatatacaattgttaaagcaatagttataattattatgtttatttatagaaaataatttatcaatagatgatgtaaattatttttatactgttataataacaacctgtaaaatgcataaaaattaaactctttcatttatacaagaattgcatttgcaacaatgtgcaataaattattcatattttttttttctttgatgttaattggcctaatctcatgcatgcatgaataaggtaagtgtgaaatgtaaactgttaaataggttaaaggtgatatattataaaagtctttattagcttgttgttttagtttataatcataggttaaagtggtcatagaaaggaggggttgaatgtgtactgaggaaagaactgaaaaagtaaaagcacaaagaaggtttcactgaaatgtttgtcgcaaaggatccaacccgtgagacacattgtccaactgaagactccaatggctagacaagtaactattacgggtcatgttcattgctcagtccataccaaaaatttcaatgagaatttcaggtcagcgaagacccataagtcctaaagccagttgaccaaaccatgcaataataattgcctttggaggtaacattggccaatgactaaaaacccattccgtttgttcttatgatgggccaacaacttgttcgtctaagaatgcgtttttcgtggctcaattcctagaaacctcgaaaagggagtggcacattatgtaatgtgatgtgataggcaactataattttggagaatcttctgtgtgtatagtttgcaatatgatccgaatcaattcaataacttggtaaattcgtaccaatacaaattgttgaattttagtcggatctcgaattttgattttgaaaattcaatccacccaatttctttttttgactttcactttgtttatattcctttttggcctaaacaaaagttggttccataaatttcacattttgagtggtgtcctaaaattgaaaataaccatttttttaataaaaaaatcaatgtgttacaataattgattaagggattattttatatcttttaataaataggaaccaaattacaacctataataaagttaaggaactactgagtaatttagtctatttttttcacattagtttctagtattattgttttaattagtctctacgaaccagtaaagttttttttaatagattccttctatattgattttttcatattaatttctattatttagaccatcaaatttttattttaatctctgtaagtcatgtagaattctgacgtttgggattaacataaaatagagatcaaaacagaaaaacttaagaaaaccaaaacaaaagcaattatatgttatattatctaagactaatgataaaaggaatatctatatttgttgtccacatttcattagacactattatccttaaaccacttaaactttaaaatttttcttctaatctatattaacttcccactacttccatattattgttagttttttattctgccatttttttattaactgaatttaacttctgttcttttttcatttaaaaaatttagagaggcaggaataaaaatatttaaaccaactactatttacgaagaaaaatggtaacaaaaagaaaatacgaagaaaaatgtcttaatgagccgcatgagttgcctggcttgtggcgctttaattactctagtttgagagttaaatactttaaaatacggtacatagatttcaatgaaagattttcttcagtcttttacgtggccgtcaagattattattttaatcagctcctta

SEQ ID NO: 682 - DNA, 2974 bp, Glycine max
  Soy_ogl_296 Gm01:52565301..52568274 Cluster 2
tttagttttataaagaagactaatgataatcctccattcggaggggggaaattgaaatcctcgctagagagatatttttagacagtccgtagtgtttgaaattttattgtatggtatcttaaagtgtgtttggttttgtaatgactacaaaattcaatttttcaatgtgaaaatctaaaaattataaagagttgtggtttctttaacgtgaaaaaaaaacaataattgattgtcttttcgcatatcacataaacacaaccaaacacactatagttaaaatggagatcattttttgaatttggtcttgtaattttttctttcacattaagtatttcacgttaaaaaatgattatgctatattcattatttactttttttttctccatccttaatatggatggcaagtagactcaaacttaataagtgtccataaaaatcatttgaataggtaagctaaccaattaaatgattataggtctatggtaattatctatataattgtgaatgtaagtaggtacaaatgtacaatgctaccaaatcttatcgatccatactaataagataactctattagtttaataaatagcgtttttaaaacactaatttttaccttatagcttttttaagtttattcatctttttttttcttgaaatatttataatatttacttttttactcttttcgatataagatgagattttattatataatcgttttttcatatataaggtgggattttaataacggtaacttaattttcggttaataactaacttttttaataagatggaattcttgtcagtttttaactaattattcaattaattatgctaaacatagcttacctacataattactaactatttttctataactaaaattaaaaaaaaaaaagaaaaaactaagtaatctaaagaattttgtttttaatgttttataattaagatttgtctttaaatatttgtcacttgatttatatattttatttttttaagtaatacaccttttataaatttatcgttaatattcatactataacaagtaacttttataatttattatttttttaaataaacacaaaattgaagtgatatttaagttaattagtaaagcttctattcacctaatgtgattcattgtcccggaattagatcgtgaaacaaacagtggaaattccactgtatgaaaatacatttcagagaactctggtttttccttagagttagaaatttgcaataaatcgcttgactatagttccacccactacgattggctccttgatatcaatattaagctacgtgttcatcatccaagtcacaaacagtcataccaatttaggcatgtcacttttcggtattacaatgacgtactagaaatccagaaaaaaatagataaatgctgaaccctagagcagtgacttactcatcaatctcagtactaaccaatccaaccatcaactgttaaacgcatcaattaaattgatatgaaattattttaatttgaatattaattataaataatgaagagtattgtttcggtgaattcaaatttaaatccttggtatttattattataataattttgagttcaaattttacttttatatctataaaaatcaaaaacagatatcaaatttataataactcattcatttgattcaaccaacttagcttagacttgcttgggtgagttcgaattgtcgcacgtgataaattaataatctcactctattaaaatagaattaccttaaaaaactctttactcaatgaaaaaagaccaaaccatgcatcgcccacagtttgtaagggtagataaaaacaaaagactttgcttatctaattatcttctctctgttgcttttctttttatcttcaaggtagtggaagtcccacatacacgatcatccatagatctttgtctcctccaccccctattgtcattgttcaacattgtcaaaggctcaatcattttcactgttttgagatccaagagcgttctaggagcatatgcaaacacccagaattcaaaatggtgcctaattaaggaacgtgtccttgtcctttcatggttttgatagtttgaataaattaaagagcctcgtttatttggttgattttcttgccacataattaccctgctttttattgggctcttaatttcaacctctttttccactttgcttcagaaccacatttgccattgccaaccgggggattttttttatctcatgtttggtttcccttttgattgcttctatcaggaaataatctcacggatcaaaactttcaatgttggcataataatgatattgtcgatgatgctaggaatgtaataaaaaattagtctagtttaattgaagtatttagaattgatgattcatactagatataattaaagattcttgcgtgagcgtacatgttagaagtataatacaaaattaatacgcaatgtatggttttgaaattgatgcttcatgatacgacattaataacatattagaaaatgaatgagacttaaagttagtttcggaagaagaaagtatccaaatcttgtaaagaatattttgatcatattcataattaaagtaagatattttaacacaaacttcttcatacctgactgagaccgtacatctacagtgtaaaatttgtaagatccgttagacatttataggtgactcaatatattatatcaagattatagagacggtgaaaatacatgaattgtttaatgttatattttcaacatacttaaaagagaaataatcatggcagcttatcccttatgcaaccataaagtttgtcttgtttggtgtcccaatatgggtaaaaagatgagtaatgtgtttagaaacgcgttactgagttacgttaatatgctattgaggggaaaaaaatagagatcatgagctagaagctataagaaaatgttaattaatatttttagaatattttttagggaattaaaaaggag

SEQ ID NO: 683 - DNA, 2000 bp, Glycine max
  Soy_ogl_2294 Gm07:8535801..8537800 Cluster 2
ctaataaactgaatcatggagcactttcatgtataatttgcttccctaaacctgacgccacacctgctgaccaagtccatcatcgatcatcatcagccaatgagtcatctaacccctaatcaacaaatcgatcgcaactagcacttttggggtgaagactacaaactaactagaaaggtgctcacaaacatttttatgtaaccaaatgtcatcagcaaaaattagaatttataaataaataaattattaaacaataagaaatgctgaaacatactttctactatcaattgaaatatataaagttatgtaagtttcactttgtatttaacgaatctattgtaattagaaatctcaattatgttattatcataattttggattcatgtaatttttaagaatataaagatttaggatatgatgtccttaattatgttgaagtgtaattgtttttctctgtaaataaatattcataaattttgacaaagccttatttttattgcatatttgatattaattaagaggacataaataaatattagtatgcaacttcttcgaataacaagatcatgtaaaatttaaacatgaaaacatttacttttagttcaattaagggagctttagttaaataagaaccgtccccgcataaaatgtaaaaggtaagtttattattttattttttttaatgtttttacgcttcagaaagacaaaatagcagcaaagaaaagaaacagataaggtaaggtttgatttttctcaaaataaatatattttttttaacgtaaaagaaccttgaatagagaaagaatataaacttggtgtactctcaatctaattatgaagttgtgtggggaagacacaaccacctatatatacactaaataaatactagtagtaagcaatatatcatgtctcatgtactgaacaaaaggaaccagacaaataccagatattagagaatatatatatcagtagtcatttattcaataaatgtatgtgaacacacaaacacgaacataatttattatttatttttatatatctatattatattattcattttattttcttttatttttttataaaagatattatgagaatatattgtaaaaataagattattcaattcaacatgtaacgtaatcttctaaaatatatagccatatacggcctctgaataatcgatctagtagtatgggcacaccaactaattgctcaaacataagaaaacaaaatgcacaagaatatcttatctgcaaaaccaaggccaccatggaccatggtcgcaaaaattaaaagcaaaaggtagcatccttgcttagttcagaaaatcagttaagacatgatcgatgcactcgtatattattccaaaaaaaaaatctagatgttgtcaatcaattaagatctgatttacccgcaagcattaattatctgtattttgattaagataacgcttaaatgtgtttttatttattataaatataagttattttttatttctttcagcaattttgatcttcgtaatttttttaattatagtctttatcaatattatttattaatgacatgttatgcatttaaaatgtcatgttaacaaatattttaaagtgataactcatatgtaacgtgaaatcattaagtatacatatattgtattatgatttcattgttaaacaatgataaaatttattttaaaacttgttgattaacatcaaaataaatatttttttaaagatcaaaaccaaataaacttatatttacaaagtactaaaatacattttacattttatttttttaataattaaactaataaaattaaaatgttataatactaatatatttattgttgaatcttgaatataccaatctaagtgaagaatatttatgacagatttaggaatctgaaatgatcctttgcaagtcaagctctagttagatttttcaggcttgatagacttacttatgtggttccttgttgagtctttgtgtgtgtgtgtttcttt

SEQ ID NO: 684 - DNA, 2201 bp, Glycine max
  Soy_ogl_4517 Gm13:37400901..37403101 Cluster 2
ataagacaactttcgtacggaatgtgttagcattacccagacgatgcgaattggcaaagaagataaggtccgtacacatacattcatgtttagtcttcctcatatcgttttcaatttccctactgctatgcatgttcaatgttccaagactattctaaagggtaaaacttcacctcccttccctcataaatgataaatgtaatccagtatatcctgaatcttttttcagaaacaaaatatataaactacaagtacagatttctcctctcaaatttcttcagaaaattatttgaaaccttatattttattaattaatgtaattatataagttaaaaatttgtccagtttctggatctttccctgccagttgcaaagtttacttttgctattgaagtttgaaacatagtttaacatttattcaaatttatcaaaagatattagggcactaaaatggtcaaatgaaaacattttaaaaagtttttatatataaagatatgtatgattgatgtattgttactttcaattgcataacatgtgaatatctgataagaataaatgatataaaaataaaaataaaatagtgctaagaaaattaatgataaaaattggcagccgactaaatttacagtaaatatataatagatgttgagttcacaagcattctaaggataccagttaggaaatattgaatataagccataaatatttagttattataaaatacattcaaaaaaattattgttgtattttaatatgattaattttattatacgtattgtctataagaagcaattgtacccaaagtacaattgaacattataaacatttatcatattcgaatcacggcttgtcattatttttatttattttactaatatcactaggatactcattaatattccttctatgtaattaaaaaagatatgatatatcagcatacctataaataattaggtccttatatttgaaaagtaaattttctaccctgtaattatactaaagggaaagttatcatggattttcctaaacttaatgatgagtatgcatgtattgggcacataataagatttgtcgatttgatgctttggaaaatttggtaataattgtacacagccagcagatggcatgtctccaaagtgatttccaagtactaccttttaatgtgacgtttaaatggatcctagctgttgtttatgtaaaggaaggaaatgcgaaattaaaaattgcacgagtggttttttttttcatattcaaaatttaaaaattctttactgatattgtatattaccagaaccatcttactttcttcttagaactgtaagatatatgccagaagatttttttttcatgatcagaatttctataattagtacatacgtaattaaagaaattatcaataaaaatggaagctaaatgatatgccgacatacaatttcgaaattaaaaactctggtagtatatgaatcgagactcttgagttctcaaattccacctttataagacccaatcataacaaatatacacttgcttaaagtgatcgattattgtctattaccataatattaacattaaaaaatgcattttaattccttaggtaataggtttatgtgtgtccgtccaatagtagtagtttccatttcctatgtacgtatgttgatatgactaatttctacgacattccacaatctataagaccactaacacattgtcctatttgtaaattaattatgacacttgactcgtcccactataaaaaataatactcataattaaaatttaattgagatatattgataattcatattgttatttaattataaaatatatataaccatataattaaaaaattattattgtttcatattagtcttgtggcctgatccatatagtggtttactttcatccaaatgtcggggtcaacaccaaattgcaggagcaacactcagatatataggaatgataatatatatttgtaaaccatataatattagaataaaatatgagatgtaagatggatcaaaacgttaaagaaaaaggaaaaaaagaaaaatggcatgagtttattttttttaataaaattaatatttattgataaaaaaatattaggatagaatatttttgtacatgtctttgagaagtcttgagtactcttatgttagactggcatgcaggtagttaatttggcatgtatcagtcgactc

SEQ ID NO: 685 - DNA, 1400 bp, Glycine max
  Soy_ogl_1833 Gm06:7503001..7504400 Cluster 2
ccgtccatgtgggtacaattttccaatattccaaaaatacttttctaccagaaatatgattccgttgtattggttatcaaagcaatcatattctcgttgttaatggaggtaaaaaaaacacacaatttcagagagaaaaaaacaattttttatgtattatttttagagaaataaaacttatatattatatcgttttagtaatgaacttaagtacaaaaaatttagagagtaatttttaattgatcatcagtataaaatattaacattgatggtagataaaactgaaactcattttttgatataactaacacagcacgaaaagtaatgtcattattttctagtgctatctcaattagaatattaaaactattatgaaaatgggaggatatgattataaattacacaattctaattgtaatgttgtaaaaattcttttattagcatatgaaaatctctaatattttttgcattaacacacaaatgacatatcagttttagtggaaaactatattatagtatatattatatataaaaggaacagttcttgcttgtaaaaaaaaggaacaattcttgcattagagacggaagaaagtaaaaggctgccataaagtatagaaatgaagctcagacgctccttcgccatagcctggctacaacctcttttatcgtcttgtcaacgtcgatgtcccattatttattttatgataaaatttaaacacaacattgttataaatattttcttaattaaaatcagaattatattagtaattattaagtgacattcattaagatagaatgttagtttaattaaaaataaaattagtatatttattttattgtgtccaaaattgactttattttcttgacataatttatttccacacgaaaaaaaaggcttcttcacctcgtacaaaattattttatgtagaaaatatatgtagtcgattaaaaaaatacattctttctgcgtgatgaaaagaaaatatagatggaaatggaagagaaagcccaacaaaacattccttatccgtgtgaactactggaccagtgtttgcttttcttcaccttcgaccttagtccatcttttccccccaaaagtaataaagtaataattttttttataatggcatatttgttttagtctattttaaaaatgattattttttaagaaatctttcatataaacactggtcaaaattatttttaaaaaataaatcaaacatgcactagttttttttaaagtcacaaaaataaattgattttttttaatcaccataatgatccaaaataaaatgataaaagattagaatgatttaattcgaatttaatattatattcaaatcaaatcatatattatttttatgtttgatttaaattgttttataaaaatgaaattaaac

SEQ ID NO: 686 - DNA, 1802 bp, Glycine max
  Soy_ogl_3021 Gm09:5805199..5807000 Cluster 2
cactgcaacgttcaactcaagtctttaaaaaatgatagaaaaatgaagagaaaaagagaaaaaatcaagagaagagaatgatgtgaaaacattttttttgttataatgtatatatagaaaaaataagtaacctttatattttttattccaatgctaacaatgaacaaaatattgctccaacaaaatattgaaactataattaatgtcatcattaaatgttataatttacaaaaaaaaaatctctatcaacccaattaaaattaatgatgaatcttttttgtttccacacaatcagattttaaatatatcattaatatttaagatatgttcaagaaaaaaaaatgcctaggatactaataatttcctaaatagtaggcctaaggcaattgcctcatttataacatgaacgggaaagaactctatagaagggtaggtagaaaatattgagatattcgttaagaaaaagaacataaatgagagtgtcacttatatgcatggaaggtgttgtgcttcgttaagaaaaagaaaaaggaaaggaggtcaacaaattaaggacttataagcttaagttcgattcaaagtttacgctcttaaaatgtcacaaatgtttgtaatttatggtactatggtatatattggattatagactacagttgatatttgaaaagagacagtacggtaacgtttgatggtgtgaaaggcttagttttttgaatttgggttgtacaatgtactaattttctttgacttctgccgtggacagaatctcgggagcaatctcaataattataattttacaaaatatttttctctaaagtcttaccttaaaatagcaaattcccttgagtcaataaatttgcttgtacatatatggcacataccaaatacgaaaattaaaattcaaaacaattaaaattactaaaaaaaagttgacactttatagttagagtcaataaattttgaatatgtataacttaagtacactactttaaatatataattaatttaaatcaaactaagtacagaaatattataagattaattttttccaagtttttaatagagtttcatagatgaataatgttgataaattttttttatcaaattcttcaaataaatttatataggtgacaccatatgattttgtggattgaaattaaatcatcgactgtatctctctctttttttttttttgtcaaatgatggaacttatactatgaaaagtgtcctcattcacaacaatgatcaatctattgtgggattttgcttaaaaaattgttcctgaattacaattttgtgaatttaaagataacatacgagaatcatatttattttggttttgatccttataaaactagttcttaaatatgtcctttaaatattttttagtccttgttattaagataggaattagaggaaaaaattatacacgcgaaatcataatccgagtcacttctcttcattcatatttcttgaaattattgtttgtctttaattttattttcttgaacgcaaacacaaacaatccccaactcaagataaaaatccaaaattatttagtttatgtgatttagattatttggaaatacaactagcttctagaatacgatatctagactttcgggtccattgttaatactgcataggatacccttagcaagtgcatattttacacatcaaatttatgatgtcgttgtcgggaactagttgaatagttactggataattgattgtgtaattaaactgaacaattttaatttcaatagtttatgtttcaatatattttttgtttttggtacatt

SEQ ID NO: 687 - DNA, 2000 bp, Glycine max
  Soy_ogl_4433 Gm13:33646601..33648600 Cluster 2
aaggcaaattcttataaatggtaggttataaatttataattggatgataatgtaaaattattttatattattagtatataatttatttcctcttaattatgaatattttgatttataatacactttagatgtacgtatcaaattattatatattatgtttaataaaaaaatcataatatataaatagagaaacagagaaggaaaaagaagaaaaagagattatcttattttggtgtttcctaacccaacttgatctcccattaggataataattacattagaccaataaaataatataaaaaataggataacattatcatatttattcacacaacaaatatcctattaaaataaaagatgtttatcctatcatattgttgtgttcaccaaaattaaaatttatttattttataaaaatcagaaacatatttttattactaaaaacatattaaatcataaatattaatcataatagattttgtgattggattgttttacttgttttgtacccatacttgtaactgattgtggttgtgatgtaaatcttataattgtatattcatttctatttttaagattcttatatcctaagcattttgtttctactttcttctagtgtgatttgcgctatagcaattagtgataactatctgttttggcgacaagtattattcccttttttttcaacagcaacgctcttttgttttacccctttacaagttattttttttctttttattagatatggttagttttaggaattttgtaattctattttagatctttatgtatttacggctcaatgtattttagaaaaaaaaaactatattttcaacttataaagagatgttgtgtaagggctattattagaagtgttacaaggttggatttaaattttttatgtttgtttctccaaattttcgaacatgtcccatcttttgaagtaacaagagtaataaggagagccaaattcgccctattgtcacgcatgaatgaaacaactcctcgttaattcacccacccaccccctaagaagattgaaaaaaacaaaacacctccttgttgcgcaaataaaaaataaaaataaaaaacaatacgtaaaaaaaagtagagggaataaaaaaacaatgaacttatcgtttgtcgaaacgaaaagctataatttattaattaatgtttcctgattatagattcattgtccttttcttttctttcacgttcccttactttttctccaaactgaatatttaaatatatagaaacatggtaaccctagttatataattaaattaataaagaccttttcatcagattttgcaacttttatgtgtaaccgaaagcatgagaaagcaaaatctaaacagcaatatataatagggatcgaaaggtagcaatatgtacgacgtagaactataaacttacaactgaccattctcactgtatgttgttgtaaaatatatatgatcactcttatgatcatgatagaggattattctaatttatgcaggaaaaagaattaatatatgtgttggaacaattatatgttattgtaacatgacttgtaaactcttataacattatagttctttttattgagaaattctattagttggggggatgttttgtagtcaacattttttccctataaaagttcttgttgacaccttttttttcttaattattcaattaattttatatctctcaattcatttgttcttgattaattgaggaaaaaaaatatccattcatcgacgttactctctttcattaaagatatattggacttctttttgtatatggaacattcactagttttattttgttcaaaaatcttacccacctttagtgaagtatttcattaaccatccaatcacattttaatttcattcacaaaatttgaacatcaattttatttaaggaaggacacaatccaatatcatttgaatcaatcatttgtcgatatctatattgaactttatataacattattttttattata

SEQ ID NO: 688 - DNA, 2242 bp, Glycine max
  Soy_ogl_5014 Gm15:12468701..12470942 Cluster 2
tgtacactgatttgcataattgaattggtagtagttttcagcttgatttttcatttgatattttacttcatttagttttctcttggttcggacaacatggaaatttgataaattatttatttttttatactccttcaacactattgtatgtaccattcttactgataaatattctttaatgttcttcgtacatatttgttatttgctcgattcttctttaaattagatttaatacgtagacaaaaaatatagatttttatgattaagtttccttcatctattctttcggtctttcaatttccttctaggtattgattgtctgctgctatgctatactctgtttttctttttttggtgtggtagaaaaaaaaagttttattaatttgattttctcatatattattatattgacgaaggtgactgggttgcgaggatcagttaaagtttaatctgttaaatcactgtttaattagttcaatttaatttcgtgaatacccctgcatctagagggctttattgcataatgaagtttcttcattaaaggagtcctattttatcctcctaatttgagttagtttggtttaattctactcactgtaattgcattttctgctataatttttggacgttttgatacgtgtctgtggattggattgaaccctttggaaatcttctgcaatatattaatgttaggcatttaaaatataatttctgcaatttggatttcgcatattaagttggaccaaatatattattcatttctaatatcagtaagtgcaggcattgagagcttttcccagtgggtgatgtgtcttttggtcaagtgtctagatttggaacttatctttgtttatggtgattattgttctaattttcttctactatgaattctggacattgagaaaataggcatcatatggctacttatttgactattttctgccgttatgttgttaatcattatggattgaaacattctaactgctatacactatccatttaaagaagtattagaaaaggaaaaaaagtaagcacgggtattttaaaataaaaaatagtcctaaagcctaaaggcatcaaaataactggcagcagataactctatgttatttggcttgtgctgtttgactttcttgtctagtacagtagtatatgtttgaaattttatgttgtgattgtttgaactaatatccaaatttcaattcatttttatcattttagtcacctcatgaaatagtgtatcatttcgcaaactttattagtaaatgccaaaaagacatgttaactccaaagataacataatttgttaagaaaatgaccttgcacacggaaatgtgcttgctggaaacatgactatatgtacaagagcaatgtttggatggaataaaaaaacgtaaatgagatgaattaaattaataagaagaaatataaggaaaaaaaaatagatgtaataagtttgacttaattatacatgtaatatataataagtaatgtaacaataagataaaaaaaaaataagatgaaagataaaataagtgtttgtttatatttttattaaaatttatgtacatgcactaaatagggaataagatccactttatttattggaattaatcactcgaatatataacaaagtagagtgcactaaaaagtgtattattattatcatttttttttaatttggtatgtgaactgaggaatgagcaaggtcaattgcaacaagaactgaattgtataggcctcagctactatttcacaaaggggaggctatatgcctttactgagaacaatccagtaagcattagagttgataatggagcatgtgattctacacggcaaattgatggttgaaaacatccttttatccaaaaaggatgctttgaaattggtgtcagtaaaggtcttataattttttttatccctataaaatagaggactttttattttaatctttcaaagttttttttttattttcattaattttttattatcaaataataacattagataataacttaatgttgataattcattgagttgttaagttattaatggattacgaaagtataaattcaatattacatatagtatataattttataatctcgaaacaccaagtttttgaaaagaaaaaaaaacaatccaacctaacccaagggttgcttttcgtagacccgaacccgctaagtaaatcgtcggtttgggctgatttcagttaaaaaggttttgggtttgatgattc

SEQ ID NO: 689 - DNA, 1630 bp, Glycine max
  Soy_ogl_688 Gm02:46131801..46133430 Cluster 2
ttgggaattatatacaataacagttcacgaatttgaaccaaagaaaggaatctacttaactattctagcagcatgggtaacatagtcgtgtaaattctagctacctcatgtacttgtgataaaaactttagggaaaattgtagtttgtataaaaaagaaggtggtcatcaggaatgaggtgttattgataaaatatggagtgggtggaatgctcgaaaaggataatacacttttctactcttatttttaaatgaacgtaagagaaaggaacactttatatattcttttgtgttacaaaagggataatgatatggtccatttgttacacatttacatcgatttgatatgacaatatatatcacaggttcatggaatattgttggatatatggccctgattcaaggcttatgaacaaccattttggaggagactgttttttcaaccccgacacttagccacttgaggaaactttgcatgtttcattattgaacatgttattccgattaaaagttgaacgttgttatcgcatatagatagtgataattctacaatgtatgtagatttatagaattattaattaatttacatgacatttgtattagcttagaagacatttatgagagaataattcaataatatgaaattttatttgattcatgtttacgtgagacttttaattaattgaaaattacacgaatttaacttaagtatttaggttattgaatataggaagaatgagcaagggaatggaaacaatacctaaatgcaagaaaaataaaactattgtgtttaaaagttctatttttttaaatgtgcattaagtaactaattttacatttataataatatagtaaatacttttcttcacttgtcgtaaataaaatgtggggttgtccgcgtgtaagtgagcgaaagcgagacatgcatttactaaagcaagcctagtaggccacaaattatataggtttcttccaaataatacttagggacaaaattttacaactatcaagatgttttgactttacaaataactatttgcacgacaatgataattgttatattatcttcatctttattttatgtaattattcattattgaatctttgatctgtgctgttgtccaaaatgcataggatgcaagtaaaatgaacagaacatttagaataaagaatcaaaacaaaattgttataatgtaaaaatatttagtatctttctcattactttgaaaattattttatttttttaaaaggaaaaataattagaatttaacgatgatgaaaaatgctattattttaatgttgtattaattatttttaattagagttagtttgggtttgatagtgcatggattttggtcactataatacaatttggacgaaagtttcaattaatttagttagatggtaatttttttttttttttggagacttgaagttttcgaatcaattcttggattaaagtagagaatagatttactagtctagtcgtgtaagtggatttggtataggttaaaccagtccaaatatatttttgtcttcctctttaacctatgatgcatctagtgaatactctcggctagttgagaaaaagatcagattcactagagtctaagtttcttaattactggatc

SEQ ID NO: 690 - DNA, 1531 bp, Glycine max
  Soy_ogl_1389 Gm04:441101..44262931 Cluster 2
tcaacacattaatcaaagttgatgcaatttttaaattttttgcagttatattgggaaagacaatcccaattgccaaattgcgagctatgggtgtagtgtaggccttccgtgaactatttgcttgattgtttgccaggacggtagtgatctttgggacttatacttttttcctattgctttctacttagctattctttaacactggattattttagaagctatctttcctgaaacaaaaaatatcttaatgtacttatttacctaaacaaaagagattaaacaaattataatagaataataactaaatctaacaaaaaaaaaatgtatacaaaacataagtgaaacatgacacatgaatctcacatgtcccctatacgattgtgagctagttaaaacataaaacatctaaaaattgctcaatgagaaggaaaaaaattcattaattaacaaagcaacttgtgaacaatagttaaggcaaaattgttggttgagtttgtattttatttaatcattttctcttgtgattttataatttttaataaattttaattaataattaagtatgtgttatgaagaatgagttaaaaagtatttttcttaagggaagaaactattgttgctagtactccttaaataattaaagcattacacttccttttacacaaattttatttaatagtaattatattaaacaattgttcgtagtacttgtttttattttcttttttctttttcataatgtacggccaggtagatgagaaaacttgattaatgatggacctgaacatcaagaaaccttgagaaattgaaagaaaaaggggaacatgacgtgattaatgagaatcgatcgacagcaaaaaattgacaatgatattcctttgaggccgtttatttacgtcaaaatatttaagggacattcaatatgttatctgatacttaaaaaaatattaatattatagaatttatcatgtaatagaatataaatataaaaaatatttaaaatagataaatattagtgtattattaatcattactcttatttatatctatttttggatgaagttgaaaagtcccaaacaactctgtttttctaattaagttatccaatcaaagcaatcacgaaagccaccgaagcaactagcaaaagctagtaattgttgtaacgaaacacttgaattatactagtatatcttctaactctacgtcatataaaaagaagttaggcataatattaggaattaagcaataccgaaatgctgtgagttgtgtatatgtctcaatttctaacaaagtttggtggtggtcccccattccattccacgtagcttaggtgcaaagcagacacaagtaaaaactatatatagagccatttcaaatgtttgggttgcattgcattgcgcacgttcacacaaattaaatcacatggcacgaaactatgctgaccacagaaaaaagagaatggttggggttggctgcgggaggcagaagcatatgctatgtaaatgcacacacatgtatttatgtataagga

SEQ ID NO: 691 - DNA, 1167 bp, Glycine max
  Soy_ogl_1404 Gm04:44812034..44813200 Cluster 2
acttgtttcaaaaaaacatttatattataaaaaaactataaacatgacaatataatcattgtgatcatatttcgaacaagtatattttttatttacattatatttttaataataattatcaaaaaccatttccttaacaaatcctaataatagaatgactatcttctatggtaatgtgataataactaattatgtagaaattctacgtttatttgattgatttaataatttctttaattgaaagttatatcaaccacgagtttgaatataaagaatttataattgtgattttgttactttaactaaaataatattatttataattgataagaatcaaagtgtgaaaactataataaattacatttcaattacctaaacaaattttcaccataaatattaccacaaaactcaaacccaaaattttacttaaggattaaaatttttttgaagcattgaaaaatgttttcaatctctgacctacaggaaattcggttaagcttttattgaggtaaaagaaaagtcaaacaagtaagtgaagggggatagaaatttaagctggaagctaccaaaaatagaaattcaggctgaaaaaatagatcgcagaacttattcgttttatatatatatcgggtttgtttgattaagtttattttttaaaaatatgcttttatatagaataagtaattgtttaagtaaaatttcaatttggtgatatgcttgtttaaattattttttaaagtttaaatgaattgacatattatatattatataaatttcttatgctactaggattcttttatattttttaaatatgattatgtggaagtgcgcaaagatattcgtgactagaatatgaatcgaagtatcaaaccgcaaaaatcgtacaaagcatatcgtcaccgactttaccacgtctacctgcattgcacgggcacagcctcattattacttttattttctttccaatatattccagcagatcaagcaagattggaaatctcgaacattcttacattatgcctacttttccagcaaagtctatagttatatcaatgttaattcttaatacaatcgattaaactataaaaaattgatttattatatttatatataacttgatcgacagagcatgctaattaaccaaaacaaattatcaataggtttggt

SEQ ID NO: 692 - DNA, 1126 bp, Glycine max
  Soy_ogl_2269 Gm07:7944501..7945626 Cluster 2
atttgtactttgaaaaagtgcatattctctcttgtgtgtcttagaaatgccgacggggatgggttctatgattagaggttcatatcattatttattttagttgtgctttcacgcacactttttttttttttgaagtgtacaaactgcaaatataaattgtgtagaggcaataataaagtattggcttaggcgaaagtctaattattattattgggctttaaaacttcttggatcgtgtccattgtattggacctccccgccgaagggtcaatttgaaacattttttatttgtatgaatataacatcaatatttaaaaagtaatagaaaataactataccagtttttttttaaaaaaaaatatgtataaatgatattttttttaatctgatttcgagtttttacctgatacgaaaatttacaataaaaaataagtatcaattattatttattaatgttcgttaaacataataaagatctatatgcatataaaacatatgtgtttctcgttttcaccatttggctataattaattatttttcattgcatcccacgctatgattttgtcatccaggggagtgaagtaaaaagtatattgaatagtatttattaatattgataaaacctggattgcatattagttttgagttttattttatataatagcatagcataacagggacatccacgtggtggagccaaagtagtaatggaaagtcatgggttcagcgtccaccacaacgctgtgtgacagtgcagcaccatatcgccgctcatcaaacccatcataaaccagagataaattcttggatacgcttccatctataaattcgtttctcccacatattgtaaaaagaatgctattaaatcagattcattaagaaataaaaaatagattaagtattttttttatagaaattataaaacaaaaatatttatgacataattttatatattttaatataaaaaattcattttaattccttgacagtgtaattagcatttgtcttataacaatatctaaaatttcaagatttatgtttttcattcaaatattaaaaatttatcttcttttatcgcattacacactttttttatttttcctatttttaattagatatgtaagga

SEQ ID NO: 693 - DNA, 1137 bp, Glycine max
  Soy_ogl_6440 Gm19:38813764..38814900 Cluster 2
gtcttgtaggccatacatggccaagccctagtacaaaacaacatgttaacattgatatacatgaagaggagcttttaaaaaatataatggataaacatacatagttaatacttacatgtgttaaaaaggaggataaattagatgaaatcagaatattttcttcacattactgtctatttttattatcctaatactagattatttggccaccaaagaatccccctactttaaaagctctcgtctctgacaatgttcagagagctgttgctaggcctctaaggctgccttagttttttcgttatctttcggaatttcgattgtgtaaagtttacctagtctaaaagaaaataacaagtatgtgcacgatattataggataaaaaaaattatatgatgaaatttctttaaagtatacgtgcgtataaatacatgtatatgttgtagaaagaaatcctacatcttgttaattaaaataagtgtttttcttactcttaaataaaaaattctgaccattaattcatattccatttttttaatttatcccttcggttccaaaataatagtgatcctatattatttgataaaaaaaatagatgaaagagaatattaattttataaaattaaccttctgtcataattaaattattttaaaattttatagtttataattaataattaatatataactatatataagtaaaataataacaattaatattatattaaaaaaataaaatgagaatggaaaactttttttcttcttattatatgataattataataggatggaagaactatccattaaatcctacatttagataacctttccttgaggaagacgtgtcgttttcttatcaaaccggtgtaataattttaaagactgttaacatcatataaattttctacaactttttaattcaaataaagtcaatgcacgtgtaatagaaaacatagatatactgtatatgtgggttaataccttatgcttgcaatctttcctctttctcacagatcaactcttttgaaagtgttgaaattttatctttatcctatggttggattggaatctttaaacaaattgggcaagagtcctgaccagtaatgtgggtcaaggctaattttcatttccttcaagaaa

SEQ ID NO: 694 - DNA, 1500 bp, Glycine max
  Soy_ogl_6515 Gm19:42461801..42463300 Cluster 2
ctatttttattgtttaacattttaaataactatttccaacgattgtcctaagattcgcgtgacaaacaaatcatttagtttaatactattccatgattgttagtagtttatagtagtatattaactagtgcgttaatttattaattaactattacactctaaggcggcatagctgaaaaaattcccagttccggcccaggctcaacgttaaagcaaaaaaagtacgtaggattctcatgtacttttcttaacatcatattcagataaagaaaaagaaaattatatagagcatatattctttggaagttatatttttacactggcaatgattctcagatcatattcatattcagaagaaagaaaggagggggatatgatagtggagagagacaaggggcgtgggacaagagagaaagagatttatcaacttttttaattatatatataaatttttctatattattaaattgaagtttatagtaagttttagaaggaagaatggataagggaatgtgaacaattcgaatcctccctagctatataacaaaaattgcaattatgtatacactatatctaaggatatatagaaattggataatttgtttacaattagtgaattgatagtaatcaatataaatgaagattagttaatatatatgttctcaaatttgtcctattaatattaaaattagtcaattttgaaaataatgaccaacctccacaaacattgaccaatcttgcatccagttttatttttttatgggagtacaaggggtacccaacatatttacacaaggaacatacatgcagttaaaagcataaacatcaaagggtacttgtcttgaaactacatagaaaataaataaacatcgctgcaagcactatttagcagttttctatcatctgtaatgcagattataccctggataacccttgaacagtactgcatctccttaaattaaggtaacccttgcatccaatatatcaattgtgaaacaaattaaccaatttttatacacaattggatgctatgtagcgttataattcttagtagagagaatggaaaggatgcatatttgaataagaaaaataaaacatattgctagaaatcaaacttgtatgaagatataagattaacttggtgataaaagaaataaaaataagttgtgaattcaaatttttttgttaataaaaaattaacaaattaagaattaacttttattaataaattaaaaagaaatatcaatcctgtactcaaaatattaattcacgatttgcactacatcaaattcacattatccaatctcatgctcactagacccgtgaaagacagacatacagcttctcctgtaatttttgtcaagctactaactttatttttatttttctttttaaattgtcaatacccaataaaataaatattttatatacgtttaaatttgtaccatgattcaaactcatctatagattagaataaaatgattagctgggagtttaaat

SEQ ID NO: 695 - DNA, 2191 bp, Glycine max
  Soy_ogl_6894 Gm20:40676001..40678191 Cluster 2
tttactcgactaaattaaagtcaacctgtaatattatattagtttaaagtgaactttaaaaaacaatttaatataatcttaagtagcaagatattgttatatgagacaaattaataaaaaacacaaatcttagtacacagaaacttgctatatggttaattagttatataacccattgattatactttggcctttttttatctcagaaaactatatatcctctaaaagaaatcagaaaattagaggatctaaaaatagaattcacaatacattatataatagtatatttttgactggtgtctttgtttcatatctcaaacttaattttttaattatttaagagctaataattatagtaacttttatatcacactatatgataagtatagttttttacttctgatcaacgagttttcagacatgcaattcaagaattaattacttgtcaatgcacttcaagaataaaaaggagtaccaagcagatatgattattcttatcacatcataaggtagtattgtgaatgaacagtgagaacaacaaatttaagaaaacacgtacatgtaataaattttcatggtcaggggtaatgagttagagcattgaatctgatctgaaaataacccctcattattttcaatatgtagtgaagcggtagaatctcacatcaaaagggttggaaagatggaagagttagttagcagttcaagacagcacttatagctaataacatgtttgataagaattttaaagcatgatttggcctgaaacaccccacatatgtataaccgtaccatcaagactacacatgataatatagtcgtcttaataagaagatttaattaactttcttttggaagaactttgagctatctttatgggttttaattgtgttggtttcaaacttgcgttaagtgttgaattaattaaataagcaggagtactatattttactactttcatattgcaaaatgaatttatatatagcttaattaatgcctacccaataataataataacttattaaagcaaaaaactgaggtctaattgattaagccaaaatgaacataactcagcaagcagcatgcatgaacaaactagtactcctatagtacgtccttatgtctgacatgtcttgaaagattgttctgttttaatttgaattgagagatagggttatttcaaaagcagttcacgaaagcatcattgaagaaacaaccgacatttctctgtcgtgccatgaattcattgtcggggtctagtaaaaatcgtaaggttataatgttgttgtactagtattaaaaaaatggaaatgttaatttatcttcctgattcgctgtcgcacacagtccactacctctctatgtacatgttatgaacatggctatctctaattgaatttttggaggaaagtttaaggacagtttgatagaataggaagaaatggagaaagtaaattgagataaaaattttgaatcaagagagtgtaaaaatatgaatcttatatcattttatttatttgttagtctctttatctataaacgaacgaatccttaatttgtgattggaagtagaggaaaggattcctttctcatggcattggcatggctattgcatcctacgtgacagtggagactgtattcatggccttcgtcctccttcttgtcagatactagctaggttggggtcacctatatagtggctgtacgtagtggacacaaatctaaggactagcttacattacatccaacacttgatttagtcaaaatatgtatgaaaaagacgcataaccttcattttattgcttcaccaagacgtggatcaaagaatgtcagacatcaaattaaacatgcacctagagctttaaatttggcggacaaagctttcagattacattgtaccgtttgaatatgcattgttatcataaaaaaaaactttaaacagttaaataatatgaaatcatgtgatagatatactacctccgttcctttgtaagatccaattttttttaatttggttgttcttttatctatatgactcaatttatattatgtattaattatttttagattaaaaataatcttaattaaataagaaaaattatattaacatgtatttagaagagaaaagagaaagaaatattaataatagtagtatttttggaaaagtatataaatttagaataacttactg

SEQ ID NO: 696 - DNA, 2126 bp, Glycine max
  Soy_ogl_3350 Gm10:3342075..3344200 Cluster 2
tctctcttctatatttaatttaaatagactaattatttttaaaactattatttgatcatcaccatataaaatataactttgttggcttcaacaataattctcttaaaactcaatttaataataatttttaattgataaatagtgtaacaatttctacaataacaatagatgaaaattaaactgatctaaccttttatgtatgaacctacttttttttaatcggtaagcattaatcattaatttttgttaacaagaataattgaacctataatctttttctttttttttaaatcactcaattaattttatatctccatttataaacctacttaaaagttaagactttataaaatgtagacgttcaccccattgaaataaaaaaaagggagttgtaagagattgagaagagtgaatatcgttgtttgatctaaaactttttcatgatttctttcttatttacactacttgctttttacaagcaaagaattattaagaaagaagtatatgatcgagatgctataactcaaatgtacaaaagattttataaaataaattaataagataactaaataaaaataagttggaagatcaataatatatcaatcaatcaatacttcttgaatctgaaatttcgcttatctaatcctctgaacagagagatttctggatctgcaatttcccagattaaacatcgatctttaacttaaataggataagttatttgacaatagaaaaagaacgatagacatcaattaattggattcaagattatggtgaaccagaatgaatatattattaagataactttcctcgacaactttaagcataaatatgggcatcttttgcacttcgattacacagggcacttttagaaagatgagtatctatatctattcactttatattacgcgcttttttgaaatttttgctgttttgttgattagatcgtgaattcataactggccattacttttacccaacattatctcatcatgaaagtaacttgctttcttttaaaagaatcaggccacaatagtttagtttcgtacttgggattcaagaaagtaactcctctctctcatatggaagatttcttccatttacattgttttgctttgggtgatttatattgtgtgcacttccacaaaaggcgccatagtttactaacaatgttatttctccacaagcaaatctatgtatgaaaaacaaaaaatgctttaaaagtgcaagctgatgcttatatatttagacatcaaattaggaaaagatgaaataacattcctttttttttcaaattgatagcccccgctcaaaattctccagaaattacgtggtaaatggtaagaatcaaaattggatcaactttaattaattgtatgtatatctaattaaatcctttcagaattaccattatctatgaaaaagaaccagctagatttaattagaatatttagctatagctctttgtcaaaagctattgtagcatgccttttattagtttagcaacattgtaaggaaatccaccatcataaggaattttacaaacagcaccaaaaaaaaaaaactgattatttgtgagtgggatcgatggctctcttaaatggataaacgattcgtcagacccacgatttagaactttatgtcattttcaattttaatttattggtaccgtcgatttgaaaataagaataaaggaaaaaaatatataacgaaacaacatccaaagattcttctgataacttgaaaatgcaggaaattgatttctacaagtataagcatcatcagtcacgcatacagacctcgagtgtgattgggtatcattaagaaataacatgcgggtcatatttaataatgtaacttgacaatcatttattatttattaaatataataaaaatgtgattaagttaaactcaaccccatctctgtaccaaaagaaagtcctgtatcaacaaaactcaaccccatcttaattaattaaaaggctaaaagagagagttctaataaccctctctcctattaattaaaattagatgaaattatataaaagtataagtgagatctattaaataatactagtaagtaccagtaaaacagaattttgtagtttcttacaaattaaattata

SEQ ID NO: 697 - DNA, 2500 bp, Glycine max
  Soy_ogl_4531 Gm13:37913801..37916300 Cluster 2
aaataaaaatttgaattaccttaaataaatttgaaatcataaatgtaataacgaaaatatgaattatgttaaacaaataaattgtatttcattatatgtattttttttttattactgtatttaagaagtgtgcattttcccttaacatatataatatttatgatgtgataggaaaataaatagataaaaataaaagataccagtagggtgtttaaaatgatggaatgttaagtatcattattcaatgaaaaaccttttctttatcctgaacatgatttgtaattttcactttatctttctttttcttttacactgtacaattgtatattctacagtgtctctttggttttaatactttgtcagcttcttctacccacctactcttgaacaaagaaatttggcctttttattaatcgggtaatttctttttcaaaaatattaaataggagtagattttgaaaaattattcaattaagagaagtcatgattgaaagatacaactttatgtgagaggttatatgtgtatccacaacttctgaatttctttattttttattaattttgttgaagacgtcgcgattgaaaaatacgactttatgcaattaaaataatgtaattaaaacattaaaggatattatgtttctccttacattatcaaacatgacatgtgttgtgggtgtgaaggtcaagggcgctatttcaaagtgtccgtacttgtaagtcgtcttcaattttattcgttactttcttccattggcactataacacaggttctgctgttggttgtccttcgagaataatttattttggctccaagctcataagatagtctaagatactcgtccccacaaatcccttctcccttttttatgacgttgaaggcagtaatagtatcccccacattccacataaggacacagacactttgatattttatgtatcataattggaccaaaaaatggacttgtgatcccatgccactgtttatctctctaatacgtaatgacgatgatgagaacaattaatacatattgatatgaccctccttctcctttttcttctttgcccgccacattccattcaatctttataacttttgcactagggacaactaatgtgtgtatcagtaaatttctttggaaacaaaaatacgtatgatgatgagatttcttgtctctaaacataacgttagggtcccaactatgaaatgaagttgaattattgaatggatagataaagaattaagaagaaatcaaatcatccagtgccatgccgcatcccacaatcgattgtagtaataaaggtattaccgttactcttcgctaaatgatatatatatataaattttctgtcagaaaaaataatgagaataatacgtatcaaattcaatttgtaaaaaatattatgaaaatatcatcataacattaatttctaattcgaaaatgattatgtcatgtggaagatatatatttgtaggtttagacaataagagtatccttaattaaatttttggtttaaaaaatataattttctatttaaatttgtttttttttcctaaacaggtctttaaaaaaacatttttcttaattaactaatatttattgaatggtccttctgtagtctttatatattttattttggtctctcaaaatattatgatttttttcttttgtctaaatatcacaatttcacatttaatcctccaaaatttcataaatttttcatttcgtctctcatttaaagaaataaaatatatgtcttttgatatttaaacaaactaaatgaaagggatcatttaataaaaaaaattgttttatatatttaaaaaattaaaaatgaggaactaaataaaaaaataatgaacttttaggtaataaaaaagcataataataataataatgagttttaattttaatttgtctaaaagaaaatttgtgtcctattcagtaacaaaattcttatgaacttttaatgtattaactattttgtaacggaaaaatcttgccctaactgaaaaggagcaactgtaagcctcgtgacaaattgatggatgcacgacggcagtgtattatatcgatatagtacagtaagattacattattagaatgaagaagtgggataaaatattttgtcaaaaaaaaaaaagtgggataaagtaataaaagcggaaaacgatgaaaagcttcagaattttgtcaaatacatgcacaaaatcccactatttattgcagaattttgtcccgatgtcaagaaatcttttcctttccctttcgccttcattttgatttcgatgtctcgacagaagataaaaacctaaatttattacatttaaattaataacaaattttagtttaattattggagcaaccatggtcttaatttctattattagtctaactactagctattcgtttaattaatctgtgactaggctaggctgttttcacataaactattttttctttcctcgtccggtatgtgatgactaatctgattaacg

SEQ ID NO: 698 - DNA, 2134 bp, Glycine max
  Soy_ogl_6437 Gm19:38789467..38791600 Cluster 2
caagtaataacaattacacatcacaaataagtttaatgttgcataaaataataagttgaaatatataattcagaaaaaaaaaatacacgttaaatcaaagcatggccactcattgcaacatggcaagtagtggcatttccgtaatttcatccaacaagaggggcttttgccttgacgttggatacagtgaagcggaaatgaatccgatgcagtcttcctttgtttctccaccgcgccgcctgctttgaaagacgcgaacagaagtttcgtttggtaagtgaaatgacgatattaccctttggtgacaaagtcaaagaaggtaacttggactcaaagaaaatgaaattaatacacctcccacctgccactgctagtgaccgaaattgtatcctctaaacaattattgattgtgttattactttgtcctcaatgggtcaaaaagcacactctcttttttctgtttttgggttacaaccttaacattcgaggacaatcacaccaagtcacatgcttagggatgaataataattattatagggtagttaagtagataagcactcattagcggatccttaaaataaagtacagtaattaatttaattttagtagtacatgttaaatttgatatttctcgttgatgattatgcaagtgtttctatatttaaacaatattttaaccaattcataattctaacaattttatttttcaagaagtttttaaacaaatttagtacttggtgttttatgtttttaatattaaatatatcttaataatttatttctcaactgttagaagaacatttgggaatctataaaatatctagttatctatacatattgcaagacttaaggttaaaataatatcattttcatgattaaataaaaaataatattaaatttatatgaattagtaagttaattagtaatattcttaatagttgaaggacttaaatgacgtaacttaatttaaaaaataccaaatcaatatttgatctcctcccttcattaatattccttcaatagacataataattttctctctctatatatatcataagacttgaagtttcaaataacgtatttttatcatttaataaaaaaatattaagtttattgaatataataaaaaataaattattttaggggctattaaaaactacttatcatcattaaaattcttttacactacttttttttaaaagtgaatttgggtgttggattaggtaacactttatcataagatgcatgttacatatctacaaatgatttatatgtagaaattactatattcaggatttcgcacgggtcaaccaaataaacgatataacaatattcattcttaacatcaaaccccatctcaatagaatttattgcaaggaacgaaatattattaaaaaaaattacactagaaatttgtaattgcacggaaataaaaactaataatcattacagaaaatttagtcacgcaactaatgattaatatctgatcacacattggccctgttaatcattagagtggttttatgcctctgctttggtatgtatagcaaaccaaatctcttcaaattctagttttgtcgacatggtctttctatgtggagatagcaaattggaaatgaaaaagaatttagcgtatccaatttgaaaaacgaataaaaaacggaagtgtgtaaaattgccaatgaggttggtgaggggaagaaatattgacaaggtattcaatttgaattttgctggtgattttttattaacaagttatccttaagtgttgtcacatgttcttgttacaacttacaacgtaatgcgactttgaaatattgaaacgaatttgcttgttcctaaattttcattaagaaaagaagaaaacaagacaaattagccagctcaaatgaaaggcaggaaagttaaaaaagcgagatgaaaaaaatatttagcactcaaactgcttcgagttaatggatcatatcatatttgtgctttgtcttttcattgatgcttatttggtaggcctatagaatcattgatgcttattgcttattctctttcaaatccctttattttagtggtcggaaactggatccaaaatgtaatgaaagtactcatatctatggaacgtgaacgcatgtgtaggtaa

SEQ ID NO: 699 - DNA, 2300 bp, Glycine max
  Soy_ogl_6956 Gm20:43531301..43533600 Cluster 2
ggattttaatagtgtggtccaaatacgtacctatatatacatatttttatgtaaggtcaataagcaccgggtcaatctaagtggtcctctccatcgatcgatcttcatgaacgtaacacctggagagcagagcgtgcgaaaggggaggaatttttttaaaaaaaatattaagtgaaattttatgttgttttcactaaaatgagtacactaaaagagaatatcgaataaaattatcttaaaatattactaattgtcacttgacatgactcaggaattaacacgtatttggcaataacatatgattgttttgtttttattcagtactccattaaattacggcgagtttagttaacaaaagtttgaaagtccgtggctttttatcctatcaccgatgccatttgtttagtaccccagactatgatttttttatttttataatcaaagtagttccacatgttggttcatttgaattgtaggtgaaattaattaattaatttccgttttgagagtgagaagtgagaacacgagggttacgtaccctttatactcttctctgaactcgcattccgtaaaaaagaaaggatttgaattttgaactcgcatttcattggatttcattaatgtcaagattattgtccacttattgtatgttttctttctcattaaaaagcagatttgaggacatagaaatgttagtttgattctttttataaggatcaaatcccatatgaaattgaacacagtatatataattaataatatgatagatgagatttaccaattcatattttttatacaatttaccaattaataaggtttaagtgaagtggtatataagcaactaacttatatcaaaattgattaacaagttaattaattatcattacgtactaatgaagttatttaatgttggcccagcctcacataacaaatatatttaaagtgtgttcaccctcaataatattattccacatgttggtagagtttgggacagtggacacaatggtgggggcagaccaaatacttttttcttgaaatgtttagtttatacacaaagaacgtatagaatgtatagactatatcgagcctgcccaattaatctgcccatctgtattaattaatattatcatttctacaacgtacgaggctttttttgttaagctatgattagcaaagcttgagagttatttaggcaaccattttttccttctttaattgcaaatatgcttgaaaagggaacactatcttatttttaaagtaaaagtacatgacacatgcctctaaacaaagaaatcttagatattcacagcccaatactttcaataatttagatcttatctaaatttattataatatttaaaataaataatatgttgggttctttgatatatttttgctatatgttgtgtttttttttattggattacttgaattgatgaagcaccattaaagtgcacgagagattttttttttttacatattcacttatcgctaaataaagaaaacttttcgacaagaatcaaatcaaatcaaagccttaaaatagtagtagttaatctttgagactattttttataccattgtacttggtgttctcctctttaatttgtataaaggaaggagatatatgagaatatgatttagtcaatgtaaaacttatctttatataagggcagaagagagtgtaagggggaattaatggtttggctaataatgacaccacattcagtaatgttattccttccaccctttaagtcttcaactaaggtcttggaatcagtctcgaaaatgactgtgatatacggtataaggtaatttgcgcaacccattttatagtttgtaacaaagcaaaggccttcccttccttgacgtattgtgtttatagttagataataagttttcgagttatttaattttcattaaaatatatgaagctgatgttgatttatgggggtacaagtgtgaattgtaatttttttctcctaatttgtcaaaatgatgtaaagaacatctcaatgaataagtatgatttttaagatatgacattgtcttttcatgctacccaacataaaaaaaatggagtcattaactttatttctcttaaaatgttctctatttttctctctcttcttctatattttatctttatttacctaaataaaattgagtgtttaaacgttgtttttatttaattaatttgtaaaattttaagttgatattcttttaaaactaataagccacaaacaaaaaatgaaatataataaaacatattttgagttgtatattaaattgggtcaaag

SEQ ID NO: 700 - DNA, 1174 bp, Glycine max
  Soy_ogl_342 Gm02:3169901..3171074 Cluster 2
cacatgtgaagatggacccaattaaagctcatagtcaatactactactaaataacaatatgtggaaaacagaaaggaaaaaagaataccgggaaaatgacacaataaaacttcatgatttgggagatttaatgagacagcagcatacttgttgcgtgttgaaacaataggctctttaaattttgtgcacaacttcctctgttccattataataattcatttttaattttttattccatatcattaattaatattataatagatataagtgaataaaagtaattaatattacattaaaaaataattattttgaaatatttttttcttagataacatttattatgggacaagaatgtaataagtacttaaattataaaaaaatataattaattaagagattaaagtaagtcaaactttttttcataaattaaatatcttattttttaaaattatttatttaagctctctgtaagttcataaattaatgtgtataaattaatattagtttatggaaagaaccaatttattttcttttttttctcataaatatttatgaaaaaattatttatttctttaatcattgtccttgaggtgaaaccgtataaaagattgcacaaatttggttaggtcagcttttgagagtgttagttaggttcagttaaattgaattaagtgcttgaatagattggcagaaccgtagctaattcaagaatgaagaagggaaaggacatgaataaatcctctatgcttatttatgataaatatgttcgtttataaaatttgtgctttcttctataaaaaataaaacaaaattgtgctttccctttctctccttgatgcctctttctgctttagctttaatggcagaacataataattcagtctttagttctgtcccattcttttttctgtaactcaaaggagtaaggacctctgttgaaatcagaatggttgtagatgatgggtgacttttaatgtgcttgtttacaaagaaaatgaaaccagaagcatatctcttcttttcatagaaatttcaccttttttataatattatttttgagaactaagaactttgtcagctaaactttaatttattttattatacttatttatatgcaagtcagtcttaactttaattttccagcaaatttttcatcattagtgtaacatcgcct

SEQ ID NO: 701 - DNA, 1475 bp, Glycine max
  Soy_ogl_373 Gm02:4309101..4310575 Cluster 2
tcttataaatttcatttgcttcttcccattatttttgacattcaacacaagcatttctcaaagaaattttgttctttctattttttatttatcacatgcattttaatatccaataaatctcttcactttcaatatttatatgcttattctttaaagaatcacggaataccttttattagacaaattatttttttttgcttggactattataataaaagggtcctcatttaactttttgtaagatctactaatgcaaaattttgagtaatttattattataattattgcctcaattatatttgaaatcaaatactctaaatttatgaattgactgctaatactgaatgttatctattacaaaaatatcatcacctcatatattacattaattataattaataacctatataagttactaatgttaaaagatttcttttataattgtgtatgttttttatcctattatttatttattttaatttaagctgttcaactacctaattcaaccctaaattggggtgtatcaatacttccggccaatccaattttgaaaaaatgaaacaggctaaccttattcattatttgacataaattaatattaattttggatgagttgatccactttatcatccttaaccatatcttttgttcaatcatttgtccttttttttttttgaaagatcatttgtcccttctatatatatgtttttaacaatatttctcataaatttataaatagaaatgctgggaggcgtccctattttctcgtttcaacatttgttcttataagtgtggttgatatattcagctatatatttagcaaatgccggccggaagcattaatttttcatttctttcggatatatataggcatgactggaaccttcaataagagtctattgatatccaccttctaaatcccacgctaaattcagtaaaaaaataaaataaaaaaagttagacactaacaaatcgaaaaaataaatagaagagaaatccggctttttgcatgcatatattggttccacgactatacttaaaaaagataagttgttttattttgcgtccacgtaaaaatatactagggtaaccataaaatgaagatcatgaccgcaaataggggaacaagacgaatattgtgttcgccactacattccccttaacagtgctaataataatttgcagcaggtttgaaagacaatgtgtattgaaatgtaaacatgtgcttataaatagaaggaactataataatactgaaaattctggaaggataattaattaactatggtgtaatctctaggtttaaattatatatggagtcatgtatattcttttacccttttcatttttaaattgtactttatatttttatctaataatatttttttaacaagacctaaatgaagtatggcaatattaaagttttaactttttatataaaaattttactttttattcattcatttttgtcattg

SEQ ID NO: 702 - DNA, 1582 bp, Glycine max
  Soy_ogl_2120 Gm07:1810701..1812282 Cluster 2
taactagttttacaggtttaagaacagttctatataattggactattttatggtctattatatcaataagtcgtgattttaatcggtgattatttttattcagtagttgacatgcgatgataattaacttagtgacaaagccgtgctatgatataggaatatcatcatgattgtttaatatctgtaaaatatttggattttttttgttaacatgtttcgatcgattgatacatactgtaattttgtttaacatattctgcatgtgataaacttgtctatatggttattggttgtttccgtaaaatattttttaccaattaattgatttttcttattagttaatttcttagattattaattgcttttaccttgatatttataaccgtaatgaataaatctgtcaaataatccttgagataaaacactcattgattacttaatctaggaaattccttactttaatttgacaaaatctagaaagttaaaatttaaaaaataaaaaagtaataataaaggaaggaaattaattaaaaagagttaatacgtaatactactgttaataattattaactaacatacatatataacaaaatatatttaattaatataataaataataggttataacttatgaatttcatatatttagatacgtatgtaagacaatctctgccgtatttgcgtaagtcaaatatgtagcttgttgcattattacgatctcatacacgccgtgctgaaaacaaaacaaattgatagaatcagtgtgatgtgaaatttaaaatcatcatgcataaaaaatattcataattgatactttttcaaactaatggaattgtattcttctttcctttttctcttaatttgttaactggatgttgctgttgagtccaagatgttgacactgcttggaatgaattaacatgcaatcttatagggatgatggaatgaatggtaggtggattagttgaacaaacaaaaatttgccacatagctagcaggcttggggatcttctggatcccttgtgtgattggtaacttgaaggagttctccagataacttgggagtaacatattggataatggagactagaaatgtccatgtgtccctatctcttttggctattatttgcccttatcctgataatattgcttcctgacatgccattcaactcggagggaaaattgaaaattgtcattttcttaaattaggacagttttcttttagtagtatataactgactcaaacatgtatttattaagatttttttatggataaatattagttaattaattttttaaaaaatattagttagtagattggaatctataatctctttttttcttcttcttctttcacccttaaactctcttctttagccctcaaacatgcatttattaagattttaagttataaacattataaaaattaaaagagtattttaatattttaatttttcactcacttataaattgctttatcaaatagaaaatagactcacatatttaatgaacataaatataatttaataagaattagtatataaagaacaaagtgatatgttgttaacatttatctctttcc

SEQ ID NO: 703 - DNA, 2186 bp, Glycine max
  Soy_ogl_2932 Gm09:1554615..1556800 Cluster 2
caataaatattagttcattaaaatattatttttttgttaacaaaaataataaaatttgtgattttttttatttattttaaccattcgatgtatcttatatctcaaatccactttcacctattgtacacacatggtctgatcatgttagggatggtgttgggggattagccacagactcgactgaattattaactcatgcagtaatttttttttttataatttttatatatatacagtacttaatttgatttgatttgattctagtacattgttttggagatatgattattaaacgtgcaatgtgcaaggttcacacaagggccatgcagttttttttgttattttttggggtaacttaaaatttttcccgcaacgtgcctatcaagaaatataaaataattatagtattagtagtattcatggtcagagcctgattcaattgaaggcaccaactcggtatcgaaaagagagtgggtaaatgggaatagtcagaaaacaacgtgaatcgaaatggcaacatctgaggaccacgcaacattggaagttggactctgaagaaatcaaataggaactcaagaaaaaacggggcatgaaaaaaaaaagaataattttaattttttccctaatatttttaattaaagctttacttacttattaaattaaaaaaaaatacagacattttatattctcaaaacattctaataaaatatatttttttcttttattgtgttctaattataccgattaatatttatcatttttaatgtataaattattaaaagagttaataaaagaaaatataatactattattaggggaaaaaacaaaaggaaagattagcagaaagggtacgttagtagcttgtgtcagggttatgaaagttaagttggggtaatccgaaaaatgatgaaacaagactctgacatgggagaggggtggcatgaggacaaaaaacgtagggctaaggctggacctgaaggtacttacaatttaatttttaatatatttcactgtgcattggggattgggtttcttttggcttttaaaggacaaagggccacgacaacatcatgatgacaataataatcttctgaatctgttaccatgagttaatgttttgaaagtgtcgccagtggggttggtttctgtgtctccctcataaaataaaaactgtcctcccaaatccaaatgccaacagtgctgcatttgttttgtctccactcataagcaccaccaactcctcctgccccacccccttcctcttctttccctttcagtttcattcacaatctacaaatgtggtcatcttcatcttcatcatcaacacaactatttcacccacaataaaattaaatacatttacttatcccaccgtcattccataaatgaaatgatttgtaagaagttatgcttatgaggtgaaaggtttttttttttttaacctagaggtctcgaccaaaaattcctttaagtagtgagatttatttatagactaacttttcttaagagatggtttttcacacacaagaatcataaatagaatcccttgtcaatcatgccacattatattactagtgtttgaagtgagaggtaaaaaaaaagtcaaatatatttgataaaaattataattttataaatctaatagtattttgttcaaatattaataagtataactgccattaattaatgacgacatgtgaccagagcacaatttactggttacataagaaaggaagagaaaattttcattacgtaactcaattacaatacatagatcagtaagatttattgatatatcgctgtgattataaaatttaaaagaaaaaaaaactgaaaattttcctacatatataattcttataagattatattatcagtattttgataattttttcaatttcaaaatttcaatacatccaacctaattcggtatacgctatattgctataaacgcataaataaaaatcagtgggatatatcccaagcttgtaaaactatgataattatgaatatagttgtgatgtactctgcacggtgtatagacagctattggaacagtgatataattaaatatattttcaaaagacactttaaaaataaaataagtaaaaaaaaattacactcgtatctaattataaatttaatgaatttatcaatttttataataattatttgctatccataaa

SEQ ID NO: 704 - DNA, 2275 bp, Glycine max
  Soy_ogl_2939 Gm09:1766423..1768697 Cluster 2
gagatgattaatttattttaagagtaattttttaattaaaaataatcttatttgaattagataaaattattataaatagagagtgatgatattattttcttttaattttccattgcattatactctcttgagtgtgaaaccagctacatctctcgaattcagagcgagaaagttttagcatgtttggaaacacatcaaaaaagtgatttttcatatctgaataaaatatttgtactaattctaacttgtacgtttttaactcatttgtttgatttgttggctgcgtgatttcaaacacatgctttcctcccaacaaacatctccaaaatttgagtgtttattctcttaatacaattcatctatcaagttcaactctagtatttcggaaaaaatgattgaatttgataatacccaaatatacacaaccccactattaagacttataatagtcaattattgaggtatatggggtaaacgtagttgcatgtacaacctgtttcgtgtaaaacgtttattccataacttcttttctggaaaaataataaaatcaactaaaaaggaaaagagtagcatagtttgacttctgtgttagagagagaaatcctggtcatatgttaattacaatccatacgcaaaatatttgcgctatattgaaaaaattataatatatatatatatcataggtatactcaactatatggtatcccataaacagaaattgtagttttcttccaggcaaataaataacttaaaatttaatttctgtttagctaaaaatatccaccatttttttgtgcgttatttgatatccacttaaggtcgttcaaatgtatctatttacagggaggaggtccatcatgatcagttcaattaggaagaagggatagcttaacagcaaacagaacccttgcaattctaaaccttccagcacgctcctccacagtggatgaacttaaagattcctttgctgctcaacgtcttaacaccactgattttgttacactctcacgtatacacaatcaaatttatttactcttaaaatttgagtttgaacttaatatttaatcccaaaaactaactgctggtttgctcttaagagtttattttaacgcaaccaacgagttggtgctgaaactttccctccgttgcttttgcatccttgcctcgaaaagcatgaaatgcccgttgaacttatgttcaacagttatccaaacatacactaactcttaagatgataattaatatattaatttttatttatatactctattttttactatatcaaatgagagatttttgacatttgttaattaatagtaactagcataattaagtttttgatatatactattacactacttacataggaaaagataaaagtaatgagaaaacaatttacatgattttttttaaaaaaaaatcgtaactaataaactttttgtgactatagtattaattatgaaaaagcaacttttgtcattaaacttagtcaccattaatgtttccctaggtttatttcaaaccattattatgtgtatatacaggtgctcatatatacgtttggaagagctcactttagcacattaattgatcgattatacaacttcaatgacactgaaagtcctggtccaactctgaacacaacttagaaacattgagtgagatatgcccccagcaggatgcaactgaggataattaacctaaccaaattgtacctttccacacctaatcaatttgataacaaatactactctaatcttcaagacctcagtggcttaattacttcaaagcgaccaagttaaagaactgttctccactaatctgatgctgataccattgaccatgtgaatagctttagtagtgaccaaagtgttttctttgccaactttatagtttcaatgataaaaatgtgtaatattggagtgctgactagggatgaaggagaaattcgcatgcaaagtaattttgtgaatggagtttcctctggattagtttggtgcggtatccaaagttcctaaagacaagttggtagctcaatccaaataagttaataatgcggatgtgctgtaaaggcaaaaggttgtaaatctcttttgctttgttgaataaaccaaagaagtgtgtccatgccaatgcgatttttccatgtacctcttggcatgttatgtatttactttgaatctcatcattccatctctttctctctaattattcgagtaaaataaattctatacagtattttgttcaaatgctacgtaaaaaattaaaattgaac

SEQ ID NO: 705 - DNA, 2104 bp, Glycine max
  Soy_ogl_4481 Gm13:36225097..36227200 Cluster 2
gtgtagcgggaattattagtgaccaaaaactaattttcggcactaaatttggtcattaatttgttttttttttaatttagaatctttgacgtaagttgtaaaaaaccaaaatctgcataagctttgagttataatttgtctcacctaaatattgttagattcaattcacatgcgtcagggtttttattttcctgaaaaactatagcaggaattaatgagtcatggtaggttgtgccaattcacgacgaaatatgtcaagtagtttatgagagtttgttttggactgggcttttaggcagacccaatcatatgggcaacttaacaagaatgtacattaataaaattaggaggtataataacaagtacccagcaactaaacaacaacctctttcaaaactgattgaaagcccatattgccacaagcccaagttttaaaaatgtgtatgtttaggtccaaacaacaacaatgataatatattaattatggactttatagacttactgtcattgcatgaagtgaaaatattaggtatgtttgttctcctttaaaaacttattgtcagttattagatattttggagaaaggaaatttctttgtattgcatattatataatgaaaaaaagaaacgctgagcagcaagaagataatctgtaggaaaaaaacgaatttctgtgattggttgatattttatattcaccagtccttgtttccccccaagcatacgttgttttcataaaaaaaaaatcacgtgttcatccaggtgcttcgataaattaacttttgtagcaggtcctcttctaaatatctaaaatttgaagcatcttagttaaaaattttcttgtttttgacaagaatctatcaatcattaaagattatgtatatcaatgtgaatacgaaatgagaattatcggggaaaaatatctatttaaacattcaaagttaacatcacctatatgacttatacgtttcgtatataatttttgaatttttttcaaacaaacaaactcatgcaacatgaagtcgcccgcaagattagaaacttaaacttgttggggtcttgttttgttaaaatctcccaaggaatcaattcgttatagacaccggactttaagattgatttgtaatgacgtaagcgtacaacatcaactaattgatttttttggcatctcaaatgttttcaaaaggaaaattctttcaaaaatcaaagggaaaggaataatgcataattgtgtgtttgtcaagaaagatctctgggttgttcttttaatttgtcattgtgtacatacttagacagtgacttaattaagaacgagagaaaaagctatgcatgtattgttattacacatttcaacgtcaaaagacaaagtgaaaatggaatacacacagccacatatttttgttttttttttttccttgtgtgacggaaaggcaaaatttaagcaaagcatgatttcggatatatgtgaccatattttccattttcctttatttgaaagctagctgaagagtttttacttatattttagaagggccaatccaataaaaaaatgttgatttttattttgtataaatgatatatatagttttgactgatggtcagtatcttatttgagttagaaaattttattaaatatttaacaaagttaaatatcaagaatgaaaactcaagatgacatgttaaattgaaataacctacattagttgatttatgtgtaggttgataaaaaaaagtgatactttaatgtagaatagaccttcccatttagtaatatcatgaaatattgataaaatcggatgacaacttaatgaatatatacagagctaaaaaaatatataacagcaaactaatgttgcccggatgccaaaaataaataaataacataatagaaatatatccatcaacaaattgagaatattcccttaagaaaacaaatgaaaagtattgtgtaaattacaaacttagcatgaacggactgatggactccaccagcacatgaaaactaaggaccaaatcacctttagttaattttgctaagacctggatgccctttaggacaaagtccttgtaccatgtccaagaaaaagttgtatttgcaagcatgc

SEQ ID NO: 706 - DNA, 2069 bp, Glycine max
  Soy_ogl_6426 Gm19:38539201..38541269 Cluster 2
ttaatgtagtgatttgtgaaaagggcagggaggcaataagggctatttaagcatgattactgattaacaaagaccaaagttgggtatttttttagtgcataatgagaagtttcatgtagcagttatgtcccaatgatggtatgaggggcaaagggccatggctttgactgaagagctaggtgcaatagagctaaaaagtaaaaatgtaacaccaaaaagtgagaaattctagttgcttgtggagcaaagaattcttttctctaatcatatcgcttgtactcatgacgacattccccatctatgcatttcatctttgcttcttttaatccaaagcagatgccactcaataacatttcccaatccccatcttttaaagcgttaataaaaaaacagaaccaaaaaagatatcaactccaccccaaaattaaacaccaacactgaaaaactatgctgcttaatcacatgacgtttcttcaatttagggggaaaaggagaatgtacttcttcaaacttttctatacgcacaaaactagttgtctatgaaatataatgcttggtttgaattttttttttttttactgcaaggtttgaatattttagagagaaacagtattttttttttgttagaataattatagagagcaacattataatgcaaagcatacagtagagaatagaattgaagtcaggaacataactaattaggatttgacaaataaaaactagcagcatggagctttatttatttatttattttctttagcatgcattatgattccactcttctgtggaatgtaggtagcatatcatatataatgatattctacctttgattttcacacacaaagtctcaaaacctcattctatattacctttttctagctcctcctctccacttcctacacaggaaatcacatatatatttgtgtgtctctctttatctgatttcttccaagtacacgcacacacataattaacatgatgggatctcatatcaacttctaatagaagcttgtataaggtgatgatgaaaggggagaaagaaacatgcagtcgatcatattttaggaaaaaatctacaatttttttttatacattaaatcattaaaatggcattgtttgatttttttattgaaaaaagtaaaaatattcatcaaaatatatttaaattatattgaaattcaattggccaatgttacaaaattctaaaacaaatgaaaaagtctgacttcattgcatagaaaaattgttatggtagacacttaggctatggactggtctattccttaggaaggtccaaaaacatcactgtaacttttagtctctcattcaattgcggttctggcgagatcttactcctagctttcatttcacgccacggtgccgaatgttgcacagtctagggagctcggattttggtatttttttagttcaaatcacataaaaaatgaaggttttagaagtcaaatgtttttttttcgtgtcaattttgtctgaaattcatctctcatgtattttattaatttacattatcttttatataccaccttcaatattgcacagtgttccagtatgtatgatggaacctctgcgtaggaatcaaaacaacttgtgcacgggtgaatggtgtaattaacttttccaccacaaaaattatgtacgagttactttttttggaaaagataactacttcttaatataatattttaaaattattttagaaaatttattaaataaggtattgtattttaaaatgcaagttattgtagcattgtcgactcatctatttcattagtgtgtgtgtatatatatatatatattacagcataatcttcctaatatgtcttaattccattagtagtagtagaataaaccttcctaatcatttacattcttgttagtttaaagtaagctatttaatattccttcaaaaaggaaaagaaaggcaatggtattcaacagacatgtgtttccttcttatattgatcaatggcctatattgatcaagttgaataaatctaattaaaaaggtaaaacccttccaactcctatttttcctgggtagaccc

SEQ ID NO: 707 - DNA, 1800 bp, Glycine max
  Soy_ogl_6870 Gm20:39525801..39527600 Cluster 2
atttttttataaaatattaggaagaattgtaagacaaaaacaataagatataacattactcttataaatatagctttaaaacaaccattacaaaaatatagtatttttaccatacatgacaataatcagataatatagtaaaaaatatttacacactatcaatacattataactaattaaattcaatataaaaattaagctatacagaatattaagattgatggcaatctgacatacgtataatttttttattagtattattttatattcatataatttaactgatgtcatcttacttttcttattgctctattcagtcaactcatctgatcatgtggtataaaagaatatattagtttcggatatttccgacgatatagctacgctacgcagaactttatgacatgcatactttttgttttaccataattattttatattcagaaaaaaaaaaccataattattttatattatataatttttactgttacattcaactaatcttatcttacttttctcatactattgaggtataaaggaatattagtctggaatttctgatagttgtacagaattttactatctaataatcaacctgtggcatagttctgattggactttggactcagtataacgtatagtaactacatttcaaggcgtcctgttgaatagatcaaattttggaccaacttcataaggagattattgttggaaaaaattgttgaactattacggcaatcaaatttaaaagtgggaattattaatccaatccctgcgcttctgacttaatctcttcatacaatgaagccaacgtatggcaacatgcattggcaagctatggctttatgtatgtgtttattttaaaagataaagtgtaaggttacaattctgttgttgaaaattaataattacaattataataaaatttatatctataaaaaagttaaagtaaactagtcatataattaattaggtgaagaagtgcttaagtggtcggtgtcatgagaaatctactcctaaaaaaattaaaattagacttcattagaagagaaagacagagaaaataaatcttcacgtaatgccttttaaaaatttgatgtgaaaataaagtatgttaaagtgtgtttcaaaaaaaaaattagaagcttataaactatcaacatttgatagtttgtaagcgaaaagtcagaatttgaaaaactgaaaatttcttaataattggttgaaaattactaaatatttaaatctaagattatttcagcttaatcataattttaaattcattgagtatataacttacattaaatgcttagagaaagtatttgaaatagatgcaacttggaggaggaaacaactaagcattttctgttcacgtgtcctgttgcagttaccatttgaaatagatgttatgcctggttggacatcaagactgttcaacattgcgatccttagaagcacttcattcagcatgatgttctgtctttggcagtggagaaaatatcaaatggaggactatttggtgtgctgttgtcttgttcagaggaacaacttgttgtttaggaatgacgaaatagatattgaacaagtttggaagatggtcagagttcgctcatgggcttggctacatagcaaaacaaggattttccacttctctatgtttgattggtggagacaaccgagtttgggcttgaaagggacatatgggtccttcttgtaatgcttgtgtaggtgatgaggaagagggattggctctcaatttggtcttccctgatgtgctgtttattgttttcttttggatct

SEQ ID NO: 708 - DNA, 1886 bp, Glycine max
  Soy_ogl_1754 Gm06:923315..925200 Cluster 2
attactagtatagcttataattaataattaaaaaaaacattaaaagaacagagacagtaatagttactttaaaatgacgagtgtcgcctactcacgttgagtgacaaattgaaatgacggttttaatggcaatatacgcagaaaagtattaaaagtaataatggcattattttaatccacaacaagcttactctatttagtaattttagtgggtcttcaaatcttccggtccccatttatttaagcttcggggacctttgcttattggagttttatgcatatacttccaaattacacatactaggttttaatcatttttagaaaggaattattacacacttaccatggcacgtgtgattgatttagacggaagatatccttccattccttgcataattgctttgtttgggagggggaagtggtcacctacttagatggtggcattaaaccgattctagtgctcctgcttatggcttaccatcgtcatggggactttattagtgaaattaacactgctccatctacccaaatctcatctagttctgtcccctacacattcaatgaattaataatgcacgtaaaattactacactataatattgttacagacttacagtgactttaatttctattattttttaattattctttattcacttctcaattttttttttaaatcagcaaaaacatatatattcataggtaggcgaaccagagtagtgagataccaatagaagcgtacaaattaaaaaacaaaaagccaaagacttagaaactggttgccaaatattcacttctcaagtatatacgatagtttaagaagaacttaatatagattgttagcataaaatttttacaccatcaactagttagaaatttatgatttatcggtataatttttaaaataattattataaaaataataaatttattatatatgtcagattgtgattaaataataataatataaaaactccttttagaagaataatataaaactcttatttatatattaatatatggtttttcccatctcaaactctaactaataatgctgatctcatcttaattacttgtgtgacaactaactagttgcactcatatgagttcaactactttcgaaatgatacagtatattctagattcttaattaggagtgcatactttaaagtttaaaatacacaaaataactatttaaattcatgtgtagggacatagattaaaaagaaaaaggaaaggaaaagaaaactatgtaaagaagtggtagaatattgattcattgtccaagctactactaagaatcaacttaaatttattcatatgatttcacttaattaatgtttaggtagacgtggtagtgttgggggggattcatttttaactttactttgcctaataagtattaatttgatggattggattggagaatcataaatccgtttaacttgtattgtttaacctactaacaaagtgtgtctagttggttacaaattcgtatcgtatatattcacatgtttcaacgtcaaaataatgagatttacgccaaagttaacagtatttactagtatatatgtctggaaacacgtttatataggacgtggaaaataacatcaatgaactctttgttataaatttcacattcatccttaaattgacgtgaaaaaataatataggcaagaacatagtctatttcaaacttggcaaagaaaaattcattagatcgaattagattgatacaaaaaataggtgtataaaataatatattcaaacacaacatactaaaaagaacttcagcaaggaaacaagcgagagggtcgatgaagaaatgcttgaaattaagaaatgcaaaaataatttattatgtaaataaatattatcaccgacgt

SEQ ID NO: 709 - DNA, 1663 bp, Glycine max
  Soy_ogl_3236 Gm09:40552801..40554463 Cluster 2
gaactttttcaagaaaatatagcattactcataattcaatatggacgcttgtgttaccctggcggtgtccattaattaatgaaatatttttatccattattaacaaatcaaatcagaatctaaccaaagacaagttataaatataaatcaaactaaaaatgatttcatccaaatttgagcatgacaaatgagaatatggaactatgtttcccaaataccctacatcctccaacaaatgccgcaccaataattatataagacgtttttgaaacaacaaattacgtagggagttcttcagattattttacgttttatatatctgttttgtaaaattcaatttcatctttatgacctgaaaaatatacatccactaattacaacaatatcattaatgcatcgtagactcaacaacgtacgtagagcataaactttattagtgacatccaaatgttaataatggtaaatttcatggccgtctttgactactaccacagaatctgaaagcaactaaataataccagacaaccactcgctatgcatgtcaagtatctgtgcagtttcttgttagacttgcaacagatttaaacaaatgttatttgttaatatatatatatatatattgttaataccatcatttttcaattacacccaaaactgatggaccgcaaatgaatagaaaattatcaatagttgagatagaaaattaaagccatagacaatgaaaatttatgagaatttatagtgattacatgtagttataatgtatactctgagtggttagaacttatgttctataataaatgttgaaacttagaaatactcttatatcctaagtctatgtgatgatcaacatatagatgtattagtgtagtgttctcaattatttattctttcttcaatagaataaattcttttaatatataatatcttcttcttcctataacatcttctattttgttatctttttcttctttctataacatcttttttatttaatgtatattattagtttattcgttatacttgtaatcatatattttaaatcaaactaaacattaaaaatttaacacataattcataataaaataactatcaaaagaatacaatgcctttaaatgaaggatggtctcatttcttgaaattttataggattatgtttgtttacaaaaatatgtacaaattttagtgtcaacaatattaaaaatatgatgtcttcataatatattctactagtatattacatcatgtaatcatttaatatatgtatttctcttcctctcatctaatcttctttgtctcccatttagtttcgataaacaccagacaaaatgaattagatcaatttaaaccaattccccaggttttgaaatttagattttgaacactaattaaatttgactttttttatttgtttagtctatcaaagctctcataaattgaattttgactagacttggattttattttaaaagtttaaattgaatttggactttttattcaagctatagccttacgacttacattaagattatgattaaactcgacttaaactacttatgaaatgcaggactttgactttaattttttaacacaaattaaacgggatgttttggtccaatccaatgattaatcactttggagtgaacttgcaaacaaaagcttt

SEQ ID NO: 710 - DNA, 2200 bp, Glycine max
  Soy_ogl_3318 Gm10:2301601..2303800 Cluster 2
tctcgtcattatcctaatcctaatgccttttctccattaattttttttatatagacataacagtggctctacacatgcaaatatccattttgcttctcaaattgcagacattacccatgtatagtacgagaagcatttaagtgcagttaagtacaaaatcacatgcattcattagaggtcaactcaacacagattaattgactgatattgtgcggctccccccttaacttttttcacactactacattagtggtcagacaaagggggacataagacatcaattttactgtacccaagattagttttgagacatataacaatgctgtctataaaggaattttattccaatactaaagtaacttatgtttataaatgctgaaattgattaaggcaagaagagaggggcctagaataccctgtgctgattttggcacatcatactcacaatgtcttcttaaccagttgctctctatatatattaagaatttaatttaatgcacgaaaaacagggaagttaaatgtgaacatgaggggagcccaagggaaacaaattaatatgagtaaggaaataaagaggggacaagaatatctgcggccatacacactttctccccaaaagttcaagtcttcataatcgaatatgcttacatgatactcctttcatggttctaaataaccaatcataggaaaacattataaacctttgccagggttgtgttcagatattttggagcctttggcagaattaacgccctttagtgtaatgtaaattattaaaaataatcatttttctaatttcttgagttctaaaattatttatgagaattttataataaagtaatttatcatttggcttccaatgaataatatagttaatttattcaataaatattgtaacattgtagatctaaaggtaggatctaaatgattttaaatttaaaaaataaattataattacaatttttataggtattatataccaacatacatatgatcaaaatgaatataatattttaatataacttaataactttatgacgtataaatttcttttgttaaaactccactcaatactctgaatttttaaaataaagtaaaaacaccaatatcaaaatgtttactaaatttaatagataataaataataaaaagataggttttaattcatattgaaaataattgattattacattgggtcagttatgaattcctgcacattgccccatttaccacactccacttcaatctcaatttgaataccattcctcgttatttatttcccaaaaaaaaatgcaattgacatttcactcttgcatttcaactatcataataaaaaaaaattggaatctaactcacttaaatttttcattaaaaaaaatctatattacaataaaatgaaatagtaattagtgatatagtctcaagaattgtgggcatgaggcaattgccttgactgccttgccgtatacgcaactttgaattttgctaaatttgctttttagtatgtgaaccctaaaccttcatagatttcattatcatctatccttctattttagtgtatcgtttactaaagcacaggtttgtattttatcattggttttttctacgaagaaaggcaatagattctcttttcatgtgaatcaactagatgtagtgcagttcatcgacaaaaatattttagattttatttagttaaactatttttaaaatttaacatgttatactatcaattggagatttgtaattgagtatatatagtgagaggaactaatcccccaaatgatgacaaacaaaagtttaaattttcattatgagaaatacctacattttgtacctaatcatgtcttaaacatgattgtctacaaagagaatacatgtgaagaacccaaagaaaaaactaatatgttacatatcataaaaataaaaaatgaaaacaataatgatatttgctataaagtatataactttggtgtatatgctaaaactattaacaaacatttttaatacatatatgtattcttatccacaaagcgttataaggatatatttgaaaattaattacaagttaaacataactaacaaagctaaatcattataaaaccgtgagacatgtacttcaactgcgccgatcgaaaaaaaaaacatatacttcaactgcatggctgactttaattttatccgagtattggaaatcagggcaa

SEQ ID NO: 711 - DNA, 1300 bp, Glycine max
  Soy_ogl_4914 Gm15:8405501..8406800 Cluster 2
ttgatatggatttgttgaatttcctcgattgattacaacctggggccacttttctataataataaaaaaaaaacatagattattgaagcaattattacttataagtggctcacacatctttaaactctaacggtgcaactgtgtagcaacagttatttaaataaataaaaaatcaagaattcactgttaaatatgcttttagtgtacttttgagatctcaaatgatgaagaaagcttatgtacccatctaaataattgtacgcggatactttagatatgtttggtttagttttcttagaaaatatatcttaaagattttttaaaaaaatatatctcaaaataaaacaattttaacctgcatttatttaaatagtttttcatataaaattatcatggaactaaagaattctgtgaaagagttaccgaataacgcagtccggtcaaaagaaaattcaaatacaaacaaaatttatagaagctttgcagcttacccaaaaaaaaaaggcttgagtaagttgaagtataccttgatttagtattaactattgttctttttgttattattatatctaaactaattaagatcaacatcctgtattaaaaaaattactaatgaatcacagtattgatttgattttaatatttaattatttcaattcatgcatttgaattgtaaattaagaccacactacgcctgaaattgtttttcaaactatacgtacaacaattttatttccctaaacttagtagcaaccacagaaagataactaattaaagtgaagacatgagatatcaaaatatgcatggggacagcaataaatgcttttaagaaagatgtgctttaatctttagttgatccacaagatagtacaagtactactagtatatagagtaacgagtttcaagtaccttacaaagacaattgcttcaacagagataaatgaaatcaattaaatgtggtttttgggtgtacattgcaaccatacttaataaatataaaattattgaatgcttgagttttttaagatattaaatatatttattttgatttaatattttcattattaaatattttaaaatttgtaaaaaaaatagtttaatattactcgttttaattgattcataaatcgctaagaaacaacttctaaattacttgggataagcacaactacacctagtcattctactatcctaaatcattatgattgattgattagttcatgtttagtacatgcttaatttatgggggaccatacccataataattaaagctatttagcttagtacttcaccccgcaat

SEQ ID NO: 712 - DNA, 1881 bp, Glycine max
  Soy_ogl_347 Gm02:3372946..33326 Cluster 2
attgtatgagaaattttcactaaaaaatctgtccagatttaatatttaatattttttaaacataaattattttcatacggtagtttattgaaaataattataactgtactattaaacaagtattttaatgaatttaaagattaagataatgatataaaattttgttgtatttatatgaataatttatttaataaaaaaattcttatttgattttcatcttatatacaaaatttggttagaccaataacattcatattttataaataaaattaatttctaatctaataaattaaacaatacccgtaatctttcacccaaaaaaaaaatctctcacattaggaaaaaagtattttaacgaaaaatgcatataatatgatacagatcataaatcatacaatgcattggttataaaagagagaaaggattggagtgaagactgaacaatccatccatcaatcaatcaaacttgtaaactgaaaagaaccaaacagttacttataagcaacacgacagctagccaagtcagtcaacacacaacacaaacatggacaagggatatatagtccgtaatcttcgtaatcacatttgagaagtgtctactattacattatcttacacacttctctaatcgtgtttttttattcattaaaatttattaagaattataaaattataaaaaaaatcgttaaatagcatgagaaatcacaaaattttgagaatttcaatcatttttaattaatgaaaaaaatgcatttaaaaaattgtgttcccaatattttcatcatattttatattataaaatactacagttttatgtatttcataaatgtttcaaaaaaattattcgtttttctgctactcatcaatttcacgtgaaataactctttgggaaatctttactgtaaaatttattaaaataaactcgtttcattaaatattatatatatgatgtaatattaaagcttatataataaaaatggattgaagtgtcaatttgagttgaaataagtagttaaggatatggaattaacttgaacttttttacatatggaatgaggctaactaaatctcaaaaagcaatttaaagagagagaattgaccaactttcatatataagaaactctctgattttattcctaattaaccaagaacaccttaattagttaatacacgtacacattcatgtaaaatttacaaaacacatacgaatatacgatagctaacgatttaacaaaagctagatttggaaggatatgatatactattcaccaaaaaaagaaggatattatatactgtgatgattattatgaatctataaaattgaataaaagtatatattgcgacattaaatggtaaacacataattggatttttataatcagtatgttgtaatttaaagaatttatatacatttttgagaaacaataatgtaaacaaattttacataacagtacccataaattaaatttccaacaaaatgtaaatgttaatgttatgcaacaaatttaagttttgagtaaaaaaaaaagtgttggtccaaccttagaggtccaatgttgcagggttcacctgctgctttgtagcctctggttttggcatcttggaaatgtacttaccatacttccaggtcgttccacacgtgaactttgtcccaccattttccttctcttgttacaaaagactcaattacgatgaattctgtacacgataaagccatttttaggtcaatcttttagtcattgaaaaaaacatttccttaaaaacgtaaataatctgtatattcgtttgatgatcttggataattaaatttgggacccaagacggatgggatgataaaacttttgtctgacttgatggaaagacatgattaaattatcgatg

SEQ ID NO: 713 - DNA, 1404 bp, Glycine max
  Soy_ogl_692 Gm02:46239897..46241300 Cluster 2
atatatctcattaatttatttataagttttaccgttcatcattaatattaaaaggaatataagtgaaaaaataataaatattacattaaaaaattaaaataataattattttataataattttctaatacaataattataatgggacgagagactaacccttaaaaaatttatggccactcagtagcttggacccgctaattaatggagaaggatatgcaagtggcgttcttcctgcctttggttcacagatatgtcccaagtcaattcggatttctctttttattttttatttttttgtattacagaccaattttattttctttggattgcttttcaatttgagacaaagagatgcgatttatatataaaaaattatttattataaaatggcccattttggtattgcgttaaaaaaattacagtagttttattaaaaaaatattatttcgctgttattccagaagataacataatactacttcaatctctttttaattgaagtttgtacattttttactcatctgttaatttaagaaataatataatattataattattaatttaattaaacttctatcttcacttgttaattattttacttacttataataaaatcaagtaatagatgattaaaaagcattactttaaagaattaactttgatgttagtcttttttctacttatcttctcacttcgaatatttcaatgcactaataataactatagctaaaaagggaaagggtacgttaattataattattttaaaaaaataaaaataattttaatacagataatatgttaactatatcttttattaagtattcttactttaaatgacacttaagaatacagtgaaataaaaatttaataagaatatttctctttaagataattcaaccatttctcttatatatgtctcgtaattattatgataactaaaagataaagataaaaaaaaaaaaaaacgatgttccaatttgaggtacaaaagtctccaaattttttgtcaaaaaaaaggtctccaaattcaaggaatgcatacttacaaaaacctatttatacatacagagttgaaagaaattagtttttgttattagtagtaacactaaaaataaatcatgttattgatatatattttatgtatgaaaactttatggattttaaccaagcattttatacaagggacacgagtcagttgcaaagctcaactgtcatagtgtttgttagttacaggataatgtcactatcacaaaatgaataaaaagtaattatcatatgatacatggcatgctagacaaagccaattaaagaagttcacgaggagtgatcgctccttttaactactatttattgtccattaattcttaagcatttcctatatatttaccttcgttttacagta

SEQ ID NO: 714 - DNA, 1700 bp, Glycine max
  Soy_ogl_3344 Gm10:3197201..3198900 Cluster 2
gtcaaccacacccttttaagtgtctgccatctttatccaatgaaaatatagccaagagtagaaaatcacgcatatcatttatgtaaacaccatcaataatttaggccctctcctcgctagaagaggacatttggtttcgtgtaactagttgtctttttcgttgaaaaatgctcacaagtcataattatatgatcgtgacttaatttgtcttttttatagaaagaaaatggataagaagaagtcggaaaaaaactataagcttgtttaattagaagaaatatttttaaaaaattattttcataaaaataaaaaatatattttgttttttatttcttattctaaaggtgtgtatgagaaaaggttatttatatgtatgctggtattaaagaattcaaaataaaataaaagtaatgtgacatttttacaattatttacagaaaaaaaaacgtacgaatcttacttaaacagtataagtaagttagtataagtaagttgttataaatctaattcttagacataaaaaaaactcaagtgagctttacatttgtaattgctcggatagagtggaaataaaactgaaaataaaatatgacacttatgaaaaaaattctctccttaaattgagaaaaaaatggaaaagaaataaatttaattaaataatacaattatccatcttttttattcttattatattaaatgcatataaaattaatttaacatatttttcttttttttcacttttcttttcaatcatataagagaaaataattactttatttaatttattttctcttgtttctgcatttttttctgttatgttttctctctacattataaaaagctatcagatgcaatttaccagttaattgggcaatatatattatctataaatgtataaatacaataggctagtttcttacagaatatttgaatcgaaatgtccaatattctaatgtccaattgtatctcaaatagagttatttttgggggggaaattctgtggggaaattaaccaaaaaatatattgtttatgaatatattttttaagaattagttaacattctgtagataacatttaccggtacttgacattgtttaaggatcgagtattgttgtatagacatatattaaaaaaaatctattctaaaatttattttaaaagtaaatatttacttatttcaatttaatttaaagtgcatcataacttaatttgctaaagaattaaaaataaatgtttcattacttagaaacattactcagattcaaattatatgtcattaccaaaaaaaattatatgctctttgaataatatattatcaattacgcaaattattttcgtcatgattttcaagagaaagaagtcttaatcgaaaaaaggaaattattcaaaaatattgttgctatacaaagaatttttattgtccccactcaccccacaaatatctttgctggggacattgacatgtctttaataatggcatctataagtgtcccacatataagtgcaatggagcattttgtcgttgcatgtctgcacattaaacgcttccacacaaatatgtttagattcctgcagtctgtacattaagcacttccatactcgaatttacatatcaagtgcacaaagattatttaagtttaatggattggtgtaactgtaaacacttgatgctggtgtaaacgaatcctatatatagtca

SEQ ID NO: 715 - DNA, 1667 bp, Glycine max
  Soy_ogl_4545 Gm13:38386201..38387867 Cluster 2
tgatggataagtggtgccccgcattcaacctcaaactgaaaatcatcccaagatatataataaattgtacctaaacaagtgacataaattgagaacgatccttggcttcccatatatacatggcgcctttacaataatattccttgtctattgaaaagcttcgtgtgacttctcattttagtttcgtttgtccgtttttcttttcttctttatttctatggaaaaaaaagattaagaactttttagcttttctagttattacaacctaatcatgatagtaaaaggattaaaccgaagattgatgttaattacattatactgagatttagttgtttattatgttactttgctaacttatattggtaattatcacacctttattagtttggtacatgctaactcgaagaaattcatccaaatcaataaagatagtgatgctggaccatgtttagaacgactgggttggtcatacgtgaaggcagagctttgttccttgcaatttacaaaagtttcatacacgattagtaggacagtttggtaatttataagccatttgagaagcttatttaacaaaaatattaaaactaccattagcttgattataaagttttttttaaaaaaaaactatttgatcaaaagttttgatttaataaattattaattaagtaatatatgacttataagttaggatttatattttttattcattttatcctattaatttttaaaaataactttgtaccttccgataattatgatatctattttaaataaattacatgtacacattttgtttttttttttatcaaatttactttacttaataatgaatttattaaaattttaatcattaaatatacatgcaaacatataaatgttttttacatcagtattttatgtactatatagctaattaatcaaataattttaatcaatgttttgaatttaatcactaattttcaatttatacctccagactttttaactcattttttttataaaaaaaattaggtagtttttctattgttaagaaagttttcaactttttttaaaaaaaactgaaagaaagttgtcaactagtttcactagataaagactagtcgtgcttaaaaaattgcaactaatttcataaaaaaaaatcacaaataatctttcacatcaactaaatttttatgagaaaattttttatgtacttgagaatgtaaaaaggtttagataattattaaatcataacttattaaatataataaatttgttaacttttaaaataattatgttaaagtaatttaaatatgatttatgatgaaatgatggtgtaaagttattttatatgatgagtgcatagatgttaattttttattttttttatgattctcttatttatttacagttcataatcataatgtgcgaggctttgtgataaaacgtaatgggcgaaaaaaaatcatttcccttgttagattataatatcgaattgattaaacctgcatttctatgttgacattttaagaattgattgttttcactttattttggtttaaatacatttttatgcaatttaataatgttttttcatttttattcttaaaaaaattgttttaatccttacaaaagtattctaaaaaggaaaaataaaacaattacattttgcaatgagtaaaataaaa

SEQ ID NO: 716 - DNA, 1479 bp, Glycine max
  Soy_ogl_5030 Gm15:12990494..12991972 Cluster 2
ttaattgtcacaaataaccatatatgttgaattattgtcaaccagtttcaactattagtgtttaataatcataattatcttaaaaattcatatgaactgaatcaagggattgaacatggaaagcagtggactccgataatagctcagctttaaccataacatccaaaaagggttcagtttcaaaaatctaatcatagcaacctacaaaaagctaaaaatacagctacaaatgctaattactttgaaatgttatgtatatttatatttatatgtttaattagcataaaatatttgatgttgcttagtacagtgtgatttccaaggaaaacattgtaggttattgcaagattctgtccatttactagtgcatgcgcctccaaccccatcacaacacttgcatacaactctaagagttgcaaaaatctttgagtaccctgcaattacatcacatatataaatcaataaacagccaaaaaagaatttaactagaatgaactaataaaatcatagattgttatatatagtaataacttttttatatgaaaaaatctgttggagatattaaaaaatctaactgatcatttttagtggaatttatttttaaacaggtaccttacttcagggaatgagaactaatgacatattggtatacataataagagtatattaatttttatgataattattttaaaaattatatctaagagaaattgtaattagttaatggtataattatctttgtattaaaaattggacaccgcaataaaatcaactagcattgattttgttaacctgcatgtgcaaatcctctgattttgttaacttgttaaacattctttaatttttattatttctattgttttctagtacaccagtacacccgtttctccttcacaaggattgaaaatattatttatcttaaatattaatatagatttatgttttatgttaacaaaataaaagcaaaactcattatgtactgagttttaaagaatgagaaattaacttgttaagattcttttcttaattgagtgaaccaaatagcttctattgttagtgtactaaaattaacatactgattgacttctgaaagtgaggactgtagcttgaccaaatatgccatcagttcctttgctgcacctgtatccacgttctttaaggaaaaaaaaattgaggtcactaactgattctcaaaacagattataacaaagtaggaggaaaatgtgattgtatcatacttcatagtcatattgagtataataatggtgcccataagtagcccaatgctggcaaactatgtcttcaacaatgacaagcttgtcttcaagtttatctttatttttatatgcaagtatagattgatttgttttatttatattgtaactaagaactcttatcttagattgattgaaatattatttttcaacaattatttaaatattattaccttacctaactaaaatgttttttatttctccc

SEQ ID NO: 717 - DNA, 1500 bp, Glycine max
  Soy_ogl_5835 Gm17:41312301..41313800 Cluster 2
acccatcggttctataccctttgcttgtctccagttctgtcacgtgtattcctttgttcaattggtcagtatcgatttttacttgagagagagagaataggctttatcatcttacatttggtttaatcagaaagaaaaaaacaacctagatttggtatagttgatggtatagttgataaaattgtataaaatataaatatatgataataatatttaagattattaatttccttaaaatatatgatcatttactatcctttaaagtgtatttcctttgaaaggatgaaatcccctaataataataacgtggtatacttaataaataatctcttatatgcgtaattaaagattcattctttaaatatgtgtattaaagaatatctattaggttaatgttttaaatagagatattatcaggaatgatctatttaaacatgagacttgtgtttaattctcatctaatcatagttatgtatcgaaataaaaatcaagatattatcaagagatttacccgaaacaagcatgcataaatcgagtacgtgtatactttttgcagtagcggatatattaactgatcacaaaaccaagatgcatataatcttatttgggactgataaaaaataaaaaaacttatttaggaattgttctcactataagcttgaggaagtgattctcgatgggcaggtctccaagactctcaaaagtgcttttttcgcctacttctcgatcgtggttgtcaacacctaatgaagggacgggaaacttttatcatgacatgtttcattgttatcttttttatatgtcggttggtcatgctaaaatatggatgggctttatataaaaacttatgtctaagacctaatttaatagtattttaaatgatttttttgttaacacgtttttaatatctttaaatttctaaaaataaatcaagatcacgtcagcacctgtataatccacctgaccatttcaattattcactccaattctttgaagtattgaagtagcatgatataacaaaatagtaataaaaactaaaagttagaaaaatgaggctcattagtgagacaaataggtaaggaaaaagagtggcaattagaatattatatacagttaaaaataatactaaatattttttataaaatttatcactcagtaacttatattaataatgagtaaattaattttattaaaagtataattatttttagacctttggccattctctcaattgtttaaagttagttttaggatccaaatttcattcacgttaataatgaacattcttgtctctattgtgatcggtggcagttaaaggtttacgcaggcgggtaggcatgcaaattctttgccctatctattaattagtgtgataattatctatgtcaatgcgatcattgaaaatctactaaatcgccactttaaacttttataaaaagttacaagataaagtgcaacaaagttggaattgagcatgcatgcaaagcaagctagcaactc

SEQ ID NO: 718 - DNA, 1354 bp, Glycine max
  Soy_ogl_3246 Gm09:40705901..40707254 Cluster 2
aaaatatgattatttttttatcaataagaatcaaattataagatttacgataatttatatttaactcaaccaattaagttagactcttatgataaaatgtattattttattaagcaaatatattttaaaatgaagaaaaaataaaatttcaattgtaatagtgtttgatttattgtttaactttttattatataattggtttcatggtaaactttataattataatatgctttttatttttaatttatattttataatcttaactaaaaattgaaataaagattaataaagtatatagaaatgaaggtaattttttgctttctagttaaaaatgttaaacgaatattttatgttggtgtaactgatgctaaattgagtaaaaaaataacatgaatttattaataaaaatgtttagaatcggtcaaaccgaggataaacctaacaaaatgaacctcctgctatggacaaacaaaaagtgcgcctcctacttcgtaacaaaagtcacccattttagtagcttggtaattagttctcatttttattcccattttgaaaaaaaaaaaaaaaaaccgccagaactactcagaaaaaagaaaggcagaacagttgaaacaagcaaataaagccttaaatttggtcatttgttccctaaacggcaaaagacccaattcctctcagaggcccaataagtagaaagcaaaataataaaaaaccaaaaaagcaatcccttcgtcccctaaggctacatgatagcttttgaatttgataagctaataaaaacacatgatatagggtcatttgtctaaacttaaaaaaaattatataaatattttagtaggaaacagataaaatttactttttaaaaaataaaaaattacttattttaaataaaaacataaaaaaataataaaactgcttatatataaggagaggtgtccactgttcaatcttgttacatgcaaatactacacctctacctgactacctccatctctcaatcatgatccatctctttgcctctctctctcccttgggaagaaaaaataaaacaataaaaatggtgattatgaatttctaatgtccaaccaaacaatcagcaatctaccaaaaccaccatggtataagaaagtagcaggtagcaattgttgctcctttgattcagtatatagttcgtccttataaattatagaagtacttgttaattttaaacaacttaatcttttaaataatattagactcaaatatatttttatcacttaaaatatgttattctaatcattataagaaaaattattcattttgtcattttatttaacagaacaaaattagcgtgttttaatcactcagaaaagac

SEQ ID NO: 719 - DNA, 1668 bp, Glycine max
  Soy_ogl_5872 Gm18:1752059..1753726 Cluster 2
aaaagtgttgtacgatgtacttaactttttttttatataaccccctcatgtcaagttggagaattggattatccatccaacttgatacaggcatacgttccagacctaaaatgaaataataatattaaaaaaaacttgattcagaattatcgatcaattttctttctgatataactaactatatctacaacaattatgttttagtgatgtgtctcaacttggctgttgcttaaaattttctgattaattatctgttttatattactcatattggtatataaaaagtgattatcaccattaaattattttttttttctagtggatacagtgctataccgtgtatctggtattgctttaatttttatagtcgtatatcttgtatcgttatatctcattatattgcgccgagtaattaattaacttagccagagaatatttatatattataaatgagattcctcgaatttgatcaaagcttgattagtcttgtatgtcggtataaataattcaagaaaacaaatatcaagacaggacaaaatcataaaataacaatattgtcactcttttcggattttttttagtgattgaacaaaaaaaattcaaacaaaaacatttcgttccttttaaattatgaacactttaaatttggagtttggatagtaaaatattttaaaacgaattttcactccgtataataaaggactcattttacaacatcaaacaaacaaatatttaaattgaatttttataagagtttaatacctatatatgtaatatcaaagatggtgaattatagttgaatgatcatataaatttttttacataattagtatataattttttttcttttttataaacttatattttttaataaattttatatgtaatgaatttttatcaatttaattattaaattgaaaattttcatgaaattataaacacacattatatagtaatttgacacaaatgattaatgtattaaagttaatgaaacacattacatacagagataggagataggaaggatttaatttgtattattttaataatgtaagtcaaaattatttttacacttttaaataactttttactaaacaattttattataaaaaatattagattgaaaattcctattatacagattatgtttataaaaaatttatcactttaaacatgtatatgtgcatgttggatatacatatagaagatgactaaagataagatgaggtgctcgtcaaaacttctacaaaagaattggtcaaaatattttgagtcagtgaatatgctagtcacaaccctcttaacttgattttaaaaataaaataaaataaaaaacctcttaacttgcttcaaaatgaaacctcttgcattaatccaatcgtgcattgaatgagtataaaatagtctacagtggttagcaacagtctcaactctcaaaaacttgaaccaagttgtattaattaaaaaatatatactgtattctataactgaaaatatcaattggcaataatttaggagcagccgctcccacattcatttactagacagctactattttccttcctctatatttgaatttgaattcttttaaaaaaattgtttttcttctttataagactctcttcaaatattatttcttacgttaattttcttatcaaaatattttta

SEQ ID NO: 720 - DNA, 1619 bp, Glycine max
  Soy_ogl_979 Gm03:39712782..39714400 Cluster 2
aaaataaaacaatttttttattattttacactttttaattattccaacaactaattttacttaatatttctaatttaataaattaatttttcatctttcaaagtagcagcttcttatcttaattatatcatgtgagtctctaaatttaaaagcttgagtgaggagagaaattattacatggattcagatcattactcttttttttttacgtaaagattcagattattacttaattaagagtcattaactttttcttataaattaaaaaaagtaattatgaattacatatacgtaaattagccgagatgataaacagctagggtgttggattttgtttggttgaacaagagattatgctgaagattgaaatctaactaccaactgctggaatgtatgaagcttgtgagtgatgcccattcaagcctcttgtttgtaaacactgatataattaagattagaattgtggaaatagtttagtccattgttagtgatttacattccatgtcgatcagctcaaattatttattaaataagtgaagttaaagatgatttaaaagtttattcgctatactacaattgagaattattccttcagtattttacattctatttttttttcttaaagatcataataaatatgttatatcgagtatataaaaaattacattgtttacatattatattataataatataagaatttattctataaatatatatatatatatttttttacaattgattggtaccgctatggagtgccaacatagttaaatgcattagcacatcattctatttattttttaatttttttaatacacattatatgcatgttatcgttccagtaaaacatattaatgctcaaaaacagtgtatatgacaataaaatcttatgttatcatttcctttgatttttcttatctcagaaagccatcatatcgaaaggcactgactgagctgaagaatttaaaaaccaatgcacaagttttagtaggatatatgtgggtcaatattgatctataagataaaatgtacaactgtaccagttttaccagagaaatcaggttctataaagtagttggaggacgtgtctgacaattgaaccatcatcttcatccataaacctaaattgtcccatctacttgtccttcctcatgcaattgcaatgtcaggatgcattgaactaagatgatttgattgaaccggcctaacattttcagcgccacctgtttttgcttgtttgtaaacttttttccattatattgtgggaggtgtcaaatgtcaagggtgctttagtaaaaaaaaaaaaaaacaattttctaataaagtgggagggtcaatagcaatgtgagaggtgccagtagtaatacctcaatatatgtaacttgacagaaaattctgtagccagataactactgaaaataagcaagaaaacttgttgactacggctcatgaaacttaggaatatactacctaatatacattaaatttctttttcattccatttccacttcatttctctctgtttctttcttcattcttcattacatcaattatcacattaattatttttctctctaaaagccatttaacatagaacttttctggcagaccgaaaaa

SEQ ID NO: 721 - DNA, 2200 bp, Glycine max
  Soy_ogl_1527 Gm05:1810101..1812300 Cluster 2
gttgtcttagtcactatcaatctttgtgtttctcgtgagcatttatccggagagggttaatattaataagataagagctattctggatacattttgagcttgatctcgtggttcaaagcccacagtaactactacttaaccatcttaaatgtaatttacgcgttatataagacattttatgtttatgggaatatttctaggactcaaattacgtatctcgtataagacttgagtgttgaagtgtatataagtgtttgtaggttttatttctcactagaagtggttgccactcgatggagtcctctaagtgcccaccatgttcaaaagtaacaaaatttctacaaagtgtacgtgtaatcactaatttatcagcgtttcctttttaaacatacgaatgcttcggttgtctaaagtaataatggtatttacgctatatatgtatacttgaggtacagcttcgttagcacagaaaagaatacaatctaaaacaaacaaaacacacaaggtgggggtataccccaactaccacagttcattcctagggaagaaaagtaaacgtcaaagaggctccaactgcgataagggagacatggctgcaaaaatatgtccaaggtgagctaacctagttagtcagcaaatgcatgagctactagattacttatggcacgtacgtacaacatataaatatataattactaacataaaagcaaaaaactttaatttaaagaaacaattagcgttctggaaattaatattagttaatggaatactatcatttatatatttagttattgtagtatttttatttatatttaattataaattttgaaagaaactaaaaatgtaacaaaaagtgtttgaagtgacatggcaatgccagcttatagagacaggtacatcatgcatgtttgatataggtatggcgcgattattttagagtggtccttacttcttaacttttggacacttgttggtattaagattatttgttatagcaaccaaattcctctcacttttgtacttaattatacaactaataatgtggtaataaatttttgtctgacataagtcaatacttttgttggttatgcatgaagaaaacgaagcacacgcataagatatataagattgaaagcttgttaccaacgaggatataaatttctaaagagttggatgggtaaaggaaagcaagaaacttcaagaaacaaaataaagattttaaccgcatagtgataatagaagttattcaaaaccaaaatttaaaaggagggataaagaaacaggtcatcaaaggtgatgaataaatctacttggacaatcaagagtgtcttttttttaaccctaattagaatatttaactctccaatgaaatttagaagtatatcagaaactttagtttaactataaaattaattttcgattccagacttagtcatatttaagttattttatgcaaattttatgtatgttatcaactgaattgtacttattagataaataataattaagaatgtctaacattatatttggaaaattatttaaaaagtttaaaaaattgaaaaatgtctatcataagattaacaaggagattaatcaagtgtcaaattttctacttggacataaaatttaaaaaacttataagtaaatgagatcgaattaatgaaatagtcaaatttaaaaaaatcatttagattaatcaagtgtcaaatcaaataaagcattaaaaactcaatatctttaactttttcaacaagaaatcataaatattcaagtactaacaaggaggtcgacgtatattaaccaaacaccaaataataattatgcaaatacttaattaaagaataaaagtataaaatagcaattaatattttttaaacaaaaagtagtttgtctactaactggcccattaacccacggactcaaacccgtataactaacgggttaaacaaatgatctgtaaacccaagcccatatatagctagttctatatataaagaagccataacggttatcggtgattaatgaagtagtatatgttacaaatttaattttcaataataaccttatcatctaactattatatgatgaatgctttatttcactagttttatagattaaagcttatagtttaaattaaatcgaattcaattattttcatttctactttaacagataattacatgtttaatatacaagagaa

SEQ ID NO: 722 - DNA, 1405 bp, Glycine max
  Soy_ogl_3554 Gm10:45916681..45918085 Cluster 2
gtctctctctgtttttgttctttgaccgggtgaagtgttctatttcgttttaggcatataaagtatacgtttgaattaaagtttgcaaatttaagttggtaaaaaatactataaatcttacttttttaaaattaacttttcttgtaaaattttactcttaaaacatatatttgaggtaataaattccaaactgattttactcttgaacacttgaaatattctcactgaaaatccaaagaaatagaatatgtatacggatggatattttgcagcagtaatatagttataaaaaaaattataacatatatctcgtaacagtatatgaaatcaattttgtcaagaaatgcaaagaaacagaattaaaaaaaatgatcgattataagtttatattaaatttgaatattcactcttgaatataaaaaataagtctataatcttttattactaaattgttttgtttctcttaccttatgccacatttttatacttgcataatttttaaaaatattattatttaagtttaattgatcgtaatttgaatttttaaaatttaaattgtgacatactgtatttaattaatgaatatcaagttaacattttataataagtaagatcttcagtttaatttttttataaaaaactttatttaatttctccgtaccatgattgtccatgaatatttcagacacgaaagagatttttttaggttacgaatgagattgcttcttatggagaattaagaaccttattgtctaaaccaaaaccaaaaccaaaattatagaggttatgtgtctaattcaaataatttatttttttataatttctttcttctttctaaatatacatgattatattataaaaggtgtcttagaaaaaaaatacattagtaaaattaaattatgctaactttctgaattaatacgtgaattatttttttattaattatattttagtccaaactgactattagaatatgttgataaatatgttgctaacactgtatatagtattattacctcatgcctatatataagtattgatgtttaaggataatagacatatgctaaaaaatatttaatgaatgtaaaatattattatatttgaactgaaatgtgcttatttaatatctcattagtgttacctcatgcacacgaatacttaacttgtcattttcaaagtcattaggtctaatgaattaatactctccatttgtgaaatgcagagtcattcagtgtaatttaacaatgatgtgattttttttttatcattgatataaaatatttatcaatcttattaatcattaatttttataaaaaaaaatctgacttttacatttgaattgtgtattccaccttcactcgtaaaaataagatgaattgtgtattccaccttcactagtaaaaat

SEQ ID NO: 723 - DNA, 1205 bp, Glycine max
  Soy_ogl_3943 Gm11:37249896..37251100 Cluster 2
aatgaaatatctatcattttcttatagtgaattttgacaagaaaaattatatatcttaccaacctgttctccttaattacttaattgctaaatgcattttttttatttcttttcaccgcaatcacttagtctcacacttttttcttcttcctatctttttctttattataaaaattattgtacgaagatatttataaaataacattactcgttaattacaaaatgacacataacccaactctatcttatggtatatatatggctaatatgattcaagttaacatatggaaaaagatatatagtttgatagggagaaattatccgatccataggtaccaatttatttatggtaaattgctaaacatttattaataaattaatcagtatcgaataaacattaattaacttgatagctaactgtatgagcggtttccataaaaaaatgtcatatcaactccctagcttaagtaatcaaaagtatatctagatatgaacaagagtaacttgatacatgggaagttcaaaattgagaaatgaaactcatctcgtgtggttgctaagaaataaaagagaattgaaaaaatggtgtggctacaatttgtctcatcatcttacatgtctatttgggatgaattaattaaaaaaagaagtgacaatacgatacacatcaagactcaagagtcttctaaacaagacagagtacgtagggtgtgatgtttaattaccattatagtggaggccgcctaagctagctagccctaattaatacaaatgcatgcatgaaattaaattaattatatttaatgtactaatgaaatccaaatctgagtgcctaaattaaaattcatcaattagtaagaaatgaaaacattccgtgaatgctcttcatcttaatttctcttcttttatccctcatttttctcggactctatgaaaagtctcattagaaaaccaaactcttacacgaggcctacaaggtattacttgaagaaaaaaaaaagtgattcccttaaaagtaaaataaaaaaaaaattatgttttagaattcttttataaactattttttttctagcttccaataaaaacattggattacttatatttttaaattgtgatctaattattatggatacgaatatttgaatgtatcacacgcgcacacacataacatacgagcctaagcagataatgatacaatcaatcat

SEQ ID NO: 724 - DNA, 1890 bp, Glycine max
  Soy_ogl_4644 Gm14:4225011..4226900 Cluster 2
catacaaataatttttaagtatataatttgttaaataattatgctattgctcatggtctcaaaagaggcacaataccatattggatggtttaatctccgactcttgcctagaaataccctgaacactttgaaaaaaaaaaaaaacaaacagacagaccttacaaaataagtataatgaagattgtatttaattttttagttaaaaatcacaaccgtggaactaattattatactagtattttagcatctcttcaccaaaaaaatactagtattttggcatctaaattgtataggctatatatttttctatataattaaaattcatcataaaagaaatattttaaataaatgtttcatgtgtgaaaataagagagattgaagagaaataaaaaactgtaggttccattttttttcttccacaaatcagtgtgaaaatgctactgcattttaaatcatacataatcaattatttgatcatcataatcaattatgaacatttttttatgcatgaattatcttgaattcatttgattagttaaaatgatggtactacagagcacaagataaaaacacaagctacaggataattttttatcttgtatattatttgacgaataatgaaaaaaaacataatataaaatttactaaaatacataatattaattatcttaatacaattaatattaaatttaatgagtttactgagatgacaaaagagagagattagaataaaataatttgatgtgtcctttttaaaatgatgatgttggttagttattattttttcgattactaaagaaatataaataaaaatatgtgtcttttaatactctacctctatgacaaaaaattgttctatagttttttgactagcaaaaattagagattttgcctcatgtttatatgtttgatttgtattctcctttattttattttttaaattaaatgtgaaacaaaaatatttgttatgtctaatgctatatcattttaacgaattaaacggatctttagttttccaaaaacaattgattatgaattcttcacaatcaattacttatcttacaaattgattttttttcttaaactaaatactcttatttttactttatttctcaattattttcatttattctatttctctcttctctattttcattttcatgtatttctttctttcctaccaaaccaaacacattgaaaattgctggaaaaaatggcttttaagtttatgttgagggtactctctataaaatgggattaaatgaaagaaaatgtacacttcaactaaaactttaaggataaatatgataagaatcaataagttttggatgattagggaatgactttgtcgcattttgttcccttgtacccttttatattacggtaggaaatagatgacttccatgcgcatgcatggcccatactccctcctacggtgcctcttccaaattaaagaaaattgcatgctggccgcgaacagagtgccctttggaaaattaagaggagatttaggtttagaattattggtcttgaccatatatcattagaaaatgaaagcggtgttattcattttagagtattttaagtttgacgaagtgtaacgaatctcctatatatatagcctgaccctgctattgattaagataatcaagcctttattataaccccatcgctaaagcttaactgataccatttactaattatataagaagattcgattgtcgattgctttgacataactacacacagttcctgtttttttctggcaacatttcctacacaatatttgtgacacgaggctagaaacttggtttaaatgtaaacagcattattagtacattgttagcattcaatataaaatagaaggacacaaatgggtgccccaaccat

SEQ ID NO: 725 - DNA, 1478 bp, Glycine max
  Soy_ogl_5780 Gm17:39394901..39396378 Cluster 2
attttccagcaaagaaattggccggtacttgttgtgcttgtgccctgccttttcccgtctgatcataaaggaaaattagaatgagtagacgcataaagtcatcagatcataaagatgtgattttatatttttaattattttttaactcatgatagctaattctattttttcttgctttttatatatttattcatggtaaagaaataaattttctacaagtgaaaatttttcatataattaaccttaatttgaaaacccaaaattaaatattagagttatagtaaatttggataaatttgttaataaatatttattaaagaaataaataaagtaaattaagaaattaaatttgttcaggtatatgttttctataggtttgaaacgacttagccgaaacattgaagtatgtaatttgtttttgatttggtcaatttcaggattttactccccggatcttcgtgtcctatatagtacacttctgatattcccggaggcaatttcaggtttggttgatatctcgaaattcttgaagaaacatcctaggcggttataatgacaaaaatgaatcacaaaaatgaatcacaattttcttacaagttaaaattaattttattttaaatttacataaactgttttatttaactttttcataaattgaagtttcatttactttgtcgattatttttactttccttatccttataattaagaaaaccaaacagtccccctccatgtctttccaaatatagcaacacatttgaaaaatattgatgataccatcaactattctctaaatctctttacaaaatcttcccaatcgatccaaagaaaccaagaacaaaggctctgaatcaaactagttaattccctcatccattgtcgtttgccaattgccactgtcatcaacattcacattctatcatgatgggtttgaaatccctcttcaacagcaaaaaaaaggatgtgatcccctcagccacactctcccaatccaagtctttgtcagtgtgcttacatgcatgtcttgcgcttgagattaaacaagtcttcaacaagtttgacatgaactacgacgacaagatctcaacattggagctcagaatgtgttataatctcgacgtccacgaggttcagatggacacttatagacccatcatactccacatggttcatgatgcctccactcttgaactgtgaagtcgcttccatgtctccaatttcgtgtgtgtgtttcgcttggtggattgagaaaaaaatgaaaagggaataatgtattagtataaactaggagtgtatatagcaactaccttaaatgaaagtggtcattaaaaaatcggtcgctaaatcagtgtttattatattggtttttagatcagtatctatatcagtctccaaaattagttacttacagaatctgttaatttggtctctaattgatctagtgactgggattttttatttcacctactgaatttttg

SEQ ID NO: 726 - DNA, 1444 bp, Glycine max
  Soy_ogl_5846 Gm17:41562768..41564211 Cluster 2
ctgtcatgaaatattatttttatgaaaattcatatcctaaccaagtcagtggtggtggtagctggcagaatgaaagcggttcagacttttttttctgatttttttttttttttgctgaatttatcggttcagactaattacgttgcatatgactaaaagttttaatttatgaaaaaattaataaaacttacttatttattacgggaaaattcattaggattatggtaaccttgaaatatgtaataatttctctctgttaagagatgagtttgatgactactcactcacctggtgaattgctactggacataggcaaagtgacattttatatttgtgaataaggttacaagaatctaggaatccaggccattcgggtaattctgatacaggttggactataacaaatcaagtgttgataaagttgaaaaataattatggaatttttttaagaaactttaacatgtcaatttttgttgaagtttgtactttgaataacataactcaattatttactcgactagggtgttttactggctacgtattatttgatcttgtttgttaacctgtttttatttaattaattaaatttaaaaaatatcaatttaaatgatttacttagttaattgagaataagatactcaaattaattagtattaaaattttcaaattagttattatattaatatttattttaaaatactgttaaataaacctacacaatttaataattaattatgacatttttgttttttaagtccacttgaattagtttggatcatgggttatgtaaaaagaaattattgtatacttaaaatttgttgatttagttaatatattgggtttgtctaattgatctaaggttataaatgagttagataatctcggcttcaatgatcagtcgaatttagatatttattttgttcttaattctattattaatgtgattattactatgtttaatgcataattctttctctctctcatgttatttatatttaaatgtcattgaaattacttttttttatatattttaatgtgattgaaatatataaaaaattatttttcaataacattttgcttttattttaattgattaactaatgtcttattatttttagttgttaataaatttgaacttagttcctaattttttaaccactaagaaattggtttctatttcaataaaatatattcttacaatataaatttgaataatcatttttgaatgggaatgggaatgtgttttgatgagttactcttaaagaagggtatttttaagaatcatttgtgagttaactattactctgacccttgaaattgtaaagacattgaattttaaaaaaaattaattttacatatttaactcaggctaataaattaaacctattttatttaattttaaaataaatgaaagctatttatctaaagtgaataaagagtatag

SEQ ID NO: 727 - DNA, 1400 bp, Glycine max
  Soy_ogl_6963 Gm20:43774201..43775600 Cluster 2
atgcacaatcaatgttctacagtttcttttgtttttcttaattttggcatcccaagccaatatgcatcagacactatttgattctagctcctcatgcttggatttggcggaatacaggctattgttggatgcttaagtagagcctatttggaagatattttactaatgggttaggaatccaaaataacggcctctatcattcttttatgaatcgaatcattttatttcatcttctttttggacttaattatcaatttgttctccaaattattttaaaagattcaaatccctcactttcatggcataaaaaccctttgattcagcacgcttgacaccgtaactgtgtccatcaaccttcaacgcctcctccgcattccttagcgccaaaccgcgagtacaaatggatcaaagaagcagccacatacacatcttcaaaaccaactatgtattccaaacccgagattcagagcgaattggtggcttttatggcggagatttaccagcattcagaacctcattcttgttaacagatatgtggaaggagagataaatataagttcaagaattgaatcgagaaaataatataatttatcaacctaattaaaaactgtcaaaaaaattcagagatctaccaattaatttaaaatttttaaataataaaataacataaattacaataaaccatggtataaaaaatgttaattaatataaaggactaaattatatgtttttaagataaaatttaataataattagaaaaaataatatatgcctgtgtaatccttaaatgagtaattttatttttatcttaattttttggattaaattaaaaataaaaaatattttaaagaaaaatatatatgttcaagctagttttttcaccattttatttttactaattttggaccgattttgatattagtcatttttttttggttaacagatcggtcagtatattggttttcaatcaaactaaccagcctattttttaaaactactacgatatagtgtaacggtaaaaccacaaagagatataatttatttgcattataaatttataatgacatggaatattctaacagattcattcaacaatacatatacctgtcacaactaatatttcattatctattaaacaaacaaatatatcattatcaacattatctaaaacttaaaccacattaatcatttcaatttttggcaaacaaaatctcataaataattggtgtttcgtgaaacttgatatgtatagcgatatcaaaagaaatgaggataaacctatgctcattcagtattagagacacaattaacatggagcgtcaaaggttattacacttttattcacgaaatgaggataaacctacgctattttttattcacgaatagttttcacatggcat

SEQ ID NO: 728 - DNA, 1328 bp, Glycine max
  Soy_ogl_4927 Gm15:8834150..8835477 Cluster 2
aaccattaatttccattttttttaaataacaaagttgagatcaatgttattatcaacttcaaaagtaaaaaataatataagtcgacaataacattgtgaattcccacaaattaaaaaaatacattaattaataagttgatcgtgaaaaaatggaccccattgacacaatccagttatcaacttacacaaatttgaaaaatatttttttaagttataacatttactttaaaatttataatacatctaccggtaccccagctgggtaaattagaaagagccacacaagtaatttagatcatcatcatttaagtggaaaacattttccgaaatctctcaatgcatgtcttgtacttcttcatcacgagttgagacacgttaattgatccctttatcaattatagtgccagtcctggccggtcatactttttacttcacacgttcggtaacccccttcaatggcatgccttttgctttttgtttttccgggaggtatgatataatgttgttgcctctaacataattgagaataaaacattacaaaaaaggtgttaaaaagaggttaatagaacatgatgcatcaattacatatataatatattgtgttatattcgttttgctaaattaacttttcaaatactgataaaaaaattacttttctaatagtgctatttcgatctgatcctttggatgggaaggtgtcaaggagatatagtgtatagtgtggatggcagtcatgtttatttatacttttttagaaggatagtatcaatattattccactaaatttaggccttagttaaatagcttatatgcatgtttatttaaatataaaatatagacatctgatcgataaacattttttctcacaaaattataacatttttcttttgctaacttattactatttctttaattataacatttttatatgctttttttataagtaaaattttattaaaataattttagatgctacaatcttataatgttaatataggtatattgcattaaaaaattggattaactcggtcttgtcccataaatttcaaatcttgatctagtcgagatcaaatttaaataaatggtccgattaaaatttcaagtcaaagtatggattagaataaactcgtctcttacttacccctatattatgtatattataaaaaagaaaaaaaaaaatcaaccaaacaatttttaactaacttttcaactttaaattaatttactaaacatagttgtttatatctgtaatgtgtattgtatgtgtttgcatgctaaattcatatcttaacatattaatttaggctattaggctatttctacatgta

SEQ ID NO: 729 - DNA, 1200 bp, Glycine max
  Soy_ogl_201 Gm01:48463401..48464600 Cluster 2
attatttgaattttaggaaaaattttctagcactattgcactaatggctttacttttaataaaaaacaattgttgtatattttaaaacccgaaaattaattgaattaagtaattaagataaaatgttacatcatttaggttaagttaggatgagttaggttaagataaaggctcatgtctagtacataggttaaattcaagtcttgtagatttaaaaattatctcaagttttacgaaacctaacttaatttagttcattttaacctattgtgacgtaataaaatctagaaaatttaaaatgttaatatacgatctttgatgtatgtttttaaattcattctttactattgactaaaacttattctaaataattaaataacaagactcaattgtaaattgcaaaataatgagtgatattaaatgataatttgtgtatggaagaatgttagattatcattttttttatttaaatatgttttttttttgtaaaattactgagtttaattctaattcttatgaagaaaagaaaatgtttagttggcatccttcgaaagctgaaatctttaattagttctatattttatatccctaagtttctagaaaacgacactcatgtaaatttttgttcgctctatagtttgtttgatggaatattaattaattggctaattacagctagacagtagacattccccagcttgcactatctcgttctataatttgacttcttttttattattcatacataaacctagttgacatttgattccaaaacgttttttctgttttaaaaataaaagaataaaggtaattgtttgaaaaaagtgtttttcaaataatattttttttatacaaaaagagagagaataaaatgcaagttttaagagtaaagccatctgtgttcattatctccatctttcttagctagcgggtatttaaatttacagttttacactacaagaacacaataaggtacgtagtaataagtatttcgtgcatgatataactatatttttaacttaagtgaaattctaaaatgcaaacttagaaatatttaaaattgaaaaattgatatctattttttttaagtaattcagatttaaactcaacgtgatgtcaaaccaatgtaggagtttgctgcttcaagaggtggttcgcactttgttggctttttttttttttatcgacaaatatcacata

SEQ ID NO: 730 - DNA, 1500 bp, Glycine max
  Soy_ogl_329 Gm02:2705401..2706900 Cluster 2
ttaaattttaaaattttctttccttctttattttcctccaatctaactaaacggaccataaaagtctaaactctaaaccacatattgataaaggcaatccccaatccaggtttgatttattgatatctgggtcttaaaataaaggttaagaagtgaaaaaagaaaatgaaactgttctttaaaattatgacattagatatatagagaacgttaaatattaagtttttaataattttaaataataaatataaaataatataaaaacatatataattacttgaagtatgttcattatatattttttaaataattttaccttttatattttaagataaaatatgtatttgtctctcattttatcttaattcctctttttgatcatgcataaaaaaatataccgttttagttcttataaattgttctattttgttttagttctaacattatgacgttaatacaataaagatataaaggaagaattttagtaaaatagtgaaaataaaaagttaacaaattataaacttaaacgttatatgaaataacattttaaaaaaagttacgggtatttttttttaaaatggtctattttggaaaagcgaaatgtttaagattcatttatttatcttgtcaaacatatttaaatagcatgttaaaaataaattagtcaaacaaacttatttatcaaacaattttatgaaatgagacaaccttttaaactaattaaacaaattaaaaagtgattgatctaccttatatataaaacagctcaacctaagaacaatagtcaatgaaatcgaagtaattttgagcatttgacaagacaactgccgtgccggaattaagcgcaaaagtgctagttgatcatctttaaaaatatcataaataattcaaccttttgtgtctttgacttacacgtatactaaaaaaaaaataaggttgcaagttcataattagaaggatgtgaacgtggattggttattgaatgggaagaatcaaataacacaaatgacagaattttaaatttgattctgattagagaaacgattcatgagttgagattaaaaaatctataaatattgattatgactttatatttcccttcaccaggtgatatttttttaaagattttccaggaagattagaagagtttatttcaaaatttataaaattattttcgggaatgagcttaaaaatattgcattctcatatttattgcgagttttaaaggattttttccggacaaaattaatttttaagaatgaatcatacttttgattggcgataattcaatgatgaagggtaggaatatagcattcttatcatatactccaattagtaactttcatgtctatttttagtttttctttctttctaccgtttgaatttaagaaatcttaaaaatattaaactacaaccagacataccttttaattcactaaacatcagtaaagtaatgttcttgaaaatgttattcttaaaaatttaattacatatatatct

SEQ ID NO: 731 - DNA, 1730 bp, Glycine max
  Soy_ogl_2400 Gm07:37705901..37707630 Cluster 2
taaaatataagtcacatgtcacatgcccaaagctcaaaagctagggtgactttttttcttgctgtgcagtataaaccgaagaatatgatcgccggtcgtagggaatctgagttctgaggaccacattatggctagaagctacaagttaggtaaagggcatgttcatgaaaagaaaatggaaaagtggatttagagtaatcaaaatgtgcatatggtagtttcattttacaagaaaaaatgatttttttattctttgattgaattgaactttggaatgagaggaaagatagaaaaagaaaaagaaaataataaaatatttcagttctttgagttgattatgaaattaatttttagtttaaaatttaatcatatttaaaatccgttctgctagggtatgtgccaactgagctacacaaataagtataaaaattaatatgtgaaaaaacaatggttgattttctaataaatttatctgagttcactgtgaagtggattgtgtagttcttgcactcaagaaaggttttgaataagaaagctaacgcactatgccccgtggattccaacagtgcaatgcataaactgggcacgggttggggggaccatcaaccctggtttaattttctatcatagataaaatattgtacgaaaaattaatcaattaggttgatatgcttttttatatatcagcaaaaaaaaaaaacgtgtaaatttgaatagatagatatgcaacatatttacataattcagagcaatgatagagaggatttaatattcgtaatacaaaattatcccttttaagtcacggacggaaccacagctatcggagtgcccccctaatttacaaaatgttctgaactatacagtttcatgtttaagcaaaaaaaaatgtcaaaagtatcagtacactctttatttatatatattttatgtctaatcaaaacccaacacataaaatatataatcaatttatctattaatttttttagacatatataagtataagctatttgagtagtgttatcaaatattacattctttatttttcctttacttcatttttttagtcattccctttttctttcaaaaatattagaaggccgaaagcaaatcaagttaaatgatgtgttacttttttttctagttggagtttataacaagtctcttcttttttcaatgttatagactatattatttttcttatgttaaaatttagtttagttttttattttgttttataatttttagggtaagtgtttagtccttgtcaatagttcctctaaaaattcctgtttatttttattgttcataattagtctctgtgagactttgttttgagatatgatatatgtacaataatttatattatatcattttatgatttgtcaaatttttgtctttttaataaaattttctaatttttttggagtaaacttatgagcttttaactaacttatcaattaattttactaaatattttaaaatattgatagtactgatttaattattaaagcaaattatgttatgaaaaaacattatgtgcaatttttgcagggctatgatacatattacttttaaaacaaaaaaaaatcatttaaatatattgaattttgcaatttttcacttaataattaatttcggaatttatccttgtgcataaaagtttcttaaattttatgtaataataatgtaacctgttaattattcttaaatcaaattgtctcaccaaatat

SEQ ID NO: 732 - DNA, 1400 bp, Glycine max
  Soy_ogl_5283 Gm16:4153101..4154500 Cluster 2
ttggaaccttttgacatttctcgtatgacacacatacgattcctacatgagaaaagaaaacacggatacggtagcatctcatcatttgtttcttttttttcctgtttattttatttttcttttaatatgttgtaaaagaaatataaaaaaaatcattttctttaccttctttaacataaaagggtgttgtatgttgtccttttacttaatatgtatgtagtaattaataaataagaatatatcaattataaaataaatataaatcaaagactgttaattatatttcagttctagaatagtcactatgacaattaacaggtgataaaaaaaggtttcaagttgttgcatggaatcataatttattctttcttttgtgggtggccgcctgtataccaagagggcacacacacaattaaaataataataataataaaaatagtgctttcaaataaaatttaaaaagtcttaattaattattggcctttgaagcattaattttttttaaatttcacttatcgtccttaataatttacttgagtttcacaccatttgtgtaatgtagcatttttattttgtgcatttcttattcagtaaaattaatttatttgaatataatcaagcatcaaaagtgaaaacccatttaacaaaaggttaatatctttttcgtgtacactaaggatatcccccgaatactattcccgtaggacataaaaatcattgaagtaaactttacatcttttaataaaaaatctttttcatgtatatgatgatccctctttttttggtatatatcatcatgtatatggtctgatatctaacttttattaatatacttaaagtactcatttatttgctaattaggccagacattttacgtatagcctaacatttataagagtatggagaataatggtgtttttaatatagcctaattgatatgaggtgccgataaggatatagatatgattaattagatacaagactcgcaaaacaaatatatacctaaattttacaagactcgcaaaactaatatatagaatataagtgttaaattttatattaacatttgtaccacatgccatgcgataaaaccttataaaaccagaatcctttttttattcttttattcttaatttaactatatataggttatctctaacatgcatgtatttttataagattaatttaactctttttatattttaagaaaatctgttaacatttacctcctttaaaatttaaatgtcttttattaaaagtgcgatatacttacgtacccacaccaaattctttctgtatatgtgaatgaatgattatatggttaacttttaaccatttgctaaaatggtagcccatatactttttacatctatcagctttcttgttctttcacaataaga

SEQ ID NO: 733 - DNA, 1770 bp, Glycine max
  Soy_ogl_2594 Gm08:10536183..10537952 Cluster 2
tttcttaaaattgttttgataacttttagtccttaattaattgtctgtcaaggtttttagttatttcaattttatttttgcctatttttagtccctaatttatttttgttattcaaaatcagtctcaaatataaaattaaacaagaaactataaattaacaaaataatgaataattttaaggaataaaaataaacgagaaataaaattaactaatttttttaaaaatgactaaaaatcctaacaggaaattgacaaataactaaaggttataaaaaaaaagacattaaaaattgaaatccaataaaattaagaaaatagaaacataattaactcaaaattataaatgacaaaattattaaaaaaattaagatgataaagttttaattgattgtgaaaatcaagtatattatcaccaatagtattaataaaattgcccaacaactatttactcttccacgtgtcacaacctaacttcttttgtcacattttattgtttcctgtcctacggtccagttatttttaatttgtatgtattatactctcttgttttatcaccatgcaaattcgacagcaaaaacaatttttttctgtcacttccaactagttttggtacaaatttatttaatttttttaaaaaaataaaacacaaaattaatcagcaattttttttacttctctctattactctcactttctattttttaaaaaccctgcaactgcaggggtcccattctagtttttattaataacctatattgtcatgtatatatggctttattttgatgcaaggttagatataaaaataaataaataaaattatggtcctaattaatcataatatattttacacaatccaataagcctgatatattattaatcaatcaaaattattaagacaacattcaaaacgacgaattgaataaaaaaaacctgaagaaaaaaactattagggttgaactactagtgagaatttaaataatatggtggaaaacataaattctaattttagtgcgactaccatgcataaaaaataataattttcgtcatatagaataaaaaaatgaagaattttttttttttgtaagatgtatcttcaatgacagatgcgaataaacataacgaatgctaactatattatgtatcacctatattttaatatattgtaaaagtttaaatatttttcaatatatttctttctattttttatcttacagaataatagaaaataatatatttacattttcatctaattataagtttataacgtattatcatgatgtctaaaatgaaataattgtatgcaataacttctcattgaaaatatgtcaaattaaatcgtaattttacagttttggaattttctttttccctgaattattgcaggaacaatcaatgcttagggaaccatgagtcatatctgctttggttttttttggtcgaaggttagtgataaacctagatgactagaatagatcctatgctcttcacacttcacgtttctgtctctgggccttcgggtaggataactaaacaaacaaacaaaaaagacagacagtaaggtaaactaaatatatgcatttatttaatagtattaattaataatcttttcatattttttaattgaacttcttttattcgaatttataaaccattaaatgtaatggtttttttatttgacaaattcaatatttttaaaattaattaaaataaccaaaatttgattcacattatattaaaataagctaaataagatgttaataatgagtaat

SEQ ID NO: 734 - DNA, 1724 bp, Glycine max
  Soy_ogl_3773 Gm11:6595201..6596924 Cluster 2
gtaaattttgtagaaattttataattaaatgaaactttaatttaaatttaaaatatttatatatatacacacacgcccttgaaacacaaaccgcaatcaccaattcttgcagtctgatgacattgaaaatttatataggatttaaagtcaccccaaaaaattataacaagaaatagaaaaataatataaataagacaaatattagacaaagagtgaatgttgtcataaggctttgaccaatccaaagcataaatttatacgaaaggtcagggagcaaaacagaggttgcacatatgcatttagggaagaaaaaaaaacgtgagataggatactatgggaatatttagaattatttatatttatagacataaacagaagacatggccacattcaaaattattgtataataaccataaccattatccaatgcaagagtgaaaacactcttcttcttcaatggaccctggaaggcgctcaatatatactgcgataggagttccatcaacgttattttcacttgaccattctaaacgtccaaaaccaaaaccagtcgagggtggtggacctgatagtgtaaatgtgacggtatatgacttgctctcattttggttgaagctcaactatgattttgacagcagatggaacatccaaagtaactgataccttgtatgttcctgcggccccaacattagtaagagtccgagtgtgtttaacaacaagcgttgcattgttgtttgttgttttatacaccagtctaatacactgtgtgcagcagcatcaccgcacttgtactttctcctgtccacgccgtcaaatcatagacaagtcctggattaagcgcggaaacaggcttggcatgtccagcaccaatatcaaacggtgttgctgatttagcaattttttaccattagtgcagatcgaattgcgatgcaataagaagaaacttgcacctcttgttatttattaagggctgaagagataaattattaaataacaagacctgcaagtttcttcttattttctttttctttttaagttaatctataactctattgcaatttaaattaaacaagttagtaaataaagaagtatgtaataagtttcaattgagaagaaataatttcacgaacacaaatatatgcttttttttctttcttttatcacgaagatatgcttgttttaatctattcaaaggttatttttaagttaaaaaacctttactgtaaaaaaaagggttaaaaacctttaacaaaaaccgaagttgtttgtcgattttttaaaattttagtttgacaacaccttttttttattaaaggttactagttatattgtccaaaaaaaaattaaaaaattataattttgctataaaattaatttaatttacataatattattctaatgataataaaaatagataaaaatattaaaatataatttttaagaaaataattttaatgaatcaatacaatttcattttgataataatttacaaattacatatgtatatgcggtatactactgaggggatgacactgaaggataattttgtaataatcttttttttaatgaaaactaacgaaattttaaaataagtaaagtgacatataatttgtcaagagtgaggagtgtaaatatattaaatttttcaaaacatgatttttatgccatccaaaaaaatattcttctaaatttacttatatatcacgcgagcattaaattaaatt

SEQ ID NO: 735 - DNA, 1152 bp, Glycine max
  Soy_ogl_4511 Gm13:37255749..37256900 Cluster 2
aaataattctcacatatgacttaattttttagttgaattaagtgtaaatttaaattttaagacttatactattaacaagttacatgtgatttttaattaacgactctaaaatgtaagatattttaacgtaaaataagtcttgacattttatgagtctggaacgaaataatagataaaatccctttatacacaaattgtaaagacataaaaatctttttattcccttaaaacaaataatctaaatttgagtaaaaaacaaaaatatttttaagcctaataatataagataaaacataaataataagactgacgttaatagtatgagtataaagttgctgataccaaaaaagtatgtgtattaagttgatatatttgcaattgttattaccatatattaagttaattaaataagaatggcttatctaaaaaaaacttggcatatattaataaatgctggcctattccgtgcccttctagtcttctctagtgataggcctagggaacgaacccgaaattcgttggatggtgacaagtctgaggcctctagttgttgcctaagagactattgtagattcttataatatcttggactaaaatattatttctttccttcattttttttaattaaaaaataacatttcattattttttaattttacagtcatgatattatttttgaattaaaaacaaaaattatttgtttgatttctcttaataggtattaataaagagtatatgtatgattaaaacggagttttttcttcttcttgtttttaaacacaaacaattttcataaactatgattaaaacaaatcctacatatagatctcattctccatttagtaagtcttatttccatactagtgagacccatataaatttaaaacttcaactaataaaataatattagagctagcatagtgctaacacttctctatttgtatttatgtgcgatatattgcaaaaataaatcaaattaatctgattttaaaaataataaaataaaatttatttcattatattaaatcagaaaaataatgttataaacttctatagttgtaagtttttctttggtaagataagacttttatttgatcaaattatgtttaatgtaacatcattatttgcatttctttttatgaattctttttt

SEQ ID NO: 736 - DNA, 1800 bp, Glycine max
  Soy_ogl_5275 Gm16:3655401..3657200 Cluster 2
attcaaggaatgtttgagcttattaaatttttaaactaattttaaagaaataattacttattttttatgagtttctgaaataattaaaaaaagaaactataatttctcaaaataaatgaaaaaattatcaaataggaggaatttgttttttttttccttttgaatgtgtactattaatgatcacgttcaaaagaattgttttttttttttgagagggaaaagaattgttattcatcaagcaacaatttatgcaaaatattttgtgtttatttttgttattacatcatttattatatcttattattctttgtcttttctctctttttttcactcccaattataaattttgttatacacttttttccatcttctgtaaataacgtctctcccaataacacttttttctcttttttattacataatttattatatcttattattcgttgtcttttctctcccaattataaaatttgttatacactttttccatcttctgtaaataacatttctcccttcaaaatattcactttagggcgcaacctttccaatttgtcactcagtcccacagctagcaattttttttgtcttgcttaatttgtcaaatcccacactttcaatttccctgcaagtgcctaaactcggtcagatttacaagactatgataaaagaatgtttaacatttttttagtactgcttcaaattacaagacttcatatttaattttatttgataaatttcttctttaatttgttataagtaagtgaatatgtagttttttattatttaatgttagatggttacgtttataacgttgtttagttatgacatgtgtttgaatgaccgaaggttatgctttgttgcttttaatgttatggtttatatttaaatgatttaagaatgaattctaaatttacttataataatttttaattgatattttttattgatttgtttacctgaggaaagtgtaagtaataattgtgggcataaatatataggtatcaaatgagtacaaaaataaaaattaaagttattattcccgcgtgaatatgatagatacatatatttattcagactctattcaatatcatccctaatcatgttcatctagtcaatgagactattggtagtgagtagtaatgttgtgatcactagtttaacattaatatgatttatttttgcttgataaagtattgttagtagtttgtaagttgtaactatataatttttttcaaaaaaagttataattataattttgaaacatattgctagtttgataaagaatctataccaaatgataaaaagtgacttaaatgtgttttattttttagtctcatgattttactttttaactattcattagctttagagttttcaatattttttaaaaggtctcttgttaacttgataattattagttagataatctaaaaactagatgtatactaaaaaaataataggacttcttttgttcatctctaaatataagatttttttaaaaaaaattgtttaacctttttgcaagactctttagattacaactcatattagattaataattataattagctttgtatttatcctttttttcatgatttacttgttattacttaataattattgatgtaacacgagttgtaatattagaatgagtcttacaagaagataaaaaaaaaaaaatcttacatttaaggatggaagaaaggagtagtattgtcttttttagtatacatctaatttttagattatcttactaaattttcaaaattcttataactaattcatttttatgtgaaaacg

SEQ ID NO: 737 - DNA, 1379 bp, Glycine max
  Soy_ogl_5024 Gm15:12808001..12809379 Cluster 2
cttattccaagacatgattattggggaaaactagctagacctaaaaatgctggccaaatggaactttcttccagttccataacaattgaaagatgcacatgacatatctactaaacaacgtgtttgaaaaataatcttctgactatacatctaacgccaaaatcgtgtttaaaataacatcttcaattaaaaacaataaaactacgtatgaagagcgtgtctggaataacatcttccgactacatccaacaccaaaatcgtgtttggaacatcttcaatattcaaaaaacaacaaaactacatatgaagagtgagtttggaaatcgtatttgcaacatcatctgagttctgactacatccaacaccaaaatcacatcaaataactcaaatgacacagaagctacaataataagcttttaaaggacatggatcaacattaaggcgaagtcaaagcaaacacgcactaaacccagaataaaacaagagttaatgctacataggagagtgtatgatgtctcccaccatgggaaacatattattaaccattagatatattgattttgtggaaggtcaagattttttatttttttattctttattcccttttttttcatctctctttgggtgcttctaagatcccaccaaaaagcttacatcattatattttattattaacttattttttaattaaatttttttagtctattattatttaaaatattttttggcatgataaaaaataaaacataattaaattatatttttattgaaaataataaaaataactaactcacaaataatacagcatctaagacataaattaaaataataaaatttacataattaaaataataactaattttgttgataatttggcatcaaattaaatcacggattcaaatggaatgaatttttggtttgaatccattgaatgaaaacaaatcaaagaagttgagaaaattttttaagataaaagtgagagaaaattgagaggtttagttgtgtaaaaaaaattgaagtacccctatttatatacaacggtaaagattaaaaaaaaattcaactatcctaaattttaacgatgataaacgatcataaaaattttaaatgaaacacaatggctattaatttgaatttatctttatttttttcttttttttattagaaaaatcttgaaggtgcttcattctagtgatccatatagtgcttgtaatggaaggtgctttggaagctaagctacttcagtgaaggagttcctattcaagcaattgttgcggctactcttagactgttgctcccatgcataatgcccttccagctttgtttcttttgtttccgaagatatttcatttgttttttccaatgagctttctcatagc

SEQ ID NO: 738 - DNA, 1959 bp, Glycine max
  Soy_ogl_29 Gm01:1685101..1687059 Cluster 2
aataatgcaaaataaataaataaatatatattctctacacttaataaaattttatttttagacttcgtaatttcatattatctaatttagtccttatacattaaaaaaaaaaacttatttttagtctcttcttatagatgatattgacattattttctacttgatgaataaattatactgtgcaaactcatgaaagcaacgtttaaaaaacaaataatcagaagacgcaagaacaaatttacaacaactattgaacaatgaaaacaaagacaaaatagagtccttgaaagttaaatttaatgtgtttgggaaagacaattagtagtttttttagaaaaaattaaataattttccacatcatttaatcatttaaaaaaatgcacttatttgttacgtcaaacagaagttaaagtcatttgtgaaaattatgtaagaagggactaaaataagttttatataaagtacaagaactaagttaaatgatattaaactttgatgattaaaaacaaaatttaatgaatgtaattaatacaattttttataaaacaaataaacatagataaaactaacgtatagggacagcaggcagctataaaaatttgacgccttcaaaaataaagataacatgttacatgttatcaaatgcacaactattgattttaaaaattattatatatacatattttatcataatattctataagactataactagctcttgattaaaaactatgaatataatttatcttgtaaaattaatatttttaaaataaaatccaacctattgttggaagaatacattatgggtcttgctaactagtgttatgagtctttttttttctaattatgatattggtgtaaaattattttcattaaaagtgatgataacttctatcggaaacctccagcacacacaatatgtatgttattctctcaatctaatttatttcatatctaataggcaaacacaatttaaattttatactacttagttaagaatcacatattaatactatttgtattaacggttattggtattaggacattattctaagaaattaaaaaaattattgtaagaattatagaaaaacaaaaaatcataaataatataattaatttttttatttcataataaatatccaaaaagaagaattattagcatttatgaatcttatatgaccctttccttagcgagggtaggggaatgttgtagcgtagagtactacgtaggtagcgatgcgttggacggttctgggctcattaactggaagattctcttgccgcgtgtcacactctttcacctcacttttgcccccgtacacgtcaagccacgggtcatgcaccaaagcccttctcaaatttctaaatcctcatcttccttcttcccacaaagaattatgatattgctatcctaataattaattgaaatattacaaggaccatccacttgttgcaaaccgaccctcaaagaatctacacatgtatcaccttctggcctatattgccccattacctaatacaaaacttactttcttccttgctttagtttcttcttttggactccctttgatcatcatcattttcattttgtgtgtgaatcaaacatattccccatctcttcactttcctttaattattttactcaagcattcacattccccctcattatgagccgtaatcaaaatagtttcaattattcacctaaacatgtttcaaatgttttaacaaactattgattttaacgcttgtttattttgttattacgttttttaatctaattgtaaaaaaaatataaacttagttgaatgtttaagggagaaaaaaaggaagagaagatgcagatttagtccttccttataataaaaatcaatattttaacaattaatatttatcgataaaaaaataatataaacgctaattagaaaataaaaatgaaaaataagaaagggtgacactcgt

SEQ ID NO: 739 - DNA, 1876 bp, Glycine max
  Soy_ogl_804 Gm03:2012742..2014617 Cluster 2
ggaacaaatgatatttttttttgaagcaaaccaaattatatttttaacctaaaattttgaatcttctatatattacaaaatatgttactaatgattagatgttaaattaaaattttttggtatgtcttttatttttaaaaatgagttattagtataaatattgtgaatctatattaatactaagatataccgtgttaacagacaattttgttgttataaaagattaatgtatactttcaatttatgaaatattagtgtaatacatggttctattaatttaaatccataatatttgtactaaatttaatttttgttaataaaagttataataatataaataaccttaacgtttaatatcttttcgtcaataaataacatttttatagtaaaaatttgtgtcaatattaatctactatagttttattactatattatgtgtttgttagtattagtgtaatacatggttctaagtctttttttttctttctcaaccacaaagaagatattctgacctcaaatgtattgtccgttgcaatttgactcgcatcggtgcccccaatgaattcaggaaggggagtgctattcagtattttttttttttaccttgttttctacatggtgtgaaacttttttggtgtaccagaataataatcatgttatagtggtaaaaaacaaatgttaataatacattttttgacacactgttttcaataaattttatccttagttgaaatatatttgaaattacaaattcataaaagagaataattaaataagttatgagatatacattttttttattcaaaaaatttcaacaaataaaaaaatgtgtaaaataatatgttgtcaacactaatctaaatgcaaaatatctatcaattttagtaaaacttattctttgttagaaaacctatttaatcctataattagatatctattctcaacaacattttttaatatagtctagaacctaagattcttcctaaaaaaaaaaaagcatccatgttcaactaaaaaattacactttctaaagcaaaaaaaccgagtgtatgtttgtttgattgttgcaaacaaacttttgaaacaaaatgagatttgtaaaattcaaatagtaaaacagttattttatgccaaaaaaatcagattataacctcataaaaatatatgatgaaacagaaaagaaagagtgaggtgatacgccatttcaaaacgtaacaggtacgaaaagcattattgtataaaagaagaaaaaaaagtagtacaatgattgtacggacataataattgtaggaactaggaagagaggcacatgcattcttaattgatacaaaagagttcaatgatttgtccttcgtagtcagaaaaaaaatctgcagttggtcggttgaatgagagactgaggaaagaaaatctcaaatgagttcgtagcaaataataatgttttgctaccatctcaacgtcaacggggaatttctgtccgtacaacaaattacaacaattatatttcttcttcttctttcttttttttttttttactaaaatttataaatcatattattgatttgagtatgtttattattgtttaaaattaattttagtgcaattttaaaacaaacaaccgcttcacgtggtgatactagaatcttctttttgtagaccacatattaaaagcgtctctttgaaaagattgataatagatgattaccttttaaactaaaagttattccggatttgtttaatgtaatagaagagtttaattgtaatacatgtatattggtatcgtaattttttatactattattttctaatacatgtttaaaaatacatacccttcttatatttgataatgttattttttaatttctacgatcttaaa

SEQ ID NO: 740 - DNA, 1970 bp, Glycine max
  Soy_ogl_4557 Gm13:38809831..38811800 Cluster 2
aataattgtcttagatttaaaataagaaaaaaattaggaggaataaaatgaaagcaagcttacgttataaggactttaaatcattgtgtgtgcatgtaaaaaggatatcaagtgagatataacttataagagcatgagagaagtaaatataaccgtatgattaaaattagaattaattaaaataattatgactattcgtatataattatataatctaaattaactcttttaatacctaataattgctacatgttatatcacaacttttgagtgaacttcaaattctttgaaacgagaaattgaatacaactatcacaaagaaacattcacaagtagctaataattaagtacaaaatctgaaaacttgcatctaattaagatcactaaaggactacttgtttagttatttatgtactaaaagtagtaaataaactatattagaaagtttaaacattatttaacatttagagattctttcatgtaattaataatcttcttatacatatataatttgaatatatttttttatatactatcatctaatctaattcattataaatcaccttataataagatttttttaagttgataataaatagtatttgaataactattaaatttatgataatttaattagttgattgtataacttttatactgaccacgctatatcaaaattaaactcatgtataatgaaagagggaaagtgaaaaggaacggataatagtcttccaacaacgagagtaaaaataatgggtctctttatgctttctcttgcatcaaggcagtgaaaaaagaatatgtggttttcgtcaaagaagataacacccaacaagaaagcagcagaactactcaacaaaattatgtatattttgtaccagagagatacaacaactacaagcttgaagcaacaatgaaaaaatagaacgttcttcaatgtcgcgtttctaggtgatgaaacacttgaaagccatgttgcattttgcaattgatgtcccaaagctttttgtctcacaaatcaattaacacgttaactaaacgattttattagcgtcaactcttaaaagctgttttcaagtaattaaaaaataaaaattcttgattaaaactttggtcgagctaggccaagttagtcagagtaatcaaatacaaagaccttacatggttgatgaaaaaaaatgaccaagaccaaattaaaattaaatttgaagtatgtagtattttctttttaatttataggcaaaattttgtactttaagaaaacgttggggagctgatcacacagagaggttctgttctcagtgtcctgcctacttttattcgcatttttatgcgtaatttgattatgaattttttattttttattttttgcttcgatttgattatgatttatttaccgcaagtagatctccttgatattacgtactagactactactagtgatataaattccctctctccacacggagattttctaatacttattcttaagaaaaaaaatactactagtataatgtattttaaacacgaataatataaacaattacaatttgatcttttctcattttaaattttgtgagcatcacgtaatatatttcattacaatataaatgttaataatataatctctagtatattattttaagtatgattcattattaattaaaatttattaaaaaatttatgagtctcactccttattttgtttaatagttatatttcaagtgacatacttattattacgaaaaataatagttgtcgtatgtcactccaagttaatgataaaaacttcttcacctaactagtcaacaacatattaaacaggttgatgtcagactctacacccgggccaattttgttgtcatggggctacatccttggctactttatcatgtaacagcttaaattattacatatgaatttaagactgagattaatattctgtaaagttattactttattttcttcct

SEQ ID NO: 741 - DNA, 1600 bp, Glycine max
  Soy_ogl_5819 Gm17:40438101..40439700 Cluster 2
tttagtttaaatgtttaatgcgatacattgtgaatatatatcagtttacacatgtaattaattcaatcctttcacttccagattcctacaataattcagctcccatgccaactttttgctgcatggctagtatattataccaatttaaatggtacgtacagatagaggttggacatgtaacgaattaagtttgaattctcattaagacaaatacgcatctttagtgctcgagcctcgaatgccatcaagttaagattttatggttcaatgggatgtgatcacacaacatgattcagacgttttattctgcatatccatcacatgaacagatcaaattcctgacagtagagagcttaagataaacaaaacctctccaacactattaaaactctcccataccattagtgaatgctgcaattatttcacatataattctttaggattctagtagtgtacataaaatgcaccattacatagaccaagctattactattttttgtgtaaaatcacaacgatatttttttgttcttttttacaaagaaaataaattaagttcttaatttctataaaaataaaataaaatttaatatagtattagcttaaaaagaaattaatgggaactttgtaaccttcgcttttgataactgtgcttcgacatagtggagattgataaaaagaactatattgctatcaactacagcccataaagaattaattaaagatatagtaatatgtttatttattttttttataataactcgagactttatttaaggaaattaaaagtttaacactactcaaatcaataacttgacagtaatatatttatctaataaaataagataaatcctattgtaaaaaaaataaaaaataaaaattgaagtttgcaatacacatcaccggcagtatgaatgccttgataaaaactctgttcaaaaagcaatgtttgtgagccattattgtctgcccgttattttcaagacattgggttgaacataggaatgttgacagcatcaaattttcctattagaccattcgtaactcttttttgaagaggacaattcgtaactctagtgattataattaataaatatatatttttaatttcatgacccgttttaaaataaaaataaaagaaaaggtcactataaacttaatgtctcctggtcttttttatcatcaaataggagaaataacgacaacaatatataacaattctcttcatttaaaaagaaaatatctatctttccatctaaaaactcttaagtcctacttatacctcaacaaccacaagcaccttgcacggcccaaattcatcaaaaggattaagaagaaaaagtatacacaaaaaagaggacaagcaagctatgtaaacatgtactaaggtatatagcctctctgtcatgtgcaaaaggatttgtaacaaatgtggggataaagtctcagtaacaaaaggagtctagcaaagaatcatgagacaagtatttttcagacgataaatataaccaataataaaattgaaatatttggtaaaatgaactgcataattttccaccggttccttatctccaaaggaacaatatgctcatctttgaaagct

SEQ ID NO: 742 - DNA, 1500 bp, Glycine max
  Soy_ogl_1928 Gm06:13770001..13771500 Cluster 2
aattatatgaaataactttctacttgcatttgagagctaaaatctgtgtattgactaaattgacataagatccaattctaaaaaggcttctagtccaagacaaaacataactactggagcctgcaggggagtgtaacggcttttcaaatacagcttaccaagtgacaccacaacaaggaggattagagttttggaggggaagtaggtttccagatgaacctttctttcttttttctttttttatcagcaaaaataggattatattaaatggggtactggatgtacccataaagaaatacagaaatagtagcatttacaagtctaagcaaataaatgcttgataaccaaatggaagcaccccagtgaaacccacgagtatttaaactcatccaatgcatgctcaccaaacgatacaagattgattacatactctcaccctagatgaacctttctaaaagccaagtctacagttcactgatattctgcaaagaacccattatttatcatctactgccatatccaacgtcgcaaggaaaagactagactggtgacttgaacttaacgctttcatcatagaaaaggaatttggattctctttaatagtctttatcatgttacgataaaaaaaattaaaattaagataattcaagcatgagcactcaatatcgagactttttttttttttttacaaaaataggtaaaactaaaaactatttccacaaaaggtaagatgtagtttgaaaattatttatggggtatggatcattttgcttttttgcatcgattatatcttcagctgatttagaaaaactgaatttttatataactatagttataaccaatacaaaaagtcaaaatcacttatgttctctgaatagttttcaaattacaccttttaggtagatagtttatacttttatctatttttgtaaaaaaaaaaattcaatccacaaccaatcaaaagtttgggatattattaaaataacttcaacacatttggaaataattttgtttattatttcaatatatttttttgttttacgtataaatattgtaattacacaataattactcacgtagttaatggtatgtcttgttataattattttcataattttttcttataatatgatactagttaggcccctgctggacctaattataaaataaatacaagtttagaaactcaatcgaaaaaaaaaattaaagacctaattaaaaattgttaaatagtttacaaacatgcaaatcaatttgatctttaatttatgtagaacaaaaaattaaatttagtttatgtttcaaattctgggtttgagggcttgatcagagacaataacaggatttggaagctggatttctcagttgccgtggtttctcctctccaccaatatgaacgctgagcttctcgcaatctaccacggcttgaaatcagcttggaatgcaggttttaggaacatcatttgcgagacggattctatgatggcttatcatacttta

SEQ ID NO: 743 - DNA, 1232 bp, Glycine max
  Soy_ogl_5587 Gm17:8386101..8387332 Cluster 2
atggtagtttgattattttttttttacatattatttcatatattatatgttttcctaaaaatattgtttaattaatatcagtttgatcacagattaacggaagttgaaccacttaaaaaaaatggaaaaataccacgtgcatgacaattgtcaaatcatgatacatgtcttaatctcttcttcggttggacacacgggagcggccaaagctattataaatcttgttcaatgtatagtacattgaaatttcaatatttgtctttattaattctttccgtttacgctcatcagtcattactcattactattctataatatacatgttttttttttttaataataagtagaaaaaaatgttttttctttcgatcaaacctagttttggtgcaagtacttttaaatcaataaatttagtcttttaacttttaagaatatctaaatttaatttttcttttcttttttaattttgtgttgggaaaatttaagttaccattaaatattaagtttaaatatgaaaagagattaaattcgcatatatttttaaagtaagataactaaaatttgttgatttgaaagtataaagaccaaaatctgattgaaagttcaagaattaaaaacacatttaaaaaaaaatcaattctgagacttttaaaatttataagaatttaaactaacaaaaaaattatttggattaaaatcaaaatttataggatctatcaaatatattaaataaaaaataatttcttttaaaattatgaattaactagacatactttatttttaatttgtgtaacgttgacaaattaggtaattcaaaattaaactaatccgaaactaagtcgagatatgaacagataatatgtgactcattagtatatgtaaggcttagttaaacaatatgtaactttttgtatcatatttagttagagacaaaacctaaaatctaatatgaaggaaaagtagtttaggtatatcatttaatttcgaaatcggttaattaaaaaaaacttttttttagaggaattacaaaactgaatgtcagctgattacttgaaatatgtaaggcatgattaagtactttttattttgttttggtgacaattttttaattatttttttatgcatacattaaggaagaaaacaaatacttcaagtcaaatttagcattatagtttataattgttacgttggcacaatagaattgaataattagattatgtgtacacataatt

SEQ ID NO: 744 - DNA, 1100 bp, Glycine max
  Soy_ogl_3309 Gm10:1882901..1884000 Cluster 2
acaaataaatttgtaagcattttatccttttaaaaaagaattttttgcggtgagaattaaattgcactagctgatgatgacgatattattggcatgaggggggccaacattctacgcttcatggtctattctgatattggatgttgtgaccatgaaaaatgtgctataaaatgctaatacgaggctcattacaactctttctcttctgtgttttttgtcgcttaatttaattcaaaaccatttccatttttaaagcatgcatatgttctgttgctatataagtttggcttatgcttttgttgatgcgtgattttgattcattttttttagtttaattcatagattttagaatatctataatttttttgtttaattctcaattttatataccttttacttattttattttgatcaaaatgaatcctagatttaacatatttatttaagatatcttgaaaaaaattaattaattaaaatataaaaaataaaggaaataaatatatataaaactattgaccagactaaaattacatattttgtaaaatatgaaagactaaattcacgggaaaaaaaaaatctaaaactgaagatcaataattaaaaaaatcaaaattataatttattcaaattctttaaatcttaaggtcagtgctaaccgtggtgagttagttcttaatctctaactcaaatttttctaaaagccaaaaaaaaggaccataagatttcaaaccaccatggtattattgattttttaaaaaagaaagactacattcgaatccataatataatgatttcaaaatatatctaaaaatcacaagataagcctattgacttttttaataattattttgaaaaacatgcctatcataatttttaattggctaataacataaaaaaaatttaagttgcatgaatattaaatgagagaattaatgtactaaattccattactccaataaagttcagtgctacttaaagtttcaattatgaattaaaaaacagatattgaaattacttttctccttaagtggatatattagattcaacttggataccaaagcttcaagtgactctcaaataggtacctggtgttttagatt

SEQ ID NO: 745 - DNA, 1071 bp, Glycine max
  Soy_ogl_5223 Gm16:1098201..1099271 Cluster 2
atgcctaattaaaaaatagatgtcttgtcgttttctgcgctgcaatttgatgcaaaaatccaaattgagaacagacacgctctccccttaacaaaatacatgaatcttccatatttctttttcttcttctttttttggtcctacacgaatcttccacttaattacaggtacagttctcatagaactattgggttgctttctcagtccatgatagtgatgatgtccaaatttacaccttggtgatgaaaatgatgctacccaatttttttgtcatgccagtgtaggttcttatacaaattcacattttaaatggttttattgtcctgggattagctggccggctcacatttgattaaaaaacagaaaattatattttaaaatgtaatatgattcattttaaacctttttaaaaattaactatgaattatgtaataaaaaaatattattcataaaaaatataacataatttgtatcttaagtcacctaaaaaacatttacatcatatttatttaatctataattttatactaaatcgaaatattatatcaccatttacaattattgaatcatataaaaatttttaaatttaatttttattcagtttatacctcttatttattaacattattattattatattaaattgtaaaaaacccacgagggcccatgaacccagattcaaatgtctggctctagtttttactgtatctaattgaagataagagtaatcattgatgttcatattgtttttcacctcttaatcgtaattttggtcaaacaaattaatccatgtttccaatgacaaaaattgatcacccatgttgtatatagtatcatgaagccacacacacacacacaaaaaaaaaaaacatcaatcacatctttttaattaattttgtcttttaaaaataatttctgttttagaagttttttatgttaaattattcattttctctattaaaaatagataatacattaactatgttttttattttactttttgaatatcataactaaatagaagttcgctaatgaaattaactgataacataatcatacaacttgatattt

SEQ ID NO: 746 - DNA, 1651 bp, Glycine max
  Soy_ogl_920 Gm03:37245850..37247500 Cluster 2
ctcttttgacttatattagaatagttaagattccgtcaatctttaagattttgaaataattaaaggtgattaaaaattttcattatttttattttattttaaaaaaattaaaaaactaaaaaaacaaagactacctccttcctcctgaaagaaagaaatctgtgagtctctcttccgtggtgtcctctttccctctttcctggcgtcacaccgccatcacctccctggccaccatcgtcgcgggccaccgccaccaacacctgcgcattacagattgtgtctctctctacttaacttagcaatgggcagaaagtaaagtacgaagagtatttttttaatcttggatccccaaagacaatacaatgatcatattttgattcctactcacccaaattgaaaagaaattaatattatcaagaaagtaaagtacgaagagtatttttttaatcttggatccccaaagacaatacaatgatcatattttgattcctactcacccaaattgaaaagaaattaatattatcaagaaagtaaagtagcaacacgtacgtaagacctggaacgttttgtttagtcttgttttctaataagaaaaccttaataagctacaaattaatcataaggatgatcattgatcatatgattcatgaatgacgaattccactaccacgaaacctatcctctatgtctttctttatgttttgcttattttctctcacacacatggctttgcaaacaaagcattatcccaagtaattaagaacgagagaaacggataacattgcattgatcaagcatccgggaatagattcaaggacccaccaacaaaagaatgataattaaaatcgaatataggttataccctgaaaccatttttattggctaggagtagccttgaccaaataatagtacaaaagaaattgcaaaatttcacttgcaatggaaaagaaaacatcatgcaacatgtaaatcaattgacataaatttatttcaatttaactaaagattttgaattcaagttgaattaaatatttgaaatagtaattttattgtttataataattttatttgattcaaacataattgtctttgggtaaaaaaaatacatatgataaaaaaaaacacttggataagagaaaaaaaagaagacaaatcgctgcaattttttagccctcaaacgtgctcaaatactatagtatatgacaccttaatttctagctaccttctgaagcaatggtttataattttccactattcggtgcttgtttggtcggtttcaaactcacatgagtagccaatttgacttggcggctgcataaacagtgttaacaggtcatcaaattgcacaagtgctttgcacattacagaaactttcagcggaaataattggttggaaattacttgttggtgaaggttgtgaatgaaagcagccattggatgcacatggactcaaattctaattactcccagaattccagggaaatcaatttgtttatgttttacttcatttgacagatcacacttcattctaatccgaatgttgctagtgatttatttttcaactgtcatatgaatggttgacgagttattcaagtattttaagacctaatttacttgttatagtcacttattaaaaaaaggtttcattgaa

SEQ ID NO: 747 - DNA, 1600 bp, Glycine max
  Soy_ogl_3539 Gm10:44995301..44996900 Cluster 2
tcaaaaacggataaattgtactaaatactattagaatattattttccattataatcatccaacttgaacaatattatctacaataaaaaatacttaccttaggtctctgtcaaaaaaaattaaagtcaccaatcaaattaattaagtagtttaaaaaactcatgtatatacctccacagatggtaatttctcccttactaagtaaaaaaatatgtttgaatttttctttttaaaaaatgatgcaaagtagaagcaaacagagactcggatgaaaacaaaagtaggtgtgaaatttggagtccacgtgcagcaaaaattgattggagttgccagcattgtcatagtgctttgatacatatgttttcctgctcctaattttatgtggctatgagatttttgcatcaacaccatatatagaaaagcaataagaagttaagagctagcctctgaaatccaaagctaaattttagcatcccatggaccatcaacattaatattctgatcttcttgttttcccacccacctttttcagatggaagcacattcattaattcggtccaacccatcatacacaacatatatacataatatgcatctgcaccatctctaaaaaagacaatgattacactacacaaatttaaattaaacaaacaaaacaaagtaaagacgaggcagagccatatctatatatatataaaggaaaagttgtttggattcgttatacaaaactgaaaaatattactacttactaagaagaaaatccaccatgataaattttcccaaaaggtttttcctatataaggttgagatcagcacgttcttccaactactagctagtttcggtgttgtttttctgcagaagcgagaattttcccttgtgaaaccaaatacaggtaaatatagagagagagagagagattcacggtggattttatcatgaaagttacctacagacacgagtctcgtaattcttacttatttttttatgtaaatgttaatggttaattttattaaaatgttagtgagagaaatttgaattcaagattttttttaatcatctaagttaatttatattatttttttatatttcatattaataatatatatgtgtggaaagtttagattcaattatagggatatagtagtatattattggaacttaatttatatcgtttacgaaatattgaaattatcgctatcaaacaaaaaaataattaattgcacccgttgataattaaataattaaatttatgaggcactgatacggttcgatgcttattttattatgattttctatgctaacatttcgatcatatcattccaaagcttttcttcactgtaccaaaaaacaaaagcttttcttcaatagaatcttttcacttcatgattaaaagcttcattaaaacactgccggggtgccggttctcaattgaatattaattctgttatccttctccataaatgcacaatattatttatttgggtgcataatgcaatactacttctttatataattacaattgcttccttttgtacttttagtggttaaaaaattataattgtttatatgattcagagaaactgttgctgaccacgtatc

SEQ ID NO: 748 - DNA, 2673 bp, Glycine max
  Soy_ogl_2063 Gm06:43091928..43094600 Cluster 3
ctttagtattaaagtatacgtctaatatggataaataaatactttaactcatatgaaaataaagattaaaattattacatacaaatgagtattttgtcttttttaaactcgaatataaaaacgagtcctattagatcttagactctacctataagaagacttttctctaacaatagttaacaggaaaagacacatgaaggatggaagaaaataaattcgcacacacatcatcgtgaaagacagccctatgtttgaatatttccatgatttatagttgtatcaatcaaacagaaccatcgaagttagtacgaaccccattaggccattagattatttaagtacttgcacaaaagccacaagtgtcaacatcccaggtcaaccgtatccacggtcctgctcaacctaaagtctccgtgagccaattcaattgatcaaataggtgtaattttttggtgtcgaaccaagaaaattctctttcttggtgaaaaaacttaaaaggataattttttttttcaaattaactcagttttagttttatgaaaaaaaggtcttattttcatctttcttatttagaaatattctattttttttttgctcaaaatagttatggttaacatttaataaaaattataaatcagttttttcagcaaaaattacaacttaattttttttaaatttaatttttagttcttaaaaaaatatttgaccgatcaaaaatttctaatttttttattgagaattttagtctcaattttttgtttaactagttaagattcctaaacatttaaaaatttcaattgttaatccctaattaaataaaagcttgaacttattagttttatttaattaatgagatttcatgtattaaaaactaaaattttcaaaaatttaaggattaacaacctaaatgaaaaaaattaaaaaattttgatcggtcacacttttatttaaggactaaaagtcaattttttttaaaaaaaaataaaagaacttaattggtcaaacttttgtttaaagataaaaaatcaaatttaaaaaaaaaataaaaactagaagctttttatgttattcactaataagacacataccagcagcgtgggagacctcaatatgtccccctttcgagaaggtttatgatcgtaggatatgtttctttcgagataagtgtgagactagtgtaaaactgcttgcattggattatatttttttgaaaaaaataaagtttcttctttccttgttgcttctatgctcctctttccccattgctgttctgcttgttcatttcaccaattttgaacaacccaaatcttattccccagatcctaaattaacttagaagcatcatcataaaataaattcaaatacagaaaagtaaactgaaataaaaaatatcatctgcaaataaaacttgaattcctatggactacgaggaagagcggcatgaagtcgaaaattgcaaaagagagacaagaagaaaaaaaaataaaaaataatatttttgtaatttaatctagtgtgaaagtcttacggtagtcttaaactaatctcaacaaaaaattatatctaacggatcacttttatttctcagtgggagacatgttgaggtcccccaggctagcctactttctctaaataaaagttgaagttttattttgataactgatattgaggtttattatggtatattccacggtggacaagcaagtaagttatccaatggtacaacaccagttttgttagttaaaaagtcaattttaaccttaaaaaatcctaattacaccctcatcatatgtgctccgccacacccgtcacctacaaccttcctcaccctcatccacaacgacgggttgatcaaagtgagcctccagggtgaatgcaaccccttctgctaaaactctcaagaatcaaaatcaaaaaaccaaaacaagaacccatgctcaaaaatctaaacaaaaaactgaaccattttctattcccgtcacccatcaccagcgaccaaccttcatctccctcatccattggtttcgtctctatccttcccaaaataaatattagggctgatattacttctgcacgtactagtgtcacaacttaacttgctatttcagggtggatttcaccttttattatgtgttatgtgttatttaatttagtactttgataagatggaggtgcgaccaattaaaaaatgacaaaataaaaaataattatatatgaaaagatattggtgtctcatcatttcaaaaaaaggattgtatacaaaataacctagaaacttagaagagtatattgttcactttttagtcttatgaaagaaagaaaaaagataaagacctagtacattgaggaaaaaagaaactcaaagtcaacaacattgtttgatctatatccaaatgtaacaccgctgtgcaattcatgtagctagtctcatataacatgacaaattatttttgttgttatcgatagtactgtaacactctaacaattccaaatcaaattatagaaaattttgtttgtgtgatctgtaaaaatataattgatgttcaaattatttataataaaagacttatttcaaataattaattaaaatattaattacattcacattattttatgtggtaaagttaatataatttaatttctacattgtgtaaaatacaagtattgtgagag

SEQ ID NO: 749 - DNA, 1936 bp, Glycine max
  Soy_ogl_157 Gm01:43996501..43998436 Cluster 3
gtgatgaaataaatggagggctaggtagcaagatgcacgtgcatgcaggagacacaaatcttgtgaaatctgaatcagagacgtcattttatgtctaggcgtatctgtgattaaagggataagctgactttcatgtagcctgtgtccctttctggtttaatgcgcactactactattcagtgttaatttctaatgttaaccataatcatacgtatatcaattgatataaaattattttaatttaaaatcttggagatatataattatgttaaataagagataattttattgttatataatcctacttaattcgattaggattgtcgaaaaatatatcttggacaaaaataaatttatactgttaatgttgccaaaagaaaaaagacaaagaaaaaatgaatgtttcatgctgcatgaaattaaggtcctcattattttctatgcccacatgaatgaaattccgatccctccctccagaacacatgcactgaaaatgatgttgagatctagtggaaagatcgtgtgctgaatcatatatggatgagtttgactctggctgctagtgcaaaaaattaacatggtgtgcgggggtacagtgaaatttggattatgtaatgaaagagaaagaacaaagttaagttgcgtgagtggtaaggattttcaccccttatgtaaaaaggatttccaacttttgagagtagagtaaatctagctggaaaagaaagagtctatcatttgcctttcctactccggaggagaataggtccctagtcctacggttggtgggattcaggaatgcgtatgagatagcatgatacgggatgagttggtttagattagattgaaatcatgacaattttttattcaaaatcatcttatttttatctattcggtttaaattgaattttttttctaggttgagtttttaactcgaactgaatctatccgactataaccagaatgattcggatagtggtcaaatttattattaaaatactaaaaacttaaaaaccaaaaagttatgaagtgtgaagtatgaactatgaatcatgaccatgtgtgcggactgtgaaagaagaaaaacataaaatgggttgggttaaaactttaaactctaaaggttaatgaaaatataaaaaaaaaaacaaaagaattatgtaatcgaatagattggattagattaaattctcaaaatcaaaatccaacacacaaactgaactaatcaaaatttcatttttaatccaatttgaactaatgattggagttaatctgaaattttcaatttgggttgatttcgatgcatcagattattagtttgatttgaatacgtggctaccccagttgaaacactccttgcaaaagtaaaaaggaacaaagacaaagacacaggtctagttcattacatgtttaaaacgaactaattttagtataaaagtacatcagtaaatatttactagaaaattggaaaaaagtaaaagttaatttatgtttgtttataattataaaaaaaattgtaaaaggaacctatgattttacgagaatctatttaaactagtttcccattttaataaaattctaaattcttttcagtttttaattattttgaatttcttaaaaaaactcatgatttttttaaaaaaattaattatacgtttttgaaaaaatgattctgtacaaaaactggtaagagacaggcctataaaagaaatgaacaaattatactaagaatatttaatactagttaaaaaataattaaaaattaaggattttattctattatttattttttaacatgaaagtatttattatttttatttttaagttatagattttctagtttcttatgaaactaaaccaagagatattttctacactcattttttgctaatttggacttaaattttgtcttgtgaatctattcttactctcattaaag

SEQ ID NO: 750 - DNA, 1600 bp, Glycine max
  Soy_ogl_1611 Gm05:25446001..25447600 Cluster 3
atagttaatttctaactattggatatgattgcaggataacaatggccatgggattgttctattatggtctgcgagacacatcagctacctactcagtgaatatttataagcttctggtatatatatgcaaactcattcctctaaatatttatgtattcattcctcttacttattttaattacacttctggtatatatatgcaaactcattttaatttataagcttggaagtgattagctaaatgaaaattaaagaaaatatttaaaaggatagccaatattaaaatttactcattttgcaggagcaagaaacaatgttttcaatatttaaagagatggaaaaaaattatttaaagggtcaaaactaaaatatatttattattggaatcaaaatcacatttaactgttgtaatatttagctctgtcattcatgatttaaatttaccaataattattattgattgatttttatttttctaaaagtaactcttttttggatgtaaggatagtgtagtttagtactcttaactcctaccaagtcttaactaatagatgcaaatgatgcacactacgttgttgacaaaaccaccacgttttcaaatagtttttaattaattacttaatttttttctgtatgtttgttgcttattttattaacagatattctactattgttgttgttttataatagattgaaaattggattgttcttagaatagttcaaagattattaacaaattatagttcaaaattattttatttattttgaatcaccatcgctatataatgaagttatcttaacaaaaagaaaaaggaaaataattattagtgatgaaaaagaagcatgagatggggtgatgaaaggtgaagagcttaaattcataaatcactagtgatatatttaaaaaagattaattaaaataaaaaggtcaaaaataataaattgaaatataaaataatatcaaaagtaatatgttaaaaataaattataagtgtctaagtaaattaactttttttaaaagtatggtgttgaaagtgaattagagattggtaaaataagaacaatattaaaagtaacaaaaataattttttcgaatataataaaaatttaaaaaatatatatctaattaacttatttatatcaaatattaagtgtattacttaattgaatttcacacttaaaaaagtctaattatatttatttaaatatttttattaccttaattatctttgttaaataatagccatgtcaaccgtaaaactttaggaaagaaaggcacttataaatgccaactaacctaaaagcattacttggccttttgtaggtattatatttattataagatttctcagagattaatatcttgctgttttctaatattttggttgagtaaaaggatttggttgttttgtgtgtttaaatcaaatttggattcaacgtggttcttaggatttcaagaaacttacaagaccttttacaatttttgtcattctagcctgtctttcttaagatggcttaggttctatttagataaacttttgtaataagtacttattggagaagaacataagaagataacttgaattgagattctcctatt

SEQ ID NO: 751 - DNA, 1768 bp, Glycine max
  Soy_ogl_2019 Gm06:19873074..198341 Cluster 3
tttaccataataatttagatattaatgtgacttcagtaaaattattcattctcatgaattaagtaaagttttcttagttgtgtttataaaaaatatatgtatccttattttatgtataattttatatttaatgtttaaaataaaaaggtaaattgctctaggaacaagtttaagaagatcatactgtagaaggtatattaaattataatgtttggttgatataaaagtttccacaggttttgcaattgacattattttcatgtataaaatatttagtgtataataatattatataataaacactaaatttaaaaatattttattaatactgtcatcttttaaccttaaaacataaaagacaaattagtggaaaaaagaataatcattattggaaagaagaatattcatagacaaactattaccaaagaagaataatttcgtaacgaaatatcctagaatgaacagcaataaaattacaaaataccaaacctaaaaaaaatataatcattaatcattttataaaaattgttaagcacataacaatatatcctagtcagattatctaaataaacatcaaaatctgattgttttgtctttcttcaagttaatcctaaaacacaattcaatccattgctcagtagaataaaagttcctaaaatgaaaaatgagatggaaaaaataaattaaatgttataagttcaagctcaaattgtaatctcattgatcttcacccaaattcttttaaaacttatacatgagaatcttccttatccctaaaatgaaagatgcttcatcaaaactttgagacaaaaaaatacaattgaaatttcacataaacaaattttttttttggattaatacaaaacaatactatattatttataagcaccatctccattgaaaagggaattttattcttaccaaagttagtaatatatcaagatgttgaatgcaaagattgaaaattagtcaaaatgtatcaaaactcaaacaaaaagggacaatataaaagatggtacttgcaatatatagtgcgacgtacacaaccaatattgaaacctatacatcaacattccaaattaacatgttaattaagaattgcatgaaccatataaaagaggaagaaaaggtggatagacaggaaattagaagaaagctgtggagagttcctgcgcactgtcattgttgagacgaaagagtccgaaaaatcaaaataaagagatatgagaaaaagaaagtgaaagaggtaagaaaatgaatcgtataccataatgaaatttaaatatcatgaaggtcgtaccaatgattaaactaattggtttttctccatcaagcacgatcgccgatgctccatcgagaatcatcaaaaatcacaaatgttgttacaaccttcactatgtaaggggagtatatatatgcaagattaaaagtttgaaagaggaatggaaagaggttatcaaaagaaagtacataacatttgaaaaaaaagctatatatttggacatcaattttaaaatgaaacgttattgatccatatttcttaaatgaaagtttgcaattaaagcctattaatgcaaatgttatgattttttcctttcaattaattatcaaatgcttcaaaaaaaatgtttccacaaataccccactcttctccttatatatatatggcaattccaaaattatttccttgaatattattcattatattgtaaaaaaattatattctaatattcaatctattagtgcaattcataattgtttattacct

SEQ ID NO: 752 - DNA, 1158 bp, Glycine max
  Soy_ogl_2800 Gm08:34790543..34791700 Cluster 3
ataatttaatttacatatgtagaggtcaaaattaaggattattatgtgataatttaaaacaataaaaattaattaatggaaatattaatcattcattttgattttgaacagaacaaacaaccaaggaagcaacctgcgggacagaaattcatttgaaactgttttataattttctttaaaataaatacatactaaatgaaattaaatgtattaggatttgtatttagatttttcctatataatgcgacagtttgtcgtatatcatcaatggcttgttttaatggtttacgctttcaagtagggaaatagatcgagtggcagaaccggatgatgaatacacacattagccagaggttggtacacaataattttccataatactctttaagagtttaactatagttgatcataaccatgtgctttgtaaaacttgactagcagtataataaaagcttaattgtatattttatcctcaattttttttaatttttggtaaattttatctttaattttaaagaggcttacaaattttattccaatcatttttctattaataaacacaaaaattagggtaaaatttatcaaaataaaaaatataaaaaatggagctaaaatttatcaaaaaaaataaaagtttggtgtaaaatttatcaaaaaaaaagttagggattaaaagtgaaattattttagaagtaaaataatagaaaataaaatccacaagttttaaaaaatgaagataaaataagttaaattaatttgttggagataaaaaaaatgtaattaaataataaaatggggtgttgtgtatggatcctgtgcagccatgctgcctctacaacagtgatcaaggccattggatttaaatctaatggttatcaaaataggagtataaaaatataattatatatttaattttgaagggttgatatgctgttgtgggtggctttagagaatctaagttcgaggtgatctaactgacccaaagtaaatatgagattaaaggcatttacatttatattctgcactcatattattgtatcgactatctcttgttatattttaaaaaattcattctaaaatgtaaatttatatttcaaaataggtacaagatgtaagagtggaattgcaggatacaatagctgagattataaatatccc

SEQ ID NO: 753 - DNA, 1000 bp, Glycine max
  Soy_ogl_3898 Gm11:33930201..33931200 Cluster 3
agtgcttaaaataatgtttttcaactattcaaaatatttttttactatttaaaataatatttaaagtactttaagaataaaaaaaataaaatcaaacacattttttgaaattgaaaaagacactaaattacagcaacccaaaatgtaattaagcccccgataaatttaattttaaaaattaaaacttcactactatttttctaatttttttgctgaatttctattcttcttctctcttcttacattaactgtcaaagtataaattcagaaaaaaaataattataaataaatttaaagttaatttcttaaattaaccaattttcttataaactttaactagtcaacatcttgtaaaataaaaacagaaagaatattagatatacttgatcgaaaagatggaagtacattccaaaattgtctatattatgtttgtcagtgtagttataagagttggtagctatattaaagtaaatgtcattttttttaactacaaatgccaaattcctctaagcacctaatccatatatgttgttgcataccggcgcaaatccttcccatttccatagagaaatgaagatctccatttcctttaatattgatgtaatatgtggtctaaatgaaatgaacggccaagttgcgaaaaaataaaaaaagcaaaacgagaatcctggagtactgttctaatatttgggatagttatcctcttcttccaacagcttgtaggtcccagcaaagttattaattatacttccaagttggttctgcagtgaaggtcgccaatgctagagtgtttccgaagtaataggcaatccggaaatgtgggttggagtttgagtttggatctgatcctccaggtggacagagacggcattcacgataatgacggtggtttcttcgctgtcaatgttgattatgtggagtttataaaatgtgtttgttttaatttttgtcttaaagtactttatatattttaaatggtgagaaaacattatctaaaata

SEQ ID NO: 754 - DNA, 1200 bp, Glycine max
  Soy_ogl_4035 Gm12:11948601..11949800 Cluster 3
taatcatctccgtaggtatatgtggagaagaacattttgtctttcatgaatggaagtattctattccattatagagtttttgtggtgacaaatattttgtgtggacattatacaaatttcggtttttggttgtatacaaatccgtatagatctgagtatacaagaagaaggacaatgtggcaccatcagagttattgtttgtttttttcctgaaaacaagatactcttgtggtcgaaacacgagactaactctcaatctaatagacttttttttcattatatataaccaataaatttaattatctaccaactatatttcaccttgttggtaccatcagagttattgtagcaccgattcttgttaatttgtgggggcacaagacacggacagaaaatattccgtcgataactgggccacttggtccaccagtacttgttgtagagaggaaactaatccttgtttcgctaaatgccactctacaaaggaaaaccactgcgccaaaaatttaaaaccaaaaaggactgaaagccacttcacgagtcgatacccgtttgccacaaaaccagttgttagaggcccatggtggctcaaagggcaaattttacttgaatgtttgatttaaaaacaaaataaaaagaaaatgatgcgaaattaagtagatttttaagttgtttagtatgaaaataaagtgagagaaaagtaaaattttattttttcttatttagttaaataaaaagtaagaaaaaaaagaaaggaatgaatattattatatagataactatgtatctaaaagaaaatacttgtataacataataataattaatgtgggtaagtaaatatgtttttgtctttcatctaaaattttctaaattcagttttagttttctgaaaaaaaaaatcctattttgtgcttctaggaaatgttttatttttatcctcaaaattattataattaaaattaattgtctttataaactgctaaaaaatatactttgaggatcaaaactagataaactgataataagagacatttttttaaaactaaaactgagtttgaaattttaaatttagagaaactaaaaacatattttatcgtataaatattattctatacgtattttacaaatttacttcatatttttttagaatgctagtttaaataatttaaaaatcatttaaaactattaaaatatgatatt

SEQ ID NO: 755 - DNA, 1523 bp, Glycine max
  Soy_ogl_5415 Gm16:33880778..33882300 Cluster 3
gcatgtttaatacgtaacagcccgccatatacgccatctatacaaatccttgagatgtcacgagctatattccttcttccttgttacttataaagaaaaaaaaaattttgaagtttaaattatatcaatatacaaattaaataacggtagtaattaattcaataattaccaattaatgtaaactctagttgttcataactcatccgatatattcaaattttataattctttgaagcttgataatttatccgatatatatgacttataaaattacaaactaactttgtcccaaatctaaatatatattagtaaaggaagtgtccaattacattctttaaaagccttttttttttctttctttctacaaggataattagaatacaaaagcttgacagtgcactaacaattaatgtatatataatacttttctctgtatcgagaaatatgacaattcctttctttgccggtaactaagttacacattgtgaatcatggccttttgtaagtgggtacttctggtaccgttttatgaatatattaactttgtttatatataaaaaaaacttttctgtatcaacaaaattacttgtaaacatgatgtattatttcgataatataaatatataattttaatattaatactttatttttcattaacaaaaagtatactaataaagacaaatttaaagtcaaatcatatatatgatatttttttcgtgctagttataggcgtgtctaaatgtcaacgcttctataaatgacactttttatggcatgtggtcctcttttcacgttgcaggaaacgtgaaagcacttttacgagacactttctaatatattttttattattaattaatttctcttaaaatttatataattgtataaattttatatcttattttgtagtttttgataaatttaatcaaccaaaaatattaaaaatatgttaataagtatattgctagctaatatttttcaacacatgtttgttttcggctggtcaacacgtagttttaaatgagtcaaattgtattttttgaagaataaacattttcactccactagtgtttgtagaaatttcaagggttgacgggtgctatggccccattggttctgcctctcattttatgataccacatattatattatcattatcaaaggaaaacaaaatactacactcttgctcttggtttaaatcctgtccaatcaatttgttgccacgtttctgtctaataacactagtagttttcaactttcattacatttctgaaagactttgacaaagatgtattcttactatattagttaaggaacaaaaaaaataatatgtaaataataagagaacacaaataaaatcattcaaatatataaaaaaattataaaaatataactttacatgtatataaaatatattttatactctttatttgttaattacttagaacatggattaacatttgtcattaagaaaataagatctcagccttcagattggtcattcccatcgtcaaagcaaacgttaa

SEQ ID NO: 756 - DNA, 1400 bp, Glycine max
  Soy_ogl_5694 Gm17:15580001..15581400 Cluster 3
tgttggtcatgccaaaactaaactaactaaagtttatgataaattaaagagtaaaaaatgacactaaaaaatgttaggaatataaaaggaacaaaattttagggtgactaaaactaaagccaatttaaaacatatttaatcctattaaattaaaaatatgcttatttaggaaaaagaaagtgagttctatcactttcattgtggatatccttattttaatgaaaacaatgcctttctttctctaacataactagaccatgctatgtaacaatataaataaatccaaattcatttaaatactcctagtataagttcaaatttgaactatttgtttagttaagtagatgggtgtttaattaaatataaaatcaaagtttaaattgttcacaactaactcaatagctctctttaaaatccaatctggaaggcattaagctcatccaataatatggaatttttcgttatagtggagcgcaacgatctccatctaaggtgctagtatggtttagtggaaggtcactttccttcgttttctggagattagttggtcattatacattatatcaagctgttaacacaaaccacaaaacattcatataattaaaagtagtcgataagattcaagttagaataatatgattaccatgcctactcttttggaaacaaatcctatccgaactcttgtagcggtttagtgaccacttgatttgaagattttcagaaattggcaaatgattttgacctattcgatttacaaagttttaaacgttaataaattatatttattctatatctaattcattcaaatttcaaaattaaaaaaaaaaaaacttaagttcataaacgtcacttggtcttgtaaaataacaactcacttggtgaggttagaacgctccattgaatttaatttcaatgacttttgtgaaagactatttgttaggtatgtatcatagatattctccatgagaccatcattttgtttgaattagatagttaataatgttatgcatagtaaaattatctcttaaaatatttaatatgaacgtagaatcttttggttaaacgggaacgattttatgtcagtttgatccatacactttgtgctaatgttgtgaaaaattattggtactactagatctagatgattattcagaatctgcaaactaacctaaataataacatgaaaaatatatactgaatttgcttttgattttccttcctcccagcgatccctctccaattaagcaagcgtaaagggacatgccaacaacccaatgaagccgcccaactgagtaattgtttctatttttcaacgttcacttattggacagttggttttgtcgcgtggggcgtgcacagtcgagtgtgaatgcaaagataaaatttcggctcttcatagt

SEQ ID NO: 757 - DNA, 1735 bp, Glycine max
  Soy_ogl_6012 Gm18:9891801..9893535 Cluster 3
tatgaattgagttgggtaattggattgggttgaatttattttaacaaataattaaaattggattagataaggagtttagaattaaggatctaactgaattcacccaaatctaccctaaacatataaaaaaataccaatatgtgattttatgaataatgtgagtgattaagctggttacatatctatatatgttttatcattatgaatgaattactcaaacaactttataatccatcttataaatacataatattttgtgaatattgtaagtatatattttaccacaaatgttaataccagtaaatgtcaatgtcctagcaggagattgggtttgacttcctctcttgacattgtttatatatcaaattaagtgattttaaaaattattaatcaaacatatgcgattttgacttttgatataagttgtaattataattgatgtagaaaagtgacaatcgattcagaaagctattttttttacattgattataattacaatcaatgttaaaaatcaaaatcatctatatttggtaagcacttatcaaaaccatttacttcggtatataattttacgaaatcactttgtttagtaaataaaaaagtctctcatttcaaaggatagttataaaaacaaattcttgaaaatactgattttgaaaatatccttgattgtttttgagtttgagatattttgtaaaaagaaaatagaataaaagaggtgataattttttaatgattcaaccggatgacttagttcaacctaattcaattaaaatttgattgggttgaaaaaaaaaacccaacccaacctgaacctcttatacccctaatactaccttcattccatatttattcaaatttaagaatcatgtgtacatataataagaaatatttaaggaaagtaatatattattatttttggacctttttcttcaaaccacattatagttgtaaattatttattgacattattaattactcatttctatccaaaaatctatctgagcatctttagtttgatctcctcttctagtaatatttttccatccacttgaacctaaaaggctgctcaaacacttataccagtgacagtaacaaatccacgatgagggaaatggaggccattgtccgtacaaggtatttttttttttttttacttaatatgccaagtatatttttttaccccataaaaaaaatatgtcccataagataattattttaaaaaatgaatgtaagaaattataaaagataaaataagttagtactaatttaactcacagaaaaaataaattgatactaacttcacccacgaaaaaataaattgatactaatttatcgattttaccttttttattttaaccactcctgatttctctaaaagtttataatatttttgttatggaaaaatattataggctattttttcctcccactaaaaaaaactatggatccaccactaaccagtgacatgttgatgttgtttttgactaaaacacccttatttaacatctcgttacttgtgatcaattactattataaagtaattgttaaaaatggatataagtaaaagaaaaatagatttataaaatatcaattgtttcttttacaagtaaaatatcaatagttttaaaaccaaaaaaagtatgttaaagcatagatataagtagtaaaaatattgtgttgacttaggatatgtttggtttaaagacgaagtagtaggaaatgagcgagtaag

SEQ ID NO: 758 - DNA, 1100 bp, Glycine max
  Soy_ogl_1604 Gm05:5303101..5304200 Cluster 3
atgagattaggcaggttcattgaaccttcaattaattcattttttgtctctacttttctttttgaatcccgggttttcttctcaatccagggaaatccgaaattgactagttgtggcttaaatgcttttgaagattcgtagttgtgtttggaatagatttgggaatcaaactatgtctatataatagtagaaactcaagttgagatttgatatttatcaggatgtagttagccatgtgtcttgagatcaatgtgtttaagcctttaaggctgtcttattccgtatgtcattgttgtcccataaattaatactacaaagtctacatgaacagaaaaaagccagacaaaaatatattgattaagcattgtgctttattacctttattaactgagtatcacatatatataacctaagatatgaactcatcaaataattaataacaaaatcttgtaatgtgtacggttgtcgccgtggatttgcaatcagctttcatgctggtcacttgtttgatacacgtatatatccaagtatatataatgatttttcgtatctttataatgattcctcaatttatatcggatttttttctctctttttttttggtcatgtttagatcggtgatgcaatcactttctgtttaagaagaagagagagaggaagaggctattctctagaacgaaactctatgtgaggaggaccaacgacttatgcagaagtggatgaagctagcaagtacaatcaaattaataatcaatggaggcaaaagttactgtaaaatatgtttagatagtttaactagttacaagaaaagaaatcatagatcaatttaaaatacttcaacaaatagttacaataaaagaaaagcaataaaaaagatgaaatgaaaattaaaaataaatcaaaaatttaaaattaatttatgtacctaaatttgtaaaattaaatagaagaaactttttagttagaatgcatagatcaattttaagttataaaaaattttctattttatattcttcttttataaggggaaagaagatagctaggaggggtgattatacggattcgttcagtcaaggtttagttcaccaagttcatgatca

SEQ ID NO: 759 - DNA, 2000 bp, Glycine max
  Soy_ogl_2341 Gm07:15005501..15007500 Cluster 3
ccgagctaaggtacattgatataaaattaacgtggatggtgctgtatgaagggatagtaatttggcagattgtggtggtctcattgggtaccataatgggaaatatgtgctgggctttatggtgaaactaggcacatgctcagtttctagggctcaactttgggctatatttcaaggtctgaaacttgctttggacagagagctcaccaacattttgattgaatcagactctactgaggctgaggctgaggctgttcaataagtttcgcagcctggtagctcccataaccctgatccaggatatagtcaaagggacctgcaaagatgccttgacaaagagggcattaggagatacaggagaggagaaaaaaattaacaaactaataattaatatttattgataaaaaaataaataaattaggagctgatatctctaccttgatcttagaggaaccccggagttcattaaggtttttctggaacacatgatgtaacaagctttatgcttgcttcttaattcttttctgttctttgggcttttgctccttatcccaggaaaaaaatacattatattttagatttatcataaaataatttctattgtgatatataattattattaatcattgataatttcttttaaaagttattcaaacataagttagaactaatttttttgaaaatgagatggaaagagttaagaagttaaggtaaatctttctgttaatattaaaagcatcagatcttaaatgtatgttagaaatatatttgaattgtgaagataatatatatatatatatcatattcaaaaatacaccttgttaaacttattaatagatattaaaaacataagaaaatatagcacatgcatttgaaaatagtgaagtttacccctttttaagagaaaaatattcaaaatgaaaaggaatgtgagagaaaatggagatagtgaaagaaaaaaagcacaaataaattttgacgtttatatataaataggagagttcataatttgtctaaatatgaaaaagactctactatacaaattgagtttacggacaagataatataaatatcgaatttttcaaatcttctttattattcctttacattttcaataaataagcaattactttatttttaaaaaaacaggcgggctaaacaagttgatttgtaaacctgtgggataaacggacctacttgtacagatctacatttatttgggtaaaatttcctgcatttttacgcatttttcattgtattatgaaaaactcattctaaaatgtaatttatatggatttttcataatagaatgggaaacaataatggaagtgcaaggaagcaacaacctatttatatacgtcgatttaaaattggactcaggctcatgcgtagccttgagcagaagtccatatagtcatatacctaactctagctaatagtacaaagtagttaatgtataattttgagttgaggatgaaaggagaaaaacacatgtctcttcccataaggtttcttaacctaactcccgagtaagataatctttaaactaatgagtaaaataatataaacaaatagaataagtttatcttaccttgttaactcatcaaacaaattgaattgaatagaataagatagcttatacaagtccatcttttttgtcttgaacatcgaacgaatccaccataattaagattaaggtgcttaaaaaaccctcaaagaggatctaagctagcagatctgaaactattgtcttagcaaaagatgccttcattgaacttattattggattttatatttgacatggcttgtcacgcgtctcacttcagagctttttagacttgaagaagagtagacaatacacaaactcaccctaactaatgttgcagttctttgttttgaaaaattgggatggcaaggattgaactcccctaactctttgaaattagaacctgtaatgctatatatatataaaataccaaccctacaagttattaggtaaa

SEQ ID NO: 760 - DNA, 1996 bp, Glycine max
  Soy_ogl_5365 Gm16:29460601..29462596 Cluster 3
ttaaatagtcgttggtattgaccatttaaagattgctagaacatgtatagacaattactagcgactataaaccgccacaattgtattcttagtttaatttacatcagtcattgggataaagaatttacacattttgttggagctataagccgtcagaaagtcacatacactactatcaaattaattcctagaaaaaatatgggttcttgcaactggtcttttagaaacaagcttcagaacttaatgagaaaatatatatatctaaatttcataattaaataaaatatttatctattgtaacttaggctaagtcatataatattagttaattaatagaaaatccgcaaggaaattgaaagcttacacttttttccatggctaaatagacgtggacaattttttcctttcaaattcgaaatggttatgcggcccccttctttgttccatagttgaacccaaaaccttcgaagaagcctagcaaaacgaagcacgtaacgatcaaaactatcaccaaatcttgttgccgattaactacacaaaaaaaaggttaattttgagcaacaacgtactctcttcaacctcttaggttttggccaatttctttgaaaaagaaacagaataaaacaatttcggttctgactagcttcgtcaatatccgaagattcatgaacctcaacgattacaaatcaaatttcaaaaggataacagttacaatacgacgataaaatttgagaaagaggagagggggaaatggaaaccctagatttcagaaaacgagagagaccttgtctctgttgcgacttgcaatggtcgtagagaggcaaatttgggagaatggttttaacggtgggtggagtgcaatgaagatgaatggtaggggttttgaattttgaacacatgtagggtttgagacaatgtgtttagtttggttaagtgacacacaaatgagttggtcaagtcccgtgttgccaagtcttattagagtcgagaatctaattgtgacagctatactaagtgccaaaatttgtaatatttctggcggtttattttgactatcaaagtaaacagacagtaaatacatattttgtttgaagtgtcaaacatgaaaatcacacaccaaaacaatagatgtgtagcaccaagcttcaaaacctttggaaaatctgaaaaaaatacaagacaaaactagaacacgcccaaaaatattcaaacctatgcaaaggaaaaaccataatcgataaagccactgtaccattcaaaaaaacactatctgcgggtagctcaagatccgatccatgtgaaaccaggcgcaaaaagatacatcaaaatggaatggaacaagaatgagatgttgattggtagttaggagagcaacaaaggaactgataaatgtagtgatgggaatgggaaaaaaaacaacctttatataagggtttagtgcaatagacagttaagactatcactattttattttgaaggatgagattcactaacgggtaatgttaagataatgattagtgatacggtgtttgttatccgttcacaattttttaactaaataatttattttttgcttatatttttcttttactaaacaaacaaatattcggttctttatttaattaaaataaaacaatttacataaatatcatgaactaacaagtcatattgttatttggattttaagcattccaatctctcaatttgttgtgtatctttcataagaacgaattgtatatatacaaaaaataccaaaatttgaataattacttatgcatttctaatttaaaaaaactaaacatagtttaattgttgaataaaaaagtacatattaactatcagccaaaaacattatctgagttacttttttatatgaatttatacgaaaacgttagcttaaataactatgaatctaatattaaaaaaataccaaagacattaaagtaaattatatttgcactctcatgcttttaatgaaccaaaaaccagctaattg

SEQ ID NO: 761 - DNA, 1903 bp, Glycine max
  Soy_ogl_5426 Gm16:37017398..37019300 Cluster 3
cacgttacaaaataatagtagtaatatatatatgatatgtgcattgacaagttatgtactataatacctacataaatttatgggtatatatccgatacccatctccatattgtaagtaattacatgttccatttgtaaatattttacaagatacctatagtgttcgaatacattttttcatcactatcatcaaatattttgatttcctctccttgtatgggtgtttaagattagtgtgcgcctattaagaaacattagttgataaaattttagactaaaatatttatatttaatcatgttattaaaatcactattaaccataaataaataaatatcggagagtttaaaaataatgttaaatgaacattcttattgatgagtaattagttattggtgtctatcttaaataaaaaaattaatgcactaataattataagcaggaggataattgaaaaaaattatgaatttaatcttaaatttataaaacatctataattttagaacaaaactaaaatactaaagtatagttttaagacggagggagtaacactttttaaggaaataaatgctaattgtttttccttgggcattacggctccttgggcaatgttaaggaaatcagattttagtttggtgaatgaaatcaagtaactaatttgggtagcttagtattagaccaatttctgtataaaaaaggtattagaccaacgaagcacttaaaggtggaattttgcaaaaaaaatatatctaaatcaatcaatatctttaaaacacatgattaattcagtgcaaaaaaaaacacattattaagttaatatgttatgaaaagtaatcgttaataaatctaaaaaaataattactatttaactgataaaaatgatttagtatttttaaaaaatgaatccttaatataatatagctccaatagcaggaatatttcacactccgaaaaggagaagttttaacgtcaacacatgtattaaaaatctatcgccgccaaacctattagagggaagggcacacctccccacgtgtcgtgggctgcccgactcagcaagtagctcaattgattgactgtgatcatcatcactatcttaattactttcatttttattactgacgcatttttaaaatactatatatttatcaattttgattataattttttcataaatttcaaataagaaaagagaattactattaagtaaagactcacaaaaaagtatgtttttgaataaattttaattagtaatagaaaatatatcaagaaaatatgtttgagagcgtgatagtaacaattctccatttccgttcctctatttcttgaaccaacatggcaacatattagaaacagaaaattattttttacacatattattgtgtgaacatcattgactgaattgcatataaaagaatgggtacattaatggatattaggcatataaatataaaagtcaatctacagtagtgtgtttgttcatgtgaaaaagttgcattgatttgatggttaaaggacatgttttacttcaagaagacattttttcttaaaaaagttacacatacatttaagttccactcaaaatacaacttgcgagtttttaaaacgataaagttataatgtatacgatttgagttttaatttaggttttaatatggttttaactatttttattcaatttattcttccatgttaatgttttttctctatcttttcttttaaaaaaaatcatttaagcatatattttatatttttatgtcaatatttttctttaattttactttgtttcttaatataaaaagtttttacacaaagtttaacaccgttaattggagttaaaatgataatcctttgaacaaatttctctctctctctccttatatatataccttattttcagactac

SEQ ID NO: 762 - DNA, 2047 bp, Glycine max
  Soy_ogl_2745 Gm08:17374754..17376800 Cluster 3
gatatatgaaaaagcatttattttgtgaaatgcctacgccaaaattatagtattaaaataaataaataaaataaaaaaatgaaagaaaaggattgttatccgatgggataggatgctttgcacgccattcaacacatgttattgttacgtattgtcaataaagccgttcctccacgatattctctcacctactaattactcatctaaacaagtcacaatcctctgctattgcgcacactggaaccatcgatcatacaccgttgacatttccatcaaaagcatcaccgtcaccatatcatccaacgattgctagaatccctggccccacttactacctaacgcacataggatattccttgatgcgaaccccgaaagagacacgtcgcccaacgtacgttcccacgaatctcgtcaaacgcacacgccaatgttatttctctccatagacgttcgtgaacagatcaactaatctaatatagtttaattatatatttgttatatcaattaaaattaacactataagtgacattatcaataagttggtgataacactattcagttttttaaaaaaactacattattaagttaaaaaagaactaacaaaagacgaaacttaaaaaaaaaacgagaggcaagaaatgaagaaatgtattttaaaccaaagaaaaggctcacacacactttgaattatttcaagttttcaacctatttgctcttaaggtgtatcagtttgcggtgacttaagttaacatgtgaatttattttattactcattgaatactcccttcgttaatatataaaagatccaattatttaaatcgttccattaaaaaagtgattgatttatttaataataataaatttataattttttctaaaattatccttatcatgaatatttctctctatttctctcttttaatagtttgacaatatattttttttaataaaagttatttttaatctaaaaataattaatacaaaaaatattataaattaagtcttataaaaaaggataaatatcatttttaaacttgggtgttataagtaaaaatggagggagtagtatttaaataaaaatagtaaaacttaaaaaaaactattatgtgttaaattttgggaatacttttctattttaaggattttttttcttcctgtttttatttaatgagtcaaccaatgagttcacttattgaggtggtgactgaagataaattttttagcttcatctgtgagaagattaattaactcgttttgatagttatactctcatgttataagagtttattaaatatatttttaagaaaactgtttatttaaatgcatccttattaaactctcattattaacattttaatgtttttattaaacatttattatttaaaattaaaaatagcattaatcccacttttctctcattaaatacttttttaggtccaacacagaaattaagtgtgtgtttgatttttttccatagtcaatcagcattctctctccacatccatttaaagaaataaaaaaacaacttttgaattatggagacctttggacgtgatttttgtagtggatattgtgttgtgcgtaaacctcattccaaacacgctgtaagaatgacaatagtaattacctgttaaggataaagtttaaatatcactatttaattatccattactataaataagaattaagtacataattaatttcatatgtgttctataaaattatgttgaaatattaattaatgttattttcaataaatttttaaatatttgatttcatgttgaataatcgactttgaatttaaaattgatgattgaaacaatttttatgtaatttttatgtcaaataaaaaagtttacactaaattttattattactaacttacttttacaataaaacctccatatataaatggcatatcaaagtcaagtttaaagcaagccaattttataaaataaattttgccaatcctcgtttaaacacactaaaacaaaaaatgctacttttaccaaaacgtcaataaaaataataaattcaataagtatag

SEQ ID NO: 763 - DNA, 2684 bp, Glycine max
  Soy_ogl_876 Gm03:34705101..34707784 Cluster 3
cccttctttacttgtctcatgggctatgtcattgtaatgttaatattcaatttaatactttatgttgtgatgattgatgaagaatcataacaatgataactacataacataatgtaaaaaataataaaaatgttgatgtaaagcagctagcagacattccgtacagagggtcaacgtctgtgtcaggctttttttttttttttcttaagataaacactttctctctttcatctcatcttctgccactactctgctcaattttggactctcatgcacactctctcatccacaaacaagtgaacagaacaacacaacaaaacacaactatttcatttcatttccactatgcaaaaatttaatgtacttgcctagttgaggaggcaggaaagtggttactcttttacacatgttcaaagcctgaggcgagtgaatgggttgtgcgactgggattgtcacattaatttggacaaactatttttttgggagtgaatcttttatgtgagattttcactcatgtgaaaatctttatatttttaaattaaatttcaaatatttatgccaataatttagattaaaatatatataatcgtcagtcaatttcaatattatttgtgtaaatatttgccaataagttaagagaatcggtaactaacatgttaattcgagcagtaaaaaaaaaacaaacttcaagtgaaactgaattgaaatatcttaaacaagatttcatcttcaagctttgtagattaaaagaaagttagggaggagatctctaaaaaacaaagtgatcaattatattttctaacataaattaatctttgataaaattgataactatttcacatcaatataattataaaaagatgattgttgaaactaagaaataaaattttagttagattttaattttatatgttttaaaaaaactattttgtatgtttggaaccgaacgatcttaataccacaatttgaatacctatcattcaatatctatgtcaaattaaaaaaaaagaagagcatgatcaatatttaataggtatattttctattatatatatacttatatatagttacttttaattatgtaaaatatttactttattagatttaattcaaattttaaattttcatcaacttgcttaactcaaatttatttatttttataaattgttatcaactttatttagtttcataatattcattttttgggaaaaatgtattttttaatcaaatctaattatctacacctatggagaaggtaagaatttatatcgggacattaatcacttatgcgtgccgccaatcatctacatgtgctttaaaataatttttagaaacttttttcttttgcaagataagttttataaactactgtataacttaacttttataaattaatattgtgaagcttattgaatgattttttttagtaatatttttttggtttaaaactacaaatattttttcacaacaaacaattatcgttataaacaaacaaatctttttttagtatttaatgtaattaattatgtattcaggattcaaactcaaaattactcttataagttaaagcaatctcataacaagcaattgattcatgtgttccatgatatacattctttcataagttataaataaaaattagaacttagctagaatataatgtaaatcatttttatattatcatctaattataaattaatatatataataaacttattaatttttataataattatcttaaatataataattgttccaaaaattattttctttaaaatcacgaatgatgatgtatatataaatacctatccattatgaacactctattaaaactcattattagagtgtttgctttttctattatattatatcacctatatatcatacttacacttcttcatcttctatttttattagcatgtttgtttttctataccagattcctcaaaccaatgttcaaaagcaaaaaattattacttcccataagatgatgctttgaaatatgtgtctactgcatctaacgtgtatacaacacatatcctatatctttttagataccaattagtaatatatattcactcattatttttccaaaaacattatatatatgaaatagattcatatatatccttcaaacggttaatatagtagtgtaaattttattttattcacatcaatgataatgatctatttaatatattatatactttttattatacataattttttttagatcaacaacaatcataaattataattaaaattaatttctaacctaataaattaaaaaacagtcataatctctggaaaaaaatgactaatatatatcaattacaacatgtgaacgacgaatgtaaaaaaaaagtgtaaaaaggaggtcacactcacgcataaaatatagagaaaaactaaattatattcttaatatagctttttaatttctttaactactgagttcaaatcatgttcctgctagctatagttgtagtacattgtcacatctgtgaacaggtttggcattttgcgtggttgccctggggtaaccaacttgtcccgcactttctcgcccttcatcagccacagagttttcatcctgcaggaccttggaaccaagttaaggtttgcttatccttgtagggcacgttcagcatagattcaggatatcaatataacccacatactag

SEQ ID NO: 764 - DNA, 2000 bp, Glycine max
  Soy_ogl_60 Gm01:2652101..2654100 Cluster 3
gaacttaattttgtagatttaaaggtgaattaaaaataattttaacataacttaaattatgtttgtagtttttggactccatatcagcctatcaagttgagtgaaaatcaagttccactcaaccagaaaacatctcaaccaaaaaaactatttatcaaatctccaatgctcaaacatcaaatcaaacacatttaaactcatttatttacatattcagttatttgtccatcttatactgttatacataaaacatgcatgcacacgtttttgagactgatgcctttgttgcgtgtaaaaccttagctcacggtacaaagtaggaggaaccgttaagacttttggtgcatcttacagtggattcattaaattcctgattccactgattccaggataacccaaccccctttaatatcccttttgtagctctacctattttattattactttttaaaccaaaaagcgtttcaattaacttatccacagtgggcttaaaatgtgagaaagattgtctataatatgtttatggttttatagtataaaataattttatatttttatctaattataaattattatttgaattattttaaaaattaataaatttatcatataggataaattatgattacataattatgtgaaatcattttacacccatcagtacaaaatatttttttttcaaagaatatatatatgatttctaaaatatagtcaatgtttggaaaaaaaataaggactcattttttttaaaaaaaaatcagtatatattttctaatatgaagacaaaaaaaatgaaaagaaagaattttttattttaggaataaaagtattttttaattcttctaagtgacattaaaacatacatcatttagaagaaaaatgttacatgtatttctcatttttgggatatattagtgaaaagaaaaaattagtaaaaaataaagagaaaaagtgatagatataataaatggagagagagagagaaaataattttaaaagattaagttaatcaattaagacttgatagtatataaaataagattaagttaattattcaattaacttggtatgattaataaataattttatctgatcatgagttcaatcttaaggcctgtgtatatataaaaaattgtcaaaaaagtcaattgcttaaatgaatttcaatactttgagtaattagttcttaaataaaaaaatatttaatttttatttctctgaaaatatgaaatcactatttttagtccatacgaaactagtgaatttaagttaacttttattttcatcccttcaacacatgaatcattgatcttggttcctaatattaattttcaggtagataaataatatttgttttaaggaagtaattttttttagaagcatcacatgttgacaaagtatcacatatactatgtgtcatatgagttgtttatctgttagctctttgatcggcaggtatgtggcattatcgagttatgctgagaatgaattgctctcattctttccctttataactttatctcttttgtaattttgccttggtatctttggtaccttgttaatatatatatatattaagttatttgctgatagaaaaagaaaaaaaaactaagtgtcatatgagatagtcgttttacctacttgttaaatacacaagcagttaataggtactacacgatagtggggataaaaaataataaatccatatttaaatattttttaggaatgaaaactattttttttataagaaccaaaattaaaatttattcattttatgagaattaaaaatatatttaacacaaaattgtagtttttttaatgcatactcgtgtatatgtcttgtacaagtattctccagtatttagagaagtctcttgaaatatatttattgtgagatcctttagagagctttctttgtttttgttcatttgtcttcttacttggaaagaaaaagataattaaagcatcaaatataatattttatgtcttttaccaagtaa

SEQ ID NO: 765 - DNA, 1547 bp, Glycine max
  Soy_ogl_900 Gm03:36357954..36359500 Cluster 3
ttaatatggttatatttgttgtttatataaagcatatatatgtgaggtaatatatgtttatcacattgggtgttatatttctttgtcccggaagatagtcacatcacttatttttatcttgtttggtgattattttagggtcttacctaataacattgagtatgttgggttttcagttgaacttgtgcacaaattttgaggctaaatccaatggttcatcacaaattgaacacaaaagaaatgatggaaatgtttttgcaaaaataatttatccaacgaatatttagtttagcacgttattgagaaggaaaaattttcatttcttaacatatttatttagatatgcgtaacaaaattgtatttttttatatatataaaatgaagtcaatgttaaagtaagataactgttatgatttcaattaggttaataccactgcaaccaactgtcttaataacaatgtctgattcattcaatagacaaacaaaattgtattccaaggtgtcttcttcatttgcattgaagttttgaatttaattaaggtcatatcttagacttggtttatgacaacaaaataaaaacgatagtactcatccctttttttataggtgtattgaccatctatcttgtatatatctttctttttctttgatatggccttgtgagacttttgcattcgaattagagcagctcttatattctatttaatcataaattttttgctgatagaaaaaagacctaagaataaagaagtaaatcccaaatgtataattaaaataaatagttaaaattaaagctaccacaatcttaataattggtataatcagtacctttaggatgattaaggaaatattttttttattaaaatgcgtcaaaataaattgtttatgttcttttataatttttataataaatattttattttttaatttcttatatccaactggttaagaaaattctagcttctacacggtgttaagtaattatattatatatggctagccgactagctagctctactttgccccttctacattatttttacttttatattttatccatgaccgtgactccatcttttcattttttaaagggagtggattttttaattgaatattaggtttttcatgggtttcattcaatttataaaacctacttatacccagctcaaaaacaaaatggtcatttgtactaataaagtattagtttttttaacatcattccttaaagttatttaaaatgaatacttttataaaagggagagagaaaataaataacttatatattttaacataataagtatcatttcttttaatatttttttattattcttcttaatttcaacgtaagactacgtaagattgatgttaataaaactaataaattattcttttataatgactaaagaattattgccatgaaaaataaatttgttaatagtgtaacttttatgtaagttcaaggaaaattttaagtggatgtactttcaaaactaatttattaaaattatcataattttatttaaattcaattttattttattttttgg

SEQ ID NO: 766 - DNA, 2000 bp, Glycine max
  Soy_ogl_1957 Gm06:15130201..15132200 Cluster 3
ttttattttcatcatttcatatttacatcacgaggtttatataatattgctctgagtctctgaccgaataaaatacacatggtcgcatttgcaacaactgaaattatacgataccagattaattcatctggaatatttttttaatgattacttcagaatcattttattgcttcagttgatccttttgcccaaatcacaccaataatccgtctgttgttacaactaaagaattttttaacacgacacctttttcaattaataaaaataatttattaaaattgttacaatttaatttaattaaaatttattttttgagtttacgaagatgcaaaatttatataaaaaaagaagagaaactcctaggtagtatttgacttgactttttaaagtcttaaaatcaactttaaagttaacaataagtgttttatttttatttttttttaaatgattaaagttgcatataagttagaatttattcaacaatatattcttggatcttggaatttgtaataaagacgcgagataagaagaagaagaagaaaaaaactccaaaaatttgctcatctatttttttttaattttaaaaaactcctaaaattagctcatctattcttttttttaatttaaaaaaattcaatttattttttagagcctatatagccattgaatttgacaacttatccttttaagtaggagagaagtttaaaacaaaataaataaaaacactataataggatgcggagtctttttaatttaaagaaaaatatgtaattcttttttagaatgaatttgaaggaatgcgaatataaatattcctaccacttgtgttatatataatacattttctttgatacatcatatcaactaaacaaagactatgattattatcatatttaatttttatgtaataacaaaaaatattggcgtatattgcagagacaagaaacttatttaaacgaaaaagttacagagtcatgatatttgaatgctcctatattttaaatacttcattaatatttttttatttatctttattttcctattatattttaatttgtagaataaatacccatttattagtgatatgagttcggatatgggaattcaccaacaaaatttcatgagaataaggtattatatattacttttttttcatcttataattactgatgttgaaggtttttaaaacataaattaagaaaataagtatttcaagtgaattaatattttattaggagatatttttattaaaatatccttgttctttttttttaattccaataaatgtaatattaagtcattcaagacaatattattttttataggataaaattgaaatagattttggaatatttcgttaaagaattatgacatcagtgaatttgatacattttttaaaggctaaaattataatcattttgggataaaagaagtattgtatgctacatatgggatgttataattaaataattatctatctatatatatacattattaattatctttaagaaataaaatagaatgattatgctaaataattatgttattaatgttctatggttatattttgatgatgtaagaataattttaaattcaattggagtaattttttatttgatattttttattaatttattaattttatacttaagtgaagtgaataagcaggagtgtaattatgaatatataaatactcaatgtgtttagagaagattaaatttgttattattcatgtgggagattaaatctgtgactttttctttttatttatttatttaaattatgtaattaatcttatatctctactttacattgtcatgtatttaaattaaaatccaaaacctcaattaattaattaaaatgatcagtgcacatgaaatcaaccctggactgttaattaataaccactataattgctataggttatatagactaacgcttgagtacgacttttttgaagcatgcagttaactctgcgcccataagcagttccatatcga

SEQ ID NO: 767 - DNA, 1400 bp, Glycine max
  Soy_ogl_4984 Gm15:11087801..11089200 Cluster 3
actaatggaactttaaagaaaagcccctacctatagctaacacgtcctttttaatgcacagagaagaagcattatttaaccaaagtagatcgtagcttgcatcttctcaatacatatctagcttaaaataaaacatgtttataccatatggattcatgtttctattttcacccttttaccatgaataaaacatgaaattttgcgaacaaatattttaaaatactatcaactgaaaattcattatagccgtattgaatcttttttccccccttaacaaatactataaaagtaagattgaaaattataataaaagtataaaacattccatattgttaaaataattcgataaagatcaagggaattcagctcagttaattatacagtaaaaaaaacgaattcaatggagtattaaatgtttcctaaacaatacttaaaaatatgccaacaggctcgatctttgaagtatgattagttggtaagggcgggattccattatcttaaccaattgttttgatattgagatttgaagacttaataagagaactctactttttcttttttgataatcaaaactttattagaattaaacaaagtatatggggtaccttgagagcatatttgggggaattgaaatttcttattttagttatttttgtagaaaaaaagttgtttgaaaaataatcaagtgtttgggacaatagctgaaatttgctaaaaaagttttttttaaaaaaaagttaattttcatgcataaatttttttgaagcttatgattatttatcaacaatttttctattccaaaaaatgttatttccaagttactccaaaaatttccattagcttttttcccttcaatttcgtacataacctttttgtaatttactatgtaaaaattgattttttttttgtattccaatgaaattattatttattaaatagtttttcagcaaacttgacccaaacaaaaattaattgtgactataatcgattgtgataataataataatcaattatatatatataatctcatattaaaataattaaatttttgtaattgtctcaaacacgtacaccagcaattgatttataaggccaaatcaaaggactaaatagagaaaagttacaagattaatataccaataaaaaaatagcattgagaactgcacatcttagccttaaatttggttcatgacctaccctttatcaaatccaaaacaccattaaagtctaaattaagggacactttttgaatcacaattttattatgcatattctaaagtactccctccttcgttcccattgtaagtgttgtcttaagtattttcttattccctagcctattaattttataaatcatttgtactagaatgtatttgataattaaataatttatcatttaa

SEQ ID NO: 768 - DNA, 1215 bp, Glycine max
  Soy_ogl_4998 Gm15:11432601..11433815 Cluster 3
tcatattaactgattgattacacacttattagttaaaactttacttttcaattctaaactaataaaaaaatattcaaaaataagtgttctggacactcactgaaaatcatcaaaaataaatgaaaacatcttaagaaactttttcgtagttatttatcagaactgaaaaaagtatacatatatttatttttgtcaactattttatttatagtaatataaaaaccatccatccattgtcatagtgacatgtgtcactcccacatactgtctgggtcctttgtttattttttcttttctttatcaatttaccctctcttttttttcccttgcaagcacgagccactcttagtggcttatcaattcctagatttttttattatttatttttctactttatttctcactaacttactagaaatctaatttttttattttcttcattttaaaatattttttattttagttatcatacttgaagagtattaagcaaaatcatcaaattttcataatttttgtataatataaaatttaaaaataattttcttaatttttaagatgatatgttattagaataaatttaaatattgaaagtgataaataaatatattttatataattatagtcaaataataaatatgttattttatgtaatataacatttatcaactagtttaattgtagatcttactaaacatttccaatcaatcaattagcttttaagtttctagctcttaacttaacttatagcacataagttttaattagcgtataaactagatttattttcagtataaaaaaattagttttatttgtcaaacacgtgaaaagtttaatttctatgcattgtttgtataaattatactatcaaactactagttattgtaatagatataattttttaagtgattattataaaaaccaattaattattatgcataataatttgttattaattaacaatgtaaaattttttgacacagtcaattcataaactatttttcacatattaaagtatattaaatttctatctccttaatataaattatataaaaaaacatgattttagtacttttggtataaaaaaaaagacaaatgtaattcaattaaattataatttcaacgagaagtgattaatcagtaatcaaagaaaggacttcggcaaaacgacagatgaatcttttcttgatcatgattttaccaaccatagttattatg

SEQ ID NO: 769 - DNA, 2600 bp, Glycine max
  Soy_ogl_461 Gm02:9932301..9934900 Cluster 3
aatgcaggggaaaatggctccatgagggtgatgtttaataatgttaggcatagaatagtgacagagatagaccactaattagttgtcggccttcagttttagaaagagtggcataattgtgcgtgtaacgtttccaactaccatgaacttgcaacctcaattcgcacgcaatctttgccctctctgccttcttgttcattcttggcaaaaaaaaaaaaagtaattagatcttggtagtttgtttattgtgtgaaataaatttgtggtctgaccagtgaaagttgtttaattgatttctttcttttaactcaaatatgaatggtgtatcaagtagtttaacacttagatgtcttaattaaaacttgatatttgattttttttatttgaatacgatggtaactggaaatatcattttatcctacaaattagttgactaaatggaagaaagattaactagatatcaaataaaaaatcctaaatgtcttttggttagactatatatatataaacagtacatgattaattaaattgaaagaaaaaagttaatacatgttgtaaaaaaaggaaaattaataacataattgtatattacaaatgaaattaaacacaatttatggtgttcacaacttaataaactaggtatatatataaatgaaattaacaaggtttatgtttttcatggaaaacaattcagctcctcaagtagcttaagatcgacctttatagatcataaaaattaaatatttaacataattactacttaaaataaaaatctttaattacgttataaaaatattgcatcagttgatccacgttctcactaattttagtaactttttttttcagtgacaggacatactaattttaacaattttagtagattatttaagttacaatggatattaaattaggttatcaaaaaaatgtataaatcatatttaatcttttttatccgttggaataaaaacacaaattgacaataattcatgcatcttacttaaaaaattaggttagacttttttgcaaatcatactctgaaaattaaggtaagtggcttgagactttcccaaaaaaaaaaaaaaatatctcgtctcttttgacttttacaaatgagttgtcttgaacatttcctcaacatatatttaaataaaggtagcatgtttactcaaaaaaatagattttttaaaattattatttcacctttttcaaaaaaaaaacttacattattatcataattttgaacacacggtttctaattaaacaagaaattaaaaataagaaaagtcggaacaaatttctatatttttccttaaaaccttttgaaatcttcttttatttctttatttttaattatatatgtgcatgtatttttttaaactgtgctttctattaattttcttctcacatggtttataataagtttttcactaactaatatttcttaaaatgttttaaaaactgcttaaaaaaaatgctttaaaaacttcctcaactttatttaattatttttttaaagcagagactcgtactagacttcaccagaataagaaaaggaggttacaagatagtactaataaaaagaggtaattgtcaaaaaaaaaaagagagagagggagaacacgtttttggaaatcaaacaagtaggcacacattttgtgatgaagaaactatttttactagatgtggataagagggaaataagtaaactagatataataaaatgtatacgtgcaactcaatattcagatatttccaaagagcttgccttgacgtattgtattttattttgttcgtttttcacactaaaatatctcatctcttaacctagccaagctaccttttgaggttaattagggtgaattaatcctgataactcacctataggaattactggtcccttcttaatatatatatatcatatgttatatttcttatccacttattcattcttgcgttgttggcttcaaatcttgttgaataaaaacaaaattatcaataaaaaaaagacttgagttaaaaaatgcgttgacggccatattcacacttttttttttttactatatgcacgtgtgtgtaattgtcttttcaggaaatagaaaaaaaattaagtaaaattatcagatgtaaacaagtttcgtattttaaaaacatgagactattatagtattttaaatttcacatccttgaatttatttatataatatatatacatatataataataataataattctatttctaatgaattatgacatattatattacgcaaataaaagagagggccatcatcactcactttctcaattttcctctattaccccacgcatcaatgaaaaggcatatgcgcaaacttcaatgggtacaaaacaatttatcatttagctttcgttttctttttcttttccttgagtgaatcaatcacgccatatatatacacaagttatgagcatgcaactgaaaattctttaagcacaatcaagaaaaaaaagtgattttcataaaagagtgagggaataatacaattcattcctcaattgccatctaactcatcaattaccgtaattgaataaaattcaatgctccccaccctgtttaattca

SEQ ID NO: 770 - DNA, 1700 bp, Glycine max
  Soy_ogl_499 Gm02:11682801..11684500 Cluster 3
agaattataattttaacaatgtcaaacaccaaactttataattataattcataacgttaaaaaaatatgattatgtttgacagttaaatttattgcatcaaagtttagtatttttgtaagagtaaaggaaaataaaagacaacaaaagaactgaggtgtaacaaataaaatattgcttgaaaagaagaactaagtttaggagaacaagaattccaaacatgacaaggcaaatccaagtaaactccatgtttgaccaaccgatccgcatcaaagtttagtatgtgcatagattaattcattttaaagaaatattttttatttatttataatctatattattctaaaaactatccagccatcaatcacacttacacgtgttttgctttttttgtgcaatatatgtcacttccttttttttctctctttttggttactgttgactgcaattgttatttttatttttacagcacttgatccctctcttgcttttttctatggccgtgctttgcacggtggaattgatgtagttttataaaaaaacttaaagaaaatataatgatttcatacgtaaaaaataacgcctcccaataaacaatgtgtaaattgttaaaaaaaatcaccacttgcacttttttaatgtcttattgtcaattaattttatttaaattttggattttcgctcccctcacatgtcttatactttagactagattttcaaaggcattatatgggatataagaaaggtttgaatctcttcaaaaaaagaaaagttaggatcatgggttttatttagtgaattagtttgctatagacaaaatggcgacgggcattcctttctaatttcttaaatatgcataaaaagttaaaaagtatttaatgtactgtataattctttttgaaaaattatacatgtacaacaaacaaattgtataacaaaatatgcaattaaaagaaaaaagatttaaatttaaaattaataagtgataagatagagtaaagagatgttgtataaattattgtacatatattacttctcatttttttaaaggtacattgtataaatttatatacgtatatgaaatattgaaaaaaatttaaaattatttatcaatgataaaaatacaaacatttaaaattttaaatttaaagatatgttaaaaattagtttaataaataaaaatagtttaattataatttctaaatattttattatatctaaaatttattaaatgattaaatgtcgaccaaaataattaaaaatttatttgattgaataaataattaagaaacaataaaatatagacttccagtaaagaaaatattgacttaatttaaaataaaaaacattaagttatttgttataaaatgaaaaagacgcttagttgcgtagttttagtaaaattagggaatttaactttaaattaatcgctagacttgttttcattaatataaatttaatatgtttacaaaaattaaaattttatggacattatgattttatatattaataacataatagtaacaaaaaaatactaataataaaattgaaacaaaaaattattaatgtggatatgtaatattcatatattgtcaatgaaaacttatatccataacaaattggaaaatgctaacagttacgaaaggattttcgtaacaaaatttattgactaaattttcgttaatatatgatttcttttata

SEQ ID NO: 771 - DNA, 2200 bp, Glycine max
  Soy_ogl_811 Gm03:2379501..2381700 Cluster 3
gaaccatatatatttacctaacttgaaaaatagaaaaacctaaatagttaaagaaataagaaacaaaaatcacacattatacaaataaaaaaactagtacaattaagttaaatttttattagtgacttactgacagaaaaatatttatttttccttcattgagtaattttatatgcataattgtgaatttagttcatattagaagtgataattaggtaaattccatatcaaacttagactttaaaatttaaattttaatattacaggtaaagtttgctcaaaatcataatcatctaacccagaatcaatgttagtgttaaaaaatttacactatcaaacattaaaaatcattgttgacataccttttttgtttggtgaatacataacttttaatataattaaaatcagtttatcaattattaaatgatagtgtaaaaattttctgcgctggacatcgatcaatacatatacaatttactcttattattataagtaaacttactgggtttaaagtaacatagttagattataataacggttttaaaaagattacactgtctagctaatttaatttcaagatgctagcttatatcctcaaattaaaaaaaaatggttctattcatatacaagcaggtttaatagttaaaaacataccaacaaaaccagctgacgcatagtatatattaaattttgcatattgcatagctagctagtgattcaaaggagcctgattgaattgacacaagtatatatattacttttttttagatcaaattaactttaatgattaggcaaagaagaagcaacccaacaacatacatatataattgtaactgaaatactaactgacagtaaactcaaaaatataaaaacaaaaattctgaccgttaagtctctagaagacttaataaattgtcaatctttaattaaaatataatgaacacacaagatatacaaaatgttatagaaacacatcaataactttcaaaactctaaggacagcaaccatgcatgcatgacccttgatgccattctaaccacatctgacaacattaatcatgagttcatcaattttgagagctatttcaactcctttaattaaacatggaaagataagaagatgatgagaagaacaataatataaaaattggggagctagcttagacaattggttgatgaagaatataattttatttgaagggtcactcccggaagtaccggtccgtcttcttctccctcttcacgttactttcgtccttctcatcacattatatcaatctctctcttctatataagatgtggacaagttgaaaagaaccttaccattagaataataaagtgtgataatacaccaacccacctcaagaaacaaacaagcaaaatataattataaaactaagcggctagattaaaataataacccaacaaaaagcatcgccttcaatcttgcagtcaacgattccttcaccaactcacttcctaggttcaaaactccaagtttcttcttgatcaccattcaccaatatacatactcttgtctcaccaagttcatttctaaccatcaataggttaatcatgctcctcttagacgttgtttcaataattttctctataatcatttataaaagataaaataagaaacaaaaatgaaattaattaatttcttctataagttaattaaaaaaagattatgctataaatgatagattatagtgtcagcatagttggaattctattctctatcgtgatatctttgcataccttttttttttaaaaaaaagtttatgcattaattaaaatcttctaaaaatactaattttaacttttactaaagctaatattaatttatgggacaaatttattttatttttaatataaatacttagagaaacttattctcatatactcaccacttatctcaaaaagacaaattaatcaaagaatatagaagtgcactattcttttatttgtcctgtactagattttagctgtcatatcacatagatgatcattgcattatagggacgttagtatggaactttagtgatcagtttagttagtaaaacatacttatagtgtgtttcagtaaatgtttacaaactcgattctaaatagtcttgattatttaaaattaagtttgattataaatatgttgagtttgaagttatttatatttgaaaacttaaaaacaaatttgtta

SEQ ID NO: 772 - DNA, 1400 bp, Glycine max
  Soy_ogl_2412 Gm07:381201..38152000 Cluster 3
accaaatgacaaaaaaaaaattactaataattgaacatttgaatccatgagaccaactttagatatttagattttaatttgtatcaactatttttgttaaaataatgtttcattcacttagttttgatgtcaacatagccattaatactctgagagactaacaattttctttcttgagaaagggatggtacatttgtagcttctattggcttctttctatggtaatagaggaataaatacctataaacttacattattgtgccatggctgacagaaagaaagagaaccgattaaacatagaaatacaaatgaataatattacagaattactactatcatactcttctgtcattccaaatatagtagctaaaaacaaaattttaggttcacttcttctgggccattgattgaactggcactagaaagctgctgttaaagtgctattctgaaaaatctcagaaacaaataattaaaaaaaaagtgataaattgaaatcggcactggatgcaatactacgactattagtagtggaaagttgaaactgacaagttggccttagactagctgcattatatggattttcgggaaagtagacaaagagaactcaagtttatccatgctggttgaaagcatgattatactgatatatcaaagagaaagtagacaaagagaactcaagtttatccatgctggttgaaagcatgattaaacaaccacaatcagatatatcatatatgtgacttttagtaatatttttttaataatcaataaaaatattattaaaaacttttcgaatgtggtgaaaagtttttaataacatttttattaaatattagataaaaaaaattattgctaaacatcatatttatataacaatgaacaatagaaattgttttctatttgtgcttggattctaaggctgctgagatactgaagactaggaattactttattgacttattcaatattttaagacctcgtttggattactgatatcttcttatttaaaaaataaaattatcttgtgatgttaaatatagccactaatttctgtatagtctagttactggtggaatttgagtctctgataaagaagattcttgattgaaaattttagctgcagtcaagaagtgttggaacactatacagaataacaagtacaattatttcatgtacacaagcgtttctgttttatgaccggtcatcatgaaaaatgctgaagcagaagttttagtgtaacatttacttaactattctgtgagtagtggggatttgattaacattcaagcacttgtatgataggctaaaagtaatgattttcttttttgtaaagttgatatgttacagtgagattatgaatttatttattgttactagtactcctagctgtgtattttttt

SEQ ID NO: 773 - DNA, 1652 bp, Glycine max
  Soy_ogl_2427 Gm07:38505111..382762 Cluster 3
atcacataataggaaatatgttaaatttagaaaagtgaaaattaagagtaattttatagacttacactttgactatatggatccctcttctttattgttttttgttttaactttattttttttttatctcttcagtatattgcttaagtaaaaaaaaggatgaaacatgtaaattgatcactgtattagtttttttttaattatcactacttttatagtctaaattttctgtcacaaaattaatctcgaatattccatctgttatcaaattaatccctcaaaaactattcttaatcgtcataagtttagtctttaataaggatttatatggtgacgtaaaaaaaataaggatttatatggtaatcttttaaatctttgagagattaatttagtgatagattcaaagtttatatatatcaatttagtaacaaaatttttaaaagacaaatattataaatttttaagaaacttattttttaaccaaaaaattcaaaataaattaatatagtaatgcatttaacttgcgagaggactatattgaagattttctccaaaataattataggataatatatatagaatgactttcttagtttttatgtataaactatagaattgttgtgtataaactttggtatacttgattatataacgataataaatttcttaggacactttcacaaggaaattcttattctcttttttctcaataagaaccggtgccttgcaagatctttccttggagcttactgtatttaattaagaacttttcaagcaccagatatttatataagcactgatattaaaggtttttttttaacttgatatgtattttttatcaaatactaataataacattaaagttagtagtaactaatgatgacgaaacgtacgaatgtatatttttttacttattcaataaatattttttgagtaaattaaacaaacacttactttttgatatttcagtaaatttcttctttgatctgtaggaataaaaaataagtaaaaaataagtatcagaaaatttataatattaatttacgcatcttatttaatcaactaagtaaaatcttttgttgatttattcaaatttttaagttgtaggattgaaaaaatttaaacaataaaaaaaaagaagaaaaagagagatgtataatggtgtagaaccggtttaagaggtgtaaaaaagaatatagagataataggatatagatggccttgcccagtcccatctagcgagaacatatcttagaaaataaaagtgacaattattttaaaatatatggaattatttttatattttcagcaaataatggcatcttgattcttcaggccgtgccttttgatatctaatgctcctaaaaatgcagccactgattgtagattttgcctcaaataaatgcagctactgaaatttgtgcttgtaaaaaaaaatgtcatgaggacaatagtttcctttctcttcttcatgctgttaataatgtaatgcttgttgttgtctacttgtcttccatctctactcaattcaaaactaatttagtgtgtaggaaaaaatcttgtggggcggggtgatcattactccccaaatttggggtaaaaagaagatttaatatatgaataatatgtaatattattttgtttttttataa

SEQ ID NO: 774 - DNA, 1991 bp, Glycine max
  Soy_ogl_2596 Gm08:10593301..10595291 Cluster 3
aattacatttttaatttcaactttttattcttttgataaattttacattcaactttttttttggcagatattattcctaaatttttatttttgaaaaattttagttctaatttttgtgtttattaatggaaaaatattgactaggaataaaatttacaaattttttaaaagttaaagataaaatgtatcaaattaaaaaaaattggataaattttatcaaaagttaaaaaattaggataaaaaatacaattaagcttaaatgtaaaaaatattggcactttttaaaaataaataaattagagttatcttttgtcagaaataatttccctcaagccgggaacactctttatgggttacaaaattttaacgacttgaactaaaactatagaagtatttaacaaaatcacataactagaacttcaatacgaaaacactgattgaattggaataactctgagtgagtacttggggatgcaaaagttttataaaactaagcaattttttaaaatcttttcatcccagccacagtcgaatattcgcgcgcgcaacaatgctgttaaattcgtttcttgcattattttctttttttttcgttctcttcttattgcttcccactagctagaatctttgtaaacagatatatagcacatgcgacatgtccactccagctcctaaagttttttgctagctagatcgaattgatgcatcgtagattttcgtttcatattccagatcgtccactgtgaattgttttaagtcaaagtaaaatattgtaaagcagttttttattattattaaattaaaaaattaaagtctagataaatttggtatacttaaatttagtactttttttttttctggatttaaaactatggatgtctcttaacctatttattagctaagttaattttgtttataatatgtgaatgttgttgacccaaaaaattttgtaaaaaaaaactaagtacattaaactaataattattttatctattattatttacaaaaagataagtaatttcggtgtctgtttgtatattttttataagacgttaaattgggtttctattaatagtcattttcgtcgtaatttagtttattattttttctcaatacatatacatttgtatgtctttttcttataaaaaaaatatatgtttttatttcattaatttaaagatatttatcttttagtcctttaagtttaaatttgatatttttttttaaaaaatggaaacaattcacattctttccttgtcactaaaattattatttcttttgctgatgagataaacatttgacaactcaccaaatgcaacagctttaaggaatcgaatggtaggggaaaatgattttcatgcacgaaaatcataaattctaaatattaatattttttttaattgatcaaaaatattttttagaatatttatataagtttctcaaaaattaaaaattaaagagttatgtaatattattattaattattttaattatttatcacattaattatgatatttaactagagtaacaaaaattaactcaggaaagttagattttcatctctctcacgagaaaaaatttgtgaaaaaacatagctaaaaacatttttagaaaacattctttcccaaggaaacagaaatattattcatttaaaagatatactaaacacgagaaattaagattatcaatctaaattctcaggaaattaaaattttctttcctgccaaacatccctaagagtcgtgtggtgaaattctcacaaggcttgttgatatgatttaatttggagtcaaattatttttacaaattgtcctttaatttattatcttgttacaagaattgaatttaaagagcatgtaaaggctatcaatatatacaaactcaagtccaatatggaagaataagaactcaagatggtatactaagttcaagtggaaaaatacccaaccaagagatttaataatgcactaactatgggcttacaccataat

SEQ ID NO: 775 - DNA, 2850 bp, Glycine max
  Soy_ogl_3131 Gm09:36580401..36583250 Cluster 3
aatattggaagtgaaaaataaaactatgttggagacatctcccttagtaagaatgccaccattatagggaaatgtaaatgataattaattatatcatgaacaaagtcaaggcaacgaaaaaaaaaaattggggaatccaaatagagtgcaatgctccacatttggtcaaattaagatgaaaggaaacctattcagatgattaaaatatgtgcttggattcccttattttatggttgaatgtttttcaacaactttcttattattttttttttataaatatgtttgtgactatttgtctacccctcacccctaacatggactcataagatgaatttagtgcagatcatactacatcttcataaagggggccttatattgcccaaggatcactctagaatatttgtggatcagtcaaatctccacttgtcctcttagttaggaacaagaatcaaaataagtcagatgtcagagtccttcttcataatcaaacagcaaggaaaggctgaggtggaaggaggtagtcagttggctgcttgctgatcatgccccccacttatagacacaatatactttaactaagttctcaaatgcaaaataaaataaaataataatgaacacatttagccactgtacatatctacaggagcaaggtacaatattatagttttatttttattttaaattttatactaaatcatttgtattttttagaagaaacaatcttattaaattatgtaggattattatgagtgatgaaattccttctattggaattatatattcaggtcgtgaactttaaatattcaactaaaacaatttcttaccaattggttcatacaatccagagttgagtttgattttatgaatgttaggttgacaaagtaagagttgaacaattaagatttaagaatgtaagatagtgtacaaggaagcaagaaagttgcaatgactttatagcatgtgctgagggaaaaaaaaacatgtatattagataataaaatattttatgaaatcgttgttataaataagtaccaaaaccaaatgcctaatgggtctgcttcaaccaaacaattcaccaggaagcatacaaccaaagaaaatgttgactagcacaaggcacattcagattagacaaggagaataacctattatacaatttaatcattgctgatgccatttaggcactagaaccctatgctaattatattggtgcataaaataaatttaggctgtcacatatagcttatatatacgctgatcaaaggggttattttctgattaaatgtacaactggacaaaagttctcaactaagtacaaagaaaacagaggaaaaaatattaaattggtcaatcacagaagaaactgtgccggaacgagttaaagacatgattagtccatattcggagggtatcttatgcctatcacattttttgattgcgtgcaacttttggaaaccataaagttgttcacttacatggttgtcaatattttggaaggtttctattccaatgcttaccaatataaaataagtgaaacatatgcatttttttcactgaaattaataaaataggaagaataaactaataggataagtaaaatataaaattactaactaagaaaaaatatgataagatttggggcttattttttgaaagaaaatctttactcccaaaaggccaaaaaaaaaattctattaattaattagtgatttcctctaattttttcggcatgagaaaatatatatcttttggtattatatgagagaatattaataattaacaatatcgcttgggcctgaagtaaggacgttagagggccttatccttgagttgtccttgtctagttgtctatcatgaattcatgatactaatgataaagtgatcaattgtcttaatttgtattcttccactcaaatactgtaagaatactgttaccacatgtgttgctctcaaagaaaaataataatagaaaaagtaataaaaatggaaatttttttgttttcacaattattatttagactaggttggtaaaactaaattttataaaccatctccatgtttattttcattacgattaaatcttattaaggaataaggatattgatagaaccgacataactatctcgtttaattgcaagaaattaaaagatataagcacaaaaaataagtgaagaaacgttgtgtaaaaaaaaaaaaaaagaagagtaaagaaacgtttgtaagttatatttacaaacctcacatttttggtaaaaggattttcacgggctcgcgtctacttgcttgtaaattagcaatgtgtgatataatatctatcttatatattaataaaatataacactaataacagtgattacaattagacaatatcttgtcaagtattggtttcgtagtgactaaattaaatatatagatcagataaattataaatatattactaagtaagattaaaattgagtatgtaataaactagatttgacacacaatcttatggtctacttgactgggagggatgtaattgagctatcttttaagccaaatcattctactctaataatattttggatctagtaaagtttaaatcatggcagttgaataaggctcaccatttgtgcatgtgtttaataattattgaaacatcaggttctgcatttataatcttgtttactatctagtgtggtaattttatggttttaatttggtggtctttgggtttggtgcatagactataaagtgtgacttacacggtgtggtaagaatgactagtagttcgaatttttttaaatatacaatagaggtttaatcttttattgtgtaatcgaagattacttgtagttgtaggtaggtgag

SEQ ID NO: 776 - DNA, 2043 bp, Glycine max
  Soy_ogl_3138 Gm09:36694001..36696043 Cluster 3
gacaaacttcggtcgttattctagatttttcttgtagtgtgacgttcaagggttgattttgttctaataatatggtagaattatttttaatataaagatgggcgtgtagtttatataaaattcacaaattaattcttcgtctatacttaattttttttatttggtgaggatatctacacttgattctactaaatgtaaaagtcaaaatttttatgtttttcacatataggaaaaaaaagagtttcttattttatcgaaattaattgattatatttatttgattttatcttgagaagcaagggttttaacctaacaatgtgcaaaaaatgacgtgcaaaccgtggtaaaacaagcatgcatattacaaatggttgagatactgatttaattttttctaaagataaatgctatgaacatatggatgagagaaatttaatatattttatttattatttttaataacataaaggaataatattattttttattttttaagtaataaaggtcttactttttattactttataaacagattcccttgtataaaatactctatgaaaaagcatgtatagtttttaaatgtagtggttcaattccgattctggtagtaaggctttcaaccggacagaatatatagtggccagattattactgggttttcaattcaactatgaatacaacaatgggtaagtaaatcaaacaagaatttcggttcatttcgtttttaatgaccttttttattgataaataaattattcgtttgaaaattgaatagccgtaagttcctatatcatatgcttttgacttttgaaatggatgaacttctcccctctttaatttttaattaaaaatatatcctcccttaaaatgaaataatatttcaatttttctttaaaattacacgatgattgtttcatggattatttatttatttccaagaacatgaggctgagaaaacttattttcacttttattatgagataataaaataattgttttaaaacataccatacattttttaaaatactcgggaataacattctcatgtcctgaaaaaaaaatattctcaaaattttaaaaaatagtccatgaaataaacaccgcgcgtcctagtcctagtgtagttccatcactctttgtaatgatttaaatatgaatatgaaaaagaagaatcataaacttatcttattattagctcatttatagatttaaaaaattaaaaataattgaaactcctccttactttcaattaaaggaatgatttacttcttacaattttttttttactgagcatgcccatcacgatgatgaattgacgattcaccaaaatagaaaataaaaaatcccccctatggtgtgaaacagcgtaatgaacttcaccgattggcccaacctgagcatatcaaaagatgggctttgaaacgttagtccaatgtatgttatctctaatggacttagttaagcccatcaaacttaattagggtccagtatagtgcgagaaaaatttggtttagtgtttttagataattttcctttagaatttaatatagctaataattacacatttacacttattttatcttcacaaagccctcatgagttttatcagaactttgaataccactgaaacttttcaaaatgattcagacgaatccaccttgaagcttagtgggggctaagatgaataaaatttgcgcaattttcattatttcgtaaaatatgagtgaaaagatatttcactatacaatttagatttttgttatttattttaattttatgctattgtttaattgcatttaatatatgctattaataataatgataataaaatctagactggaacaaaatgatgcggcaggaggagtcaggatcaggactgctaagtttatggtggctacgctttcattcattatttgatttgacactgtatttttcatttgaaaataaacaaattttgataaaatgtcacatgtataaggcttaaatattatcatacctacctggtaaaataaattatttttaatttattacttaaaattggct

SEQ ID NO: 777 - DNA, 2297 bp, Glycine max
  Soy_ogl_4215 Gm13:23165036..23167332 Cluster 3
gttcacattcttacctgtgtttaaaaaaaaccttatgaaattcgttcgttagaaaaaaaaaaaaaggaacattatgaaatcggttcaggatttcataatgtgtaaaaaaaagatgagaaatcaatttaaaggggatgaatttcttatcatgaataatgttttatattatctgtgtaaataatttttagattgtattatttaagtaattatttttttttggtattatttgtgtgaaaaaatcacaatatatttgctgattttttttagaaacgccaaggacactagttaagaaatttaaaatagaaatatttttattgagaggtgaaaaattatgttgtctataatttttgtgctctcatataaatttcataataaatttttctattttagtttgttaataatatttgaagtacccttattggaaagattttttttaatcgttattttttgttcctttgtaaacgtttaattctatcaatttccttgttgcacatttggaaacggggataaaccaaatataaactacctttcattaatatcattaagtgtgtgttcagattaattattaattctagcaaaattaatttgaaggctaaaacaacaagtaattgttttaacttttaaatttttcagcatgattttgattttggggtcaaagttgattctaattaagaagtattcaaacacactattataaatagttaggtacatgagcaatgaagcaaaacaaatccattacaaaggtaaaatttaattttcaacaagtacaaaaattaaactatatttttttattttatttttcacttataattaaacatgcttttaggagcaacatttaatttgatttcaatttatttacaacaactaaacaagttcttttattttttttctttaaagtcatgttagtgatttttaaacgtgggtttggagaagataaacgctcacctcaagcatactatcagatggtcaaaccaagaattgaattctatgttaacgacaaggaaatggaagttatcctttatataatactctgtaacgtcttctctttgtttttctattcttctcatatatacattattatttggacagtccaaccttatagtcatttcggtgcacacaagtccctgcagaacaaacaagaacttatttaatttgagaaaatatttttattaacaattattaaatgttacctgatttttacattttactttatatattcaaagatttatataaaaataatgaatagtattttaatgttttagtttttattttctgcaaagaagtacttaggtgaaaataaggaaagaaagcatttttatttgattgtcaaatgacgttatggcaacatacacatcacatagtttagtttgaaagtgaaacattgttttatattaattcagggaataataaatgttatttgacatcgattttgattaaaaagtgtttgaattaaaaaaatattatataatttgatatcaaagtgtgaagtcataaaaagaaaaaaattttaggctcatatttttactgttaaaattaaaattaattttcattcttattttaatataatttttgttttaacattttaaaaattaattttatccaactctatattataatactaaactaaacagacaactaattaacgatcggcgccctgagaagttttaacagtatgaatgaagttttaagtttaactaaacttgttgtcgttgtaaaaaagaacactaaaaatttttagataaacatttaatttattaattgataattcaattttaaaatttaatttgatgataaattaatagctatataacatccataataattagaatagtaagagagaggatcttaacttgtatcttgtcggttgtcgatcgctagttggaatggaattagtcgaaaatgatgccaaattacaaataatagttctgtttttgtcaatatctcttatggaaaaaaatcggtgaagatattttatgcaaaaacacatataatagtttatgtgaaatatccttttcgtaaaaaaaaaaggcatgttttattactaatattttggggaaaatttgttttaaaatcatttacattcttttttaaaaaattatgtttcttttttttatataaaaattatgtttcaaaacctgatcttggaatagatgattaattgagatcgactaccactaatattattggcgttggatatgatttaaaattagttcaaaaaaccagattggtaaaaacattgattgatgcattattcagtgaaatgcgattaaatcactattgaattagtagaagtaaag

SEQ ID NO: 778 - DNA, 1200 bp, Glycine max
  Soy_ogl_5679 Gm17:13890401..13891600 Cluster 3
tataatataataattttatgtttgacagagatttgttttctatgaactaatatcatttcttacttattattttatacttcttaaattactgaattataaaaagaatggtaaaataaaaagagaaaattgctaaaaccaattagtaattaagtttataggatttttactaaaaacaaaaacctttaacttaagttacatgccaagatctcaattttttttatattctctatttgttttcttatgttgttcagtagtttttgttttcacatatttttgtttcttttttattatgcgagatattaaagaatgagaaaaagaattatacataatcattcaattataatttttaattattattatttttattctaaaaaattaatatccgttgatttgggtatcataattattttgattgaaattatttaatacacccatttaaatatttaaataatctgaggaactttttcttcttcaagtttatagcatcaaattacatcatttaattaatttatttattgagattaattttttttttggaatgatattgagattaaatttgaattcaaatattgtaaaaaaaattcaaattagaatttatatattatccaatacgtgttacataattttaaatacttaatatgtattataaacatttaatataatttttttactatagttacccctagtatattttttattactatagcattaaataccattaattaattttgcttctcagaataatcaaataacaaaaactttaagcaattaatgactattatttgctaatttatttaattaaagtaattaattattcataattaccttaattgtataaaattaaaaccatcatattagtcttattatttacatcgaaaaatttctttcagactaacatatttcatttttaaatatttaattaattatttaattaaaatatcttatgtggttgcggattagaatgttgctaaataagataataagacttttgtattgataatccaatcaaagatcttttgttttaaattatttattttaaaatatttcctttttactcatattttaggcaggaaaatgttttctggaagtcaattttaatgtttttcgtttttctcctccttttagccaagtcaaaagtaatttacacaaaaattaaacatattaaaatgagaaactgaaaaaaaaaaaaagaagtacaaa

SEQ ID NO: 779 - DNA, 3467 bp, Glycine max
  Soy_ogl_6092 Gm18:43731334..43734800 Cluster 3
taaaatatgtttccattatttaaggatctcttttttaatttttgcgagtctaaaaaatgtccgagacggcggcactgcaacattaaaagaaaacatgataaaaattaagctagtgttaacttgtactgaacgtccaaatatatttgaattagcataggcaattgtggaaggaggatgcaacattggaaaaggtttgctttggttttagctaataggatatctgaagtcaacgggaaatattgaaacataatagaaacaaaggaaaacataaataatgcctatgaaatccgatccacttagagagtgtgtgcagtgttgagtttgaaagttcgattaaataggtgtgaaggacggggctttatacgtacatatatgatgcgtacaacagacaaggtgtgatcaactttctatcatattgaaatttctctcggtctttaaagaaagttcatcaaaatatagtttgtccttccaaaaaaacatataaagatttaaaatatttattgttttaagatcttaggcattttttttttactttttcctctatcaacgtattagcaatttatttattatttaatcaattaaaggtgctttgttaaataaatataatttttaaaatgcataatgttgaatataaattttaacaaatagatgacgataaaaaggtatttaaaatctcgagtaatggaatttctctcaatttttcaaaaaatttcttcagaaaaacttcaaataacacaaatatgttgacttcctggaaaaaaaactttaaatatgaataaatttgatatttaaaatatttattgattataatagattaatgaaatgcactactcattactataaataattgtcatgaaataaatataaatagaattttagctctcataagttgcatataatatgtatttattttatacaataattaaaatttctgataaatatatattttgaattcaaaaattatattataattaaaaactatagttaatatcaaaaaatatttggaatacacattatattttacataattatattattgattttttataataaaaatatattaaaagttaatttaaatacagagtatatgaagtaaaagcgaaaaatgatagtttgaaatgattatctacgaaaaaagaataattgcacgaaaccaaataatacttatcttggtaggtgaagattaaataaagaactaataacaaaataatctccttgtctgttagaaagacttaaattcaaatacagtctagaaagtccttgcaatttgcttccttgaaattgaatattcaatactccgtatttaatattcaatatttaatgaatgttaagtcaacagttcagttttaggaaagtaatatgaggattaaagattaaaaataaaaaattaatgtgtattactttttattttacaacacacacatccctaaaaaaaatactacttagaaaagaaaagtatcagtgtttaaaggacaaaatttcacataatggcgcgtaacatctatcaatcttcggtcgatagaaatttatgcattgccttaatccttgaaattgaatattcaatattccgtatttaatattcaatatttaatgaatgttaagtcaatagttcagttttaggaaagtaatatgaggattaaagattaaaaataaaaaattaatatgtattactttttattttacaacacacacatccctaaaaaaaatacaacttagaaaagaaaagtatcagtgtttaaaggacaaaatttcacataatggcgcgtaacatcaatctttggtcgatagaaatttatgcattgccttaatcttatgtgcctcgggtaagaaaaaaaacttgaatattgaatattaaatatttaatgaatttaaagtcaataattcattattaggaaagtaatgttaggattaaagattaaaaaattgaatattgaatatttcttatttaatattcaatattcaatatttaatgaatgttaagtcaagaattcattataaggaaataaatctgaggattaaagactaaaaaaattaatgcatattaccttttattttacaacataaacatatatatataaggatcatttttttacaaactaaaacacaagctgtcaaaaaaaaaaagaaacacatccctcaaaaaagaaaaatataagtgtttaaaggacaaaactttgcacaatggaaagtagtctctatcaatcttcgatcgttggaattctatgcgtcgccttaatcctatgtgcctcaggtaacaaaaagagattagtttttttttttttctgaagaaaaaacagttatgaaaaaatatatatattttcaatgttgtttcatatttatccaagaatatatcatttggtgctaggtaaaaccccttcaaaaaattcttaatagtttttaattggaacttttgtaagctaatttttaaagcaagatatatgttaaataaagtcttcatacattttcctgagaattaggatataattacattaattttttaaatgtttatattgctaaattaatccattagaatgttaactaatgtgtcagcatatttttttatatgaattttgttatcgtgttagtattgcaaaaagctttaaagctctaaagtatcaatcacataaaaatataaatttgtcaaaggttttatgttttaaggcattgatttatgtcgtggggaaaatctttgaaggactaatataatgacatttaatatttgaatgactatgatcctgcttactttcagaaattatgttttgtttttaatttttatttaactttccaaaataaaaaataattatttttttcattttttattttcaaatatttaagttggaattaaaaataaaaaataaaagtaacttttgaatttttctacgagtactcataatatttttttatggtgataggaaattaaaaaaaaaatcttattttgaaactaaaagtgataataaaaaagaaaatcaaaacacctttttcacaaacctaagatcattatattggtaataaaatctctaaagaaccaaatagaagattttttttagatatgttctattgaggaaaaatgctatctagtaccaaccagttttttgtcatatatgtacgattggtgatttccgtcaaaatctattttatatattatttaaaaaagaataagtagttttaattttaaaaaataatattaagccatatttcttattcatgtgtttcgtttctatctttgtcaatctgtaacggagatataattgataataagcaatatgagctatgtgcataaatttcttaactttttttaaataaaaaaaattgtaggtccagcaatatgtctcgaacaaggggaaccagaacaatatgggcaactaccagagttaggaggttgcataggagactgcgtgccagattgcgaccatcaatgcattatccgtggtttcaagagaggtgcttgtttgggatatgccgtgtgt

SEQ ID NO: 780 - DNA, 2199 bp, Glycine max
  Soy_ogl_6138 Gm18:52562502..52564700 Cluster 3
gatcgtctcttcactctcggatactcctataatttacaataaaataaactttaaaaaatatgatttaaaattacatgttaaccattatttaataaatacaatttctgcaaaagtaatctattacttttaattcgatgtaaattttattttttgttttaagttttgaaaaccaagttcctactttctatttgattttttttctattactacaaagtataagaataaaataaagtactacataatataaaaaatattttttaaaatctgatatcaattaaggttttaaaaaatatgaaaaagcgatagagaaataatgaaagtgttgaataaaagctatttttaattaaaggaattgataagtcatgcatcaatatctctagtctttaatgttgtcaaaaaaaattatctcaacattaataatcatgttcttaattaatgatataatttcttataataagctacaaattcaattttcaattatatatatgattttggtatttagctttttcacctctaattatcaattaattaagacaagtagctaacttttgggtaatttttccatcataaaacatccttgtccattacaatttgaacaataggaactgattcatgtaaaaacttacataataaccagtaaaataaaattgtcatgcactatccacgaccttgattcacacgcatcttcttcttcctcttcttgatgaagtccaaatccaaaatttaatatattttatataatcaagtcttctactgtaattttatcctattttaactacccattaggccactagcaaatcctgtcatgttacttttacattttgacctactactttagtattttctcaatattctcacattttttttcttcctccttctctttttccgtaaaattagattatcaaattttattttatttttatagttttaagtttatcccagaacactcgaatatattttaagaattttttgcaatctagagatttacattatggaacaataaattcttgaaatactagtattatcacacgtctcatgccactaattttctctatgtttctcatacttttaattccaacattattatgtgtaattttgtttagtatattttgttaattacgtgtaattagatgtgtatgttctatatcaactttatgagtttttttagttcaagtcacaaatatgttcttatgaatgcgctaaagtttgtcttttattgaaataactaaattatacaaagatagaaaagaaaatataaactaccaacagacaaatacaaaacatatacgagtgcaattaaatttttaaagtcttgtgtgggattttttggtcctaggtaggtggtgaaaaaatggcattgttgtgaacttgtaatgcaaagagtttaatcaattttatgaacaggtgtgcacagcgagcggaacaggaacaaaaagtcaggaggggacaaaataattgatgctataatgtataaattaaatgtaatagttttgataatatcgtctcttataagggattttaagcatttaatgatactatttgaatattaataatttttaattatcatttatgatattattttttttcaacttcattaataacaattttctgggatttttcacgacctttatactcttatttttattgaataaaaaaattaaaaaatttatctgtaatttatttttatgaataaaaatttgtacaggaataaaaaaaatattaaaattttctatcaatttgtcaatgaattcaaagacaaccatattttttccaaaatcataccaaattttgcagagaaatcacaaaatttattaaaaatatttgcatggaaaatctatgagaaaatgtgtagatttgagttaattatattatataaaactttgaaagtgttataaatattttttagtggaagcaactaaaacatagatactttttttaagatgtttattttattaattgaaggaattatgagaaccactttttctctctaaaatgtctcatattttgaaattagatgacacaactagttatctttttctcaacaatgtctttatcatttgatctaataggacttcgttagataggaataaatttgataaatattaataactctcaaatagagtattagaacagaaaaatccattaatagatggagcgtccatcgcagctagatctaaaggaaacttatgaacattacat

SEQ ID NO: 781 - DNA, 1200 bp, Glycine max
  Soy_ogl_6337 Gm19:2285601..2286800 Cluster 3
gtgaaatatttttcagttttactgatgattaacttttattaaataatttaattgatcttttttagtaagatttaatcttttaatcacaatttttttattcataaaacttgaatccgaaattttatttaaagaaaatgaatccaacatcacttaaactaacagacttgttggtaagaatttaatatgtctgtgttgtacatatatcagtcttatttaaataaatttttcactaagtatttataggagaaaaacaataagaagataaaataaattaaacttctttcataaattaaattgatttatatataagttaaaattagcttttagaaaaattaactaagagagtttttataaattagttcatatataagttaattttaatttataagagaaatttaatttgttttaattttttatttttttctataaaagtctttattaagaagttgtccatttcaagggcttctgttatgtgatcattcaaaattaaaagcatgcattttactagtgcataaaaatataatatgtttttgctaatttaattaatcaaatgtgtttgtgaaatcgctgttcatatccaaatatgctcaggttggctaattttatttaatttctgaaaaatatcttgaaatattaattacttaagaaaaaataaacaaaaggggtcttagtacagattaatttgcctgtttaatttttttaagtacttgtacgaaataaacttgcagttttgaacaactcatactgcaggcaacatcttgaaagagagagaactcaagaaaaaaatattatcaaataattaaagaaaaataaaagaaatgtatatatgaattaatttcaggtgcaagttgactatgttttatcaaacaaaacaacttttttttttcttttctccttttcccccacatgcccaataatgcaagtaggtatatgcaattaaatgtggtgttcacatggtcccatggaacgtgatcaatgtagagattcatcagatccacctaatttatattattaagaattttgttgacaaagataattaaaaaactttttattttttaatctggtcaaaattaaaactaaagaagaaaagtgaaataaatataatcttatgcgcgccctaaaatggaataaacaaattaaaatcctaaaactacattaattaaaaggattgatgtccaaaatttcctaataaaaaccaat

SEQ ID NO: 782 - DNA, 1463 bp, Glycine max
  Soy_ogl_2425 Gm07:38489531..38490993 Cluster 3
actttttttcattgccacaatagagagattttttagggtgttattaatacaaagtgtttattaatttggttaataattatttttcatcatattttctcttttacaatcatattttttcacaaagtttgaatgcaaaactttatttaaaaaacaaaaatttagtatcagttgaaccaacgatttattgaaaaaaaaaaaataatttacatattttttttgagagagagataatctgtatttagatcatgcgtgtcactctcatacaacatgcacacttctaaagaggtttactatttttataaaatttggagagtgtccctgttcactagcatgcgtgggagggattctctgatacaagaggaatacctaaacttgattatgaagaaaaaaaaaatccaatccaggtcagtaattttagacaaaaatcaaatggtaacggaattgcaaattaaggaaatgaaaaagctagaattatttatttaatattgtcctttatttggcaacggttttgaaaggcaaatgtagttttgccggcgaatgattcatgtgtcagtagggcccagggatacgatacgacggtgcattccagctcagagattgagagccgttgaagttgaagatggacccaatcatgccaacgtggaaggttcgcgaatggagaagacgaggcgttatgaaccgacacgtcgcaatcagagatgggttgtttcatcaaggtggtccaggtcccagagagttcggagatgacaccagaagcaactcgtttgctgtgggtgtgtcggacttactcactactataccccatttttctctctttgctctatccatcggtgtcctcgtttttagggttaggtaccctagtgattttgactttttgagcatgagtttatttagacttaaaagaaataatttttaaataaatattttaaaaatagtttttaagaaatagataagaattttttttttaaaataaagattatttattttatttaaaaaacactagttttaaaaaaaataaatttaaacaaaatcaacctaagggtttcttattaaaataagttgtttttagcttatttcaggcttatggtttgttaaaaaaaattaaacaaacggataaaatacataagtgtttttccttctaaaaataagtagaaacaaaacgcttgtgagtttgtttaaacttttaaaaaaattaactaagtatttttttaagaagcagataaaatattaaaataagtagaaagttatttttttaagtaaaagtagtttagataaatatgttaaaaaacataaaattacttattttattataataaatgattattttaaaaaataagtttaaataaattgaccttaaatggagactttatacttttgttttattttagaaaaaaaaatttaaacacccaaaattaattgacactttaagagaaatagagagaagaaagagaaatattgatatg

SEQ ID NO: 783 - DNA, 2458 bp, Glycine max
  Soy_ogl_59 Gm01:2617543..2620000 Cluster 3
ataggagtatatctatacaaaaactatagtatattctacacttttaattcattttattttgctttattataattatttattgattaatttatctaaattggctcgttatagaataaaaaaccgtattagttgtttgacgattttcataatattatccttccactgtgtgcgtggtaggggggattaattaaaaattaaatggaataacaatatttttttttattagtgccatctctaatatttttgcttaaaaaagtaaaacggcttcgctttacagaaagaaatagtattgatttataattaatctcaaaagtagactttggtcctaattaactatatataaattctcattacttacgtatgctttttcgtttaaaagaaaaagaaatattttaaatataaaatactcacaatatttctgtcttttttaacaaaaaactttgagaaaaatatgtttatcaatcatttgatatacttatcataacaaaacacgcgttatacagagatttattcgtatgtaggagtatataaacaagctccttttaagcatactgcagatataattgacgggtgggaaaacatgaaattagcttatctgttgttctttttatgtgttatatagttgtattaatatttaattttgtaatttaattttaaaattatatgattttcaaaaattagcacagaaacaactaaaaaagaaacataaaaaaaatcaggtccgaaaaacacatatttcaaatcatttccttccttgctgcacgaatgaactttctgccaatcgaatcagaaaaaaggtgtgaacttcaagcccaccaaatggtaggtttaggttatactatgatgactgctgaggtatacataaattttcatgtcaaacaacagttttatttatttcaaaaaatggggaacgtgataatcaactggattagtgaactaatcatataatcaaagacagaaaagttttgtgagtcaattatgagctaaagctgagacatattttgtcgtgtcacattcatggtgcctaatccatacgtcgcacgcgaatctttgacaaacggggacaccaaagatgggtgattgatttcttggggaaccgagtttaacatattacttcactcatcattttaattaccaactacgattagttgtgacttcttaaagcttcctggattttcactaatagtattgtattctttctgaatttctatatgagtaaaaaataattaattatatactaattaaaaaaattaattcatattattaaattttattaatcttaaacaaaaaataagattatttaaaaaaattcatttttagttcaattttctcttcttctctttcacttcatttttaacaaaaaaaattattcttaaattattaacgacgtcaattttaaaaataattaaactgaataaaaaaataaaataaataattaaaatatcctttttaaaaaataaagaattaaactaaaaaaaagactaaattgaacttttacttatatataagtttagagagagtattagaaagagtattagtcagttacgagtggtaattctgttcctacgtataaaaataaatacttaattcatcaagatgaataaaaataattaagttagttaactttaattaataacaacataaatttgaattttattttaaaaatatcctattgaattaaatgatcaagtgatggttatattaatgattttacttattttttaaaggataattttttccaccaataaatataccttatcttatcaatagtctttacaataaataagaatataaaaaaaaattaacaattattacatttaaaagtaattatatattacttatattaaggggaaaaaagatattcctatttgtttcttaattatatataggaacaaagaaaatattactttcccatccatgcatctcttttcacttagctacctgaattaattaattgaacttaattttataataagaattaaaaggagttctatatatttagactttcaagtgtcatcaaaagtgcaatattttactattgcaaatgaattatcattaaatttttgtattaggaattaatgttactaacatactgccattttctaatatttcttaaatatatttttaattcttataaaattaatgaaaagaattagcgaaaacataaaaggtgtggaactcagtacgtataggcattatacagtatacattatgcaatcagtagataaaaaaaacttatcagttcatagtatgcatatgcagttgatcaacagataaatgcatcatttagtacacacattatgcattatgcagataaataccagcatgcacaatacctcaaacgcacaatgttttattgaaaataggatggagaaaaatttcaagaaggtttttcgatgtttctttttctgcaaatggagtggaccaaattcaagaatcaaggatgaagaaaaatttc

SEQ ID NO: 784 - DNA, 2100 bp, Glycine max
  Soy_ogl_418 Gm02:6494701..6496800 Cluster 3
agaagacgtgtttttgcaccaactgttttgttaagtgtttatttttaaaaaaacttattcaatgataatttatttataaattcaggtgaatgattaatttatttttccactggttaactgaaagatctattaagacaaattaaatggaattataaaaaaactcatgaacatcatatttataaattaattccataagatctcccaaaaaaaatcattcgtgaaccttttgttaattaacatttgttgcagcaaacattgagatgggacggcaaataaaaaagattattgataaaaacaacagtcgctatcattctgttttttgaaaaatattagaaaaaaccattaaaaaggaaaaatggtcttttaaagtttagctaggagtagattatgggtaaaaaaagatgttagtattttacagtgtctatcttaaaatggttactgatatttagatgtctagaatatttttttatctattttgaaataaataaataaataagtatctgtttttaaattgggcttgattctcagttttctgcataatagaaacattatgtgtttgttacttttaattaaatttgacatcactgacttgttacaacttataactatcatgtatggctcattaaaatgtaagattaataagatctcatgtctaaattaacctccttttgtttttttctaaaataaataattacacaacatagataccccaaattaatttattaaattggtaaccagacctcaagtaactcattttgtattattaaagtttcataaaaaaattatattaatcatgacagatactttttatggactgcttggttcaaaagagaggaggaaggtaaattttaatgaaggaaaaagattttgattagatgtcctgtttggtttagagacaggagggaggaggttttaatggagggaaggaggaaaagtaactcttttcttatgtggttacaacgggagatgtatatctttaattatggatttcaaaaatataattagggttatctttcgaattgcagttgaatccaccgagagataagagataacttagtgaattgaaatatactttgatcttagtgtattcctcatgacttaccttcaattttttttcttgagcatgtcatgggatgtcttttaaagattgttctatagggtattttgttgtgctgattttattctgtcaaatgcaatgtttgtgtttcaatattcattcttttggttgctttgattgaatgaggacttgatgtttttttcaagtttcatgcttctgaatttatgcatgtcttttaattcggttgggttggatcatcatgttaaataattaaaaaaaattattgtcacctcttttttttttaactactaacaaagaaattaaaccccccatcaaaatcagtaatgagacattatcatttcattgtttaatttcttaactcttatttcctccattctcttttataagtaaaaaaaaaacttaattttttgttttcaaatataaacaaaacctaactatttttaccttatttaatgagattatattaaaaaatatccttcatttaatagaaatttatgtttaatatcaaatttcaatgaatgataatttagaaaaaatatttatttttaattgaaaatgagacaattgaattaaataaactatctttcttaatgttgagtataagtcaatcattagtattcattgctttattgttttatagctcacaattagaattcaataaaatcattaatattgttttacaaacaaaaattattagattgagttaatttctaaaaccaaaataaattattgtggcttgcaaataaatcgttaatattttttttattttttataaaccagagttagaatccttaaacaaaagagttcaatactgataatgtttaaatgaaccccaaacgaatgtcaaatatgcatgtcttttttttttttttatggaatcaaatatgcacgtctaaaagggtataatctcatttccttttagctagcttaacttaacgataaataaggacaaaatttatataggtgttgttcttctcattctgaagaggaatccgcaggagattaccaaaaaaaaaaaaaaa

SEQ ID NO: 785 - DNA, 2200 bp, Glycine max
  Soy_ogl_886 Gm03:35779801..35782000 Cluster 3
cacatattaagtgggctgaatgaaaatcacacgaaaaagacctgtttaattttgcgtgtaagtttaattttgttcatttaatgcgtattattattatagactgcactaagttgacttgtaacaaaaacaaattaattgtaataacaaaaaaaacattaactaagttgactgtatatccacttatagctaaaacgctgatcatcaaaatttgaccattatacgttaaaacaatttttaagcttgaaaattcttatttaacatgaccactacaaaatatatttttttgctgattaaaaaagattataaaacatttttaatacaagcatctaataattgaaaattatcctactaaaaaaattgagaaattatcttatcatcacatcatatatattaatagatgagatgatatgaaattataaaattgatttggtggtcgaagggaggaggctccaaaaaaaaaagaaatcacaagtttaaatatctctaattaaccattaatatttatcgaaaaaaaaatgtcatgacatgataaaatcatagcttcttattaaatatgtgtataaaattagtttatttttattttcttttttaaagtttctatgtaaaaataaaaaaaatgcaatcaagtttcttgttccgaataaaataattgtgagtttttttttatctttttcatttatacttcacaataactgtgaatgtataagttaattaaaaattgaatagaaagtaagaatataattttaaaaaataattaatattttatcttaaacttttaaaacaacaaataaaaaaaataaaaatctttcaaaaatcccacaataatacgtataaattaacttatttaacattacaatagcataagagagggaagaattaaatcaattaatgcatgcttccacaaactactttactcatctaactttaaacttgaaagtggggcaacatgagacaaaagtaagcaagaatatctaagataaagttactcttaatagttagtggctgatgattctctaatgtatatatgttctctctttgagtattccaaatttattctttggaaaataataccactgtcaggtttgatatatgattctaaaactattatttcagaataatattatttttaaaatatttttatttttttcttttttattctcttgatgagaagtagaatattatactttctatggcatataataaaattcatcttatataacttaataattaatttccgttttcaattttatttttccatcacaatatttctcttattatttaaatttcaaaactattcttaaaaaaataatgtttaaatatacaatttagttcccatatatagtttcttttaattttgattttaatccgtatattttaaaattttggttccgaatatctttaatttcaaattttcaatttcttcataaaaataatcctggccatattcagcctcatcaataatggcgttacatttaagttagctagtgcatacgtgatgacttagttaaattaaggttatacaagattttgatactcttttccttggcaatcatagtgcagtggttattaactctgaattctttttcaagacgagagtaaatatgtaaaaatatatctaaaattaattctaaactcataatcaattcattaaaatcaaatcaaactaaacacacacttaatatcccatccagccagctatgcataaagaaataacccaaaatacgccaatgagtcctagtagatggcagagaaaatttgatgactagcattagtttttaggtttcttgttattttagaactttgagattgtggcccttcaattaatgtttctacaaaggctttgatatagtagttgcaccacatcctgtccagctttgcatatgcataatcaatatgaacgtacccatcttgacataacaattgtacatggcaaattttgcaaaaacaatagcataaaaaatcattctgaattaatttctataatttcatcaatgagatttctgtatatcatatttgtagtaatatatctttgctttcattttttttttgatggggcagataaaatggtatcttaattaatgagaatcacagttaattaaaatggtatgttaactattattcttgatatgtatactataaaagacaaataaaacaatgaaaggagtaactttgtaaaactttatccaaaggcaataatatt

SEQ ID NO: 786 - DNA, 2811 bp, Glycine max
  Soy_ogl_1823 Gm06:7199890..7202700 Cluster 3
tagttcctataatatatatgtagatcgttttattttaatctttattaaatgtttttaaagaaatcaaattcaaaataaatgaataaactctaggaattaaaataaattttttaaaggactaaaataaaatagtaagaatcaaaatcaaatttttttacaaggtcctaaagttaagcaaaatttgtctatatttcaagggaaaaaaaaacatattaaaatttatattagataacatatcattcaacaatataagacacacagtgggatatcaactaaggtttacctagctagtagaaaagatttgagtagtatacacaaggcttatgtttaaattttgttgttgtcaatgaacacacacaccaaaaaaaaaaacacttacacacaatacaacaaagtcctcacaaaaaggtagcgtaagtttagcgtcaaatttcattaatatagggataaaaaaaacttaaaccccatcccattccctaattcgaacatcatcatatctttaatcaaagtgagttttctccacaaaaaaggtaatttggtggattttttaaaatggaaaagtcccaagagtatttataaaagtaaaattgtttaatgacatatatggtattaaaagtatttttgaaatttaggactatcaaaattaatcatgaagagaaatttaattaactaattttcttaagtaaaaaatagaaaggaaaaaaaaaaaaagaaatgacgaatcttattgttttaacaaaagttctaacatatttttgctgcgtgaaaatttatacgtcgagtttataaaatgtaaatatcttataatttaaatgatattttatctaatgtatcatattaattttcatttaaatattcaattattaataaaaagcgaaagtttctaattctaatgcctacacaagcaagattgataagcatgattttaaaaattagactaataagtaaaatcattgtttttttccttctaaatgtcccagtagacacatcgtaacttaaacataatttattattacaagtgagaaaaaaaaagatttatcggggcagtatcgtgaaatatatcataacaagagaatatgatttaactttagcggaggttgctgttttatgatggaaatctctcttgctcgctcgctctcaataatttgctcaatcctgttagatattgagctttattgtccatatttgcttcttttaatgtcaaatcttgtgactttgttgttcccttgatgtatgtcttagttttctctcttgttatgctggtccttttatgattgttcctttcgtaatgatcttgcagatagctacaatcttagggagaagatatggtacgttcttcatcatgctggaatgcttttcatgcttgtttctgctatgaattatgtctagctagatattaacagataattttttaaaagagtataactatgaattgcatgatagttagttctagtgcacatttatcttcttttcttttaatatctatttttttttcttcttctaatttgcgacaatggatgacaattggaccagtcaagaggcatctgtaaaaaatacccacaataaggaagaaaaaaacttgcaaaatgatgagtataagtgcggatacagctaccacaaaaaaaaaaaaagtaatctagtgtaaaaaaaaagtccaatactcctcaatttctagcttcaatggtataagtagaagcagtgcgtgtaaacagtaaagtattgtagtttctcttagtgtacggtttggaaaaaaaaaaaataatgttgtccgatcttctctcttcacgttacctcaagagagtaattataaaaaaaatattcttcattttttttcatttaatttcttttaatctatatatattatcctgttatacctaccctattgtttatacatcttctgaatactttatctttgataattatgtgaactatagatgttaagacaaatgcatctgcttttgtctatagccacgtaccaaatgaaaatattatagtctcgaatggggttttttcagatatataagtatataataatcctcaataattaattaatggaatattttagttctgtggtacctgttaatcaacttaacgagaataactaatactaaatgatagagtaacatgaccaaacaccatttacctttttgactaacagcaagctgtttaaaaaatttggataccataggatccaaaacatcttatgtagtttaataatcagttttctttttcaacctaaatcagaaataagagatgcgcaactgtaattaaagggagcataattcgtgccaatcattgacatgtggcacgatagtcaagattggcaggttaaacatcaaataaaaaacacaaaaatactaatcctaattaaaaaatcaatatctttaacattagtcttttaaaactatttttaagcattcaaatttaaaagtgttaaacttttattaaaaattatttattatactgaatatataaatgtataatatttttaagaataaaatttaccatgtttacgtgattaaaataatccaaacagctgacgttaattttattttattttttaaaaaaaaactattcatacttgcattatgaaaattggacccacttagaggtgtttagacggggtaagaaaaattgtctccccctcccatcggagttggtttttccgcctccgtcctcatccctgaaaattcattaaaataaaaggaaaaatttaataattcaacagaaaaacacataagaattacagaaacaaattaattcacatacaaaagttagacttcacatccatcatatatatataaataaggt

SEQ ID NO: 787 - DNA, 1800 bp, Glycine max
  Soy_ogl_3370 Gm10:4870501..4872300 Cluster 3
tactaaggagtccaacccatgtcaaacccaataaataccactaatatcaaaatcactattgaatacagattcaggggacaaatggaagggggagggggcggatccaagtatagttgagggggagcatgactttatgaaatcataaagatatatgtagtgttgttatttttttccctttattttcatattttgatcccaatgccttcaatttttgtcttttatatattagttgttttcttatgttttgttccttttaggtttgattcagttaaatatttgattctatttcagaggataaaatattttttggcttctgtaaaaaagtaagttcaattttagtcattaacaatttttttcttctatttttcgtccctctaatttttaaatgcacaacttttactcttcaaaatggttgaaataacacttagaggacaaaatatgattcaaatagtactttgagcggaagatcaaaagtgataaattttaaaattatagaaacacaaaagagacaaaattgaattaaaatttttaaaaggataaaaaaatatattttaccttgtttaagaaaagatcagtggggacttgttattcattaatagtggcaaaacaagaacaaaaagcagttaagtataggcggctattagtgtgaacgactaagtgaaggaaaaaaaatatcattggtgcttactaatttattgagtgggttggttgaagtcttctataagtgaagtgactagcaaggttagtaaggattggtggcttctaacttgataatacttagcattaattgtaagagggcccataaagttgagatatatttaagccaaaatacaaaaataataaacaaatgaattaaatgataataatcataaatcattgatacgactaattacataaaatttaattatcttattatacatatagatagattataaattataattagataatagggtaaaactttttacactaagtgtataattgttttttctgtaaacaaataagtttagatatatgcttaattaatgtcatgtctctttttctgaaaaccaattatgcataactttcaatccctaaatctttataggataagacagtaacagcaatataaccctgtaaaagtgccttacaaattggtgttacgactcacgacatcttgcccaacatatatatgaccggaagagataaaatagtatagtggagatcagcgacggatccagaactttattagagggggttagaatttttattttcttttttgtaatccaaattccgcaataattaaaaaaaattaatctgaagtattagcagaagcatgcacaaaaatattagtagaaaataggcataagaagtggagtaaaaggtgcatcattatttactaatatatagagagagaacataaactagttaataaagaaaaatatacaatatcaattcaattgatatgattgtcaaaaaaataaaagaatataatctcgtataattacacaatttttattattacactatcatgtagaatcaatcagaattttttataattaagtaattacgttaacatggatatatgtgtaaaaaaaaactttagaatcaatcatctgaaaggtttcaagaagctaaagaaaaataactctaaaaaaaatccgtattgttcattcgtatttttaataaggaaaaaatcagtttgtataaaagtgagaaattatgttactaataattatcagtctatcagaacttagaataagaaaaaaaaaaacaaactaactactattgagctaattaacaaaatcaaaattaataaat

SEQ ID NO: 788 - DNA, 1714 bp, Glycine max
  Soy_ogl_3383 Gm10:6111001..6112714 Cluster 3
aactaatattgtttggcctctttaaaaattaaaaaaaataagaagagtaaataatttatatactgataatataaagattttttgtattatcatttaatcacatgccgttatttaataaattaattgacttttaaaataattattataattattataataatttctaattgatagtgtaataaattttaccataacaatccataaaacttaaaattctaaggaaaacaaaaatagtcttatatgacggatttatacaatgttagagatgattaattatatctttaacataaatatttctatcctaattgatatcctaaatactcaattaatacttgactttaattttttcaaatgagactcctaatttcaggattgtaaatttttctcttcatttgcgtgactcaaaattgcaagtgaaagggaattcattttggtcctaaaaattaatatacctaaatttgggtatcataattattttgaatgaaattaattaatatatccgtttaaaaatttaattaatctgaggattttttttctttacgtttatagcatcaaaatatatcatttatgtaccaaaaaaaattatatcatttaattaattaattaatttatattaaatttgaattcaaattatattttacataatatagttattgtaattttacataatttatattatcccatgcaatacatgcttttatataattttaaatacttgttgattttttatgttgttacatgtagattttttcatattttatatattataaatatttaatataacttttttaccatagttaccccaagtattaaaacaaactttattactataacattgaatacaattatttaattttgcttcccagaataatcaaataacaaaaaactttaagtaattaatggctattatttgctaatttattttaattaaactaattaattattcataattaccttaattgtgtaaaagttaaaccatcatattattcttattaatgaaatcaaaatatttgttgcaaacaaacatatttcatttttaaatttttaattattctttaattaaaatatcttatgtttttctaattacgttgttgctaaataaggtattaagatttttgtattgataattaatccaatcaaagatttttttattttggaatatttttctttttactcatattttagataggaaaatgttttctttacggcaaggcaatgcaatgcttttcatttttctccaacttttagccaaatcaaatataatttacacaaatgattaaaaacattaaaacgagaaactaaaaaaaaaaatacacaaaggagaaacttgctctaaagacaaaagaaataataaagataaatatttcactaaaaaagtagtatgcagtttctaatatagaaaaataaaaaaactatcaaattcattacccactgtaataacatgggttttggtcttcacgtgtttcttgttatctttttgggatattcctccattttcacaattgctagcttctagcctttttctaaaaaaaattacacatttataacattacaaccacttaaaacctcataaaaattctgtgaataatatatgttagtcattataaatatatatgttatataaattaattaattatataaatcatcattgaagtactctagtcatcctaacaattagtgatgctaattggcatcaattagttattaaatttgc

SEQ ID NO: 789 - DNA, 1600 bp, Glycine max
  Soy_ogl_4220 Gm13:23387201..23388800 Cluster 3
tttctatgtaacacagctgcccgcctaggttatcctattccaatatcataatatcgtgtcacaaatttcaacttcatttatatacaacccatcaatgcaaaactatcagcaattacaatatcaaacacaaaactgttacgttgacaaattgaactttgttgtctcttctctctactacttaattacattattatcacattagaataatgaggaatcacctgttcttatcataaattataatacgttattttcttaataatttttaaagttaaaactcttatctatgactatttaatttttatatagaaatgaagcatgaaaatattacttaaattaatggaacctcgatcttactcaccatgttacagtcatggtaaatatatcgcactcataaattgttgggtccattttttatattcttatcactcatcactccttacgaactataactcagaacttccacctctctgccagttttggtgcacacctactcagcgaagcatgattctacaagtcacccagtcacaaatggttgtgatttctcatgctgtagctacctcaaaacccttgaccaaagaaaacttacaaaacaagccgtgtcttaaacacttgactttcatatatattataaaacaaaataaaagtgcgtttctcgtcttcgattcatacataaaaggctaaactatacttgatatttttttaatttattgaaatttattttaactctttatctttttaagaaattgttttagtattttatatctcaaatttggattaatgttatcctttctaaacaatgactatttttaatttttgaacataattttaaactattttttttacacttaacacgtaaaagttatctcattaaaattacttaaaaattacatgaaaaatatcaggttaaaaattgcgtaaatattaatcctgtgagtaattgaaaaaaaattgatattagatttttgttttttaattgttggtgagactattttttatgtaattatcaccatgtttgtagtctttttttgttcaaaagttatttgggttctataggttttatataagtaaatctaataggataaattttttgtcttaaattaatttaaaaagatttaaaattatgtcacgaatagaaaactgtcacagttttgaaaggacaataatgattcaaaattgagagataaagaattaaaataaatcttttaaaatataaaaaaataaaaatgagttttagtaaaaaaaaaaaaaagcgaccataggtatattttagcctttataaaataatatgaaaaaaaaatgatttttagctattaatcgtattacaatttcaaaaaatagtaaaagataatactttttagtaaaaggagtatatattataatttttttggattcttaatgtattcagttattaacgacaacaactatgcgttcgcgtctatatttatgacaaccatgcgtgtaagatagccctttaattctgttgtctctttacgattatgatttgttttttttttagacatttacgattttgaaatagctaaacataagctagcttggatttttatcaaatatgttgaactctattcctcttttaactacc

SEQ ID NO: 790 - DNA, 1900 bp, Glycine max
  Soy_ogl_5241 Gm16:1954101..1956000 Cluster 3
ttttttgaggagaagaaatcaatatgattatttgaaaaacaacttttttatttttttactgcgagtttcaaaaacaaattgttattagcaagattgagataatattaatacataactacaaaagaaaacttctctcttgtagacttttacaaattacaaggactaaagaagcatcaactagttccgcaacaaatttgagaacaaccgagatatttttatttttttttgttcgtcatgtaataagttaaaaaaaaatcatgtgaatttgtagcgacacggattcattgtaatgactcacgtttatattaggataactacttctcttcccaaaagattgagtatttttagttaaacgaacgagttttgtactaagtgtataaatgaattaacttagcttcattcaaacgaatcaaaactcaatctattgagagctacatgttcatgtagaaggaccttttcttcctgtggcgatagtttgtggaaaacataactttattaattaataatttaataatacaatataatcctaagatattccttgagaaaaagtcgataacgtatattgaaggttgatgtaaaagaaattaaagtagctgtctatttctgcttgaatatctattaaaaaaaatctgcttcaataagtgattaaatatttaatacattttcccttttcataataactttcgctttgcctaaataaaaaagttaataaattagatttttctagtgatgaaattattgttcttgtagtggcccaattaccgtttaatgggattggactaacaattggcttttgctattgcaacttaaatggaaaagtatgggcttatgaataggcctagtagccaccattgattgtggactcaaacataaaaccacgatgggcttatcaacattgccctttgaggatggtgtgtgactctcgctttccagaattgtatgatttaaatctaattgcgtgtgttatcatcaaatatggaaagaccgtcgtctaacaattaaattatctttaaaataaaataaggatctattcatttttttaattttattgagttcaaattagcatttgtaccaaaataaatagaagattgcaatatcagattgagttcaaattagcattttttattgagttcaaattagtaaaaaaaatagtgcccaaattttatgtatccaataaaatggatataaactatatttatattatttttatatcagattgcaatattcatcactggtatcatgaaataaaaaataatcataaaaaaaccaggagagaggcaattgtggtgatttttttatccacgaaaatcaaactttgagtattaaaaaatttacaacaaatcactaacgcactacttaaccaattaagcaaaatatctttggtaggcaattacagtgatataatttgcattcacagttgataaaaatttacaaacaattaacaaggacatactctaaaaataaacaataattgattgtcatatgattatttcaacaaacaattcactataaaagtaaactaatttaattgaaatgcttttatagttagatattttttattcaaccatctaataattgattgtaatataattaaaaactattgactttaacctatagtgttatatagtggtggaggtttgagtaatatgcataagaatttagattcaattctcattccaacgactatataagcatccaaaaaaatatactgacatttataataattattttaaatattatgtgtaaaatgatttttaattagttgatgaaataacgtcaaattaagtataagtatcatcatgcaatcctcgtggaaccaaattaattatattttcttattgcatcttcataattcatatttgactatatattaccatatcgttgtccgtcccaaaaaagt

SEQ ID NO: 791 - DNA, 2359 bp, Glycine max
  Soy_ogl_5618 Gm17:9753742..9756100 Cluster 3
gtaaaagaattttaatttgttaaaaataactatgaatatatttttagtttacttttaaaagtgtttgtccaacgataatatatatgggtgggtttgtttaaatttagttcttgaaatggacccattttggacttataattcattttaaatggacccatcttggacttataaatgaacttgggtgtgtacgtacagatatggtgagtattggagtggaggattgcacacttgttggaaaattgatgaagataaaatgtgcttagctaagaacatattgtcaacggagttaaaaaaatgctcttttattaaataaaaattataaaaaaattacaaaattataaataagatttattaaataaagagtaagacttgtacacttttataatttttaataaattttagtgaaggaataagatcatgcgtgtaggttatgttttctaaaataaaaattgtgtatgttattttaaattgaaactatcattaattaagttgaacctttcaagattcaaattaataaagttccttgcttccccctaattaacctcacttctcaaccttcaatttctctctctaattgcagtgtgaacttcgatttggttcaatttcacttgctagctttttaattgcttcggtttcactttcactttagaacttcgattttacttacggacttttgaattgctttggtttaacttgcgaccttttgaattgcttcgatttggcttgcgaacttttgaactgcgtggatttatttcacttgtgaacttctaattgcttcgatttcagagtttctccgccgtggtgggacctaacgggagcgggaagagcaacgtcatcgatgcgatgctgtttgtgttcgggaagcgagccaagcaggtgtgattgtagaatgttctagaaactaatgagtgttttggaattggagtgttctttttaatttttttaaatgttttttttttaaaatttggaaactgatgtggttgttgcagatgcggctgaacaaagtttcggagttaatacacaattccaccaatcaccagaatttggatagtgcaggggtttcagttcattttcaagagattgtggattcggtagcttttcttattattattaatcttatttttcaatatagatgtattggctatatggtgaaatcaagtttacaagtgcaatttaaacttgatttaaaaaagaatcataacctaagtaggttgaaatagaagaaatgcgtcattcccttccagttcatagttgttaatcatgaatgactaagctagcaaatacagggtgaaacacatgtacaaactcacttttccaaaacagggaaccaggtaaacttgggaaccacacgagatcaaattatgtccgagagaaaaaggagacagctaatggctgagagattcatagcgttttcatctattatacctggcttgaaggtcagtgcttaaatctctgcatcactttgtagtattattttatcgttaaacacttcaaaatacaatatttctatggaaaatgtttccaattttttgcctgtgatccaaggtagaaggatgacaaatagagaggtaaaaataaaagaatgaggggaaattgttggttgatggatatgtagtgaaaaaaaaataaggttagaaataatttgtaagagaagttgctgggtgaataaaatagtgtagagagattgagagacggataaaaaaaataaaagagatccagagtaatagataccgaaagtatatgcttagtaataattgagctaggttaggctaagtttgactagtttaacacctaagtgaaagttattggttttaactttctatagtttctcaattggccttaagcattatttgttagcggacatttttaaccaaattaacaaattaatatttgataataaaaagaaataaaacttgcatatctttaatttacaatcacacactgcattcctatgtataaaataattttttaatgaaaaaatagaatttttaatgcaatgataactttttaagacaaaaatggcttaataagcaaaatttggacaaattttctgtattttgctcgtttgtaataatttttttagagttatcttatgagatatataagtatatttggcaggtttgtgaaaaaacttattaaaataggtagtttaacgtttgtttataatttattttcaatttaattaagtttaaataaactttctaatataagtgaaaaatagttcctaacttataagcttagttacaattttttgtctcaaaatttgaatcaatcaattaaatatcaatacaaaattaaatggggttaggtggggaatgatttaaatattcttaatggaactcttattaaacaataatga

SEQ ID NO: 792 - DNA, 1500 bp, Glycine max
  Soy_ogl_5948 Gm18:5629601..5631100 Cluster 3
ttatagactgtgtcctataaatcaattaataacctaccaattcaaccactgaccgagtgacccgcgccatgaccagatgaatcagcaggccgatctttaaaactatgatttttatgtccaaattctatggtgaaagatgctaatacattcatactgaaagtgtgtgcatttagcgatcctctttaaatataatatccatatgatttcatttaactaattattttaaataataatttaatatagagaaataatgagcatactcttaaatacactattttggaaacacgtttttatattgattgaaatttattaaaaaataataatttttttgtaagtcctgcattttttttaaatctctcctctattttaaagtttttaataaattttaattgttaaaaatagtatagagagtgtttcctaacattattctttaatataatatgtgaacaagtcaaagatagcatatgatacagaggaatcaataaatttagtgacgaagacacttgaaatatttttgcaaatagtattaaatataaatatagttataagttaacattaaaataatttattatcatcagaaaactattatatgcaaaatacaaaaacacattttttgttagtgtttacactctaaagcttggtaataaactctatatataatattttctctattttaaaataagtttcatatttaaaaaaattatcccaaaataaatattgtatttaattttttatgtaatattaattgattttttcactaatacattaataaatattactttaatttttcaatgtaattaatattaagatcagttttataattttttttatctatttattaacttttcttagtccatataaaacaatataagacaatacttatattgagacggaaggagtaatttttttatacttctaataaatgcaccatgtagtgtaggtttcccccaaattaaatacacttatgtcatttatttctattcctttaaatttatttttattccttcaaaactatctcataaaaaaaagagcttggtaacaaactctatctgtagtttttttttttttacttctaataaatgcatcatatagtgtagcgtttcaccatttaaatacacttatatcatttatttttatcaaatgcatcatatttttttattcctttaaagctatctcatacaaaaaaaaaaaaaagagcttgttaacaaactgtatatatagtagtagttttttatacttctaataaattcatttacggtaacttttcaccatttaaatacacttatgtcatttatttttattaaatgcatcatgctttttttattcctttaaaataaagctatctcataaaaaaagtcaaacaatgcacccaaatatctaacaattaatccattattatgaccaatatgttccaatattatgaaaattagtgcacttaattatctttatagataatcctcataaacacagtattgtagtgtgagagagaaaaatagactc

SEQ ID NO: 793 - DNA, 2035 bp, Glycine max
  Soy_ogl_5959 Gm18:6067266..6069300 Cluster 3
taatcttatgtatgtttattattttaaaaaaactactcatgtttttattttttacagacgaaaaataatttataatttgtttatttgcgtaactagagttagtttaatcaatgtaatactaccagacattacatcaataaaacttagttctttatttggttttgtgaaactaggaagtatttgaacttaattatatttaacatctaactaattttcctttttcttagtaggcctattttagaataaaataaaataataccttgactaaattccaaaaccttgattaaagggaaaaaatgtatcgtttcctttagttttaattgttcttcctgtcatatattcgatcaattatttaaacttttctttgtagtttctaatagctagttattgcttttgtgtattgagaattgacctttttcttttgggtctctcccatttattcaacagaaaagaaaattgacctttgatcctttaaaacaatactcagttacttaattttattattcctcactcacgatccagtagacttattgtggtctcattacttctcttgatgtataatttcttaaaagcttgaaatactttttttttaagaaaaaaacttcacatacttgaaaacttattgtatacatctaaaaaaaatattcattttttattcatttgatacgtcaatgttcatcagatcacctaaaaagtgaaatattctctttttatacatttaatacttataaaaaaattgacacttttttttatcattggaaaaaaaatattaattaactttttttcttttagaaaacataaaggagtgaaaatgaagactttaaatttcgatggactaataccaaaagatttattagcatgattgaaaaatatattacgtatccctattttatttatataacaataatgcaatatacatgaaacttattaggttaatagtgctaaattaagatttgttcaatgctaaactaaatgatatgattaaattaattaagcaattttgtcggtagttgagacttgtcccacaagatgtagagatcgtcaaagtatgttttattttttttaataaaattttcttatacccacacttagggaatcaaattcctatcaagaatgttataaaaaattcaactatctactccgggccttgttaattagtaaagtgaaaagtttaagtgtggagttaattcaaattattgtgaaaaataattatttattctttattagcttcctgagaaaattttaaaaaaaaatatgcaattgttttttgaaagaaatcagttatgtaccaatcattcatacagttgttagtttatagagaatattttattttgcttaaatttgtttctctttaatacctttattttaatggaataaaatagatatacatgttcatttatgcaaaatttaactaataagttaaagtttaggagaatatgttttatacatcaaacaaaccaaaatgattaatattattctttaattaaacacacaaaaatggggaaacggtaaattcttgaaaacgatagtataggaaagcaagtaaatatttccttataaagcgacttacctaacaaaagaaaatcatatatacatgcatgtactaagttggttaacaaaacaatgatgatgaatcctaacaaaccactgatgaggactccatatgcatatgccaacacagcatggtttgaatctttctggatttggtttcaaatgaggactccatacatgtaatatgtgagcataccttggtttggacttctgaattattaaattcattcaaaagaaaggcatcatacttttttttaattattaatttcagtgactgagtttgagttgggataagcacaccagcaaagaatatcaactaattaattatggtataagtattttcaggaaaattagtaagctagcaattcatttgaaactaacaaattaacaactttttccaaaaatataatacatgaataatttaatatttgagttggtattcttcagtaatatcttttcttcataaaaataatgtagggatttt

SEQ ID NO: 794 - DNA, 1351 bp, Glycine max
  Soy_ogl_1324 Gm04:39432301..39433651 Cluster 3
atgtgcaaaattacaactcccatggtacatgacaacacatgccataaatcagtagattaagtagctgctaaaaatcaaataaaaaaaactgcagtctacttgaagcgttacaccaagatctataaatcccacataaaaccattaaacagatacaccagaatgtaaattccaccggcaacatattataagatttacaagtaagggtgtgaaaaactaatttggtaaaaaaaattgaattgaattaaactagttttaaattattttatcccgtttagttttatatctaaatagttaaactgatttaaaaattgatttaaaattaaactgattttaaaaatatgattctgagttgaattaatttttaactagttttagattggttttaagagtcaaaccaattttgaatttgtttttgaactattttttcaaataaaaaaatatttaaatgaaaatcagttcaatttaaaaataattccattaactaaattggttttataaaatagtacactcattttttctcaaactagttaagaaaaaaactaatttaatttagattcatttacaattcaatttaatcccaatatttttttacataccctattctgaagtcagttccggtgcatcccatctaggtcacaaaagaattcaccactatataagatatggcacttcatatacttgtcaaacacaacataggttttgcgttgaccattgatagaaagagcatgaaaagttcctcagttttgagtttaactagtttcataacccgaacttcgccaagtccaccactcgctctcccagcacatcagaattttttaagagtatctcattttaatttcttattataccagttctagaaagtaaataggtatacattaacaaatccatacacgttaatgatttcaatagtataacaaacatatattataattaattaattatagtgtaattattagataagaataagatgaatgaatgtaataataaatattagtcaccaatgaaagaaaatatacgcacatatgttcgtatagcttttttttgccaagatatgttcgtgtagctaggaccatgcataataaaacaatatatcaaattcacaatgaattaatggcaaactttattttttaatagatctcaacttttgaacatattaccttgccattcgtccagatacaattaaatagctggcctagctagaagttcacatcaaaatcacgtatggttagtcgtaaaggagcgtggatagatacatttaattggtgatgtcgatgctccttgggacatggtctacgatattgcatgattgaggaaaaagattaggaaatgaaatgagagaagaaaaaccatc

SEQ ID NO: 795 - DNA, 1900 bp, Glycine max
  Soy_ogl_6353 Gm19:2848201..2850100 Cluster 3
ccttttttttttcattattttgatctttcttgattcatataggtagcagcaaaagaaatcaaatgaggtttgtgtcaatatatagtaagaacatatgcattaattgagagaggtttgtgtaacgtaaggatgaaaaagaaaaaaaaaatctagtgaaatgtcaaatcttagggatgttactgtaattttccttagatgctattatacttattttactgcaaaatattatattttttttagagcgagaatattatacttaattactcaaaaaaatatctttttaatttctcaacttatatcctaatatacttagttttcaattctccataattataaacgtctatacatttaatcaaaatgtcaatcattgttttgtttttaatgaatgagtataatttgtcattctactctaattaattttccactccaaattaaaagtttttttaaaggtctttcataccattatttttaagatattagttaaggatctaaaaaaatatttattatataaattataaaataatgtaaaaaatatcaacaacacaatttttcgtccatcaataataaacatatttttattttaagtttcttaatcaatatttttaagatttcggttaacatttttttaatgcataggaataaaaaagacagaaaaagagagactacaatataacctcacataataaatggcaacagcatctcaatatatagactaacagaaagaagtagagctttgtcattaatatggtattgtgaaaaccttgtaattgaattagaatataacctcacataataaatggcaacaacatctcaatatatagactaacagaaagaagtagagctttgtcattaatatggtattgtgaaaaccttgtaattgaattagagtactccttcctactttatttattcaaaagatcttgcttataaaataaatgctaattatatggacacatgtaccttatggactcagtgtctgagaattgcttcttaaaaaataatggtgtccaagttgttgctttggcagacatgcagtagagcatggcatactcaatctctttaactccccaacttgaaggagcatatataagagctttcaagtatatatcacatttaaatatatattatttgttgggggtcacccagaaggcctgtttgacataccctgttaaccgacatagttcagttacaatccttcttttgtttgaatgatcaagttccttgttgtcggtaggaagatcaggttcattggttgtacgtaggtataagttagccacttgatatgcaaacgttgttttatttttccctatacggaaatttgttttatgttcccatttggtattaatttctagtccactgtagtcactactcgaaacaatatgtgcattcctcacaatatagacattcctttcaagactttaaaggatatatatatttgataaaatatttcaattaattttaatttgttttttactaattgttgccactgttaggaggatcattgttgaagagaaatcacccgttattctatttcagatccgatccgatgacggtttcattttcagatctaattatgattcttgttgtggttttcgaattttctaaatggatgcattgatctaacatttcattcttgttttctttttgtttatgtaccatttacattcaatggctaaaataagtgaggaactaccttaaggatatcgcatgcattagaatcagattaaaaataaaaaataaagacatacacttctccagtctttccttctttgttgttcagcgatacaaccatccctgtggccactgctaaaagaacaaccgttgccaccaccgaagaaaaaccactcatttttttatttcaaatcccatgatggtttcattttcaggtatgatgatgact

SEQ ID NO: 796 - DNA, 1503 bp, Glycine max
  Soy_ogl_133 Gm01:40194398..40195900 Cluster 3
cgggttgtttccttcccctatacacatatattgttgaaatatcaagggatttaacttagttggttgaacatgatacatgattttttacaaattttttagtacatgtttttttattcatattaataaaaataaaacttcattgatatcattaatgtaatatttatttaaatatatgatcaaatatatttttcttatatggcactaattatactatttattaaacataatacatgtttaagtttaaaaaattatcaaattttatatttattacatatcatgaatataagatatgtatgcattaaatatacaagaaaaatatatattttaaaaaatttaacattgaatagagttttatttaatgtaataaaaatcacattcaatagtactattaaacttaatacgtttttaaaataataaattacattaaatagaaaatgcttgtttttaaaataaatactacataagtaaaaaaatgtttcattatttagtcttttcaagtttagtttccttgtgtatattagaatatacttggaaggaagtattaataaatacttattattattgtagtattttttttgccttccaataagcatcctttacatttaaaaaaaaaaagtatcattttcactagttacaaccccattggtattattaaggtactctctattcacaaaccatagatgtttaaggttagcacacactcgttaagaaatattaattgataaaattatatactaaaataccactactaaaaagaatgcattctatgttcaaaaaactctcaattttgtaaataagaggagttaaacgataacggttttcaaaaaaccttcgtgaaattctatgttcaacaactgttattttaatttacaaattaaatgttcagaccccactcactcctctctcaccctctcacctccccttttgttgtccccgtgcgagcctcgtggtggaggcccttgccatctcactcacgcgcctccaatttgacaacacgtggttggcaaccctatgcttcagcgatagtgcggggttcaaggtctggcctagttgctgcttgcggtgctgttagggttcacgaaggaccctttctcgcacgtgcgagcttcgacattggaaggactcatcagtttttttgagcatgacagagttttatgcatccatctctttgcttctagaatcagatgggagaatatatgtgtcttctatccttatatgatttagtcttgtccatttgttttgttattgagtcgcattttttattctgcagagtttcccttcattattggtccatgtctgtctcattttgctttacgatttgaaaaaaaaaaaactcatgccaatgaaatatatttttagttgagaaattggtgttaaaacaaataagctaaacacatggaggatttttcagttttgcggaagcatgctactgagagcctacctgcattggtatttagatcttttgagtttcctataactaagactaaatgattgaatataaat

SEQ ID NO: 797 - DNA, 2535 bp, Glycine max
  Soy_ogl_185 Gm01:47339901..47342435 Cluster 3
accatgcatgacgcatgtctgcaatggatatttcacaaaatgaaaaaaaagaactgtaagcaaagacccttattaggcgcacacgcaccttgttgtttcttactgcatctttgtgtaagtaacaacgaaggacaacttgtggttaaatgtatggcgaaaggtgcgcaaggagatgaaatcattttctctcaagcaatgctggtcgaggaaattgagccaacctcggttcagcgcgtagaaaacattgccattcccctcgcatttcctcagcatcatctggaactcgtgccctcccctgtcatacacattcacttcaatcccctctctaacgtcttccctttcctccaggaaatccaagaggatatcttcaaactctggcactcgcaacaagaacaagttggacttgtcgccggtgagttgagctctgtagggcatgctcaactcacattccttcactattccaacgctcatcacgaaatccagctgctgctcctcccttgctaggatttctctttctgatgagggctctgcatctgccataatatctctcttctctgaactttaagaggttttattgtttaggtcatggtaagctctcacagactcacattgtatatatatactacgttgcacacccctcacttgagtcattcgtgactcatgagtaatcagatacaatttcctagggttagaaaatactaattagaagcatgcacatgtttaaaagagaaaaacaattaaaaaagacatgaagatattgatagaggattctgcaggttgaatccatgacaattaatttatacttctgcttttagttaattcatgtatgcattaaaacattcagaatgtataaattagaataaaagtgaatattttcttatttataaacactaaaaatatatttaatctgaatttgaataaaattcatcaaatgaaattgatatatttagtatgttataaatataaaacattgatgtttttcctttattagtatgatttaatatagtaaatatttttttaactgttaaataagataatataaaattgttaataaataatttttaacatatttcctattttttttttattttttttgttggattacaaaacaactagatgattagaagtctctaggaaaggaaacatgagccatatcaactcttaacttagcaataatacactgaggaggaaactcaaacacttacaccatagacaaagccgaaataacttgcttaaacatatgttctgtgtaactagatcacttaaacatatcaatgaagatttgatttctaattaactttaaacattgaaaatgttttattaagagagataagcatattttagtaattttaattaacacttaaaagggaataatatctatctagcttgtctgttaggaggtatctttatttttttttaactgcagtatcatatatagtgaaatttatagcatacttttttatatgataagaatacattgaataattacttaattaaactcattattttttttactgaattataaactcatgtctaaacatatatatgatttttttttaattttcaagtttcataaccataatggtcaaacaataattaaaatatgattaaattataattttgattcttttttaattttttatatgtaattttttaaaaacacggaatatatttacaccatcatcatcttcaaataaaatatttttaacggtgacaccatgactagcgcataatagtacagcccacaatacacctacaactcccatcatatgaaatgaatttaatgtccaattatgaaacaattatttcttatatatttaagtgatttaagtgagttgagccgatctaacttttttaggtatgcatctgcctcgcatagcttgcgcgataacgggctaacttgtgcccgttatgaaagaaggaaaattataaaaaaaaatagtaaaaaagaaacactatcaagcgattatagtggaattcataacttgttactctctttttatttagtcctatatgaattaaataatctaaatctataaaaaaaaaacaaagaatagtggaagatcacgaacaaaacaggcacacggtaaaggttagtttaattattaaaaaaaaccgaattattaatttttaaatataatcattagaaattattaaatatgatttgctctaatacttatctttatacatttacttttccatgatatacataaaagtataatattagtggtttttctgttttttctcagatgcatgtatcttaatatttttggccagcgtctgcatcatatagcttactggccaacttgtggcctgttatgaaaaaaagaaaaatattataaaaaaatgtatgtaaagagaaacattgacaagggattgtagtggaattcacaacttgttagtctctttttatctagtttttttatgaaataaataatctaaacttacaaaaatattaaaaaaaaatacacagaatagtgaaagattacgaacaatacatgcacaggtgaagattagttcaattattaaaaataa

SEQ ID NO: 798 - DNA, 2300 bp, Glycine max
  Soy_ogl_488 Gm02:11087601..11089900 Cluster 3
ctttgttttttttcttctttggccttaatgtacatttaataaattatgtaggtagttaagtgcattaatgtgcatttaagatctaagcgagctacatatttaaaaaaaaagtttaatgtttatgtataattattttaaaaattatttgagataactattttaaaaattaacaaatttgtataattattttcttattaagaaaaacactccggcaaagaacaaagaaattatgtaggtagtaaaatttcagaaaacagttgttaaaaaaattcttaaagtcataattatgtttttgtatgaagacaaattttgatattcctgtaactacttttataatcagaggataatataaagatataaagacaagagagctaatctgagataaataagagaaagatataaaggaaagtgaaataaatgtgttaagataaaataaatgatgtaatgggaatacatcctttacacaaactttatcgtcgagatccaaatcttccaataacttttattataaaagagtaatataactctattttataactattgtataaatactacggtcaaagacgaaaatctatatttataaaccaattgtattagtttaatatctaacttccctttttaacttactcgcgctttatattttggtaatcgtaggttattatacttttttttcctggggcttacactgtgatttctttacctttttttatactgcaaattttttaacttatatgcgcaaaccgtgaacttctgatttcagatcaattagggatttttttattattttgtttttagcctttggtttgttttctatttgattaattgatttggatgcaccatacgtaaaagtatggactgcttttttgtctcgccaaagttgtggaaagttcctttcacaggcaaaccctaggctacacttgctaggataattcagcttacaaagtagaggtagaagcacccattcaccataaaatttaattaataaatggacgtaacgataaagtcactgaggtatggccaaattacatttccttcacgtatctttaagaggatgaatttcatgcgaacagctaaaccagaaactttttttctcgtcgatattttctccccgttaaatcagaaacttatatgatagattgtgacattttgctgcttatctcttgtctttatcataagaaatcaaattacatgaaagccctctgtcctcacatttttatctatttcgaatttaatttacttcaatttttattttatattagtttaagtggttacgattaatatattaacaattggttttgatatgatttgtttatttagattttactttcggtagtttttactcaagatatttatccttatgctatactaaagaaagtgtctatattagttttatttattaattaaagtattattaattttaatttaaataatagagaatatagtgacaatgccgaaaaaaaatatatgggcaaaagtataatttataaaagtaaagtcaaacatccttcaaccttcagcaataaaatgttaactatttaattatggcaattaacttttctatttttttcttcaaaaaaaactttttgtattttaattggagtttacttttttatgtattattgattattgataaaaaaataattttaaaattttaatatcatctcataatgaaaaataattaatgaaccccacaagttataaagttataagtgattcatgtatcattattctcttcgtggatcatttaatgaatttaagtactacattaaaggattaaaggatgtataggatagtaaattcattaaatggtatcatatatagcattgttagatgcaagtcagtgcaatttgttttgtaaaaatagtgcttcagtgtaaaaattctttatgaatatttttaatatgaaaattatgttataataaaatttgaattttttaaaacataaaatatatttttaatatattataaatattttatattataataaaatattattttttattattgccaaattcttttgcaattcattaacacttttttatgttgattaatatttactgaataagttcctcgtgatgattttgtcttccaaacccatcttggaattagttgtgtttaccaaattttgtagatcattcaacatatttttctctaattgaaataattaggatatgtttggatatgcgtttgggtatctcaagcatactgttggagcttcaaactgattgtatgatatttgagttcttcgaaaattatttctgttattaattcttgacaaccatttactttataattcaaaa

SEQ ID NO: 799 - DNA, 1707 bp, Glycine max
  Soy_ogl_500 Gm02:11709516..11711222 Cluster 3
aacacaaaaattactcaaaattattctaattcaaaattaattttaaatctaaaattaattatatattttttttctaacataaaatcaaacatataaaaatatattcaaaatttcctcaactacaaaccaaaattacactaaaagatattccaataaaccagtaaaaaaaataaaatttggtttgagtgaggacgcatgaaaatgatgcagcacagcgtagataagcgtggcactgttgagtttggcacctcagaatcacattgtctgaaaaggatttggaagtgaaaggcaaccaatgcaaaatcgacaaatagcacctgcaacctatcacacccagtgcctttatttgtgtctgaccttgttactcacctaaattaatttaacgtgccctacttgtagccctccttctgacccttatttactgtcataattattttcagaagatactcttcactcttctccttttagaatcccattgtagataaatggagttgtcaacatgtaggtgtgtaggaatattttttttttcaataattctactgatacaaaattgttcttgttgaaaaatttaataaactttgattagagactttgaatgtaccaaagaaacataaataaatatatttttaacataatttatttcatacacaataatcaattataatttaaattataaatcacttgattaaaaaacataaatcattattatttatgttaattattattaatggtttgtagatatatataaaaaaatatttaattattatatattaaaaacataaacttgctatttatttctgagttttgttgatgagggttttgaaaataattgttgagaaattaacaaatgaaaaatattaatagtcgtcatcccatgtaattgtttagctagttgcctagttcattagcattctcattttttagttatccaaatctttaacaagatatgtagtatttaattaaaaaaatccaaatatatataaaacaatttattactcattgtgatatttcaaaagcatggagagttaagtcctataggttttatttgcatattttttatctacaaacttgtccatacaattttttataatagaaaaaaataaaaagataaaataaattaaacttctttcctttttaaaaactttaatggttaaattagaacaatttcatgcagattaatttatacgctcagtgtggttttccataagttataaataatgtacacttcaactacattttaactcttaaagaatttttctcatgtaacttttcctaaaaattttacagagaaatttatttaaacttgttatagttaagtttatgacgaaattttaagcaaaatccaggtgttactcttaatcgtgtttctttttattctaataagtttttgtaaattagttttttgcaaacataattctgctattatagaacaaacaatgaaattcatatatgatgacctaatttagcaaatataatattggttgcattttgtccatttacaaaaaatattcatttggataacaatgattatttgggtaaataaagttcaaacaaaagtatgatagttttaattgttttaatgttaataaattttttataacttaaagatttactttttacttattttaaaaaatcactaattaaataatatgaaatcaatatttatataattactatcataaaatgttttgaacacacacatattga

SEQ ID NO: 800 - DNA, 2101 bp, Glycine max
  Soy_ogl_545 Gm02:14238800..14240900 Cluster 3
accatgtactctatcttttaacctaatcatatatttaatagtgataacagtgtacatataaggccaaggcaacaaaatccaaagtttaatatatttttacttaaacactggtaataaaaatgatcgacaaaaaataaataaagcaattggaaagaaaacagtataaaaataggttaaaagtggtatataattcatactaatagtgtctgcacagatcttgttatccagctagagaaatgtaaatggagagatgatttatatggtttatccctttaattgtttgtttttcctgagtaatttcaaataggacttcagtcattttgtattttctaagaaataaattggtatatatatatgcagtttttttctttttttataagcacatatatgtttgcgcagttaaatttgtgcatataaaggatatgcaaggatatatattccatccaattgagttttagaaattataatagcatatattatgttgctaatttatcaaataaagagccaagtgagtttacctctgtttctttgtatgttttaacatactgtacaccttgtacaggtaacaaacatatgtaaatctttgctattattaatcaaatatatcattttgcctttaaaaaaagcgagtttacctcccatgcatgcacaaagtttggaaaatccgtgagaggtggtgggcgaagccaaaaatttccctgattaaactgaggcatcgttgcaggtataccttgtggaccaatcccagtcattaggaacggaagataccttggagattgttggtaactgctgctactactactactatcatagggaagcattgggaagcttgcagatgatgaacatgattgaaactgagtgaatgggtttcccatagtatttggaaacacaaaatttccaaatgaagtgccaatttgaggaggatgttgtggatcaaaagttgctaacctaactgttgtgctaacactagcattggtattaacactagcacaagcaatgccaccaacactagcattagcacctgcactagcagcaacaagagcactaacaccaacacttggactagcaccagcactagcataaccattaggatgcaatgggaagcttggtgattgaaatggagtgaatgcttcagatacaactaccccagctgcaggtggaattgaaatttccacttcctctaatgaatttgaggtcaaaagagtagttgaatttgtgtcattggttagtccctccactgctttaaggacttccaaggaaatatcatctaaaggaatttgctcattgaaagagttctctcccagttgcaaaatatcattgtcattacatagtcgtgccattaaatcatcatagacactcattggcacggagtaattgttgaaaaaaacatacatttcatccattgttgcttgtgagataagcggggataggttactttctaaatcctgacatagaaagcatgtgaaaaataaattaacaacgagtccaaaagagattgaaaatgttgtaatagatttttttacattttagttttaaaactccggtgatctactatgatactccttttgtaatcatatacacagtaaaaataaatcaattttaactccttcgaaatgaaagagaaagaatatctcaaattaattattttatgaatactatatgttttttattccttaaaatattttagaatattaattatagtccttataaaaaattagcatgcttttagtttttaaatttagtaaaagtgatgtgattttagtctttcatcactaaagaaaaaaacacatgtttctgaaacatattaaatttttatgaggactaattttttttaaagcattttataaggaataagtgtatgtttgatttttagtctaaattattttcttatgaattccgagacaaatgcaacaaaccaacacaaaatgaacgcaaagtgaaatgtctataattaaattttgagagatcaaaattaaaacatattatatctttgttttactaaataaactttaaattttagaaaaagaaaatacgtacaggtctgacattttgaacacattccgtggattgctcttcgatggtcatgcgactggctgagaat

SEQ ID NO: 801 - DNA, 1400 bp, Glycine max
  Soy_ogl_547 Gm02:14242101..14243500 Cluster 3
tactacatttaaccacttccttagaagttattttttgaaactgaatactacagcaaacaagagaaaaactgaagataaatatttgaaaaagatgtcaaagaagacatgtgagtgagacaacaaacgagggtgcgaatgaagaacgggggactcctgggttgttaattttgtttgattaataataattggccataagaagaaaagtttttttctagagataaaatgaataaaatatatgtagaagaataaaaattacaacaaacgaaaaatcacataaatataaaattaatagaaattcagaataaaaaataaaataaaatttgataataacatatttaacctgttggattgaatttgacagcaaaactcgtgaattcaacatgttagatgatattcatctttttttttttttaagtgaaagagatcaatatggcagtttgtgattctactttagcagtaaaagtaaaagcctgacttattttttaaacgttcttcaaaattgaaccgcacaaacctcttatatatactatggggcgaaacttttaagaccatgccaaatatttgaaagacattattagtatttgcaattattagttctatatattttaatggctggattttaatgacttgttatttttttaatcatctttaattatatattttctctaaggttggttcaagaatctcaaggataaatatattatggagatgataatgctataattatcgcatggacaatgatttaattaattaatttatcgtcagttatgatgagtcattactttttaatggttaacgtctctttgataactattgttgaactaaaactatattatataaaaatgaatttgacaattgagtaatgacatgtacatttttaaaattaatgcatttttatatgattgacaaatatgcaattgaaaaaaatataaaatttggtgagaaaatctataaaattgaatatactttaacttgagcaataatcactcattattttaagaaacgataaatattgctcatttattttataaccatagggcagctctaaatgacaatcgagcaaatatgattttaatggcaatggaggctattctcaaaaaaacaatggcaatggagggaattaggattgaggctgactggagatggagaagtaagaggatttatatattatatatataattatttgataactgaaaagtaattgtaagatataaaaagagtgtaatagtcaatatcatttaatgtaaccaaaatacatagttcaacatctttactgcaaaagtgaatgattttaggaagaaaattgaaagagagagaaaaaatgaatgagtgatgcaacaatcataaagagtcaataaattgagactaacttttctctaatttttatttcagatttttct

SEQ ID NO: 802 - DNA, 1200 bp, Glycine max
  Soy_ogl_588 Gm02:40362101..40363300 Cluster 3
tgtgggttgaaaagtgatatttttatgggaatgtaaaattttattgtctaatacacatgtaatttttttactcaaattatttttgaattttaaaaactattaccagaaatattaagatgaaactaaacatattttttaaaaaatccgagaatgaaattcccatcttatattcctgataatagtatttttgtaagaacattaaaataataactttatccaatttatgaaacaaaggctccctttcaatcttaaatttgtcattgttgtacttatccaatttatgataatgatcatgatcctttatcatggataagtttgtttaaactttaaaaaaataattttaacatgaatgttttttatataagaatttttttcaagaaacagataatatttacttcttaaaataagtaaagaaataagtttttttttaacataaccaatttagacaaactaaaaaaacagaaaaatacttattttattaaaaaaattatttcaataaatattattaaacaatttgtttctttactttgattttgattgttgtcggatgtcattgctggtacctagaagttgcatttagttgacaagcacataattcattatacaaatttgtatctactattatccaaaatgtttcttacaactaccaaccatagaaaagttatcttgatcgatccaaaattacataacaagatgtccaaagtactatttataaatctcataaccaccaactaaaaaaccttcaagcaatgaccaatgtattctaattcgtcatataatctagaaagggaaatgttaaatgttacaaaatggatttttcaaattgtgggaaaatatgttttcttccgctactccattttttgtcttaactattttatttttctttgataaattataggtgctacattatttctaataatatttgtaaaaaatcttccacactaaatatcattgttcaattatatagtatatcatgatttaaatcttttgtccaaatcaaaacaacaacaaaaatcccaagttgtacttttttaatgggataaattcctatttctgagagaagtttcaattaacaaattctttttaatttaaaatttacatttcttttaataaaataaatgtgttacactttaatcaaatttaagataaacaatttttctctatgtaattctttgcttattagcagttaattatgagtcc

SEQ ID NO: 803 - DNA, 2000 bp, Glycine max
  Soy_ogl_1306 Gm04:38287701..38289700 Cluster 3
ttatatatttaatcaactaagtgtaaacaaaatcaaatctgcaacagaactaatcttaggacattaaaccagaagttatctgaattttgataacttctctaaattgtagggactatgattggtcttgctcttgattcttcaagctgactgaaagtttctcgaaagtagttgaccaaagttttccaattttgcaagtaattatactctattgactgggacaaacagaagctttttgtttccatttcaccacagttttagaactctgcaacagtcgcaaatgggtagaataagatctgatagattccatttaattgtggatatatatgatttatagttttatattgtgcacacaagacttgtaagtacataatatccaaatagaaactgtaaatcccttaattatagtctttcaaaacaatccattgatttacttaacgaaaagtagtcctaacatcaatttaggcgccctctacagcctgctctctacagccggagaattctggcaacactgacagttgcttccacttattctacacccttgtttaattagttacgtatattaattaactactgctagcaatttattaagaattgattatgaattcaagagaataaaaatattatttttatggttgatatctttttcaatattaaaagaaaattaaagagtttatttagatactaatttatacttttaattatatatttaggggcattgctggaaaaaaaataacttaaaaagggttaaaaggatcattattttgaaacaaaaataaaaagttgaaaagagtattatattgaaatggagggagtacaaaaactaatatgaaaactaaatagtaaataactacagttaatataactacttaatagcgtcatctacgcatgtattgaaaattgaaaccagtgcattttactacttaatagctttttttaatataatacttggatttaaattttatccattttaaaattacgaattacttacaatatataaatatgtatctatctaatcaattaattttctcaaaaaaaatctaaccaattaattgttcttctctaactatactggaacttataaggatgctttggatcattatattgcccatgtttacggatgaatgaaaataaaataattttttttaagaaaaaataaagtgcaagaatggtttacgtaggtagtttttatttcaaccaaggtaataataaataaaataaataatgttttacctttaatgattttaattatagtatttgattaattattttaaaacttattattataataatttaataccttttttatttgtgagaatcaaaaacagaatgtttttataataatacgcattagtatcaactcaaccaattgatctagaccctcttcgtatatttaataaaaatttacaatttagtatatttattgaatagttagttgaaatttttatttaagttagttagatatcaggagatatgttgtagagaattatgatattaaggagttagacaaaaatggaaagaaagaaaaaattatactcccacaattcctttctatttttcctttaaggttattttgttgaaaccaagtaattaattaattgtcttaattaactctaataaaataattatgaaattttttattttactccttttctttttcatcccataataaatgcatgtgactcttatttataaattaagagataagtaaaaatataattgataaatgagtaattaatgtgatattaactttataaatgacaactaaataaaaataaacttatttttgaaaatttgacatttgaaaaggaacagatggagtacattttatacttgaggatctggagtaagatgcaaccatcttatggttttctttcactttcactccttatcatctcacctctaccaaaatcacccttaatatattattttgtaaaaaaaatggttaattcaatatcacaattttggaaaaggtaaaataatttatttgtgttattacagta

SEQ ID NO: 804 - DNA, 3810 bp, Glycine max
  Soy_ogl_1310 Gm04:38612895..38616704 Cluster 3
atacaattagaaatttattccttcacacttctcatcgattatgtttatggcacataagtaaaaatgttgttgataatttaggccatttgaataaaaacaatgagttcatgtcaatgtttaacaagtgtttgcaagattgtgaatcaaagaatgaatttcaaatgatatgggatgcaatgatcaacaagtttgaatgccaagatcatagttggttgagaaatttgcataagttggaccataagtggtgtacatggttgaataaaggcacatttttttgctatatttttgtctagtcaaaagagtgagaatacacataatgtttagggggcttggaaaatgcaatcactagtcttacaaaaattgcacttgcctttgacaacttattgaaaaggtggcgtgcatgtgaaagtcagagccaatttgattcagaaagggaaattcaaaatatcatagttaaggatagtgtcttattgagacatgttgcaaggacatacacaatttcgatattcaaattgtttctaagtgagtatgccaatgttcttgcatcaacatggacaacattatcacaatgtgacaattcatacttatgaagtgaaatatcaaggaattatcacaaacaaaagtgttcagaaggtacataatatattttgatgcttcaactttgagtgtctggtgtaattgcaaaatgtttgaatcaataggcatccttttttcccatgctttaatggtgcttgttcttaataaagtaacaccatttctaatcaatgcatcttgcctcattgaacaaaagaagagaaggataaaggaaatgcatcatttagcgctcaagttccttttttattttcattttcccttacattagcaatataactattaggttccttttttttttttaccatgttacaagtttttcaaaatattgcttccaataactctacataggtaattgaattgtcttttagcacgtgtgtgtctatgtgtgatttacattacaatttatttatataatttttttgttgcaaatatattcaaacgtgtttggacaatttcatccaaatatggagcaaaaggattaaaatactttaaaggtataaatctttttgccgaattttgttggcatatttcattagtcttcatacttattttttttacttgttatctattaggttgagaagataggtggtgggagattgaagacaatagattacttgctttagcacaattgttcttttaaaagatgtgttttagattaattgaatacacttgtaattttttttgtttcttttggcatctattaaaactgcctaatattttattttacttcttggttgaatgctttgggaacaatgcttagaaaattaggaattttatatcaaattttgcttagtttgaccaaaactttgtataattaattgcttataagtatttttatttttggccattaaacttgaatgagctattagttttaaaatgagttaccacttttggtcattatttatagaaggagatagacacacatgattccgcgagtgctctgggaaataaattactctacttcaatgttagcccatttggtatcctcctaatatacaaaccaaattcatggttacatagttacattcattcgtataatcactagatgcagttcattttttaactccagaggatcaatatccatttttacctgtaaaattttcttggcttgtgtttgcatgaggttttacgcaagcataaaattggattttatgctatgtaaacttagtggtaatcacaagattaaggtgatatttaaagacttgaatctctaacattttacaaatatctcttaacgttgagtgaatatatgtgaagtcattgagtgactaaagagtgagaacacatgttagcaaatatcaagtttaattgctatatatcaagtacaacaaacaataaattgctttgtctgatgaagattaattttgtttgtgtttagcgagataagtcagataataagataactttcaacctgattagagatggattggttgatattataatttataaattccaaaagaagaatcctcaaattctatgagattccaccatttgcttttggtttaacgataccagcctccattgagcttggcataattacataagaccattcctattttttataggcaaataagattatataaataaaccaaccttatcacaagttgtaacaagttggttagcagtacaattttgtgatacattgtgaagctaatctacagttaataaagatcaaaatgttaacctgaccccaacattattctaccctatcaacaatatagatatatatagcagtataacatgaacttataatccaagactaataaagaattcacattgcattttgatggcactacaaataaaatgccattaccatttccccaccatgccattacacatattgtctatcaaatcctcaaaagcaagaattcaatctcaaaagtaagatcattcctattagatgggaaaaccattcttgagtctcaattttgtccctttcatcttccctaaaaggcttgtcattagatattaaggcttctgccacaccccatctactaatcatagtacgacaatccccaacattaagcacaacaaggttaccattcctaatccgcacaacaagaaccgccattaagattggaaggggaaatagagtaattgatgtgtggtctattatcctgccaatgtcttcttccaaggtggttcttcataaccacaacacgaacacacatacaattaccaaccatagccaataactttcattccaaacagaagaatagtttttttttttaaggcaaatgaattttattacaattaagagattttgcataagtacttaaaaagagatcaacgttaattacataagaaactatttcaatccttttaacctcaaggctactacaaaattactggcccctgcgccagccaagttctaaggagcttaacccctactaatttattgtttgtttgtcactcccatgagcagaatcatgaagaaacaacaaactagatgggaaattccaatgaagaataaaaaaaagggacaaaagtaatcaaataccaaagaaattcatgaaatcgcgagagcagagaaccaatgaagaggttgaagtgtgaatgtgatacgcgttattttgttacaacaatctcgtttccatgctaagatttgcatttgcagttataatattaaaattatcttgtatgatttgaatagaccgtgattttagtttgaatttattatattttattattattatttgtagatatacttgttaaaagtaaatgatgttaaccccttcgcggtgtatttgtcaagtcacatgtcttcctctgagtggtcgggactacaacctaagtggtgatcttggaccatagaatagtttctcgtgttttacatgatgaatctttattattcaagcatgatttacatgtaatgattaattaggacccttgcttatcatacattggtataaaatagcttctcctaaacacttagcaggactttcaatcaatttgaatgaacattaagctttgcttattgagagtgagtgtgctcccatcgtacaatttaataacaaattggttcatgaactttataactcaatgccaaattgatcataaaaaaataaaattaatgtcaaattcatcatttgtttaaggaatcaaattgatccttaaacattataggtcaatgacaaaatggtcccatgaaacataattgcataacgtaattcttacacttttacatatcatggattaaatcagaattttcgttct

SEQ ID NO: 805 - DNA, 1407 bp, Glycine max
  Soy_ogl_1342 Gm04:42174449..42175855 Cluster 3
gacaaatattttagctggagagtatattgtttaattaaaattagaatttatttcactaataatgtgataaaagatttgtataaatattagtatgctattgaagtgaaattttaattttaatttaacaacgtaaaacaatatttaaagaattgcatctaaattttataactaattacatttctttggttgcgccgtaaatttttttctaaaattaaacatttttcacatgtaaattttttaagtaataaattcttcatttaattatttatgtctttgagattatagcaggcaaattacttaagaaatttaatctttttttacagatgaaatttaatcctctctatatataatttaatatagttttattgaatgagcttataaaaaaacattatttaatttattgagaatatttttaacagtttttcttcaatgctaatctatcctatccatcttcatcgatcgaaaaagaggcaaaagtcttttaatctgtgcagcaatcaaagttggaaagctgaccccatctaaggtggtctcgcccactcgattcaaaaaagtgcagctgaaagtatgacctaattctacgtaacattaactttagttgcttgacaatgcactgtggatagataatagattgatggatgtttgtctactttgtttgtaaaaacaggcatctacgattgtggatacatcaaaggttgtttcaatgaatgggatgaggactcgtgatattttctaggatcatctctagatagatagacataagtatcgagaaaaaaaaaaaaatagataggcataacttagcggaaagcatacaatgctgtcacttccacaagcactaacgtacgaattatctatagattctgaaagtagaagtgttcacattgcaaaattgattaaaactttttcatcatcgatcaaatcattaataggtaatcgattaaatcattaattaaaaaatcactttatttattcaatttgaatcagcttcgagtttttttttaaaattaaaccaaaatatattattgtacaataaattttctatttaattatatatgcatataagtaaaactaaataattaatgaaaaatgacgataaaatacttaaatcatttaagttgtttagatactaaaaaatcaaacatcaccatatattatttaaaataagtaaactcaagttcttataatcattattttccatatatttagtatagaaatgaggtaatctataaggtaactagctagttctttcattaacaaagggctaaaattagcgaatataaagatgaaaatctgctatttgaaaaatacgggtgtttttttttactgaaaaaaatgcgaatatgttaatatagtgttttaagtaacattagtaaaataaaaaaaataaatcattcaagtcaaacaatt

SEQ ID NO: 806 - DNA, 1400 bp, Glycine max
  Soy_ogl_1593 Gm05:4879101..4880500 Cluster 3
cccattatctaaatccactaggatcactgaccaatccaaaaccttgaattgagttagtgggagcaatttattaaaagaaataaaattaataataattattatcatcatgatacctatgaaaataaaagtatgagatggaataaaatatcaaattgaataaagactaaaaatatctaataatttgaaaagacaacaaaatgtaagaatgaaattagctactaaaggataaaatttgaaaacaattgaaagtttggaggcgatgagttcaaactatataaataaaagggggcaaaataataacaatattatatgtatatttacatttttttttcaaagttatgggagcatttgcatcctccaagaccaagtaggtccattcccgagggtctgcttagtgatgaaagttagagtggatgcatgaaaaattaggttaaaaaagttcaatattttctgtaatcaaaagatatatacaatactatatattcgggaaagtcaatttttttaacaggtgacctattgattatttttttttatcataatacatattaatttgttgtgtagttaaaaaagcattttttttaataaaataagtagatttatgtttttttatgtgtgccctaaactacttttatttatcaaggtagtgtagctcaattgattataaacttcgtagtatgtgtcttctattcttatgaataaataaaattatttttatttaaaataagtagttctatgtttttttaagaaggcatatccgcttcttaaaaattacttatttaattttttttaagtttaaaaaattcacccaaaaatcactaaaaaccctgtcaaaaattacattgaaataattgtaaatatatcccctttgtacacggcttagcagccattatcattgaaaattaagtttcttccacattgcaacaattggtgttaattgctacatacatggaaaataatgacattagttgccaaaatgcccaccatattctcaggatacctcttctatatcttgacagtttcatcttcatttattttaaaaaaattaaacaggatatttccataactggtaattatgactaattcctttaaagatagagataattggagtgaattttttctcttccaataaagttttcttcatatccagaatccagaaccaggtaaaggaaaatgtaacacttgaactggttgaagtgatggagaaaatgtattgtcttttcttgtataatggatacatatatgattattattgctattaatttttggtacatagattataggatggaggatggagggcatgcatgaggcaacagcagcatatgatccccttaaactatagtccattatacagctgcatttcactcgttattctaacataaattccgtctcttctctccact

SEQ ID NO: 807 - DNA, 1547 bp, Glycine max
  Soy_ogl_1600 Gm05:5217201..5218747 Cluster 3
ctaattcgacgtgctagggttttaagaattgtcaattttgatttttttttaaacgtttgatgatttacaaagttggttgagggcttttatagattgttgaattttgaataaaactaatccaagaacaatgattttccgtttaagaaatttaaggtatttgcaaaagcagctagattttggggcgtgcttagtgcgaagctggacgtaaatgcaaaaggagcctattaagaattgtcaatttcgtttttttttttaaattaaatgtttgatgattttaaaaagttataatattttacatcaattatattaattattaatgtaaaagtacgaatttttgtcaattaaattaatggtgaaaaaaatacaattattttattttaaacaggataatattaaactttttaataattgagaaatcaaattaaatcttaaaatagttaaggaatccattgtataagtatgtctcgttataaaacacctaaaattcaaacatggacacgtggacagagaaaagagaaaaataacatttatcgtaagatttttatatggataaaatttaagtacaatattataagaacttttatattactttttaatcaaagctttacttcgtaacctacataataaaagattgacagtaagtgtgcatcaattattaaagtgaacttttaatttcaattggattattatattatattaaagttttgtcttttaattttccctaaaaaaaaagttttgtcttttaattcagcaattttttttctttcctattttgctattatatcttcatgaaaaacattcttaatatacatccttactcttcaccttatctttagttaattttaatttattaatatacacattcttatttttaatacgagtgtgttagcaaattaaatgacagtatttactaatgtacacattcttaatttttaacatactctttaatcatagtttgctaacatacttatcttaaaaaatgtatgtacgttagcaaaatatacatataaattttttttattactagtattttattagaaactaaaacaattacatttttaaaaattattatattttttgttaatgtataatatccttaaaagacacttaaaagaggaatagacagagtttttatatccaaattaatttattttcagcccaacaatttttcatttaaataaatgtaattaaagagataaatctttaagaattgcttagctagagattttcatgtggaggagagaggagttattcactcatgttatgaaaacaagagggaatgcattctccgccgttctacatcttttttaaaataaaagtaaaataagagagagaatgtcgaggttaaatagaaaatgcatggaaaggagtgtacaattaactttctaacagttaaaattaaaatgcatatattgtgggtaattatttttctcttaatcgtatgcagacattgttgaatatacgagcaattattgaggctaaaattagcaaaaaaaataatgtataaatcaaacgggataatcagattgtttgtgtaatttaaggtc

SEQ ID NO: 808 - DNA, 1462 bp, Glycine max
  Soy_ogl_1616 Gm05:27064301..27065762 Cluster 3
gttggcccagtcaacaccctcaccctggcctgggctacaaactctgtgtgctaagcttccccagcagtactgactcatggaatgtctctcccacgtgcttttgtcagggtttggtgttagaggactcttcttgtattctattactttcaattttttttaatagtgtataataacctaaattgtgaaccatacaagattaaaatatagaatgtattggttgagcttgagcgtttgctttgcggaactctccatcctactcacacccacgtcattgccccgtggaaatcaagagaaacaaatggggaaaacaaatgccttcaactacttatgataaaaatatatagcaagtagttttctcttcttttgtctacctcacacatgttctccggagaaagtaatatttgcaagcccaactatgtgtcgcatgatgagaataattctttaagtggagattcttttcttgtatgagacttgaatttaatcttatttatgaagaactaagtatatgccgtttaaaataactatccattgataagatattagtaactactttttattttgggtacataaaatagtagtaactactttgtgaattatataagtactagttgatttaagtaacgacaaatttataaataaaggtagtgaaaaatatatacgtaaataattaatttaaatgaacaagttgtataaaaaaaatgagaaaagggtaaattaaaatgataattgaagagtatagtaattaaattttgaaacgaaaaattaaacgtaattaaaatcgagatttgagtgaaaacaagatattgatgtaaaaataaattttgaaatagttaaaaattgaagaatgtagaaataagtgctaaataatgatgaaattatatataacaagatagagagtgtaataaaaaaaaaaaagatttgacatccctaaaacgagtaaggataaaataaataatccctgttattgatgaaaataattaaggattgatattttatctctgatttttatcatttttgattgaaattgcttactttaatttctaaagtgaattgttcactacaaaggagccacaccctaacaaaatgtcttcgtgattagataaaatacacaaatttatacaaaggagagttgataaattaattcgaaatcagattaaacgtttctctgttttttttttttatatattttttctggttctaggttaaatagtattaaattattaaaattccaagctagctgtagaaatccttagcataataataatacaacaaaacatatgaaagattagtcatccatcgaaactataatttttgctacaattcaacttcttataacaaaatcatcatttactcttaaatttaattaaattagtttatacatgattttgatctctttaattcaatttttttaaattcagtttttataaaattttaagtactgaaattaagtttctcatcctac

SEQ ID NO: 809 - DNA, 1541 bp, Glycine max
  Soy_ogl_1620 Gm05:27259901..271141 Cluster 3
ttttcacctttccttctttctcttttatatattgcgtaacactgatatactctgtttgattttgttttggtaaaagaaactttagtgcgtgatttttagaaaatttaaagcagaaaaatgaaactagttggaattcttttaatcaagatctaaattatttttgtttctttaattatgtaagtatcagagcctgtttaatcaagtagaaaggcatgacctacacatggtatttcttttttactgttttgtgtttgttttaattaatcaatcaagatggttgggtttcttttatttacaagttacaacttctatttattcttctttctcttttcatatatttaaacatgatttacaagtataaaatgctaatgaacctcttcatttgttcagcatatagtatggtaaaaaatttagcattgaaatcatctactaatggatctgatcaccaacaaaaaattgtttttatttccttcaaaaaaaattgtttttattgtctgagttgtatatatatttttatttccttttatatattgatgttaatgttatgcggcatttacttttcaagcgaaatattattttacttgaattcttacttatgccttttttcttcacatggacatgaatacactgcagaaaaatgccatgacggggtgcagccagcggctcaatattaaggacaaaataaataataactaaacatatactgattgaagcgcagtttgaattttaaaaatctatcaatatgttaattaaaattgtccatgttttgaattttatgaatctattaatttgttaactagaactgctcatttttttaatttaaaaaatctgttcatgttttgaattttatgaatctactaatttgttaagtataactgcttattttttttaattttaaaaatctatgaatttgttaactaaaactttaaagttcttgaattttaaaaatttaattatttgttaattaaaaatttccatttatttgaaacttacaaatctacataatttttttacaactaaaactgcttcgtttttatttaaaaaacataacaatttgttaactaaaacttaccagttttagaattttaaaaaactgtcagtttttttactaaagctacttttttttatataattttaacaatctaccaatttgttaaattaaattttccatttacttaaattttaaaaatctaccaatatatttattaatgaaaactgctgattttttaaaatttaaaacctaccaagtttgcaaaaaaagaaaccctaccaatttgttaattaagctccctaaggtttattattttactttttttgctatccttttgtttttattgtacctatctagattatatactatctcctaatatatatattttttcaaaaaaaaaaatttgttatcgcatggctatcacaagcacaaccacacatatatactaattacaatcaaatttagtgcaatacacatgtaaatacatagaaatttttcaaatatattttgtattatataaaattttattgaatttataaaactaaaatta

SEQ ID NO: 810 - DNA, 1400 bp, Glycine max
  Soy_ogl_1645 Gm05:31795701..31797100 Cluster 3
taaagtgtgtactacgttaaaaaaggagtacaatttaacttttcaaacgaaaaaacatataaataaattatattaactcttaacttgaattaaaatatttcatcaatttaacttaactaatttaaataaattataaataatttttactttcttattttaaaattttcaaattagtgtaattaacgtaattaaacattaatattatatcaaaccaatcaaagatagaaaactcctcaaaagcaaatgccagtgtaaaagtttcagttatggcaaccagaaatattggacatttgaactagtcaaccaagacatacgtgcgtgacaaaattgataccgacagtgataattaaatccccaccacaaaaaaaacaacaaaaaacttttataatttatatattgccgtcaatttaattttatataccatgacgtggcaaaatgaattattatacatttgactaatttgactgtatttactattttattcgctatttacagtgtagataatgtagatagtcataatgttacatacaaaactttaaatgagaactttttttattatccgaaataataattataaatatagattattagattctatttaaattatcaagattaaaaataaaattatatatatcattttaaacattatatatggttaatggttgtactggtatggtatataaatttatatataattttctttgcatatctatcacattgtatcattagactttccttgaacaaaatgtcctcgaaaactttcaaaacctcccggtgcgtatttgtatttttaaaaaataaaatatatcatatgacttgaacaccaggcctttcttttttgtctatttcacatttgtgttaattaaaaaaactatagccatgtacattaaatagaattaatttgtcaaaatatcaaaaaaaaaattcaaaccctaattaaggtagataaggatctctaactactactttaatccctcaagtttcttgccgctaattttgggggcgagggtactgaaattaattaaagtggaatatataaaatctttttaatctatataaacactatttatttttgtgcccactatggttaatctgaaattaatctctcaagatcgatgtagaattcaatacaatgatttttgaattccttaaaattttaagccctagtatatatcaaaaaatatttttggtcataaaaaaacattttaaagtgtagtattgctacattttttggttgattaaagaattgcaatatataattgtaacaatggatagtaaggaaaagaaatgaagtaatggctatctcagaacaagaacagccacgcacaatacaatttttttgggtagtcctttatttattgcaaaagcgttagatggttatattatatctattatttgca

SEQ ID NO: 811 - DNA, 2300 bp, Glycine max
  Soy_ogl_1647 Gm05:31822201..31824500 Cluster 3
taaaaattatcaaatgagaatactttttaaattaatttttatttaaggataagtcataaaagtagttatgactttataaataaaaatcttaaatcttttatacaaattttagttccaaaaaggtcacatcttttaaaattgatttatgactttgtttagaaagtcataattaattacttttatgatttatgataattaattcaaaaaataattcaatttgataattttaaaaaaaatacccccaaattttaaaagtgacaattacatcattcaatagtgtattatttatattatggatttcattatgatatacatacattcttttctctctcactaaaacacgcaatctatcgttagattaccctactattgtataaatttaatattaagttattaacacaagtatagagctgcatattaaaggtcgacaaccaagagatccagctttaattgttgtaaatcttcattatgtctctcttttgattcatatagataaaataataattaaagatcgaaaactatctgcctttgttaaaattttaactgaacacaacaaggatataattttgattttccttttaaaagatctccctcttctaagataaaatcctaaaggtcttttattaattattttctccatataaagctctcccgtaccgtacgtgcacgcgttatgtagattctacagcagtcacactattcattgagaaatgtgggatcggcgttgcattacctccaaataaattgccaactttattattcaaaatttcaaatggatattaagttttttttaatgtggaaatggatagcaaattaggaccacacaggtcacttcaattcagaagcaaatagctcttcaatgtatatattatttgcatatttaatccattacgttattttcatataatatctcttgtaatcaatataatatacatgtcttttaatacttatattttctttttctttttctttttctccaaacaatttcttgtgcaaaaaagtagcatacagtgaacatttttcttatttttttcaagtctatacttctaattattatagatattgaactatcaactactccccataatttcacacactacgcaatctttttcttgtcattcttcctccatccctatcttataggtataacatttaaattataatagggaatcctttcctttaacaaggtcgtgtgatggcgaagatcatagctaaccaacgtctacaagaacaaagtagtttgtcttttatatcaattaattataagttaatctaattaacaagcgaatataatattagatatatgaatgagtactctttgaaataataatatccctgtatcatatgattgataatttacttgccgttttcttttaatctaaaattattgcttattgcaagtagttttgacttccagactccagctagtatacagatcaattatatctatctggcagactcaaatggactaggatagtatagaagttagatttggtatatccttctaacaaacatggtgtaatttgttttttaggtaatagggggtgtcaacataatgtttagggagtgttagtgtaatgtatttcaaacaattaataatgataatatatataagagtaaaagagagagagagagagagaaatcacggagaatttgataaaactttaagaaatactagtataatttataagtagaatcaagtacaattagaattcacacaagaaaaaggtacaatttcataaattcaatagaataacactatttttccattgttcaatctccaataattgattttatggggttttttaattttcaatgttcaagccttcaaggttgatttctaggaatttggtacgctcaatcatcccaaattttatgacgatagagctttgggcctataagcctatttcaatgcatacgagaccttacaactattgcatattgcatgggagttgttattagtccaataaaaattgctaccagtctctatcaacttttaaaacctatggaaaaaactattttattcctcagttcaaacccaccacaccccctctcttccccttcacctttctcgcaccccaacaaatacacaatagaaaacctaattctgtgtacaaaatataaaacagaattatgatttctgttttatattttgtttgcactcctttattacaattgaaatatgattctgcatacaaaattcaatacagaatgtgatttcattttcagattttgtttgtaccattgcactacaccggaaacatgatttcttgagaaggcatttttgtaagaaaaaaaaa

SEQ ID NO: 812 - DNA, 1600 bp, Glycine max
  Soy_ogl_1900 Gm06:10792501..10794100 Cluster 3
aaagcttagcatatgataaggtttgggccctgaatatcaagcccaagagcagaaaataattttgtcaaatcattagggctttttttattatcaaacctgatatcaagatcaatgaagatctaggtctccaggattaatagagctacagttacatgcctacatttatgaatttcctttttctttttcctcgtccaaatgaatttcaagttgataaagttactatcctctcttcttcttcttccttttttcccgattaaacgggggctaattaaagtcgaaaggcacaaacaaaaataaataaataaaatagatgtaagcttcatgttagagaccttatcaatttctgtccatgcaggaaaaaaaaaaagagtgacactttcatagttctgtacaaacaatcagtgtatagtgggacataagcacgtgaaagtgcttgattgaagatatatttagttctttgatttcatttccttcatatagagatacacataatacaagaacatgtgcttagttgtggttcaagttcaattcctgtaagattgtggttccttgtacaggacagaggcacaaaaaagtcacgatgtcaaatcattcaatccccacttcaacccccaaaaaatgtttagaggataaaatgatatatcaaaataatttataacatgaaaaattctcccaaatttgtatctattaataaaactattcttcgcaaatgtgtttgacagagataagttagttaaaaactaaaaaattactagttaaaacctaataaattaacttatttaatttgaagcattagtaaagttagttgtgaaactagataaaaaatataaaataatataacaaggcatatttgtatggtttttatataattgtattttcttaaacaaaaatattatttttggtgatgttaaaaaattttaaattcttatatttttctgaagataaaacattttgttaaaattaagataaataatataatacaagaaatagtgtaatatgaaaaataagctaattgtaaatattataaaatagaataataataaaaatagtttatatttattcctttgctaatatttatacttttgaattgtagtaattactattttgtcattgtatttttatttttcgttaagaagttacatattatttgtctttcttttgagtaataatctgttctcttataattacatctttaagttttgggcattccatgaaaggtcaatattgaaggcttgaggaatgtacaaacaaaatgcgtgaactaaaatgacttatatattattgaaatattaaattaaataatacaaatagtagcataattaaaacaaataatttaatactaaataagtaaccaaaattaatataatgactatgcaaagagacttttttgagtggagaagtgaaaatagattttaatactaatgtaaaaaatgataaaatattaagaatcatataataataaaactattaattataacgcaactaaaaaaacttatactagtaaaataaattagttttccaaatattttgattaaaaaaatttataagttactcagaaattataaccaaacttaaatttcatgtaaaaattaggtttata

SEQ ID NO: 813 - DNA, 1859 bp, Glycine max
  Soy_ogl_1976 Gm06:15871042..15872900 Cluster 3
gatttaccattgtaaacaaacatctatagatatatgtatattattaacagtgcttaatcagaaacaatctaaacttttcatccgtctttctttttatccagccaactgccgccacgtgctatgaacacaaaagtgagattttttttcttccacttttaccttctctctcattccatcattctctcacttttttttaaaccgtgcattgacacggtcctatacagcaaaataaaacaagaacacacagattccacctaaaaaattattgtgtgtactttagacagatctctgacttatctattttcgtttgaaaaaattattcttatacaattgtttaaaattcacaagagataaaacaaagatgcacaaaatatatatgaaataaaatgataattaaaaaatcaataacaaaaaaatgattaaaattcatattaaaaattaaggttgaatatgtttttttatctttaaacaattctataaaattcaattttagtctgtaaataaattttcagcacaatttgtatacgagagagtttttatgatacccaaaaaaatatgagagttttggtactatattttttttaaccaataaaattgtaatattatatgtcttttcattaattaacttttttatatacatttttttcaaattagtccttgattaatttttttaaaattaaaatcacaactattttaaattataaaactttgattaaacataagtttaaaagtaggaactctaatttatttcacttaaatttatatttaatctcctgttatataatattattattttgttgttcacttttgtccatttgcttagaattggtttggacatgtaattgatattgtaagtgcacttagtgcagttctatctgttcatattgttgcgcatgtgtgagtgcagttatatatatatatatatgtcaattgatttattagtttgatcactgatccataattggatcgatttttttagactcataataatattttaattttttaaaatttgtatcaagataattttttcttatatcttaaatataaagaaaaaaatgacccttaaaaaattttagttgtaattttaaatttctagctatatatataaaagaatagagcatcaaaaagttcaaaataaatatcttatattattgacacgttaaaaatattttaaataatcaaaaactaattaaaaaaaatcaatcaatcagaagataattaacagtatcaaaatcctcaaaatttttaaggacagagtgggaattcttttttgatatctcttttgagacatcttatccaatttcttttattcaccaaaaagttgattgaaaaaaaaatacaaataattttttatactttttattacagtttttatcttttttggaatattttactttttaatcaaagcacccaaaaaaataaccgagcgaagataagcaatccctagtaacatttccaattttagtcggtaaataaatttttagcacaatttgtatacgagagtttttatggtacccaaaagaatatgagggtttggatattatatttttttagccaataaaattttcatatcatatgtctttttcattaattaactttttttatattttttttaaattagtccttgattaatttttttaaaattaaaattacaattatgttaaattataaaactttgattaaacataattttaaaagtataaactctaacttatttcaccaatattaatacaaaatatttttcttaagcctaacaatcacttaaatttatatttaatcaaagattttgattgaaatagttgtaattttaaattttttaaaaaatattttgattaatcaagaactaatttgaaaaaaaa

SEQ ID NO: 814 - DNA, 2035 bp, Glycine max
  Soy_ogl_1988 Gm06:16561866..16563900 Cluster 3
aattttaaaaaaaaataatattttttaaaaaagtataagtaactatttgttacttctccttcaccatataaaaataattgattttttgtcatcttaaatttattccaaacacaataatacttgtattgaaggatatcattgatagttcaattttagaaaaagaaaaaggaaaagagaataaagggaaaataatgttttttttaaataatttgatatttaaaaaaaataacttcaatttaagatcctaatatttttcatgataaatattataaactcttttaaattaaaaaaaagaaaagattgttcttttctttttatacttaagttccaaacatatgtcaggaacactcgaaaaaagccaatcgtgaaatttggacatgaaaggtaaccaaaatgctcacccatttgaacatccgaaaatggatcatgaaaccatttggcatcaatgtattcttttcgtctgtcgtacccaccattagctggatgatatacgaatgccatatttgatgccttgaactactatgcaaatgggtccaatgttcgacaatcgtacaatcggattggtatgcattatttgcttcaagtgtgcaactctcttgtatccttgctgtaggaatatttattttcccactaaaaaaataagggcaaggtgcagagataggatttcagttccatcatacacattcacaatttcacccagttatataaatgaatgaaaacaatggccttgtaagtttcaattattgagataaaatataattaagatgtctaatctttatttaatggttggttttgattgaatggttgcatgaatctccgaatcctaaaatctaacatgtattagatattgaaaaaatcaataacattttatactattacacattttaattcaaaatcttaaaggtaaagaattttttttcattatttaatgtttaattattttatttttattcaatacggaactccatctagtactccaagactaatgtccctgcttaaggaaaaaaaaactaatgtcccaaatgctaaaattaaaatcaatattaaaaagtcttttctaaaaactaggttagagatgcattaaaaataatgatttttttactgggcattaaaaataatgataaaagtacattaataaaagttttaatactgtaaatattttttcactttttttaaaggaaatttttaataacgtttttttacttgaaaaattaacctttttatgagaaaaaatcaaccatatatattatatatatttaaagtttttttattaaaaaaatttaacccagatagttaaacattatgcatgaattaatgtatgataatgtctttatggatataaaaaaaatggtgacttatatattcaaagttgattaatgataagtttactcaataataattatatttaattatgttagcttcatgtttggagggtggtgcaagtcttgctcagtggtgttgaatttagtgacatgtctttagtaaatttaattgtcaatattttataattttctataataattgtcaaaacttttacagatatatacaagacaatacatccaacaaaaatattatacaatataagacacacaattacacaaacacatactgtttttcaaatttcaatatttaattgaagttgaattattttactagatgaaaaatataatttaataaaaaaaactatatagtaattatatgtaaatagattacacgattttaaatatcatccatatttgaatacatgaaaagaggaaaaaaatcacatttggataatattaacgattgatttaatatataaatgcatagttggttacattgaattgtttatcttaattttgtgggttttaaaatttcacataaattaaatattatatacagaaattcacttaaatattaagattgttaaaataagtgtttaaattaattttatgagtcctgcaatgtttaaaaaatatattatttatggtatgattttgttaagtaacggtggttatataagtaaaatttcttgtcatatgcttatgtaaaaaca

SEQ ID NO: 815 - DNA, 1226 bp, Glycine max
  Soy_ogl_1989 Gm06:16605156..16606381 Cluster 3
gcgttttgcttttatttacgagtagttcctttttgcttttattatgtatctgtatacgaataattatgaaactaatattcaattttaggagaatccaaacatagaaactactcataaataaaagctaaaaaaagagacttggaatatattttaatttttttaaaaaaaatataatatgatacataatttattagtactattaaaaagaagtaaccatttgaatttagtaatttacactattcctaaatatcctcaaattattaagaaaatatgatagaatcaatatttttgtccaatcagatgaagtttctagcattgcacccacactcaaatgaattttatacttgcatacaaacacgtgtcaaatgatacaataaaaaataagttcaaccattaaatcttatatatattgtgaaaaataaatcaatagtagtatttataaaatctgtccaatcactaaatattgttgcacgtgtcacttaactaaattctcacttttttttgtttattgaaaacgggctttgcttttttttttttttttttatctttccaatttctctcaatgcttatgctgtgcacttgttcttttactagttttagttaaatattaaagtaaatagtcaaattcctttatgaaaatatgagacgctctatcaaaaatattaagttaaaatttaattattgaatatataaaaaatatgataaattagtcaaatagataatttaatgataaattaatttttaaattttataatttaaggtcaaattaatccccaaaaatataatttataatcaaattaatccttaaacattataacataatgacaaaatgatctcataaatttaattatagaactaatttattatattttttccacataaaaaataaatttataatttttatctttcaaaaattaatttatatctgcattttacttttaaaaataaacttgactatttatcctaaatattaagttttttactgaaaatatgggatagtcaaaattttcgatacaattaatctttaggtacggataagttaatctcaactgcattttacttttttgcgaattatttgtgtaagactaaacaattatcatttgcttctcttggttactactctttctctgtacagggagggggagagaaagtgagattattaaacttactgttgttaaagaaatagtttgctttctaaattattaaattaaattagtgtaattttt

SEQ ID NO: 816 - DNA, 2700 bp, Glycine max
  Soy_ogl_2008 Gm06:18558801..18561500 Cluster 3
acttcatttcaaaacctagtctgaaaccatagccacaaaattaaccatgtctccattgatagtttgccttggctacatttgcagcagcgatcatcatatatcgtataataaagttcataacacgcacttccctaccactcccgccgggccctaaaccatggcccatagtgggaaacttaccacacatgggcccggtaccgcaccactccctggcggccttggcccgcatccacggcccgctgatgcacctccgcctcggcttcgtcgacgtcgtggtggcggcgttggcctcggtgggcgaacaattcttgaagattcatgactctaatttcagcagccggcgcgaaatatatagcttataactaccaagacctagtgtttgccccctaaggcccatggtggcgctttctccggcaaggccatggacgaatctagacacttgcgtccggtgaatttactatgtccacgtactgatatgaatgctacaaatatatacaaacaaacaaacataatttttactacatattctatttgtatttttttcttcaagccaaggaatggcatgtaacttaatcgttattctctttagtttttacgtgtatgcggtgtttctgctaaaccatttacgtgccagttttttgcaagatgtcatgaaatgctatttaacctcagttcggttttgatctacgcaagagttacttaattactgattgtactttcttttccgaagaattattatgaatgcttgcatgcagaaggattaggaaaaattaagactcacttgattgaataggatgttttggtgtaataaattcttgtcctagattgttcctgccattaaagtttgtaatgttgaaatatcaatataactacaaattatatattttaaaaactaatttgatattaaattataaaaatttagaaattaatttgccattaaattattcacagaaccaatttatcataatttttttatacatttgaagattaaatttaaattttttattttataaacactgatttatcatcatcttatactttcatcaactaaaattaaactagtatttatagtccactaactgctagttatttaataggaaataaaacttataatgactaaaataattacttgatttcttttaataatttttgtacatgatacacaaatatttacttattttaaacactcattaacatctttaattttttttcttcccatcacatcataaattttattaaacttaaatttttgtctttttttctctctacatgtttcatagcataatgaatgtttataaaacatttttcatatgaaaagaataaaaataaatactcattttgattcctgaaattgtgagacggtaaaaagttaataactgaaaaatagaaattaaacttgcaaaaaatacgacagattgttcctgtcattaaagtttgtaatgctgaaagatcaatataattataaattatatattttaaaaattaatttaacattaaattataaaaatttaggaattaatttgtcattaaattataaaaatttaggaattaatttgtcattaaattatccacagaaccaatttatcataatttttttatacatttgaagattaaatttaaattttttattttataaacactgatttatcatcatcttatactttcatcaactaaaattaaactagtatttatagtccactaactgctagttatttaataggaaataaaacttataatgactaaaataattacttgatttcttttaataatttttgtacatgatacacaaatatttacttattttaaacacttcattaacatctttaattttttttcttcccatcacatcataaattttattaaacttaaatttttgtctttttttctctctacatgtttcatagcataatgaatgtttataaaacatttttcatatgaaaagaataaaaataaatactcattttgattcctgaaattgtgagacggtaaaaagttaataactgaaaaatagaaattaaacttgcaaaaaatacgacagattgttcctgtcattaaagtttgtaatgctgaaagatcaatataattataaattatatattttataaattaatttaacattaaattataaaaatttaggaattaatttgtcattaaattataaaaatttaagaattaatttgtctttaaattatccacagaaccaatttatcatatttttttatacatttaaagattaaatttaaattttttattttttaaacactaatttatcatcatcttatactttcatcaactaaaattaaactagtatttatccaaagagtatgatacacaacataggtgcatgtgcacataatacaactttttttcctcttaaaatgcatatagttctgcaagactacaaaaccattgtatttgaagtatagtgtcattcatatattacgtacacgtgttatatatcatttgacattcgacgtgtagacttttaaccctagtactagtattatttgcgaagcgtatgcatgagcgtgggaacacttagttggagtaaaggccgcattcatgttactacttaaaaaatgtgccacatatctatttcattctcaaatataattcattaattaattaaacctatttcaaatacacttgaaggaagagatagcaagattgacacataacttagcaagttcacactcaaga

SEQ ID NO: 817 - DNA, 2571 bp, Glycine max
  Soy_ogl_2324 Gm07:10454386..10456956 Cluster 3
aatcgcaattataaattttaaactaatatattacgatcaacttcatatttttaaaaattatacacattatactttttctaattacttttcatattttgtatattaggtaattataatgcatatttggatcagacaagttatttataagttaacaattagtgatgagacaatttgacattcattgttcgagtgatttattttcgtatttttaaaaaatattcttttcactatatcgaatctaatgtttacaaaaggcaaacctttgtgaatttatacttttaaatttgtttcaaatttaaatcggttcttttactttttataatatatttttttttatcttattaaatgtgtattgagtctattgactaaatcaactactgagtgattatacctgcatacgttgtgaacattttttggaaacatgacattgttaaacaatactttattttttattatatagttataaaaaaaaattgaaagaaaatcatgagatcatgtctgaaaattttacaattaatgttgtctaaagaagtttccgagaattcattttcatatataaaatatttattcagaacagtttttcttattcttagatttgattattaataatacaaaatttactctcttttttacatttttaattctcaagtattttttatctttacattcattttgaaagcaaatcatacatcgcggtatcaaactagttactttttaaattaaagataataagaaagaagatcaattcttcctctccctccaactaataaaatcccatttatttccaaatatatctaccctcagttatacacaaatgcatttatgaaacatatgtcaatgctcccattgtccgtgcgagccgggaaaaataatatgaaaaacaaaaacacttgtcgattgaattggatctggtctcccatttattatttttttatattaattttggggtgtttagtggacctaaagtgtcttttccattttcaaattcaattcattgggagtaaatatatcgccctttaattgcttgacttactttttctaacgacatgaagcgattgcatataagattgcactaataagtagctcgagttgacattttttttttcctatcagaaaccgtatcttagataagaaattattgcatatataaatcagaaagagaggtccaagatatatataaaaaaaacttatttaaataagtatgttaatatagtgtttcaatcttatcgtatcacaaatatttttggaaataaataaatggaaagggagttatatatgtatgtagagagaaaagaaaacaacattgataagatatgtagagctaaagaaatgcatgttgtgtctggaattgaatatatatatcacgtactctttgctctacaacacctgcaacataacatatataattagattgcatgcctaaatgacatcaaaaatgggggtgggtcccaccaagtgtcgaccttaaagggggcagagaatgatgggtggctaactgagccctaacctgctacagctatatatgcatgaaagataggcaatggtgccacacagtgagaattcaagctcatgtgtagggagcaagagggataagctcttctggctttgtttcgtacgatctctagaggaggaaaaatggaaaaatagtcatttttatttactttcattacagcaaactagacttttaggtcctatctacgacatgcacttaataagattttttttatataaggattaataatagaaatatatatactcttttatcaaatgatgtgcatgtatgtgtgtgaaaaagaaaaggtttagtaattaaattcaccttcttttagaattttttataagttaacttaatttttacttcctagaccttttggaaatttgatttttagtcttacaataaaattttgattagttaaagtttttaacgtttttttgttaagattttagttgttgaacaaaaatttaacgggttaaaattcttaaactttttaaaattttagttgaaacaaattaaaataatatgattcaaacagagactaaaaattgaattttttaaaactttagagagtttgatcaagctttagtttagttactaaaaattttaaagaaaaaaatgcagaaactttatctagttaaacttttactaaaggattaaaaatcaaaatttaaaaaaaattaaggaataaaagcttaattaatcttttttctattagacaaaagtttaagtaactttaattttatgaacttaatatattttttatttaacttaaataagaaaatatcatttgttattgcacgatacttctaaatatagaaaatgattattagaaaaaatgataaatctttcacttttctaattttattatgtaattttttggggtgataacatataaagccttttttggccttcactaagataaagctaaagtttaacttattatttgttgcatgccttttttaagatatgatcagacttgaaaacttatttgaaagcctatcaacctaagtaaaaaaaagtcgataggcctatcaacctaagtaaagtaggtctattagtaattacacaatttt

SEQ ID NO: 818 - DNA, 2482 bp, Glycine max
  Soy_ogl_2325 Gm07:10458580..10461061 Cluster 3
tgggattgtttggcagacaggaaaaaaatatgaaaaggaaacaaaaatttaaattaaagtaatttaataggtaataaagtaataaaagtaaaagtaaatagtgtgagaatggtcattttatccttgaattcggcctttgtagccaggcaacaaaatcacacctttttttcatcttgcttttaccattgtacttcgcttttatgtgcataatcaacatattttgatatgtaatcaacatattcaattattctaatacatgcatcagatgcatatgcgaatatgcaagtaatatatttgattatcctaataggtctagttctatccctcccatgcgttatgcaagttggatggagaacaattttgagaacgcaaaaagggacaaactttctcatacttttcactcatttcatcttagttttgaggggaaaaaatatgtggatcccattacttttttttctcatttatgcaattcttttattctcattgaatgaatgaaatatcaatttttcactcatttcattcttatcctcactgttattgcttttcttttactcgaaacgaagagagcctaaaagattaaaactttctttgataattaagaaatataaaaagtaatataatactattaaaaaatacaagaatatcaaagtttttttatatgttatacttacctccttgtactttttatggtcttcaataaagaaaaataaagaaaaaattttctttcactagtagtttttaccataaaaaagggtatagccatataggaatagttgtaacttggaagagagaggtgttgtcaaaacacaaattctcaatgcatgaaacgagagcctataattaaaattgaccatcaataatgtagtttagctaggtcagcctttcactcattacaattccataatttgagtttcaaacttgaaattcacaataattttaatacgcatgaatacataccattattttttttcttaaaatcaatgatttatgataaccttttgaatggggagaaacttttcttatgctccgtattaacttttttatagaaaaaagttgagtaaagaattgatgagtataacttatagtaccactatattaaaagatttaaaaatcaataaccttaagtatatcctggaccctatacgtgtaacagtgtgggcacacatgaccccattcaatatcaaacttgtttaatattattatagaattaagtttttatttaaaccatattatcattattttttcttccattatattttttatttcattgtatatatatatatttaatttcttctaattatgagatgatatcttatttttattatctaaaattttcggggccgttattttctattctttaattagagtaaaagaaagtaaaagcaaaactcagatatgcaagtcaattatacgtggttagatgtaacttaagtgcgcaacaatatcatcatgtatctgcatcaatctacatgcagatggtatattcattcaatttaatatgcatttcagcttcagcttgcaagttgctagtttgaacaagccatatgggatgtttgtctcgtcaatttgcaataaagtttatgaaaagatgcataaagtaatgcaatggcactagctacataattaattgtggcctttaaattaaaccttccatgtgtagtcacatgcatggctggacacgtgagtaggcctattattaagacccttcaattagtgagttagctagttactatcactagtgacattgttaatcttcactaaagtgtataattatatcttatcgatcatcaacttattggtcaactatatttattaggtactcccaatatgcaaatagaagtcaactattttaaaaatatgaaatcatgattaagtattaaaaaatttcaagttaacaaacttatattagaattattttttatattattttccactcacctttattcttattttttatatttaattcttatttattttgtttaatactaattggaatttgatttgctttaatcaatttcctaagaaatttaaggtatgcttggttcattacttttttattaaaaaattattttttagcccccccagactgtttttgggactattttagtgatcatcaaatactgtagatcataagaaacatcgacgtatcacttaggatgtgtttgtttcaaataagaccaaatttaaaaataatatttgtctagtgtcatgatcaagttttataactactttacggttaagtgaaacaaaattaagtccagatgacatgttttattagatgattccgttgagtaacatacatataattaaacaagaagtgtataaaaaatatttaaatatttttttttctttataatttagatttttttattcttgtccttacaaaatgtatttattttattttctgtctttaaatcattttagataaaaaaaaattcattttttaaagttgttcttcattgttcaaagcattaaagtgctt

SEQ ID NO: 819 - DNA, 1900 bp, Glycine max
  Soy_ogl_2355 Gm07:17321301..17323200 Cluster 3
ggggtctctcttgtcaaccatgttatttaagaaaaccaagtctagttttagtgagatcaacgatttgttgattgtgttcaacacagtatgatactataaaagttcttaaattttctaagggtggagagtttaagtttataaatttgcatttaaaacattattttatgtctaatcttgatctaatgatttcattggtttctgctttccattattttccattattttatctaagtatatacttaatctttgtgataataccacttagattaagggctgatttgtttaaacttaaaaaaattgtgaaataagtgctttttaaaataagttttttttaaagaagcatatatgatttgatttttaaaataagtaaaaatcttttttttaagcagaagcaatttggacaaacatactaaaaaacataaaaatgtttactttattaaaataaacaaatatttcaaaaaataaattaaaacatattagccctaagtggtgtgttcaaagatccaaggaataagaatcatattaataatatgatttgaatttaacaatccatgcatgcattattgcttctaaaatatgttaaattataaaatgttttacaaaattttacatcatactatgctaaaaaataaattgaataaattttccttcatctataactattaataaaagtatttacctcattttatgtacacatttgttattcctaatttacccttcaactacttttaaaaatcaccaacaatcacaagtagttattccctaataattttttaacatgactattattacaactatatctaactaaaaaaagacaattaaggcaaaaggcacacaaagcctatttttcaactagtatattgataaaccaaatgttaaaaaaacttaattataaaactttaattaattattgcgtacttgataaaaaaaaaacaaaatgaaatttgacaaattatattaaattaaattttgaatattattttcacataaggcctcaaaatttttttgcctttacacttgagtaaaaagcaggtagcaagtatagtatggggataccctgcatatacagggattgagattaaagttgctactcatataaatacaaggttgcatatgtgtatttttttcaaaggttggtatgagaatgactattatagtatcatattcaaaccctttatgttgtcatccctagcaaaaacaaacatcaaatatcaaagtgtaacataatttcttaaacttacataagtttgactattcgaaaatagatttaaaaataatgtgaatcatcactcaatgagtaaataaagcaaaatatcataaagagggatccaatatataaaattttagttgtatcaaataataaagtgaaatgattatgaaaaaaactcgaagttgaaccccaataattatataaagcaaaatcttacacttgattagaataatgttgtgtcttaagtaaaggtttacttggacttttttaactataagaatgaaataagatatgaaagagtttataacaactcatttcaaccaactgaattatactctcttgattttgtgttatagactactctcacctatgacaaattaaaactcttcgtctaggataaattgatcataggctccttcttgcaaataagtcatgttgtatcaaattaatatttcaattcgtgtcaaatataatattgaagtagtctttcccccaaattattctaaatcataagtatgtatataattcaaatactcaaaagcatagaaacataagcatcaaaacaattccaaactatatatacatagattttggtttgcctgagtttaacatccttaaaggggaatttattcctatatacttttgataaaatcttcaaattgatgaaactattcctccaaatttttgaaa

SEQ ID NO: 820 - DNA, 2672 bp, Glycine max
  Soy_ogl_2656 Gm08:13372401..13375072 Cluster 3
ataaaaattataatgagagtatattgtttgtcctttaatttgatttagtgcactttactgtgaaaattattttattttaatttaacctcaagttttgtttaaaaaaaatccttaatttttttaatgtgtttctaatcaattactgtaccatgcaatatacatatccaagaaaaatctattgcttattgtgaatggtaattgtttttaaagttttcaatcattgatatccaaaagtatttttgaaacatgcatagttgacaaattactgtgtcgcttaaatatgttgttcaccatggtaagcaaaaaagtatgttgttcaggtttttattcttaatcgttagtacgaaaaagagtttgttgaaaaatataaaatccactttaagaatatcaatattttaagaagattaatctttaaatactgagagtctattactccacatacacaaaaagtgattattttgaatactaacttatccaagtataggaatgacaatactttcatttaaaaataaaatactagtcaaatcaattctgtacttgtaagggtaactatccttactcatttggtacttctatatatatagttatgtacctagactacttacatgcatttcagataacttgaatatatggtctcctacatttactttgacaaacttataaaatataattgttttttttaatattacgttattcttggtatatgtggaaaattcaaaaatacacatcataatggaaagcgctcacaaattagcttgataatagcatcatcataacaatacggataaagtaaaaaataaatattatgtaaaaaaaaagttataaataacggtgtaaactaatcttatattatcattctattataaaatattattgatataatttttaaaataattattatagaaataaataaacttattatacatattgatttataattttatgataatataaaattattttgtatgtataactttttttttaatgtggaaacaatatattccaataaaattctcactttgggataaacttatgcaatagtgtctgaactctagattagacatgactcattttttctgatgagaaagattaagaaaaaaaaacattgggttttttatatttactcatctactagacacactcccaacttatttattttttcttacataaaattacttaattaaccttatttttataatttcaaaacaaaagtcttgagtcctcctccttcatcccacaccacactctcccaccttttcttttacaacctcatcccttctttttctgcacctcataagcatattctcctctcattcaacaaaaacccaacttcattatgcaaaagcacaccaccatccgttccaaccctaaactgcaaaaccagaacctaaatatatacgtgtagcctagtcatttgcaacatgcttcaaaagttgtatccatgtagccaaaacccttgttgtcaggctcgagattcatcgcctctcgcattgccctatgattagaagaggggggagtgtatttggtaggtaggggaggtgcaaatatataatcgaaaaaactgtaagacgataacacgtctatggataatgggctctcaattgaaagcccaaatcgtttctcaaacccaaatactaagaacttgtgctcgacgtagatgtaaaatgaaattggtcctcgacatcagaataaaggaaaatgcttaagttttttttgggtacaaaaatgcttaagttttttcactcatttacttgtaatttctactttattttttattttaaatatattttattttgtatgagttcattaacgtaaaaattatatatacatttattagttattaccccttaaaataagaattaaacaattaattttacctagaaaattctatgaaacatacattccaaaataaattttaatacggtgatgagaatataatattttttaaatggcttaaataaccttctagtccttataatgaatctttgttttagtctattaaagatttttgttttttaaagtttttgttttagccccaacttttaagttttaactaaaaactttaactgattaaaattctaaaacaaaaaatataaatattcaaaagattaaaaaataataatttaaaggactaaaaaaacacactattttataaggaccaaaagataatttgaaccttttaaaaatcatgatattgctaatttttttatataaaccatttttccagttagaacaattcaatatgagttgatctagacacttgctacttgctgaaattgctatgatacaacgtatacaattaatattaaaaaatttgaaagaattcaaattttaaaaataataggatcattataaacataacaaatgaataaacttatcttctggtattataattagtattaatataattttttataaaacagagtaaaaaatatatatggaaatgcatcgaaaagtgcttaaaagaatatgtattcaatactgttaattatgattctctttttactattcttttggggttattctttcatattatactatttttttgatttttttattgaaatatttaatctgtaaaaaataataaataatttaattaataaaaaatataaatatattattactaaaaatgtatttttattatgaaatgcacagatttgtaaatttctttt

SEQ ID NO: 821 - DNA, 2333 bp, Glycine max
  Soy_ogl_2674 Gm08:14182268..14184600 Cluster 3
tgatcagtgtgtgcttgcggaaacgaaaaaaattaggattgaatgccattaaaggcttcaggaagctctgaataccatgtaaaatatcatgtaggtgagagagaatgagagaaaactaaaactattataaaaatctgttattgtattaatggatcagttatttacaacagaattacacaatggtttatatagagcattctaactgaagaattagttagacaaactaagtaattcttatgttgagttagcaatgactcagttgtatctattatatactattaattggaagcttgattggtagtaacaatatagccaaaattgatgaggaagagtttagtttaggaggatacttgttaatattatgggtcttgttaactagtgtttgatatcttaaggatcttaaggacaatgatgaattaaaagaaaaaaattaatataaaaaattatagaagatcaagtaaaaaaaaaattatgaaaaatataattttatgtattctaataaaatacttttttcttttaatttcttaatcttaggatcctggtttgtatttgtataatttatttatttttttcttggatgcatacattacaatagttataaaataatcctcatcgtgtcactttcctttatagtgtaatccttgtttagaagcataatcaacctgctataaatcaccaaacaaaactgaacgaacatttatgatcgtcgatcaatgtccgtctgatttagggatgacgataaatgctttggtcattaatctccctagatcgatcttacacctcgaaatcattgttttccaggtatataagatctttgacatgcagaaacgtagatcatataaagtgcaaatcaaacgtgtataaaatatacataatatacctaccatatctaaaaaattggcatcttcatctaaaagaaattagagaagagaaagaatgttggttcaaatatctacaatcgaataacttttgaagtgtttattatttgtttcatagatgtagaccctatgttttttttttacctaaccctctacaattacttcgtctagaaatttataccgtgcctaacacttatatcgtcatgtggatatagtttacttaaaaactcatcacgtaatctggtttgattctcttgaacatactttatattatatataaatatataaataaaagaagtttgatgtgctgacaaaattttagaacatgtcataatttggagaagattaattgagggaaagaagcatttaactattatgaaattaagatgataggaacgatgctatcattggaccccgccaaaagataagtagtgattgtagcacgattgatgtttttttcttctatatcaaacgttcggaagcgagacaatccaatgcattatcttcacgcacgtgaatcttgatttttaattggatttcattattggagggtataaagaaacaaatggaaacaaaactgtacatcacaagaagacatgcttaagtgcttaactaaataatgtgaacatatatcatatgatcatagacccacgaaaaaattttaggcacactaaaaaaatcgtcatttaaccgaagaaaatattaggtattaagaagccttcatttggataattttttcataaaatttaaattattagaatagagattatggatctatattaaccatatgataatcaattgatgataatgttaatatagattagtaatatctatttcacagtttaaattttattatattagagacagagcagcatattcaatacttatagaagcaaattcagtacctaactattagtgtgtaacatttaattattgagttagattaggtaagatgttagctcagaaacaattattgagcaaaaatacccaatatgaggtacattaaataaggtaaaccctttttacccaaaaagaaagaaaggtaaacaaagctgttgaacccaaaataaacttaagagttgatattgatatatggatttgaatcaggaaactagtaatttaaatggtgaagcctctggttgataaacttgatagctgacaactaatacacacatcagtcgacaagcttggtcactgatagtcaatcaacatatctgttgagaagtgttttttttttttttttggagtacaatctgtagagaagtatgtatgataagctgacatatatacgttgtgatggttgttagctaattactgaacatattaatcagtagaaaagcattaataggataattaactaatatttgaatgatcagattatgattttaaggatatgtacgtttccaaataatcgagctagactatgaataggccttgaggatatcatgttgggtt

SEQ ID NO: 822 - DNA, 1900 bp, Glycine max
  Soy_ogl_3052 Gm09:9475501..9477400 Cluster 3
ttgaccatggcttttagctttttgatattttggtcatcaatattttttcacatacattttttatttatttgtaataacttcttagttccattagtaagttgatttggaagcatatttgctattatatgaaaggaacataagaaaaataaaggaaataattaggtagaggatatacaaaataaggaattaatgttacttgtttattaagatttgtttataacaatcttgcatgaatattatttattcaaatgaccttttgtcttgaacattataacaaattatatttattctaacactcttgttagcaagaattcacgacataagttgcaagacaatggacatttggcacataaagacagttgtcaaaaacatgtacaaacacaattaaatcacttataaagaataactataaaatgataaaaatagacaatgttgtaagagaatgaatattaagatttgtttataacaatcttgcatgaatattatttattcaaatgaccttttgtcttgaacattataacaaattatatttattctaacactcttgttagcaagaattcacgacataagttgcaagacaatggacatatggcacataaagacagttgtcaaaaacatgtacaaacacaattaaatcacttataaagaataactataaaatgataaaaaatagacaatgttgtaagagaatgaatattaaggttatcgttaatagacttggtcaagccacaattagtaataaaatcagagacaacatcaatatatagaaatttatgacattttgtaggataaacatcaacacattttttattcaaaagtatcctctatcttaatactatttttttctgcaaaaaaaacattttttatacaaaggtggaaatattatcaaagattagcaatctttgaaaaactttgtagtagataaatttagtttactaaacattttatttggctcaatttacacaaatgaaggattataatcactttattgaagtccaccataatcatgattataatcacaatttcagttatttttatctctatttgtatcataactcttctctgagtctgtgcaataaatctcataatttatgtatagtatataaacctttagctacaaaacaataagtttacacatcaacatcgtattttttccacgtgttgtgttcaaatttcaccctctcaataactcttattttttattaaaacttttgtataactcacatctctacaattagtgcatcatttaaacaaccactaaaaaaccaaatgaattgttaatagaaaattacattaaaacattcataactttcatctctacaactatgtattgaagaataacatattagaggctccaaacttattctcgtacaagttgccttagcaaaactcaaatcaaataattatatcagttttactaatagtagtagaaactataattccatagtttccagattaattgactatatatactcatttcctcaaccaattcaatcatagcaatttcattaagattttctttactagctttttggcttctggtatatattgtattatacaacataaaatcatagttctttgaaatgtagctaattaatttactccacaataagaagatgaatgacaagtatgagaaattgaataaagtcatgtataggaatgttgaattgcttaatgaaattgtgaatgtcatagatcctgatatagaagaacctagaattcagcttgacttagttattttccttcgttaacggatctttgaaaaggttcttgtccatccaagatttggtgggattcctcaatgggttgttttggtgagaattgtttgagaaattatttcattttctttcttgttgagatttctaatactagaagtattgttgcactataggtttagtaa

SEQ ID NO: 823 - DNA, 1500 bp, Glycine max
  Soy_ogl_3059 Gm09:11957601..11959100 Cluster 3
atttttaaagcatttatgttacacctataactctatctctcactctaacgttcactcttgcatgtttttgaattatttagttaatccttttgtttcttctttatgttgcaattgagtacaggcggtattatatataaactaatggattcatgggatttataaagaattatatattaaatttacttaattctataattcatgataatttgaaaattacttataattagtagtttttccaaacattaacaagtaattcaacaataaagaagaaaaattcaaataagttaatgtttattaataatttttgtatactatcgactataattaaaaattcaccctacatataattttttaaagtaattattacaataattaataattttatcgtatatagaaaattatgtttaaacgaatgtataaaaacttttatactttttttactaaaaaaagtttttgtattgttaatgtattataattaaattcgtaaacttattccccaaggtttcataagtgacacccttgaatccattcattaagaaactgttgagagactgtcgaattcaccattttcaaattttaagaaacaatatatcaataaaataaagttgagatatttttttttaaaaaaaatatcaatgttaaccattaatttgttagtctttttttgttagctagagatattcaaatccacacactctctcactccttcataagaaatcactaagccaacattataactgcataataaagttgtgataataaacatattttatgaaagggaaattctatttatacatttataaagttttatttatttttattattagtgtaaaatattttgttcaaatatttaaaagattcagcaattttatcacctcatcctattactaatatatttaacaataaattttttctattggatatttatgtaaaattattttatattaaaaatatatataaattaaattcctgtttttagataatcttcttaccaataaaaaatatatatataaataaaaaaaataacgtgataaaaagattaaaaatattatataaattactttcattgcaaaaatataatatagaatttaacgatgatgcacttattgtgtattattattcaataataaattattgttatttaacttttaaaattttattatatataattatttataattaaatgtttgtgtaaaactaataaatactaacatttgatatgttagaaactaccaccgcaattgcatttataaagcacaatcaataacatcgatctcatcgaaaaaaaaaagaaagaaaattcatgacatgatgaataggtcaaatactaccccacatgaacaaactggtactacgattaaatttatacaatcaaccaatattatatcacagctaccattcaaattaggaatcaaaagtctcactatcaacgaatccaatttcctcaatatatgttgtcaaatgtcttgtatgaggaaattcacttcttttcttcccccc

SEQ ID NO: 824 - DNA, 1900 bp, Glycine max
  Soy_ogl_3076 Gm09:29040701..29042600 Cluster 3
caaatgaacttaaatcatagaccaattaagttgaactcgggacaaatactactatactcaaggttcatgaactctctctctcacacactttgtatatatagtatttcataccatgatactttgtatatatacttctgaattccaacatttctagttgtggtatagttattggaattttcatacctcgcatgatacttctataatatgtcaatttggagggtaaaaaaggcattatcaagctcatttatagtgggattgcgcaaagatacatgactccttaacaagtgttttagttgtggatatgcatgtttcttaatttttctcaatttgataattgtgcatgtagataaccatggggacaacaataaaatgttttcacagttaaatgtgagaatctttttgaggtttaagggaagagtattgccatttcatcaaggtatttctcacttgtgaatattgtcctgactcctgactttctcaatgtttcttacatcagtggtgatccagattcaagttcatctaagccatttgatctgttgggtgctaaaggaagctctggaggtgggaatcccttattctcaagttttttgttatcttatccattatcctttaacaagaaaaaaattccccaataaatggattacagtatcaatattatattcaactaacatatccgggctaattttgcatgatgggtttagtaatctacaaattcttgataactgggaagggataagtcatggatatgtttagcatgcctttggttctagttaactacttgtttgtcatttgccacattattcttgtaatgtgtagatacagaagaatctgcttgggaaactaaaagtaattataatcataacacctcatgagacgctgcagtggagaagattggaatataaggttatataaagttattaaatatatttagtttcaaaatcttctagaataagcttaaaggattatgtttagctttctttcaaccatgcaagtcattcgatattagttgtatctatgatataaaaagttctcctttgcctctcatactttttagtatacatctcatatttaagtcaggagaaatcttaatcttatagtattaatttttttatcttttataattattttaatatcacgcacttgctaatataaatgtatatgtgtgtactgtgttaactagaaataaaatacaaggatctattattataacaacaattaaacatttttttactaatttttggaagtatttatataattgaaataggtgtatattcctaaaataattaatcaatctatgcaagtgattataattttttgattagaaataaaggttatgtttgaacttttaattaaagaaaaaagaagtaaaaatattgcatatgcacatgtttgaacatcctcgttgttattttctgtatacctgtgaaatttccctttcctttcatgcacaaatgtctgaaagttaacagtagggccatacatcacctttatagccacaagcttaattttattgtatggacttatttcatagatgcaaatcagaaaggaaaaaaaaaaagtagatcttgattgttttggtgtatgtccttcaatttttaaaagaaaagagaaaatagtgttgactattgaatctaatattgcaacttttttctctaagaattaattcgaggtcattagggatttctattatttatgaatttatacgtacatacatgcatgcattatttaattaaaattttcctttaatgtattattttattagaattgatatagaaattttgttattaacgtttcctattattttattagaattgatataaaaattttcctttttttattattttcttagaattgatatagaaattttgttattaacctttcctattattttattggaatt

SEQ ID NO: 825 - DNA, 1494 bp, Glycine max
  Soy_ogl_3087 Gm09:30314601..30316094 Cluster 3
ctgtgttatctctacattatcatcatcctgcatcattatttatatatactgcaaacctcacaaggtgtgatgggtgcaatagtataataagttacaaagccagaacttttggactaagtttacagttctcagaattgaagttggtgaaggcaacgtgtatagtggacaatatgcagaattggatcgtttgtttttcttcttggttttcacatattgtgctttgttattttgactttataatagctgaagtaaggaagcatacagtgagtgtggtaacattataaaagggtgtgttggtgcagtgctagttgtaatgtgtggtgctttactattttgtttacagttgcaccttgctagcttttgagtactcttttttatttgaacttgtattcttgtaatctggtggcttctagattttggcacatcttgtgtgctttgctgggttctaacataattcgttgtttgctgctaaaaaaaaactatcaaataagctaacgtgttatcattagaataatttgtatcataactaatttgattacggttaaaatgataacttatatcataataaaataattaaaagtaaaaaaaataatctatattaactcagaaattggaatgagtgagttaatataaacttttgatatttttctttgatttatatatataattgtacaggtataatctcacaatatatatttgtaaattaatatttatttatatagatatatcttatttttgtaattgtgtataattatgaaatatttgagtcatctataaaaatttatccaattaataaagctttgtcactaagtaatttatccaattaataaaaatttgtccataaattattcatattctacgagatgtgattagaatttaactgttttatgtctaaagctttgtcactaagtaatttatgggattcaacccacctaagattttattaataaaaaaattatgagaaaatttggaaaaaaataatttggattctcccaagttaaaaacgggagtacatttcccgctatatatatttgtggtcatttattgcttttcatgaatgaaaccatccttaataattttattaactataaaggttcgtattcataataaaaaataatatattagtatcatcaattaatttgaataaaaaacatatcttttttttttgttaccgtattgtttaaaatcaaagtctatataaaatttcatgatttaactttagagttttatttgctttgattaaatctcgcaaggcttctaaatttaactttgaatcatgattaatttccataattaattaacataatcatgattgattgtcgtaattaagtgtttcacaattaaataattaactcaaatatgattttgatgaattaagaaaaataattttctgaaattttggagagaaaaaaaatgaatgaggtgttgtcacatggaaattacaataatatttgagatgataaactatgtcagttatattatactttggtaatg

SEQ ID NO: 826 - DNA, 1458 bp, Glycine max
  Soy_ogl_3418 Gm10:10104701..10106158 Cluster 3
gtattatagacaatggattaatacttctaacttagtttatgtctactaatttaaataatttaactagtagttacaaaaaataaattaaaaaaataaagatgagaaagatcgatgaattaaaatttaaaaaggataagcttgaagagaaaaatatatttccggatctcaagagtcataatcaaaagaaaggtacataagaataaattaatgatcacttcactttatctaaatttaaaacggaaaaggttaaagagaaagaaatatattttgtatagttgaaaagaaaggaaatatttttgtaagattatatcgtaacctagttttgttatttttattatttttttggtcggcagtaagtttagtgaaaaaagcagaagcaaatttcacaaaaaaaaagaacgaaaaaaaaaaacagaagcaaaattggttaaaaagcttaccttgataagggtatagatggtaattccctaaaaattaaagaacaaaatagacgtaagacaaaactgaggaagttgatcatggtatattttattagtaatgaaatcatgtaacttttttttttcttttcataaaaaaaagttgcatgatttgaccactaagaagatatacttatgttggggctaaatttattttcaatcaaatctctgtttttgaaatcatccttaatataaattttatatttattataaaattaaacaaaattgtaattaatacatcttagttattttattaacatgtatttcaaaaatgctcttcaatataaaaaagcaaattgcacacaacaacatcttttatatgtgtgtgtgtgtggggggggggggggaggggaagttaagtacttcaattaattagttattgttaaataatattgttgtgagaaattgcttaatacaatataatttataaaataagaacaaaataattacgtaatgagtaatgagaaatgttagtgatacccctccaacactatttttcaaggattctgtgtgtgtgtgtgaagattttgctcgaggatctttgactaagattcaatagttttttttaacagaaattggtaatatttaatactgagttttaaaattaaattatcagtcatttttaatgttatatttattttattcattttatctgtaatttagacagatacaagatgggataattttttcataatatacattcattaaactatgtttattaatatcataagatatttgtttttaaaaatagcattattattgcgcaagaaaaactaaagaacttgtttactttgaacaaaaaatgtttcctatttttatttctataataattaacatctaaaaaataatttctttatatgttagacaaattcaaaaaaaaaaatatacgtactaaacaaataaatcaaacattgaagaatatttgtttgtgcatggcttgtgctcttgttaacgattgcaacaattaattcggttatattaa

SEQ ID NO: 827 - DNA, 1795 bp, Glycine max
  Soy_ogl_3854 Gm11:16787606..16789400 Cluster 3
attggatcggtgggtgcaagcatgatgaattgactttatgcaggttcattatgatctggggatgattatatttagaaggtgaaaagtttcatttctattgatatgaagacaatgattgccttataattgttagatataagtcaacgatttttgttactgtgaagaagcactatataaagtaatatataatatatatagctagaagtgagaataaaatgcaggcattatatgaggataataagttagttactaaaagagatgggaaactttaaagccagcatatatatcttcctaaatccctgtctgccaacggagattattgtgttgctttaaatcatttaatatgtttactttatggcagccactgagacactttcttcttgtctacattcaatgattcaagtaaaatcaattggcaaattaaaaagcagtcatgcaacctaccaacaatattttgacaaaaaatatatagtataccttttttatagataaaaatatatagtatactatgtttaatataaataattaattacaataatcttcttctcgaaatatggaggaaagtttcatttccaatttttttaactgacttaatttgttatgcttcataaaatgaagagaaataccaatcttcagcacgaatttattgtacaaaaattaccaaccaagaaaactcggcatatgactactccaaatcagcattaattgggtagctttattctttttttaaataaaaaaaacacgcatttaatcgtgttaaaaatacatgaatcttggtgggttggagtgtttttattgttttagatgttggattgtgtaagaaaacatattttcaaagcttgaaatagtcgttcaggacagattccgccaaagagatacaaattctgatcgttttctaaatgaatgattaaattaaataaaaatctaaagaattaaattgaaacctaaattacagtttttaattggcaaaaaggtttttttaataaaaaggaactcactaatttgcacaatatatgtcaattaggagataaaaaattaatttaatgataaagaaaaaagaaaatgagagattgtgttcccactaacaaagtaacaattaacatttgtcatacaaaaataaaatatgccaaagaaacctaaattaaagctagagaatgaaataatccaaattcatttaattaaaatgtataaactcttgaattttttttttcatctaaagacggatgaaaacttaatgtgttttaaaaaaattataattaaattttatttaaatatgattttaaatatcaagtcatagttgaaataaaaataaaaatattttttattaaatcaattaagtaattcattttaatattataaatttgactcttcattcttgaatgggagtattctcactcaaaaattcgtttttttattaagtcatgtgacttctcaaacatttaatatttaattttattatttatttgtatttttctttttaaatactttatgtaattgtaatttgatttaaactttaaatcttgatgcattctatcaaatgaaagatattttcatttttagatagactaaattttaaattttttataataattataacttttttacgcattataatattatatcttgaaatatgacgtttcttaattcaaatattttttttcatcatttttaatttttaaaaatataattgctttaatttattattataacttgctcattattaatagcaaaattttattattcttatgaatttattttttaagttttatttaaatcaaaatatcagtataataca

SEQ ID NO: 828 - DNA, 2400 bp, Glycine max
  Soy_ogl_3887 Gm11:29980201..29982600 Cluster 3
tcatcaatcctcgcaattttttcgaggaatatatatgcagaattttctataaattaagtagcattttccatttaaaaaactcttcgttcattcattcatattagatatattatattcttccgtacacttatattttttatatcaattaagaaggacataaaacataaatgattgaaattattattattgttaaatgtaaatgtgaagaaatatcttttccaatttttccaatataggagagatcgaaagactcgaagattaatttttttttagtctttgtctttcctagtaaaaaatttcagtagttgaaaggaatcggactcagtaaatgtatacatttaaaaataaaaaataaaacatttgtgaagcatcaaactgtttatgttttgtgcaatatatcattaaactttatggattgggaaaattacttaaaattaaatactcttggaagatatatgaaacatgttgatttcgtcttatttttttacattaattataaaaacaattaatgtaaaaaataagacaaaaacaataagatgacacatccttttaagtgatgagaataaaacttcatttaacataatattttatgttatcttattgataaaaataacccataacatataaatagttttaaaactatcctattttgatacataatttttttattacttgtttcgtaaaaagtatccaaaaagattatgtattatatgcacgtaaaaaaaaaactcatatatcttctttactgctaagttttaccaagtcaatacaaaattacacaaataatatttcatctaaacctagtttttgcttaagagtcaacagctggcaaatggatagggggtgggggtagctaacaaaggtaatgattggaggcattgaataccctagcactactaacataaccaaaagaaaaaatagggttccatttacaattttatatacttcttttgaccatgtcacggacgcaaaagacatatatatttatccgtaacaaaaaggtagtgctcaatttaattttattaatttatgattcttgaagatgaataaatacaatttcaaaaataaattatatggtatctttatgaatataacactcgtacccactaagcctttttcagggcagaatcgttgccagcttcctccttaagctggatatgtttgaatggagaatagaagatctagaagaggcaatattagaattttaattttaaattgagagagttatgaaatatttttaaaataaataaagagtaattaaaaatttatctgattatataccatttttattttaaagtatttaaatactgattcaaattaaaaaataatgacccctcccttattttcctgtcaaaaggaaaaggattattcttatatattacttcctgatataaaattctaaatttaattgaaaaataacaaaaaccatggattaatttaattagcacaatttcatgttaatttatgtacgtggtggtatacaagatgtgtcgaggatagtgttctaagttttatctatttttatataaagtattactatccagtatttaaaagcataaaactaaaaaattaaaaaatattttttaaaatcaatagaaaatatgtattaaaaattatagttaggatgcattaaaagtcagtatattgataacaattttccatatttattttcattcattggctagacactacaagaaatgtttcatgtagtgactgagaaaatgtcactaggggtgtgttcgtttacaggaaaagacggtagaaaatgagagaaataaatactaaaaggatatgtaattgatatttttacatcttattttaattcaaaaaatttatcttaatctacattttttttcacctactggcggatcctaaaatctgtagataaaagacgttctagaatgttttttttctctacaacaatgttaatgagatttaaaattaaaataataagtaaactacttaaactcctcatcattaggctaactttaataattattgactacttttttaaggaaattattgactacttaaattcttttttaatacaaatgttttatttaatttcttcagccgaggcactaattagtatttgctattattttaatctatatcaaagcttttgatatttaacactacttaatctagacacaaaaaattactcataagattgtgacagtatgaatacaaatataatatttttaattcagttaaatgtggtgcttttaatgaatatgtctatttatcaattttagcattaaagaaataatatattttttcgaagggaataattttatgttattgattcataataaaaacacataaaaaaatcacatttaattaaagtgtgaataataaattaattcagatatatgcaatgcatatgcacaaatgtccatt

SEQ ID NO: 829 - DNA, 1700 bp, Glycine max
  Soy_ogl_3917 Gm11:35969201..35970900 Cluster 3
aaaaatatatgtaaaccggttaattatatgaaataaaagaatcagttaacttttctgatgtgtcatgattaagtattttcttaaaacgaatattttctctcttttattctttcacctaaaactaaaacaaaaaaaattgtttgaaaataatcacattattttcttagtttgatttttctgataggtttttttttaatcctatcaataaattttccatgatttcaaagattttgtttaatcctatcaataaattttccatgatttcaaagattttgttctctagcttgtagtttgattatcatagcaggtagttttctgaatattcgcttctcacttttttgtgattggcaagttacttttttaagataattagtgtattagaccataaaaatatgtattgttcattatgatttttgtgtgagcctttatggttatgtttttaaagacacttcaacgagttaaaggggtgtttataaattacttttgactccaaaactaaccaatgtaaaactttttgtttgtgtgtactagaacaatagctttccaatctagcttaagggagttagagggtttgatatatagtgccccacatgtggcttacttcctcattttagtgtcaatgttctgattttaagtttgctgcattgctaggcttactatagttgatatattgtttgctttggctctcatttgtcttttcttttttcctttaaaaatacatcttggtagattaagggaggaaattatttttatattacctaaaatactttctgtggctctaactgtagtcagagcttaggttctaagaaatagacaatggtatcaatataaacattatgtgacttacattactcatacaatatatttctacaatactttatatatggtattactttttctttatttcttctcaccacatcattcattttatctcaaactttctcacctcttttctatctttcataattacataaatttaattttgtacaattatatacattgtacaccaaaatttctcaaattaggtggtgtgttgtatatcattctcgatagaagaatcaagtggtatattctatagataattatatggcccaataatagtatgttggtttgaacatttttctctccatttttttcataaccttgaagatttgatagtttatgtagaaaatgattaattatttgaattatatataattaggtagtgatgaacttattttttttaaaaaaaagatactttaaagttaaagctaaaattaatgttttaaaattaagtttaaattaaagggtgtgacatttccatgttttcatttaaaagttaatgagttaaaagataatttagtactccgtagtatattctcaggtcttggaatttgagatagagaaggggaagagaatgtgacgtttctattttttttttctttttaaataacattttctttgccaaaaaaaaaacaatttatattttagaacttttgtaaagttatattccacacaattcctcttttaaaattaaaaaaaaatccaaaatatgttggccaaacatagttggcaattagtgagtgaggtcaaacaaagaggggaatagatgggcattttgtatattttatttgttgtagctaggtgtaattcaacaatctgtgtaccatgtatatcaataaggattaggaacattttaaagatatttagatagccatggt

SEQ ID NO: 830 - DNA, 1865 bp, Glycine max
  Soy_ogl_4216 Gm13:23168901..23170765 Cluster 3
gctttgaaagaatatatgatgagaaagaaaacttttcaagagtgatattttcagacacttgtgttgaagatcacgtggataatgaaaattctagcatacgaggatatggttatggagaggaaatttccgatttatatataattccaagtaagagtaggtatttcaatattataatattcattctataaatatttaccaacttaaataaataaataacatatatatacacacgagaatgaggagaaatcaaattactttttattctaatcatttttttaaaatttaatgattaagattagttattaattataatcattaaattaatttcatgaaaataaatgatgagaatgaaaaacttaaaagaattactctttcaatgaactgatccttatatatatatatatatattgggaggaatccgaatatctatgtgcttccaatgcccatgactaacataaggggaagtaggtagtaaaacatctttgcgctcgttggacttgcgacttgggaaaaaagtctgaatttttaaactgtcaattaattaaaaattatgtttaatatgatttttaatataataattattaaaatcaataaatttaatacatacgattgtaaaataatatatgtactttgtattgtgaatgcatatatatctatattcttaatattttattttataaatttttaaaagtatatttatttaacaattatttgtgttaattaatcattataaaatatataaattatagttttcaaaatatcttttaacttgataaaaatatctatatatattcacatacttttgggccaaagtgaaaatgatattcattctatagatatttatcagctcaagaattgcatatacaagtaattaatttgacacttttgttctttaataaaaaattaggtttgatatttgatttcacaagttgtaactaaagttattgctttactcctcaaatgaaccaatttagtaggagatcagaattagttaagtaataaataaaaatttcataaatctccttgtaaaaaatagaaaaaaaaaacagtctgagataatagtattatattgtatttaccgacgcctcgtcccctttgcaactctcgcttgtctctacgagacattagtcacgtgatccactgtagaacactttgcccaacaatactaattgctaaaattctcttatacttttaaaggacatatatatacacacttgttgttttagtattataatatatttctatacccattgttaatgtataagtttatcatttttttaaacaaaatgtataattttattcataaatcatgaactgaaaaatgaatcatcattttgtaaaatctgctttatattcttttttagcaaatgcttatattttttatacacaagaaaattatatttccgtatctccttcaccttaaaaattatataaacacttttacaacgtagtacactccgatccggcctccgtcaagaagctatcaagaatgcaacctaaacactttattgcatatttgaagggaaaaaaagaaacccgatatcattattaaagggatagaagcctatgtggagtgtggagtgtgcttcttattttgagagtaagagattgactttaaatttgtgaagggaacatgtctcgaaaagttatgctgaaaaggaagaatttcaatacaaaatatctaaagaaaactacgttgatgcatgaaatatccaacaataataggacgagctgccacgtctaacccacaattttttccttatattttttttgaagtttttccttcaagttaagccgttaagcttaaagaaaaacttgtcgttagtataaaaaatgtatataggatatatgatttttgcaatgtc

SEQ ID NO: 831 - DNA, 1300 bp, Glycine max
  Soy_ogl_4734 Gm14:12997901..12999200 Cluster 3
cacaagccaaaacagctacaagctgcgagaaacaataacaaaaagaaaacattggcacatttagatattaaacctccaaaaaacagtgaaaggatcaaacgacaaccagcaaaatcagtacgttgtaaacctcctgagaacaccaccgaaacaggtaagatactgagagtttgaatgttggctgtgtaaaccttcgaaccagcttctaaacatgttcaaatattaccgtgttctgaatacgatgatgatgataacttttcttgtttaaaaaaattcagccttacttcctctgacaactaattgcactttttattggaaaagaatttatatatttacaagtgtctctacgggtatctataaaatttaaaaatttcagaggtacttaaagttttaggatattgataatgaaaatataaattcatatgcaaatatccattaattcaaaacttttaatttataattttttaaattaattttaattgaagaaagaatcaattatagcttagactagtttgtttcttttgtaaatttattttcctccttgtaccaaaaaacaattatgaatgaatatatatcgttattacacttaaagttaattaaaaaatggacatcaattaaaaaataaaaataaaaatattattttagaataatcaattaaaattttagatatattgttttgattgatagtcttcaacaaattaaaatcttttgttagggataatcaattaaaaaaattaaaaaaaaagtaatccataaaaagttgtatgagttaaagttaccatatagtgatgtttaacttttatgcaattaagtgtaactagatgggtgactcgtggggttatttgatttttttttttaagaaaccatatatattaagaataaacaactttaaattgataaaaatgaaataaaataacaataagagttagaagatctaaactttaaagaaccaaaatacaatttactgaatgataacatatggttgcaatgatgaaaaaataaataaaatataaaatattaattgcttgaaactgaaatgaagacttaaatttatcttttccagaaatgagcaaagcagttattccgctagaagctgcaaacatatccctccaaataaaagtttttcatgttctcccaaacccatatagaaaaaacaattttgacttcttatcattaactctatccattattgtctcttatattcttctatattcattcatcatggactcatggttgacatcaattgaatatgttcttgagtcaaaacttctttattatagtctagcacctcatatatgtt

SEQ ID NO: 832 - DNA, 1400 bp, Glycine max
  Soy_ogl_4735 Gm14:13000301..13001700 Cluster 3
aagatattattcatttaaatagattggttttatatgttttattatttagagtgatttcatatttatttaataattcaaggttataaaaataacctttttatccaacatcatctaaccgatcacatgttataaaattaagtttcattcctttaaaaaaattaattttatatattttattatttacagtcatcttatagaaattaaatcattcaaggtccataaaaataacctttttatttgcatgttacaaaagtaaggtaagttttctttcaatatgttgactttatatattttaatatttagagttatgccataggaattaaaacatccaaattttaaatagttttattatcttttgtttattttcaaatggaaattttgggatagatttaatgactaatgaggaacctttttatccagataagattaaaaaaatttaatttactcgtgaattagtaaattaaaattaaagaggatattttcaagtaaaacccttaattaggttattcaagttttaaatagttctattatcttcttttttttttttccaatatcatctaaccgatcacatgttataaaaataagtttaattcctttaaaaaggttaattttatatatttttttatttaaagtggtctaataagaattaaataattcaaggtcataaaaataatttttttatccagcatcgtccaactaatcccatgttacaaaattaaggtaacttttcctttgaaaagattgattttatatattttactatttagagtaatctcataagaataatccaagttttaaatagttttattatcttttgtttattttcaagcgaaaaatttgggatggttttgatgacaaattaaggaacatttttatcaagataagattataaaaacaatttagaggatagcctggtaaatcaataaattcgaattaaagatgacattttcaagcaaaacccttaattaaagaatcaagttttaaatagtgttattatcttttctttattttcaaacgaaaaatttgggatagatttaattacaaaattaagacaaccatttttattcatataagattagaaaaaacaacaatttattcctctagctttttaaaatatttttattctcctaaaaactaaaactcagaaaggaataacaaataaacttcattcttattaaaagcataatgaaactgattacataaaaactgcataaacattttttaaaatatttgacattctctttgcccttttccactccaaacttaacaataaatctatcttaaagcttgtttgctttgcagcacataagccatcctcaagtaagattgaaacaaaaaggagatccagtgtctctaactactttgcaaggtcatcgtgtcttgaattcatcaaccaataa

SEQ ID NO: 833 - DNA, 2036 bp, Glycine max
  Soy_ogl_5054 Gm15:15022820..15024855 Cluster 3
tatataagtatatttagtcaaaattataaatttaaaatcaacttatatctgttataaaatcagttaatatagtaatttgaattttttataattatttttaattttaagtcaaagtaaataattaactgtagttataaaaccaaagcaccagtatatataaagttaatgagtgttgttcttttcttattaaattattttacactattctctttcataaatatggcacacccattaacaaaatatttatataatttcatatattaagaagatgacttatgtttcatattttcaatcataataactgatttttcaaattttcttgaaaatattatatataaacttgataagttgtttctttttgtttcattattttacactttactttatcattaatatatcttataatttacttaatttatttttcataatttttatcatttatatgtaattcacttgtacgaaaattgaaacttaattcctttaaatatatttatcaacttatatttttttattcattatataggaaaaaataaatgaatttaatttatttttgtaagtttttgaaccatttgaaaatttatatacgaatttgtaaattatgttctttaattggatatgtaaattaaaaagtaggtcattaaggttagttcatatggatctattgtttatggtaattcagtatgtttaattttgtatattacacgatgttgtattacaatagtataaaaaacttggattattatgtacacacttaaaaaaaatgttaaaaatattatgtaattgtaaacatacataaattgataaaagccaaagaaaatatattatttatctacagttataatcactctttaatcataaaattcacccttaagtgcatgaccaaacaataattatattttaggatgattcttagcttccttgcaatttatgaaaacaaatgaccattttgtttgtagatgttaatgaaaaaagattaatttcatattaatttgcagaagatttggagaagattaaggacacgtattactgaaaaactaaatttattgaaattaaaaaaaaaacatatagaggaggcatcaaatttattgaaaattatagttatgttaacggattattcaaatatagactgtaaattaatgttaatagttaatttaatgtaaaatgttaattaatattacaatttttcaatttttttaaataatttaaaaattagttttaaattactatttatagaggaattcgtattataaaaaaagtacattataatcttaacaactttgttttgcttcgttctcctgtttcaccttatatgtctcgcaaagaaaattaattaaaatatgtaaatcaagtttaataatatatagatttcattattcatttcataaaaaagaaaaatcattattcatgatctcaagctcaccattatcactctatctgatttctttgtatacttaacaacttttaaaaaaattccattatcattgataaaaatataaaaaattctctatccttactttactttaaggaaattcaattattattataaaaagtcaattattcaaccaatcgatgactaattaaattataaattaaaaagaactacatgaaagatcttttaaattttaatttaccactaattcaaaaattgccagaaattttttcattgaaagtataagcaaaataaagaaagaaaaacacatcagtattttttgtgacataaaaaaagatttcaaattgaaattagaaaaagaaaacaacgagtgtggattaagggattttgatacacaaataattaaggaatttcaaattaaaaatcaaattcaattattatgatttaataaaaaaaataattaaaaaaattagcattgattaatatgaagaaaaggaaatattgagtataatgttattccaacaagtaaccgtcgatattgttctcacttattaccacaacaaacagtaaaaaaacaatttaaaagacttaaagcacgtaagaagaaagacaatttttctcttttgagtaagaaaaagaaacacaa

SEQ ID NO: 834 - DNA, 2805 bp, Glycine max
  Soy_ogl_5078 Gm15:22415101..22417905 Cluster 3
atataaaaaaattaaaaaaaatgctattaaactaattgatctaaatcaattaatgatagcaccaaataaatgatatttactaatctcatcatcatcaaaatgagattttgaattccaattgctcaggtaattcgactatgctaattcaatttggaccattgttgaaaattgatcaaggaagttatgagttttgacgtggatggagaaatttctgctgcgctcataaacttttttgatccccctctatatcaacttatttgttttcgttttcaaataaggatttgtttttgttccaatgaaattgattcaattaatttttcccttgtagatgatcggtaactgtcagaattcaactgatacatcatgtgactacgattttaggtctgtgagaattcgggaatacagtttgttaccaaccaatagtagtaatagactgaaacactattaaacagactaaaatattactattttttatcttagtgttgtatttgagagaaaaattatttgaaaataagtgttgcattttacttttataatattaattgttcttttttttttttaccaatattccttataatttatttaataaggttagttttataaaattatcattctttttcatttatttattaacttttttgtctgtataaaataagatttgtattatttgtacaacccataaattaggactatgaagaacacgatgtgtgccttttggcttctgttatttgttatctctatctaaattcagaaactttaaaaataaagacaattatttaaacaataatttatgactaagatttaactaaaaaaaactaaaaataaaaaattaagatacaattttaaaaaaatagaaataacggttaagatcattttaccgtcaattatttgatctgaataaaacagaagaatatattaaaacgagagaacaaattatgtgcacaaatagtttaagagttttctttttaatattctcaatcaatgataaatcccaattatgcttttatttatttttattgtgtttttatttataatttttatgaatttcaattttttaaaataaaatatcatacacaaaatgtaaaataaaaaataatattttgttttcactattttatttttaaatttgaatattattaaagtaaaataaaacaacaattttacaattaaaagtgtttgaatccttgcattcatttattatattcatggattttatttttaaactaaaatcatatccgaaaaataaataaaaaatattccattctcaattattttgttttcacttttaaaatattttttacaactaaaaaaataatatttttacttttaatttttaaaattactattaaagttaaatacaataatgtgcttataattagcattttcaaatgggagaaacatgttaatctcttacgtgttacttaaaaattcatttaacatgaatttatgaatataacatattaaaaaaattattttattttattttctacttatatatcatattttaatttgaataaaaaaaagtaaaacgagacaaagttttaacttatttataaaaatagtatagaaaaatttactgcacaatatttttaaaatttttgtgtctcttttggttatggacccatgacgatcacaccctagactatgtccaaggccgaccatgattgtaatatgacatattttatattttaatatgacacattcgattttctccatcaaattgtataggttaacaatttatttatttttatgtaaaatggtagaatgagaagacacctctcgagtactaaagaactagatgctaatgacatattgtgaatttgtaagtgatatcaaaggcctacctcacccaccaattaggattttaatgatgcaaggggaaatcaaacagtattataaagaaaacaaaaattaacttctaatcttttaccatttgtttcaactcaccttggcaataaattttaatagttgacaactttttatgaaattgtatttaattttaatcattcacaaaaatagtgtgactatggcttgtagtagtattttaaatattacaactagtgtgtacacccacgagaggaacaggacgagttggagtaatttttaatttatatttaataacatataaataaatttatatattcagtttgaaaatattagatataagaatcatattctaagaaattatttaataatcataagtatttataattactaatttaacactaactattgtcagttttttaaagtatttatgatattttaaaaaatttataatttcaaacattccgttataactatttaaaataattaaaattagtaaatatgaatttaattatttaattccaattattataagtctttttaaaaaaactcttataacatttttatataatttaaaattttaataattaaaattagtaaaaaaaaatattcataaaaattgaagacatatattagggatttacaacaattgtaaacatatgagctagatcgatcttctcagtaagaaaatattttgaaattactaatttaactcaaaaaaaacttatttaaatatttttatataaaatgtttaaaaatttaagaagaattataaatttttaaataattagaataaatataattgatttggattttttaatgattaaactattaatagtttcaataaaatatttatatcatttttaaaagttcaaaaaattacaatagcttttatatgattaaagttatcattatttaacctatctatttgatttaaataattcccagtttccataacacatctgtatcaattttaaaaag

SEQ ID NO: 835 - DNA, 1600 bp, Glycine max
  Soy_ogl_5107 Gm15:42332601..42334200 Cluster 3
aaaacaatcagtgcagattattattaagaattagttccaagttttttctatttgaaatgaatcttcgtagtgtgtatgatcatctctatgttttttcctctttctaatttgcaatcactacatttttagaacattacttttttttaacataaaaattgcagtgtttggaacaaagtcagaatgtttagaaagacaaataaggattaaggaattgtaagctttatgttttcttatttcaattttttcatccgttgcaattgttttttcttaaaccaaacaatatgctatatatgttatatcctcttggggacggccactaagcttcggatgtcaaggtggatatatgcatatgttctctaagatgcatagtgggtttgctttcattcatccttgctatagatttttatttttttctaattattttctttctcaatatttacgcagttcctttgtttctttttatgattgtactattttgtttatagcattttaagttttatgttttaccgtaagtgaagaaacatagcatcttcttggcaaacaaatttgggtctactattgttcgtcaccgcttgagcaagatttctgatttatttgccatatgatttctttagagaagtaaaacttgatggctcttgtatacttaagatttcacagcttttatcaaccagttttggtatggtatattttatttgtaatttatatacttcgatcaatgttgtctatatgaagaaaaaaaaatctatcaatgtcttgctgtaattttataaatcatgtgtaaattctcttctcaacctctaattgcccattaccttccgaaaataggccacaaaaggtaactttgcaagatttattcttatgtaaaattgtatatttgtaatggaaaaaaataatcatgtacttcacattactaatatagtagtgtttttaatcatatacggatgataagttaaaatattagaagtgatgtagtttgaaatgttaaaattaaaagaaattgtcaaattttaaataatagtaatttgaaattttaaaatttaaaactttgacagtttttaaataatatagtactttattaaaatatccaataagagactaacagggtaattttgaattttaaaataaaaagaattagcattttttaaataatagtagtttataattttaaaattaaaaaaggccaatttttaaatagtagccgtctagaattttaaaattaaaaaaatggaagtttttaaataattgtgatttacgtttttcaatcttaaaagtgggggaaaataactatattatacagccaagcaaataattaacaaataacagtggtttatctaataaggcaattaaaaatatcaaccaattaatttaacaaaataaatattaaaataaatataggttaccataaatagtaaagccacaagaataaaagaaaaatacaaacaaacaaacacatttttagcaaaaaaaattataaactaaaactaacacatgccaatagtttcatttaatagttagtatattaaatccaattacatatcgatgcgtatgataaagatataaccttttatgataattccttaaccttgtatttagatggata

SEQ ID NO: 836 - DNA, 1700 bp, Glycine max
  Soy_ogl_5133 Gm15:46965601..46967300 Cluster 3
tttcctatttagtttaaatactcacaaagtctcaactacaacaagttgaaatcttaaattaacatgtttattggaagggtgagcctgtaatataagtaagatgcttaagggtatgcttggataaattttttgtaagtatttttagaaaaagaaaataagaagaaataaactaagctatatagtccataagttaattaaaattaatttatagaattttttttacattattttctttaaagtcttatttttaagttatgtataagctaattttatttgtagagtttttaaagatatcgtgagttgtgttaaaactattctaaccaaagctagagttttacagatctgtcgttacattagagttcaatagtaaaattttattctaaggaaggtaagaataaatttaaacttgtattgaactaaaataatctgtatctattaatacatatttccaaactacaagatttattttaaataaaattaggaaccataaaaaattgtcttaaattaattttgacattatttgaattgatacttttggtattacttatattaattaatataacattacctactttatatgagatgcataaaatattactattaaatagttcttttttaagaataaacttagtatagcatgtgcgtcgcgcctacgggtcaatcaaactagtataaaaagaaaagaaaaaaacaaattatatatatattgatttcaaaattattagtattgctttcacacgttagttcacgttttgatgagttttaattcagctttattttgttgactaccgctataattagtcattctaatcctattatgtctatcaataaaaaaaacaaattgagaaaagacattcttttttttagtataataaaaaaaagtaattaaaatttttatttaacacccaactaattcctttcattgagtcattcactttagaagtaaagtaatccttccttgaattcaaactccaatctttaaataagggagacaattattcagctacttgtaatgacgacttttaatctgatattaaaattattctatgagcatgtaaattaattgatacaagattatttaatttattaaatagtcttatttttaattttaaatacataaaaaccttaaatatttataagaagaaaaaaaatatcacttataataattttataccagttaaaaccaattgtgtttaactcaattgattaatcatatacattcaattattataaatttatgtattcgattactaccaataaaaaaaaaaacaaaacaagattacctacccaaaaagaagattaagaagaggcatgaatggttagccaatgttatcgaggctaaacaagaaaggaaaaagagaaggaaggttgattgagaataaggtgtgataaaaagcccttgacccatagggtttgtccccacaaaagcagaggatagaaaagatgtgtgtgtgtgttggggtgtgtctgcactaaaagttgacactagaggacacaaatcacaagtgtctgccttgcagggtccttctgtgtcttgattggattggcatccacagtatattcttcgacatccactcaataatatgctcctattgacctattccaattctttggttctttttatcatctcctctactatttgctgaaagcactgtggggtactagaaaactttgtctctttctcatttccccctttcggt

SEQ ID NO: 837 - DNA, 2700 bp, Glycine max
  Soy_ogl_5156 Gm15:48247501..48250200 Cluster 3
tgaatttaatatttaaaatagaaaaagagaagttcaaaatgaaacatgtattttcttgagaaaaagtagagtaagaaattaaaatcacactgatataagttaataaataagggtaaatttatgataaaaattaaaaattcattattttggtatataatcaaattaagatggttttatcagccaacaattttttcaataagaaaattgataaatttattgataaagatgcaaatatagacgtgttcatctatgtactacaaaaaatgaattacatatttttgccgacaaacaaaatccattgatttaatattggagcactgcaagtggtattaattcaaagaaaatatataagtgaaataaatttaattaatttattataacatgaaataaatataaaaaccatttataaaaaaataacacattttatgtatgcaataattaatagcccataggtaattttatgcctaattaaagtgataattttgagatttgagtccaaggatatctctttcagtaataaaaatcctaaaatgtgtgaatcaattcacgtgaaatctttttaatttaactgatagtgtctagtttgaatcaaagtatatatttaattatcttaaatacctgaaagaatgctttactaataataattaattctaatggacagaattacttctaatagaagatatatgtaatatcaattaaagaaaagtaatatagtaataaaagcaatgttactaatctcttctacctggaaatgacgatcaggtaaagtcgatcgtttttaattaactatacgagacacctatattaatatatcagagaatgttttgtatgttttgacttttgagcaaactagcaagattagttacaatgaatgcaaaaaacattagtattatataagcaagacagtttttctgatacacacttttttttctttctatctcatctcctagaagacaactactttattttattaaatccacaaatacaatagctaataatataagtcattgaaaaaaaaactgagtgcatatgaattaactatagctttttttagtttttttttgtgagaataaatttagggggagaaaatgacaccccaagacaaaaaaaaaaaaaaagattccaaactcaaaaaacacttatgaaaatatttatatttatcttacccaaaaaacagaaataagaatttgagtctcacgtgagattttatcttgttatcctctacaaaacccgttgaggcataagtgtagaattaaattaagttgcattgcatgcccttaaattgcgcagtgtgcacatggcacatcaacatcgtggtgatagctagcatcacgttctctaatgcaaaggtcgtattcatattcatcatcttccattattcttctttttcttcttcgttagatcatgaacatgcatgtttcgtgtatacggcggcataaaacccaaacatattgtttctgatgctattttggtgggaaatgattgaagatccgataaagtagctgatgcatgcgcaagaaacagaagctaatcgaatgacacatatggtctctgatattattcacgtgcctacatttattctttgcatttcctctttcacattaactatatctgtcttctttcttctctatagatcgatcgttttggtctctatatgtaattacagtgtctatctctggattgtcttctccactggtcaacaataattattaaaatgacgctgcaaattttgaaaactatattcatataaaattggatagataaaagaaactataatttataatatatttgtgagtttactttatgaatttttttttcttacacccttcttttccttttatttataatagtttacctattttattcaagttttatacttccgattctgataattattctaattttaaattttcttttcttcaaatttcatgtgactattgattattattgatgatttttactggtaattaatctgattgaaacttaatgaaaaatttaggcatgctaattttacgtcttttgtatctttcattaatatgtttattgctaaatattttttttatgaattttcttattagaattgtaatgtgtccaattatgcaatgttggaatgaaatataactcaattttatttttattacaatttaagaagggtatttgcttaaagttacagggcatatgcatatgattttatactttaatttttatagacttgactactttttaaatattatttttattgaaatgaaaataatttccaagaaaataaaatattaaaatattaattttatataaataacaactctggtgctaaaaaaaacaactcataatttctatacgattgtatttcaattgataagtgtatatacatcattggtatataaaaatttccaataaaatacatttaatgtaatatcctcattcatttgaaaataaaatgatatactttggtccttttaagaaaaatgtggcatctataaaaaataaagtatgatgaattccttttcaataaatacatatggattttattgtagaaaaattagttgcgtcttttaaaagctgaattggaataacctatggaaaaccaatgctaaatcaggttgtaaagaaattatttctttaaatttatctgtacaaattatatgacgagaaacttttaatttcaattaattttccaaaaacaaaatctatctttatcca

SEQ ID NO: 838 - DNA, 1254 bp, Glycine max
  Soy_ogl_5157 Gm15:48285661..48286914 Cluster 3
gtttgtcaagtaaacgtaatacattgcacgagaccatatattcaagttatctgaaatgcatgtaagttgtctacgtacatatatagaagtaccaaataagtaaggatggtaaaccttacaagtacagtattgatttgactactattttatatttttaaatgcaagtattgtcagtttgtcattcctatacttggataagttagtattcaaaataattactttttgtgtgtggactaataatagactctcggaatttaaagactaattttttaaaaaattaatattgagattcttaaagaggatttttatatttttcaacaatttatttccctactaacgattaagaataaaaacctgaacaacatatttaagggacacagtaatttgtcaactatgcctgtttcaaaattacttttagatatcaataatttaaaacttaaaaaattaataacaaattactactcacaatcttatataagcaatagatttttcttggatatgttaattgcatggtaattgattagaatcacacattaaaaaaaatattgattttttttttcaaaaaacagtcgacgttaaattgaaataaattatttaaaaaaaaataaagcgacatcaaattaaagtacttacaaacaatatatactttatataattttgatatacatcttatatacagttaaaattttaccctcaaattatgcatatttattttttatgcatttaaaaaattaaagtgagttgaatgtcagaacttataaaatttaatacaaacctcaagaattaaaaagtgcttacagttacattatatgtttggctatcaacacgttctcatattagtaataaaatttcaatcacaatatgaactttatccttgcctttattcatttaaaactataaaaaaatcattttaatttttattccatttgagtaattaataatattcccacacaatggaataccctagctgcatgcagattgtgatcactgacccgcacgagcaccaacactgaaccgacacaacccgaaatatttgacttgaacaaaaagcacacgtgctgttccttaaacaaactttgtcacatatattaacccaaaactatataaaaaatcttcggaacaacgtaagccataagcaacctctaatcataaattcactatggtcccctacgcctcccaaaggatgagcatttattgctacacgaagacctttcaattcaatcatgagtttgggtcatcaatttaacgcgtaca

SEQ ID NO: 839 - DNA, 2111 bp, Glycine max
  Soy_ogl_5198 Gm15:50521278..50523388 Cluster 3
ctcttgatccttattgtttttgatttgttgcttgtatatcttttatttggaaaacatatgttacaactttatatctttgatataaaaccataagaagttttcctaaattgttttcaaagttcagaagaaacatataatcgtttctataaaaaaataaaaacaaaatctacactagctagagtatgatatttcaagtagtttctgaagcattatatgtcagtatctttgtaagaatttatcggaaaactattttcatacaaagtacaatagagggataaacaatgctcctaacaaggcttctgataatctaaattttgatttatctttgaaacatcagaaattgtgttctttggcagaaaaattcataaccagtcaagtgtcactattcaatccctttgtagtgaccttcggattcacttcacaaagtcccgcgaacaaggctgcacaatcagaatacaagtctagcaaagtccattccattaaatttgaattgttattatgaagtctagattaacattattgtcacaaccattggatccatattcaaagtcaaatccaatttgacactatcttatataatttaatttgacataatttttaactgatgtgggagttgaagtttttcctaattgatattaaccatagttctagaccagggttagctactttgatggggtgtgacattagccaatagttagtcgtgcagctggatttcaaccatgtctagaataaatacatataccttaaatgagggtgattcttccttatacatattatgttgatcctttctgcatggtaactaaataatcgtgataacacaatgatgtgcaattattatgttttcttaactcctactgatagttacttaatttttcaagattttgctactgtgtactatgggtgcatggttttcactaacgatgttcatgacctgacttgtctcactctaactcgtcccctgtctgaagttaattgtgatgagttcaagtttcgaaaataaatctggtgtattttgagaacaactgaacaagtttgagttgtactttaggtcgtctcaacccaatccaatattcttttaaaaagtatatttttaaaataattattaataatataatttcttgacttaatagataatattttatataacatgatattatatttataatgatattatccatctcaaaatatatcttgattgtagttttatatatttctttaattttactattttactatacacaatgttaatattattatattctacaaattggattaatttgatttgtcctagatattcagggttttaattatgttaagatcggatttaaataaataacccccatcgaaatttagtagagacagagtattaaattaaggaaaagagcattaagatctcctaaactttagtcattttgtaaaacgcaccttaaactttaattttgtccctccttttgtatatatgtcatgtgctcagactcaacattccttgtgtttggtttgatccattggttttggttaataataatatggtttctctttgcctttttaaaaaaacactttaatttaattctaattaatccttaaattttacttcttttgcaaatagacatcatcaattttaaattttttatgattgatatttaaattttaacttttttgtaaatagacacttgaactttaattgcgtttcaattgataaaaaagggttttatttgatttattaattctaaatattattatttttaatgtttgaaaaagtgatttataaaaacaaagttaataaatagttgagattaaataaataagcaattgattttttttgctagtaatttaactccaatttaataaatgatatttttcatgaaatgggaatttttaaaaattaattgagatgaaattgaaatttaggtgcctacatacaaacgacttcaagtttaaggattgattgaaatgataatatggtttctctttgcctttttaaaaaaacactttaatttaattaggataaaattaaagtttaagatatctattttaaaaaaaaagtaaagtctaagaaagctgttaacatatcatcacatcctaactcatttcacgtacatctctggtttaca

SEQ ID NO: 840 - DNA, 2400 bp, Glycine max
  Soy_ogl_5646 Gm17:12089701..12092100 Cluster 3
ataatataaataccccgcatgtctaaaaagcctacttataattatttgttaaaaaaaaactattaggatgaggatattgatttaggaaaagtgaggtttgaccgtggaccagatccagcaaaataaaaacaaagtaactttgaccaagtttgcacgtggtgtagacagacatatacacgtgtactttgctgtctgtcaatgaattggtgcgccaagtaggattcacgtgggtttgccacaccataaggtgagaaggtgaaagagaatcttattacacccttataaaaatacatttaatatgtattgagaatatttctatcattgattttagttaattgtgcataaaattaaagaaatatatgtaagatcagctataattatcaccttaaaaatggatttttacagatactataactgtatattattagctagtgtacggcctttgtcacaaatgtgacataattttttttatttgtgagaatttaacccaacattaaaaaatttataatatttatattttattcaatcagttaaactttattggtgtgtgacataagatttataaaaaatgttagtaacatattttttaaatgtattctttaatgattaaactttattaaaaatgacagtttttttaatctctagttatatttaattatttcttcatttgattttatatttttcaagaaattttaactataatatgtgtgttggaaggaaaaaattgaagtctattcctaacactcctcaaaatttatttatctttttgtttattcctactatcttaaataaaataaaattaagggtttataaatagaatcaagttaatatacacctaaaaatatgattaaaaactaaaattaaataaaataaaaaattttaaattttaaattttgaattttttattgaattattttattaaaatttaatttaaaaaattgattagttaatgttattagttaacaatattgactaaaaattgtaacatagaaaaagttctgtgattttgactaattaaaatttagattagagactaaaaatataaatttaaaaaaaattaaaaactaaaaggataataaacccgaaattccataacataaaaattgatcatattccttaaaagaatcttcacaaatgatattttttttggggggtcaagaggaaaaatacgtaatattatttgtaaagaataatattactttttttctttttcacagaaaagtttaattatttctaaagtatttttgttatgaatatgatattacttattcatacggaattcttcacaaataattttaaacacacatatcagtctactgctattgttgcttgccaaatcaagtgtgaattaggcatagttacgcaataccatcttaattgcgaacttatattttttttattcatggtgatagctaacattatttcttgctctcacaatcacataggctaacacttaagtatccctttcacaaatggggatcgttcccttaactttgcaagtgaagtggaaaaatgaagtcttgcgtattcgtcaaattctttaagttgtaaaggttatatatggatatacctatgacattagaaagaaaaatgttttcggtcacaattgttcttaattattcattcaaaatgccaaaaaaaaacttacatcacaaatagtttactctatagaaatgcaaaacatccatttctgatccacaaattccagaaatatccttctggtacatcaagaaatccatctctatgctaataaaataagccctcgtaagaataattatagctaggatcaataacttttgttgttgctacacataaacattcaataagattcaatgagggttgtgacctgatctttgaaatagattcattggaaatattatttcttacaaaattaagcaaacaattatgtatataaacatttccatacatgagattcttgggaagggggcaacttgaggagaacattaccatcatgtcctccctcaccgatgaagatacttttaccaatttttcttatagtactagtggttaaaatttagataacatttgcttatataatcctcccaacaatataatgagcctccttagttgtgtagcccctatatatcattgcaaaagtaattacaattttgatacaagtgtcatatgaggatactcactaattctcctccttcacacgcttttttacttcatcctactcattcttgaagatgctcgacttgcttcgtcctataagggtcacaagactcttaaattttttaatgatttagcccttgtaattttgcagattgaccacaattaatttgaaatatgtccttactactaccacaactaagggtcaagtccttcaatcatgagtcacgtctacctttcttgtgggtggactatacctgtgtaacc

SEQ ID NO: 841 - DNA, 2300 bp, Glycine max
  Soy_ogl_5727 Gm17:35367901..35370200 Cluster 3
cacgtgttctccggcctcctcgccgccatcagcaccgagtgccttgacgacgagtgccacatcatcggtttaagcatgattggcggcgaccacccctctccaactaccgcttcgtcaccaccctccacccctgctccgccgctggcaccgtcatcgtcgacgtccccgccggcaacaccaccgaggacatgcacgtcttcatcgacaccatcctccgctgcaacctccggattatccttttcaaatgctcttttgaattttaaattaattaacgaaagtcttaattaaaattgtccattaatttaaattttaagaatttaccaaaattgtcaactaaaactgtacagtttttttttttttaattttaagaaaactatgaacttgttaactatttttttaactttggcagcctaccaatttgtaaattgataaaaaaaaaataccaatttattactgcttattttttaaattgtaaaatcctaccaatttgttaattaaaccaacgtaaactaaactattgttatttaaaaaaatatgtttttaatttaaaatttcaaactatcccactattctcatcttagctttttaaagaaatccctactttttttaaaacagtcaattttttaattttaaaattcaaactactccaattttctattggtttttttatatcatgtccaatttttaattttaattttaaaaaactaataattaactataaaccaaaattttaaaacaacaattatgatattcatattttgtaatgactgtattagataaaatagattttttttaactcttttaactttaagcatcaacatcataaattaactattgctgtttagacaaaacaatatcttcttaaatttaagatttaataatatcctattattttcttttatttttcttaaataattcagtattacttaagtattacttaaatgttgtcattttttttataaaaaaaatcccaaactatctcactatttcctttaattctatttttaatctaaaaaacttgaaatttattattttaaaaaaaaagataagaattatttttccaacaataaaataaatatacgatgatgcctatgatttctttttttaaatttatatataatataatataataaaaatgtatacacacagtgcggcagttaacagagaaaaaggatcataatttcatgtgcataaaaaaattcaatagatgaatttatccttttcaaattaacataacatgattaagagccataaaaattagttttcgaatttattctttgtaaacagtaaaaataaattatccttttcgaatgctctcacattatcataattaatttcttagctcatgtacctccagattagttactgtttgaaattaaaggtcccgttttattttatctccatcaatatagatattagataaaggggataccattactatttaattttttttctctttttacaagacatttatgtccatgtatacttattttcatagataaatttatgtttttagttaaggataaaaagaaaaaaaatataaagtaaaagtgaatttaatgcaataagtaactgatcaactcaacttcaagaataacccacttattctaatttgtgcgtgtaccttctcattgttaacctctttatttaaccaacctccaatgagaaatcggttatcgcctgtgtaattattattattttacgaaaaatatgaagttagtgcaaggggtgggataatgggtaattagttttgctttggttaatatataatgaagtggtgattataaataattagtgtatttcaaattcaaaattgtgttacttaattatgaattttatcttttaaaagaattaattctaactctaattactgttataattattttcaatttaaatattttaatttttttaattaaaacaataattgcaattatttcagaattttaaaatcaaatgtgttctgaaattcgaattgattataagaatttgatattaaatatttctgataaataattataaaaaaataaaaaaaactcagctccgctttgatcaatttttagatcgtccctgctaataagcattttttgttacaaaatatacaactaaatattctctcttcctgttactattattaatttgtatattatttttgttttttttctcatctttgttgtttttatcactctttttataggttctaacacccattacgcattgagtgcatgagtttaaatattctttcttcttattactattattaatttgtatattattttttaatatttttttaatcttctcca

SEQ ID NO: 842 - DNA, 1173 bp, Glycine max
  Soy_ogl_5735 Gm17:36701101..36702273 Cluster 3
aaattgagttcaattatttaaatgagtcaaacctaaactttaaaatctcctcccacacacacattttatttatatcattaaaaaattaaacttatgtagattccacattatcatattacatatttaacacgtatttgtattggtagattattgtctaatgataaaatattttttttaacactaaattgataaggttaaaaaataatttaagaaaaattttcacaaatttaaaaataattaagttataaatgagttaaagaagtcaaactcaagttttaattttttttaaacaagtcaagttcaaactttttggttttctttgatgaaaaaaaataaattcgtaaacgtggaaaaaaagtcattaaagaaaatatttaacttatttaaactcaagttatggtatttgtacatgtttggatcattgttttcttttttaaaaaattatcataattaattaaataaacgtattaattttcttaaaataaatttaatcatatacgcatttaccgtccttaaaaaatatggatgtcaaaataaaatgccttatagtattatataatgatcaaagttttagataggaaaatatgactaagcatattatatgattttaaatgttgaatacaacatattccacaaaaaatataatattataatttcattttgattaaattcagataatttcaagcaagttatttgtgttctcttttttatgattaaattgtaatttttatcccctttaactcttgatccgtgattttaatcttttttttttgtgattttagttcccacactttaaaaaatctgaaaatttggtccaattctaaactttgcaaacatgtgtttcttttatttttatattttaagtaataaaattattttttatgatacttaaaatgaatatgttaaatttaaggttcacttttgaccaaataaaagaaacaaaatatatgtaaaattgaacattaaactaaaattatgaatttttaaaaatataagaactaaaattaaaaaaaaatagcagagccaaaatccgtgatataaaattaaatttagcaaaaaaaatggtcaagaggtattatattatattttactgcaagcacagtgacattccttttatggttctcaccagcacactaggcttcagccggttcgatccatactgcaacaaagttg

SEQ ID NO: 843 - DNA, 1400 bp, Glycine max
  Soy_ogl_6053 Gm18:16560701..16562100 Cluster 3
taggtttacattcacgtgtgcttggcattgacgcattaatttttacttttaagggagaaattgtatatttaaaattaagaaagtgtaaatggtgcatctctcaaaaggaggaaattaaatacaatttattgtatttaaatcattataaagttaaatcataaatttgacattacatgtttgtattaataaatatgattaaaattttattcttacattttatggtacttagtttttaactttatatttgttttatctattattaaaatgtactttttggtgcattaactaaaatgtacttaatatgtgatttaaattattttatgataattattataagataatttttataaaggtttatatcaattagaaattattattcagtacttaatattaatatatatgaagattgatataatatatttttaaaatacacaaagacaagagttacattattatattttaattgtttattataaaatgttatgtcttatactgtggtatttttttgttctgcctatagcccttttttattaattaactagatattcatttttttaaaagattagaaaggccaaaagaaatagaaagggaagctaactgtttttttttttttttgagacaacaaatttattaaaagccaatcaaagcacaagtggtgccagattgcttaaaaacgtataaagagatcttgacacaaatagctagagcaccattctccaaaaaaaataagcccaaccacttaaccgaaaatcctattgctattaaatcccttccaacccattacaaagttccaaaatacctgcaccttactgttatatccacctcagtaaatcagtataatacaccaacagttcacaaactcgctcgtgcctttatatcagaactagttagggacccgtccgtatgcacgggtcgccctgcatcactccgttatattttttgttttggtattaaaattattcttaaattaaaaattttattttttttaatgtttgaaaaatgagaatttaagaataacgataatttgaacgtaaatatgtgatttaagtatagttattattatactttattgtttataacattataatatataataaaaaaatgttgcatacctaagcttcaaaaaataaagaaaacaaaatattgagttagtacctagttaagtactcatgcgtgcgcactggtatgccaacaaattatatttacaatatagttatagacataaaaatattagacaatattttcatgtattcaattggaaactaacaaaataagaataaaaatgaatataagctaaaaaatttatgatcaagttgaaactagtttgaaggtcaagtaaaataaaaaacgatattataataataaaaactgtcaattaacaaagtatttaaatttagaag

SEQ ID NO: 844 - DNA, 1904 bp, Glycine max
  Soy_ogl_6093 Gm18:43809301..43811204 Cluster 3
atcatgcagtaatagatcattgtaattgaccaaaaatcaagacagcaattcaaacttgaataatccacatcaccattcatatcaaacaattatacaacaaaacaaggtgcaaaacatgaaacctagaatcctacgctctccgaggaccttgatgttgtttctgtagcacaaaggatgagtttgctatgtattagaagtggtaggttggattagcacgagagttctctgagggtatgcgtatgaagtacgaagtcaattaagaatttgattcttgcattattgtatctgatttttgtaatttgtgacatgctttaaagtttaaattgaaaattaaattgcgacagccaaaaatcaccacaaattagacatttgatatgtcatgtttgacctgcactaatgttatatgttgagagagacttaaaaaaatattttatgattttggaaaaccaaaaaaatcaacttttaatttaaggactaaaacaaccatatttgtatatttcataaactaaaaacatatagtaagtcgtagcatataattaaattcctaactaattatttgactttcaaatgaaatacatgtcttctcaagctaggtttatagttgtaaattaactataaaagttgataattaattatacacataaaattaaatagatttttaatgaaataacttaataaatacatgtactgaaaattaaattcatgtgcattccattccttagtaattatttaattcaaaaattaaaaattaaaaaatactataaatgctttcttctttatcaatttgaaatttacagattttaattattaaaaaatcatcataaattctttgttgaaattttaacttagaaaaacattattaaaatatgaattcaattggcaaaataagcatgtataaaaaattttggcaaaataagcactattaatattaaattaccaacgttaacataccaaattaaatcaaaattaattctcctaactcaattccaaaaataataattaacaaaaataattattattcaaatattaacggttcaagcttaaaaaataatttaaaaaattaaaccagaaatttttttggaaacctctttacttactttttataaaatgaaaaataattaaattcaaacacataaataacaaaacaaaaagttcataccatttcttcataaaaataaatcattaaaacatgtaatatattcatttaaacccgtaataaatgttttttttaataatatataaccgtttcaatataaataaattaaaatcaaatcaatataatagcatttaaactgatttaacgcagaggcatttttcacggcagaatccaatattaaacagcaattgattgtgaaaatcaatttataaaattaattaacaatatataaccgtttgaatcaaatataaataaatcaattaattataaataacatttaatcatatttagatggtgcaattttttaaatcgtgaggaatttattaaatcatttattcttaaaaagaaaatttatatatttttaagtgcatactaaccgcacaataacatataaatatatataaatttataaaataataccataaatcaatttataagcatcttgacttatacttaaaaagaaaaataaataaaaattataatttttatacctataatttgccaaaataaaatttattaaatttgtttgtatttttttatttaatttttaattaatattacaattattaaatttttatattattttaatatttcaattcaatcaactaataatatcgatttttcttaacaatatttaaaacatgcaacttattttgaaaaaaacagttaaaataaaaaggataacatcatacgaaaaataacccttcaacaaatgaaacgttaaaaagttaaaatgaattcattaaaa

SEQ ID NO: 845 - DNA, 1900 bp, Glycine max
  Soy_ogl_6214 Gm18:56797301..56799200 Cluster 3
cccaattaatttgtattttgctctggtatatttttttttcaattacttatttctgactacaaaattaaatatgctaatataaactaatttataaaatggatttcccaagtcccatgcctcattatttaagctactttcatttgtatgataagaaaaaaaagtgcattttgacattaataacatattgttaaacggtgatttactactataaatctatattttattggataattaattatattattagtacaaatattgatcggttttaacgataactatgaacctgcctttgaacttctacttatatagaagaaattaatcatgacattatattgtttttataataataataaaagttaattaccgttcttatatggaataccataggttccctaaaaaaaaacagaataccataggtttcctgatcgtaaaagatcagtatggggtattcaatggtttccttgacacctggactattttatggacttaataatactaggagattataagttgctaactctccttgatgaaaaataataggaaaaagttacatggacaccctgtagaacacccctgtagaacacatatgatcaaagagaaaaaatataaatatgatgaaatctataacgtgataaaagaaatatatagaaataaagagagaaatacgtatgcataatttttttttacatgatgtgtattgataaaaacataataaaatatgttttggttcttctaatatgtcttttttgtcattattatgaaattatttttaaaatagtctttgtaaaatttccttttttttgtttgttttggtccttgttaatttgttttagtcgttataatatatttattttgtttcgttttgatccttatagtatataagatcatttgtttttaacctctgttttcaaaggagtaattcaaaatgaacaaaataatttaagaataaaagaatgaaaatattacaatgctcgaaacaaaataaaaaggattgaaacataaaaaaaataggcttgattgcatatttaatttattaaccaactatcattatttaagaaaattttatcacgcgagttttttcttcattcattttattatcatgttttttttttcatttttgcgtattttaatgatttactaaatgtgtagtgctagagtatctctaaaaatcagtcattttagcatcaacataatggtaaaataggtaaaaaaaaaacatattgataaaatgcataaaaataaacttaggttgtaaaatatgtgaaaattataaacataatgataaaatactcagaaaaaagtcttaaaaaaagaaacttggagcctaaatgttataaggaccatttaaccaaaaaaaaaagattgagaaacaaaaatgatgttcacgtatagaaattaaattaaagcatatttaaatgtaaataaataatagaaatagatgaaatgtgtagaataaaatgatgttcgcgtataattagttatgtataactgtgagtctgtgagcaaagaaaatattacctcataaactaaaacatttagatataaaatatagaaagctttgataaaaaaaaatcatataaaataaataaatgttggtggcccttgcccctagaactaacataactatatatatatttagcgaaggattaacgaggaagtgccgttgcaaattagtgacggataagcaagaattagtgagaaagataagtatacaataaaataaataaaaaatgttggtggcgattatgatgcattagccagaaagagttgttgcaaattaataagagaattatccattttggatcatttattttgtgagagatttttcaaatgaaattacaaaggaggtcatgagattagtgagaaaatagcaatgggcatatttgctaattagtgacct

SEQ ID NO: 846 - DNA, 1600 bp, Glycine max
  Soy_ogl_6354 Gm19:2918801..2920400 Cluster 3
gagagtaccaaaagcactcaacatcatgtcacgtaatacatcccaaccatgtacaaacccatgcttgttcaatttacaaatcctcaactacctacgtgaccttccttaccatttattgtagcttttggttataatttatttaagcattaaagtacactatccttatcaatgaatctagttcaattaatcgagtaccgtgcatgaatgatgtaaatcccttgattgagttaagcccaataagtactccaccaatattgatcttccaagccaatatcatatttgagtctacactccaaatcaaaggattgtattatttaatcaatctacaaaggaaaatttcactaataagagatggtcaacgtattatatatctaagaaatataaatatataaaataattttgtcattttttggattcttacacaattaatggatgtccttgcatattttctataaaaaattaattttttctacatgttatgttgttgttttattagtgagaaaaaaaaagagaagattctaagtccattgataatataattgggatttgatccttgtaatcaaggatatatagcggaaatttatttccttctattcttgatttcatgcttttaactggaactaatatgtattagttttaaaattttgtttactaatatgtattagttttaaaattttgtttcactgtgttcttttttaatataccaaacataacatcatgcagttgtgtttatattctaacttgtatcttcattatgcttccttagtttaagttattcatgaatattatcatgcttatatatatatataaactatgaatattcgttgtgcatgtgtttgggagctatatgattgcgtaaatactctcctctcttttgtgcatgatgttagtaatttttaatttttaaaataagaccaaacaacaaatagtattgtatatgtcattatcatatggtaagaatgcacttgattatctgttgattgaaattagtatctttaataacgtgtcagtgatacaaatggatgttttaaatgcacttactcaatagacatctttatttattttcttctttctttaaatttatattattttatcgtcttttgtcaggggtagggttccaaaagatttcttttgttccttatatagttaattgtattgaatttaactaacaattaatagataaaatactttaaatatattaaaatatcttcttcagccgagaagagtaggaaaaaaaatcattacaagtaacacttggatcacacatacgtttatcttccccgcataaactttctagccgttgtagtgggttttattccactttgcaaaggaggttaatttacaaggaggtaagcctgtttccaagggttaaactggtaatgaaacttcttaagaatccctattcaattaatcatatatatgtcttgttttcatgcaatatagtatgctagttcagatccaaattcttatctagcaagttgtagtatctttaatctcttcgtaaaaggtctttttagtgacaaacatataaagaaaaaatgtatcttcacattagaggttatgtttttaaaagatctagctcattctttatatgaatggt

SEQ ID NO: 847 - DNA, 2640 bp, Glycine max
  Soy_ogl_6673 Gm20:1309189..1311828 Cluster 3
gtcattttatattttttaactacttcaataaccttagttgtcttcaataaaacaaccttagttatttaaaaaaaaacttaatattctaataaattatttttaatttatgaaaagaacaattttgtgtagatttttttgctaaatcaagagtcagagacgtcattcatccaataaccatatatttgaggaccttaactcgccctttgccattcagcagtttcttctagtagggaggggccaattgtgcatgtctagctgtttagtttattaatttttagatgtacttaaaaaattcagtttttttcataattcatgcataaagtttattaagatagtgcttttgagtttattttaataaattctaagatcaattttgtagtataattttttgttcgaatatattaatctgtatttaattatagtattgatattttttttgacaaacaaattattgatatcttaacacgcgtgtatattataaaagttttagaccaaaatttaaacacacaacctatactaattaattatatattataacaaagaacttagttatatatatacatttcctagtttctagatttatagcaaactattactatataataaaatgagccttcaatgaaacaaaagtttttcattcttttttttgtcaaattagttattagttttattagaatgttatgggaggtatttgaatccacaatttttttttatccactaagccaaccttataattcttacaaatttttcattctctaaacccaactaatgtcccaacaacaaaaatctaacccatgacatttatgtgattatattattaatgcaaactatgtcaatcgatcatgtcaataactaatatatttatttgagatcctgactaatcattgttagtaagatctcttttattaatttttttatatcaaaaaactcaaatctaaaacattattaatctatgagattttgattcaatttaattcggatgaaatgcacaacatattgatatgtaacccaaaatttcagcatgcatcgtttttttatgttattattataaaaattctcttatagaatcaactttaggttctattcttctaggagatcgattttacccttattctaattaattatttagaactagtgtttagttaaaaaacgatatattttcattcaaaattttaaaatcacatgtctttttcttttttaagcattcacatgcaaaattaataacaatgacatttattttctatatattttttgaaaaaactaatgtagtaacgtttatctaataactaacaaagatctggcaaaaaaaaagaaaaccacaaagcttaaaaaccaaacacgtattcattttgcacttcacatcgaatcatttttattgtttgatttcacatgctatgaataaatgctacagtgactaaaaatattggtatcaactttccaacattcttcgtccattttaacggttcctaattttactattggttaaagctctctcaataatagtcaatagtttcagtttcgtccctttatgcaccaaaagaaaaaaaaaagtttcctttctttttactcttaaaaatgtcctggatagcattatccggagctagctagtttgcttccatgatagcgacacggtataaaacgtgaaaaagtgagaccattggaagaacgtgagggaatcccacagaatgaaaaaagattcagaatgaatgcaatcactgaactaagttcatgcaccttattcaaataaaacctaatagtatgaatatataaagttaaccattgagttttgttcgccgaaaaaagtaaataacctaagttttgaatgcataacctagttaattgcgttattacattaggcacaactaaatatattcaaggtccaaaagaaaagtaacttggttcaacgcaagtcatattcatgttagaccgaaggacggtacaaaaagtagtcacagttgatgtttcgtagaagaaaaacttacactgcttcagtcttcaccatatcttagaccgaaggcctgtttaattataattctttcaatgatgagattatatgggagattggtaataagtcatgtgtgaacactaaaatggtgtgtttagattaacgttaaaatcatgtttaacaaagaaattgtacgttccaatgtaaaaaaatttaaagtaactgtattattttttttatcataaaaaacaagtatattgtaactttcatctcaaagtctattgacgttggatttaactgcttcctgaaatgaatatcaagacaacttttgattataatttttttttatcaataaatattagttgttaatagttaatttttttgttagtggaaaaattgaacccaccacctttttttctttttcttcttttttttactacttaaccaactttataactctattttttattatacggcaaactatttgcttaagctcttgcaatcatgttatatgttctctaagtgcctagacaaaacacttaaagttagtgagccttacccttaactttttcttagtgaaaatggtagaagcttaaaggttttttgttcaaagaatatctggttagctgcttgaataagcaagtcaaagaatacccgtgtttgagctaccttaggctttcattgagtttcaccaa

SEQ ID NO: 848 - DNA, 2300 bp, Glycine max
  Soy_ogl_6683 Gm20:1751101..1753400 Cluster 3
attaaagttagtctcgtggtaagagtttgagtaatatatacaaggttttaagtttagggtttattcattaaagttaaaaccttattgatgttattgtaaaaaaaaaaattgatgatatatataatgttaactgaatatattttagttatataagaaggaggtatcaaagttatcttctttttaaaataagagtcaaatttgttgtattaggataaattagtacttctaacaaatgatgaatttttttttaaaaaaacttcagtattcaactctcaaaaaagataattgttaagggacgtataattttgctgtatgatgtgaaatatatatagttgtacacacaaattttgtgaaggttattcctggagagatatttttttctgcaacgagactttgttctgttgatgttgatgtttcataataattattatttaagtaaataaaaactaacctaaaaaagaataaataaaaactaaattgttgtatcgggtttgggttgcaggaaaattgggcttaacctatttacaacctgagttttttgttttaagacgaaaacaaggttcttgttatttacacttacgcgtttgctaagtattccctataccttctctttatattcttttattgtcaagtatacccttttaacgttatctttacatgccccatgtttattattgcgactcctgaacatacgtccaatttcatattcagatttgtttatgactactaaaaataactttctagaataatatataccaattatggaaagtagttttctgaaactatttgtatttggttaaaatataattgcagcaattactttctagaataacatatactaacttctaaaattgtgtattttataaaaatatattttcggaaattattttttagagttgatatatatatatcggtacaaggaaagaaaaatggcaaaataataagttaaaagatcaagagagactaactccaacacatcattaggagcagacatcaaatccatggtggcttctagggtggaaaaggcaaacatatctctctactttttaaattaagggctagattttattctttttcttttcttcgttttataattttgtttcttcttttactatttatcctttcttctccaatgttttccatcactttagaccactgtttttcagaggaaaaaaaattcatttatcaagtagttaaataagttttcaactaataaaaaaattaacaacttactaaaatgccttgtcaaatacatgctttttctggaacgagattttgatatattgatgttttcataataatgaatatttaagaatatgttaaaactaaattaaaattgcatcaagcattataaatttataatggacactagataaatatttgacaactcaacaaccgttaatattaagatatttaacaaaaactagaagtaactcgaaagaagaaaataaataaaatgagaaagaaaaatagttatgacataatcatgtataaatattgagctactttagataaagttttccaaaaatacttgtaagagaataaaataagaaaaaaaatttatccaaaagctaaaattagcttatactatacacaagtaaaaaaaaatatcttttaaaaaatttaatatgaaaaatttctaccaattaacttaagcataagttaatttaatttaatagtttatacataagttacttttaactgaaactcatgttattttttgtttttattcttttctctttgaaagtgttaatagataaatttatttaaacgtagataagttgtcaaaaactctttgtagactttttttttttacaaaaatatccaaaccaacttgataaacataatttgacgaatatagtgtgtaaaattttatcataaaaaatgtttgtttttttggaagaattgatttttaaaatatgatattatgatgatagaagaattgaggttaaaaaattgattcgcgtttaagatttatattttaaaatgagtttagaagaattggttttctattaatgataaagtagaatttctttaaaaatgtaaatacaaatacaattttaaatttcgtatttttttaaaaacattaaaattttataccaaatatgtttgcgctggttggaataaattctaaccatcacagctgcattcttttaatttgctttgcctcaaccaaacaggctacaagtacatcaatcccacacgattggtaaaaatgtttgaatagatttaactatagagggaaaattaaaagacaaatagctcatttataattttacaaatatacgaagaattttttt

SEQ ID NO: 849 - DNA, 2575 bp, Glycine max
  Soy_ogl_6703 Gm20:23469923..23472497 Cluster 3
caaatggtatctaagcttgttaactaaatgagctaagttatattttaatataattatattcatttagttcatgataaagaattaattttactcacaatatttgtgtgttacacgtacatattaaaggtggggcaggagaggagaggaaacttacaaaagaataaattaccatatgtttataaaatataattaacttatttcaagttttctataatttataacgacaatttaatcttattcggttttttaaatatagaaatgatttatataaaaacatgtatatatgataaacattaagtgtttaattaaactatttatctaagcacataaacatcaaatttaaaaattaattaacctttaaaatcaaccgattaccagactagtttttcatttttgtcgcgttctagtaattttcgactaggagtgcgtttagtaagccttttggagagtttataaatttatttgactaatttataaattagtttgtccaaaataatctcatgcattactattacccattatctgttcattgataaaagttatcgacaatcatatggttgtcgttttatttttattttatgaagataatcatggttataaacacttgttcgtgccgccaccattaaagtatttattttgtttaattcccatgtaagcattatatgtatattgtatttgtaaataaattcgtatcacaatctaaaatgtagatgtttgctagttgtggaaaattgggagcgttgattagtgtaggtaatcagagatgatttggacgaggatagaaaattttctaattccaaaaatccattttaacctaattatataaatgcaattattatcattattcttattagggataactaagtttttagtccttcatattttcatattataagttttagtcattctaaaacattttgtctatttttaacccttcatttatttttattactaaaaaataatctcaaatataaaataaaccaagactaaaaattagtgaaaaattagtgaaatacgaactaatttttaaaaacaaaaataaataagagactaaaaataaactaaaaatttaggacaactaaaagttgcataaaatttttttgagaaactaaaaattaaaatatagaaatattgaaggaataaaaacttaattaacctttattattattatgaaataatatataatatagtatacgtcataaatattatattacatatatagcaaaattcaactttggatttttttatcttctttttttagtttcatttcctcattgtttaaaaagatttaattgaatcattatttatgtttctattcctcattgtttaaaaagatttagttgaatcattatttatgtttctaaagtgattcaaaacggttcttttgttaatttagagttaatatcgataataattttaagatacgggcaattaaaaatcaccacaatacaataattttttctctgaatatttccattcctgtaacataataatagtttttaaccctattataatatttaaaaattcaaaaacgatttttttttaatatcctaatcactctcatatatcatgatataaaattggctaatgataaaaagaaaagaaaaggtaaaatacatttaaaattcaaatctctttctaacaaaaattaaccatattaataactaatattttcaaataaaaaaatacaacaataatgacttctcttcacttttctttgcccttgccagcaaatctcctttcccgcacaaccccatctcgttcctcaactcacattatgatgaatgtgagacccttgatgcccaattgcaacctcttcttctcaccacgcgacgccagtttggtagagaccgtttgtggtggtcgaacaagctatgatggtcgatgttacaaggaggctctatgttggccacatttcccacacggtcaccaacgatgagctttcagatattgttgaagaggatggcgtggttgagaaagttgaggtattttgccccttaatttatctgttgttcaagttctcccttttctaattttttttatggactttttttttacgttggattacattttattgaaagaggtgtactttggttattttcttattaaatgaattcaacctcgctcgcttccatttcagttgcttacattttttgcaaatgttgtgcagtgacaataatgataaccttgacaacgagtttcagacccaaatgttttgtgccgacgaggttcactgtgtcgcctgcagtggttgtcttgatgatggtggcggcggagtggggaggtgatggcaagctccgtgagcactgttgttgttctagccaaaaagatcttgtcgaggtgatgcagttttgaaggataagaatgctacatactttcaaggactaaaatggtgacttatttgtattgaaaatcttgaaagacaaagtttcaataacaagaaaatgaacaactttgatatcatgtcaaacttatcctccctctattcaaatcccttaaataaagttttaaatttgagtttttgtggatgaagaaaatttattcaattggagtaagatcctatcacaggtggtta

SEQ ID NO: 850 - DNA, 1700 bp, Glycine max
  Soy_ogl_6717 Gm20:30991701..30993400 Cluster 3
taaatgtgactacttttgtttttttcgctcacttcttgataatcaattagttttgtggccgtgtttggattttttattgagctatataacattttttattattatgtattgataataacatgtatattagtttcaattttacattaatattttttaatatatgtttatctattccataaaaaaataattttatctataaatattttttttttacttcttggaacatttaatatatcaatggttttgccatccttcaaactaccttcattgagaaacccaataataattatatctcaaacatttttattccttgcaattaaaaaaacatttgtaattggacattgtttttagctaactataaaaaacatatcaatgaataaaaaataataaatttaaacagttgttacatgtttgcctgactttctcaattgattatacttataaataaatttttaatatttttttctttttaaacttgagaatctcaactgcaatagttaatactatttatcatataagtttgatctaacttcaactagaataaatttcattttaattttattgtataattttttaagatttatttttgtatttaaaaatctcaatggaaataacttctcatttattttataagtttattctgatctcatataaaatacactccttttaataaagaagcataacaaaaataattgtattaaaaatggggaaaatatggagaaattgaagatatcgttgattaattatatttaaaatttttaataaatatttttaataattaaaaaaaggaaaacataaatttttctatttttcttaatttttaaaattttaactcagatagactgaaaaaacaaacaatagccttattcattggtagtgataagttacaagaatagaaaaagataacgtaataagaagaaaaaaaaggataaattatttttttactccttaagcttttaattttttttagtccttaagtttttaaagtctatttttagtctcttaactttttttactccttaagcttttaaattttttttagtccttaagtttttaaaatctatttttagtctctttttttttcagtcttacttttaatcctttaacttttctttttcattcttacttttaatccttttaagggcctataagaacaaaaaagtcaagagagcaaaaataagaatgtaataaaagttaaaagactaaaaatagataaataagtttaaggactaaaaacataaactttaaaaagtttaattaaggactaaaaagataataaaaaagagcaaaagacaaggtgtggtggttaattgaaatctactaagaaataaaaatggttattcattagttgtgagaaaattttcaattttcttgtatttaagatgtaaaatcacaaccaacaagaataatttgtttgaaaatttaattatttagaatctattataaatgatttcttgaaattttaaagatttaaaatttaaaatgatttttaaaaatatttcacattttctatcttttatattttatttcattatttaaatattgattccttatttttcaaaaaatttcacagaaaaaatttatataatctttgtatctttctaatttatactcaaaacaaggtatagaaagaattggaaacttttgcttttaatagtgttaatttttttattttatatttataaaaaaactaaaataat

SEQ ID NO: 851 - DNA, 1642 bp, Glycine max
  Soy_ogl_828 Gm03:3565101..3566742 Cluster 3
agagggagagaccaattacacatcatttttgttattggaggacctacccttatgtgacatttgattttaatatcagtccttgctttttgtgtgtgttatagaataaaacaaaatgtgtgggttgcgaagaatgcgttgtttctaagctgactaagaaaaaaagaagaaaaagagagactaagaataaataatttttttatagataaatattaatttgttaattttgttaaaaatatcagttttaaaaaaatttaaactcaatttttttttctcctttcttctcttttgtatttttcttcaatcatcaaataaccttatatattcagaaacaaatattaattgacacaatttttaaaaataaataaattggaggacatatggttggcaagcatcttcaaaaggtgggaaaaagagatggaggggtaaaaagattgtctggtgacaaaaaacgcaactttttaaacacacgcacacccatgtatcccatctcttcacccccaccattttcaacctcacaaactttttggctttcttttccttacttttgcaatgctatttgccttggatgctcacttggcgttttgggggatttaatttagcttgagttttgtttgcatagtctttggggcatatgggtttaatactcaaaagttctaaatcactacagagaagtatctttcttggatgtaaaaagagaatggaaatataattgcaactatattttcttgttccttattttacttgttaatttactagcatccattaacgtataaattgttgtgttgccttgttgattctcatatttaacatttcaatatgtagtttaaaaaaaaatacttctcaatatatagacacacatttgtataagagtagtgatcaatttctatctcattgaagagagataagaagcaaaaaggtatagaaacaaaataatgaatgtgatatttaagtgacatgatggaaaagaaaaagatatgaaggaaatgaagtagaagtggaaatgaaatagaagaccgagtaaatgtttatattttttcttggtataactaatcaaaggcatatacatagatccaggggtggagccagaaatttgattccaggggaccaagaaaaaaaattatatttttataaaaaaaataaaattttgcatgcaaaaaatattaaagaaattaatatattattatatatattgaatattttttataaataaaaatatatatgactacattaagtacaaaggtaatactatatgagaaaaaaactagatagataaaataattaattttagataattatatgtaggtacctcaacattatcaacgtttcattaatatttataatttttttatttctcttgaaaacattagttcacattaactatcatatttatatattttctataattttattataaattttaggaggatcataattttttttcatagtaattaaatacatttgaaaaattttgggggatgggggcatggcccgtacaggttctcctccctccgtccctttgtatatccttctcaacatatgacacatattcccttaagtttatggaattagactctaagtttagtttcattatcatggtagatcatccttagtagattcacaaatcaagggataaccaagggat

SEQ ID NO: 852 - DNA, 2300 bp, Glycine max
  Soy_ogl_853 Gm03:5168101..5170400 Cluster 3
ttccacagtaatcggagaaagctttgctccttttgtttttaatccctaaagcttctcaatccgtgctgatgcattgatacctgatttgcttgttttaaaattttactggtgaagatgtttctgcgccgtttatcataaaaacaaaatagtgataattaagagtgagagaaaactccatctattgctagagctattatatattatactctggcttaatatgtttattttgttatttctatcaaattgcatggaggttctgataaaaaaacaattacatgtaggttttatgcctgagcatatacatttcaaagaaatatacacaataattaatgtacaaattctttaccatttctgtaaatggtttttacttatacaatagcttataaaatgtcttcacttttattaaaataaaaaaataaaatgtcttcacaaaaaaaaaatgtatcttataaattgtaatacataaccaattagcaattattagggatattcaatttattataattttataatttttcagaattgtcttaaaactattgaaactccattctctttatatattcccagataattaattatttaattaacaatttaattttatttaaaaatagtattaaatttgtaaacaatttgtttaactttttagactaccttgaattattggaatttcattctattcggctaattaattaatgcatcatatttttataaaaaaaatataataaacaacaatctacggacaatcttataattaaaaaggatcaacaattttttacataaaaaaaggtactatgaaaagaactggaggaagtattaactccaatatcttgtcaatttaagtcataaataaatcaattctcttatacgtagtatataaataaataactcagcaaaaaaaaatgtatagaaataaattcccgtagaactgaattttccttataaataaatccatctaacttaatttcaattagaagctttaactagatttaaggaaaaggatattacagcacatattggagattttcaaatatatgcctgtaaagtagagggaactgtgaagaagtataatagtaacttaattatatacatatatatattgacgagacttccaacactatattatactattagcattataaattgtagccacagccccaagaaatgaaagatgtaatggcaactgtctctctgctgtatgtgtgtgtgtatgttactacaacgaatgaatccaaacactgccctcactgagcagaaaggtaattaattatcaagtacctacctgttcacatgtgtgcccattaatcatcgctacaaaacaacccacagcacacaaaaaataaataattatcttgtctcctgcccttgctactttcaattttccccccttcaagaatgtaggtgtattctagaaccaagtctgcttctctctctctctctcttcaataagttaattacacattgctcttgcagtctttaattattaccataatactataatcttgtatagccttccattagctcgactaaactaaatctatattatagcaaatcattatttgatagctattttaaaatcagacattaattaagaccatctaccctgaaatttttagttagggcaaaaatttaaagtaaataatgcttacattaggtagtgtctattattaaaaataactacctggaattttgttaaaaataattggtttgacgaaggttagaggaattttactttttctttattatcaacataatttgtaagggatcattgagatgtcaaatggccccattagacacattatttggtttcatatttcataaaatgtacaaaggagctattatttggagaataatcaacaatacgtgcttgcctttttgcctgacttacataatgattaagagttcaaaatgggttttattctgggagaaatgacaaaaccattgcattggaggatgaaaagattgatttaattgagcaacaaaacaaattagtgggttccaaaacttcaatattaatattaataaagccctgactgctgagtatgacaattttttattatcaaggtattctaaatcaaacaatggatttgattatttctaaagattatttagatattctttatttttagtagaattatatctatttatatataataagttttatgtgtaaagagattttaagattatttgtttcgtttgaattatctaaaataattcattttttagagtcaaattatatttaaaaaaagatgcatatatgaataactttcttttactgaaatatatgaataacctatagttgt

SEQ ID NO: 853 - DNA, 1365 bp, Glycine max
  Soy_ogl_1822 Gm06:7197036..7198400 Cluster 3
ccataatttaaaagtataagatattcaatacttttatatacagataaaatgaatttagaatttataatcttcaaaatttcatattattcctagattatttaaatcgatattccaaattcaattattgaaaataaaataatcattcaaatgaaatgaaaattttaattagaaaataactttaataatacttaatatattctatgactacaacaaaatttgtatttagcggctgttgaagtcgtggtttacttgcagttataattgccgctaaccaattttccatcaattcctaaattgacatgaaattcaacgtcgtaaagcacctaatccatgtcggttaagatgaactgtcgggataaatactggtaaaaaaaatttaaatactgtttattcagtacttgattgaatatttgctagtaagaatttttttaaagttaggtagcttgtataaataactttttttaaagatgcacttttgcatatgtagttttccctttttgaatttaaatctttgtgatttcatttatgtaatatatgtcattataattttgtggtattaaagtgtttgtctcttatagatgaataccttaacgaattaatcctgataaaaaaaaaccttaacgaattaatctgtatgaagtaatttttatcatcttgatctttatcttataacttttatgacatttaaaccatattttttccataaaaaaaagttcgtcttaaaaaaatataaatgataaaaaccttaaaaagaaaataatcagcgatggataacgaacggttctgggcagaataagaatttcactttctgtttccctggcctttttaaggatggctacgaggcaacctataaagtttgataggtttaggtcagatttaaaccatattttgctcgttgcccatgtatggggagacaacactcaacccgtctgtaaaaacttaccttcattcctttgttttaaaatatgctttaggttaattttgtcttttagtcttaataaatatgtgacattttgagtttattagtctttgtaaaattttctgaacatttttctacttttctgatatatatgtttggatgttgttattctaaaactgagttaatagtaaattttagtataatttttttatccaaatgtaaaaattaactaaattaaattgattcaactcagaataaatttgaagacagagtcaattctttaatataaaaccaaaaaaaatgtaaacatgcacctaaaatcaagttaattgatatttcaacatgattttaaataatttaatgtgaaaccaaacccgcttagttttcatgttaaatttaaaccattaataacgcttgtgcctgcgcatatatatttgcaaattgtg

SEQ ID NO: 854 - DNA, 1700 bp, Glycine max
  Soy_ogl_2282 Gm07:8168401..8170100 Cluster 3
tttctttccaccataccatctcattagttttcttttatcaattatttcatattaatcatttctaacttaattttacaaattattttaatcataagttatattgactaaatatgtactactatttatatgaaaatattatttattgttagatgaatgttttaattcaaaattaaccatagaagttcagttaggttatttgaatctttagccaaatgctcctaaagactaagtccactagtaccctccaattaatttttctgttattattaaatcatattcattttttaatgttttttaaatgcaaatttttatgtaaaatttaataaaaaaaaagttttattcaataattctaaacactaatcattgtctaaattcggttttaaacttaagtactaacaaaactagctaaagtttaaatggtttttcttttacttgtaaaagtatttaactgattttcattcttaaagatttaaataaagtaatcatacccacacaatttaacacatgttatgaagggggaaatgttataccttatcacaaattattgattttcctatcttatactacacaaaatgtatatatgggttaagaagttaacattggattttttttgaaaaaaatatatcaaatcttaaaaaaaaaacattatatatatatatatataaagttggttcattggcctatactggctatactcctaatatataaaataacaataaaatttctaactaatcgaagcataataattgataattgagatctctcaaccaatatgatttttcttatttagtacatcgtttggtgatgagcaattaaacattaattatgtatacaatattggggtagttgcttgccgctaatacaatgtgttattaatctatttatttcatggctgactgtatatatgatgaaaataatttagccatagttaatttgagaaagtgaacgacttaacgaaatagccttgattattgcctatgttctctttacgataggatttcaattcaaaacttttcggttaaataacaatagtcctacattcaaaactacaaaagtataaatttagaccaatctcctattcaataatatcgagaagttatacatggaaaaagatcaaattatattatattatttaataattttttattaaatacttttatctcaaaatttcccattgaattgaaatttttattgatgaaaaataataatttagccatcgttattgattgtccaattattttatattttatatttcatttgtataattaaattattttaaattttaaatatatatttatattatataaaataacaaagcattaaaattaaacttttaaaaatataactataagttaattagcgacaaaattggatttaattgttttgtgtttaatgtctttatttgtattttaaataagagtgccttcaagaagatacctacgaacaaccaaaaactatatttagaaaaataaataatatatactttgaccatgtatatatacataaaatgatatatatatatattaattttattaacttatataataactattttaagagttatattagaaattaattttaaattataaaaaagaaatgattgattgataatattttttttacacggagatgcatgtcaattcaactttctgtaaattgtatagatgtattgtgttaggttttaaataaaatatttattt

SEQ ID NO: 855 - DNA, 2200 bp, Glycine max
  Soy_ogl_3143 Gm09:36904601..36906800 Cluster 3
aataggttaatctccacgttaactattaaaacttattgttctttaaattaatataaaagtcgattcacataatatgaaggatgtgagagacttttttttttatcagcaaaaaaggtatttgatcattatttaatattcttaaaattaacatatttgttattgaatcaattaatttagtcccaactatcaattttattttaagtcaactatgatttcattttatctctaaattttataatcatgagttaatttggttttcacgtttgagaattgattaatatacattaaagttagatactaaaataacttgaagttaacaaaattatacatttataaattgatagaccccaacatgaataacttaaatatcgaccgttaccaaatccaaaaactgttttttcatacttctggtacttgtttaatgaaatattcttttttctgttaaaaaaagaaataattcgatattttactatttgaattagaatttaattagaacaaactagtaatataaattttttatactgttatttaatactaaattattatgtattgtaagattattatttattacaataaatatttaaaacaccgtaccttgctcctgaatctgattttcttattaggttttaataatagcattttccctctctcaaaaaagaaataataattgcattttcccaccttagaaaggaaaaaaactgaacgatatcccgaactaaaagtggtttgggtggcaacatgtggtcaccattagtttggcatgcgagacactcatacatcttttgataccgcaagacaaatgaaagacaccaataaaactagaacaaaaaagagaagacattgagtgcattattaactcaaattaaccacaattatgttgtggttacattacgtacgtagcccaattcactatctaccctggaagttcaaagcaaacaaatatatttatctggttctcaaactcaattacgaaaaaggaaaaaagcacacgtggtttctaatcaaaagtgaatcttcacttttcatgccacggagatatagatattaatatacatatttacgacattgttgagttaaaaaaagaaaagtatttacaatatcatgtatgtgacgtatgagattataatatattataagtgtggaacgtgaggcaatgatttattcaacttacttattagaaaactttattgcaggtcatggagtagtgggtttagagggtagaccagagagtgcagcattgtgagatatattgggtttttttttttttttgtgagagatcacatgttgtactttatgaaagattaattttatttataatacataattattattaaatattgatttaaaaaaatttacataaaaatgaaacataaatttaatttcctgatatgtgagtataatatgatcgtacatgattgcaccaaatatatgacttagatatattcggttttatgtggaagagaataaggcaaatagaaccgcgagggggggcttgccactgccactccctgtcttcaaagatattgatgtcggtaacgcactctacactcccacgtgtgctacaaaatgtgtctctgcgtttatcaatattataattataattacaatccacaaaagtataaaaaagtatttaggtcactatgtctagattttggtttcgttctgtctaagaaaatgtaagaggaaatgaaattgccctcgttaagagcgaaatatatatatcacatatacatagattagtataggagtaaaacttttttttaatatttaacatattttgtatgttcatactcgagctcaatattactagtcaaagcttgaataattctacaaaagtttattcatgtattcaataacaaaagaattagataaatctgcattatagtaacaaaaaagtgtttgtactgtataatttgaaatcaacttgattctttggactttaggatcaaaagatgattcaatcctaagatttttttaaaaaaaaaactcatcttaagaatatttatagagaatttatatttacttaaagatataaatactggaatttgtgagttatcgaataagagatcattaacctaaaaataaagagttaattatattaacactcgctaaagttttgttgcattacacataatatctaggctttttttacccttataatgacctcacttacatggtacacggtgtaatattatttata

SEQ ID NO: 856 - DNA, 1400 bp, Glycine max
  Soy_ogl_3378 Gm10:5360401..5361800 Cluster 3
tttgttggctttaggttgctatcaccatattcacgagacattcaaacgtagaatgaaaatcaaatattcgggactacgatgaggatttttttattatattgacttaaacaattgcttttgaaatgcgccaccatatttgtgactgtcataattttgtgtcaattagcatattccttcgttgaatttgtgaaatttgacgatttcttaaaagaaactataaatatattctatgggaagtaaatattatgctcaaatcaggtagaatacagtaaagtttttctcctgagtatttagtggagttctatacataaaatttgaatttaaaactattattaaactgaaaacttcctcaataaaaaatatctgagtacaaagagaaatatatatttttaagcaggtacaaagagaaatatgaacttttaaagaaattattttacatttacgtgctttaattctgactatataataaataaataatatactattactattcgtagagattggagggagggagaagagagagacaattaattaaggatttggctagcatacatcagctaaaagaacaaatcataatgtattttgcaaaaaactataatattgtactttaattttcatcacacaacaatatataataggcttaattatagattttatcatttaatttttattattttataaattttatcacttaaaatttatttccataaattttatcatttaagtatcaaatttttaagtattttaccaccattgacctataaaaaaaagttaaaaataaaaaaattgatttcattttgttaccaacaaaagtcaaaaaattggatgataaatttataaaaattaaaagttagatggtaaaatttatgaaaaaaataagtgataaaatcaactaaattatagaagtttaataataaaatttgtgaaaataaaacttaaatgattaaattcacgttataataaacgtttgatgataaattttacaattaagcctatataataatatccaatacccaatacttatttcttctactctcgtgcaaaattaagttcactcatttcatatagtattttctttctattcttctcatggtgtgaaacgactaggcaaattcttccaccttttgacttgctttcaatattttgcttggtttagtaagtacgaagtactcacgttttggttttttaagctaacaaactatctcccaatgcatggacggttcaatctctctcatctatatcctgttggttaatcattcagtgcatcgcataattgcatatgatccacgccacatgttcattgaacttagcttactaagtgtaatgcacagtcttccactcattaatcaaataattttactagttttttcaactgaagccacaaaattatactttttcat

SEQ ID NO: 857 - DNA, 1300 bp, Glycine max
  Soy_ogl_4982 Gm15:11080001..11081300 Cluster 3
ccaatcaaaaaccaatattgattataaagttttttttttttatataagtcataatatttttatatagtttttaaaaatttatatgacaattttatgccaaaataattttttgaaattttaacctaatacgttcctaagacaactttaaaatctttattgcacccttttaaaatgattaaaaaataaattaacaaaatatataactagaacaaagaaaagatgtgaaaattatgttttgcttggcagtttggtaattgttgttgtgtattctttgatgtaatgaaaaactcaaaattatataatttatttaaaaattatgtttaaatatatttttagtccttcaaattttgagaattatatttttttaatcctttaaaaaataatttgttttattagtcgctcaatttttttaaaaactactttcagtctatctttgtttaatgtattcatggtttcataatttttaacgatttttaactatcaaaatttatttttaagtatttttttgaaaaatgatttaggacaatttaaaaccgtttgacacctatgttttgtcggcaaccattctttgcatatcctattggttttaaagaagaaaaaaaaagatagatataaaactgttgtaattttttacatattctgtctgttttaaattgtcacaaatcatttttaaagaatttaaattataaaaatacatttttgacaatgaaaaattactacaaattgtgacatcattaatggaaaaaatgagagagattaaaagtagttttttgaaaatttaaaagactcataaaaaaaaaatcttttttgtaggtgaatttttattcatatttaagtaaaaaaagtatttgtgtaagtgaattttaattaaatttggcatcatcaagctatcacaatttaggtatgactcattcaaaataggattaataagatgtcatgttttaattattcctataaatttttaataaaatagcaataatatttttttaaaatcaaaaaattaattaagatattttgtttcacaaccaaagattttttttttgtttccaagtgtatgtgtgatgcatcaaagcaatctaagaattattaattcctaaaataatctcaagttatagggctagattgatgctattatggatgtgcaaggagaggcctatgctttgccaagagttacaaagtggatgaaacagctgccaccatgctatcatcttcgaagtaagggaggattgatgtaccaaattggaggtcacaataccaacatttcggactgtggtattttgatggatcacattagattgaa

SEQ ID NO: 858 - DNA, 2281 bp, Glycine max
  Soy_ogl_5342 Gm16:7853801..7856081 Cluster 3
aaaaggctgaatagaattattataagaatttgatatcataaaatgaaaaggtaggattaataatagtttaaagatttagtaatcataggacttgtgggttctcttatttagtatccatcattaatcatatttattctcttattactcaagtagtctataagtagagaattttagagaaagtagagaaaaagttagagaggaataaagtttgaagttcttctttggtggtggtggtagaagaatgacacaagtctgagagaggaaaaatgttattttatgggagtgtaaagatgaatcttaaaggttctctcatttcatattattattaatttgtatggtttgaagtgttgattttgaatgaagatcatgatgaatttgcatgaacttgtatgaatgtctataaacaagatgaacataagagaaattaaaaagacctcacccatctttatgtggagtgtaactttgattactagtgttagtatgtacttattctaattattattagcacaaatacaagccttatcacatatttgtgtttatatttctattgtgttatgttgtatataaattaaagagagaaaacaaagaaaacataggtattctcatgtatttattttgttgttggaaaaatatttcttatatttctttaagaacaaaacatttcaaaattttcagaataaaaataaaattaaagaaagtagtgcaatagtttgagattttaaaaacaaaaaatgacaatatttaagtaatattgatttattaaagaaaaactaagaaaatagtgggataatatgaaatcttaaatttaaaaagatattgttgtttctaaataacaatagttagtttactatgtttatccttaaaaggttaaaaaaatatattttatctatatatattatttttcatttaataatttgattttagtgtggctacttttcttttttcttccaattaggcatgacaattaaatcaaggggacatactaggtgtgtgagtattggaaacccaatactataatgttcaattcatacgcagaaacatgacaattgaaggctccctgtcattagaaaatgttcatgacaatttattaattagttatgtatgattcattagaaaagatccatcttagtataattagtcgtgtcaggtttagagtaaagaaaagcagagggaagcgaaagttttaaaattttaattaaaataagatagatccattcatgtattatacatttgaatgtgcttattttaaaaataaaattatatacatctaaaatggatactgaaagtaaaaaaataaatataaaatttatattttaaagatcaagatatccatattatttgtcatattataatatgacaaataatataattaattaattatattatttaggctttctctattatttctttgtcttttaaataattcattttgtcttcatcccatgatgattctttatcttctatttcttgtattttatctttatgtttttcttgttattttttttattgttaagtatttaaattttttatagtatttatatcacctgttaaagaaagaaaattatgtaaatagtaaataaaaagaaagttgacaatatataggaggattttatagtgggcaaagaataagatgaagagaaaataataaaaaataaatgaatttctttaaaatcaaacttaacccaaaatttaataaattcctttgaatttgattgttaatcaatttcttaaagaatctttttaaagttatgtagttttgataaatctgaaatgcacataaaatattagaaaaaaacacaatacatacacaaacaattaaaataaaacacaaactatgacaaattgggaagcttgtgttaagtagagtctaaatttgaaacatacatgttaaaagagagtcattgtgatggtgaatgggtggaagaagaaagaaagaagatgagagttaaatatgtgattagtttgaagagaaaaaaggaacataaaacataaaggaacaactggtaccacatgatgcagttggatatgcagttcccaaaaaaataataaagtgcaattactttgtagaaatctggatataaaatctgagtgcatttattcttggtgccttggtggcttcgtgtaattccttccataagttgaagggtaaatttttaaaataaaacgaaatatccattcctaatattattggagaacatggaaaaaaataataaatgataattttataattaattcatgggtaaaaacgtcaaatgaaatgtgtacagcaaaagagaataat

SEQ ID NO: 859 - DNA, 1538 bp, Glycine max
  Soy_ogl_2185 Gm07:4465401..4466938 Cluster 3
ggcacaccaataggcaggcatcaaaatgtgtctaatcaagtcaaagccatgtcttaaatgagtcaagtaggttatcataaagtttgagcctatagcaaactaccatctgagtatctgatagtggtagtattaactattaactttgttacgatcggacataacatgtttcataattaattataagtttatttgactaatcgtactcaactggctgtttcagcttttgtgatggatttgagtactattgtactcaaatttcaacacttatttgtttatttgaaagaatcagaatatttgtttcattttatttgtggtttaatgtagtctgtatgttaaaataaatttaattgtttgtactaattcttttgataaaataatttatccgcctaaaatatttttattcctcaaattattagttatacaatatagttgccgctatacatctattagtgtttttatttattgaaaatatatatcattaggaaaaaataattaatacttaaattgaatacttttttacattttaaccatcataattagaatctgaatttagttacaattaaaacttttcaaccgttctcaagaatatatatgtgttatagaaattgaatataacttttctctcatagatttaacattggttgtcaattgaaatttactcattaaaatgaataattttgattttagtcttgataaaaaaatctttaattttttaaccctctaaaatataaaagcaataattttggtctttattgtcatatgatatctactaattaattatatatataataaaaagtcatatgatcatcttaggtgatactcaataatgtgtatgtgaagttatgccaacacatgattctaaaataaaacttaaattctaaaataaatgttatttatttatcttaaaataagttttagggcttaaaaataataatttcatattgtggagggtcgaaaaacaaaaattttcttggtagagtacaaattaaaaaattgtttattttacaaaggataaaaaatagtgatttcaaattttagaatgatgaaatcaaagaaaaagaattttagcgatagtctaagatgataaataattcaagatagaaaaacatttcaaaaataacaaataatatgaaaggggagaggatgtgattttaggctaatgaaattgaatcaaaagaaggttatatttgaccataataaattataaattacttgaatgttgaaaagttaattgaaattgagaaaatttatttttaagtaaaatttaaattttgttattttttttattatttataagtatttaataaatttaagggtgcactttactaaacaacttaataagtatttatctaatacatgcttgtaatctaatcattttatggataagttgggtctataatcaagaagagaataaaataattttttcttcaattcatatatgttgtagtatgttagtttcataaactattatagagaacacattgaagtaagttaaaaataatttatgaacatttcataacttatttttataagctctt

SEQ ID NO: 860 - DNA, 1300 bp, Glycine max
  Soy_ogl_5964 Gm18:6519001..29300 Cluster 3
aagcaaatactattattaatccatgtatactctctaaattaattttaataatttaagttgcaaatggtattttttaaaatatgtttgtttgaaacatttacactaatcctaatattttaggagactttgtactaattttaaagaataaaaaattactctttttaaaataaaaaaaaaagctcatgtgatttctatcacaaattaggtaataaataataataaaattaggttcatgtgatttctatcacaaatttcatgacaaccttaaaatcatactttattccttaaatgcaactcaatattaatttttacgctaatttactgacgttcaattaacaaacatattttattggtatttttattaattttcatttcaaattaacaagtgcttaataatcaattttaaatattttgttaggtatgaaaattatcataatttctaaattaattatcatattctgttatgatatcaaaatgatggcaattttggtgttgacttatttttttttctctttttctattatctcataaattatattatatttatatatatttattcttttttttaggtgtcaaataacatattaaatggtcatgtaacatttttttatcataaaatatgcaccataacaataaaaaaatctaaaaagatgaacgggaaaagagatgcacgatttggggaaatggatgggtattttatttaataaatgattttttaattaatattttatccacatcttaatatgaaatattttataattttttatacaaagagatacttattttagttaatattttttaaaagtaacattatttaataatatattttaaaataaaggacaataatttctatattaaattttgactgtaaataaaatatattttgaaataaatctctccatctcttttaagtataaaatataggacattaacctattaagaatattcttttatttgacatatttttaattaataaagtatatgaaaatgatatattattaaggattagatgcatgtgtcttatcatttcctatcacctaatccaattatatggtaatatgtggtctccttggaaaattgaactaatctatcaatttaaaacaaaaaattaaatcatccttttctttgccaatgtctgccatgacccattttattgaatcaaaaatatactttatgaccccaatcattatgcttaaaaaattgtggtcccaagtttcaattgatacgctatcagatgtcagcccagatgatatgcaatttactttattatgtttttttctcttacatgcttcctattatt

SEQ ID NO: 861 - DNA, 2300 bp, Glycine max
  Soy_ogl_1368 Gm04:43764101..43766400 Cluster 3
actaacaatgaagtcaatacatctcatttaatatctacatttcattacataattttattcttaaatcacttcttaaaactttaatattttttttttctaacctacaatacttctataatgttagttatttttattctgtcacattaattatatttaacttctattttttaatttattatttaaaaaattcagagagacacgaatttcctagtaataataatctaaaaaacgcttcatagttacccatagcttaaataaatcaactcgttaatcattattttaagatattttagcttcttcaaaaaaaaattatagctaaaacaacttggcacttttaatattatttattgtttaaaatttaaaatgtacaaaaaccaattttagaagagattaattaatttagacgcgatgtcttattgttcctagttttttcatgtttttgaaaacaatttctgaaattaaaagaagttgatttttatctgacatctttttaattatatattttagatcattttaattgtgacaacttggtgattttaatttttttccatccatagtttttgtattttcttaaataaaaagtaacaatccaacctacacttattttataagagttataccatattaagtttttttttattgtattaagttacctataaacgataatgtattgtcaaaaataattttcataatttagtttccattatgaataaattatttattcagtcattacaacgttattcctttttttttttatttcaagtgtttgaatggatttatttttttcaatttttttataagtttgcacaaccaatataaggtatagacttattaaaaatggtcagtaagaaaaatcaacaaaagaaaaagaaagatccaaaaagaaggaacatagaccgtcaagtacatgcgtggtattcttgtgaaaaatgaaacagagaagaagaaaaaggagaataggaagaggagaggggagagtgtaagtgggaagagagagcaacaaaaattataaataaaaaagtcggtgaagactttataccaataattcaaaaaatattttcttttgtaaattagtataaacttattttcaatgcatatataaactgggaattttctttttattagcatttctcatgcagtggtagtttacttaattttttaatattgaaaaagataatattttataaatcagatagtaaaatgattatttttgtaaagttaaacttttttttaaagatggctatgctaaagcacatcatagcccaattcaatataaaatgaaagtttaaaaagaaatggtaaaaagaagtagttatgctgaaataattaaaaagttaataattaagaatagaaaactttgtcgttctcatgactcattgctcctatttttcatagcactgtagcaaaattttgttttcaaactctaaacttaaagatgttaaaagccaatttattattcaaaacaaacattataagtattttgtttaaaatttatctgtttgggaagtaacaacagactatatattaattcaaatttcttaacatgattataattccaccattttgtcaacacattataaagaggccgaaatggggctcgattggatgtgaaaagcataacacatcaaggaaaaattattttgattggaaatggaagtgacatgcactatggaaccccatggaatctagttgtgacctcaagggcccaattatgcattgtcctaagagtgcaccctcaacccagtattgaattaaatggagaacaatgttcaaaggataaattgaataatgtgcaaaacaagtttaattaccgaaaattaatataaaggttgaaacttgtaaggagttcatctatactgttaaatattttattaatgaatctaagagttaaaaactaatcgcaacataaactgaataataagcggtttcccttagccaataactaatataaaatatgacaatatttagatacctttaaaaattccaacacccaatagacatcataatttctatcaaatccacatttttctctctttctatctatttacatctctaaatatgtaataacatttgggtttctaatgatctttttccaaagtgttaatgtatcaaatacatcatacatgtggtccacacttacaatacaaaaaagagaaaaatcatgttggcagaatatccagcctagaacttatcatcacgagtgtaagcaccacgtagtgtacatgcagggctcctatgtaacaagttgagaaacattgtaagacaatgttttggttttggttaattttttggtacgtaaa

SEQ ID NO: 862 - DNA, 1514 bp, Glycine max
  Soy_ogl_2500 Gm08:45311..4576324 Cluster 3
accaaacttaaagcaattatacttttaaaaaaaatgttaaagcaattttttttaacttccattcaccccctcttaaaaaaacaccttccattcacctcatattctatactattaattagagaaaaatccccacaatatggagtgaatggactccatttataagttatcccaataggtggtgaatctatagaaatttttttagcggaaaaaattataatttttttataaaatatataatattatgaccaaaaattcaaaatacctatatatttacaaattataattgttctttgcatgtttttatatttaaaaaatattgtacaatttttttcaatgccaatactataaaatgtagaaacataaaataataaaattaataccaaattattttttcttttatcgcttataatttttttacattcatttaaaaaataattatttatgagagtaacactatttttttatagggataaaaataaaatttattaaacatatgcaaataaaaaaacattatttgggggaaattgccccataaccttcaacatggatccgccattcctatactttaagagcgcaaattggtcaatataataatatgttggaagagctcattaagtgcaattaaattaaattattattctgtatgattaaattaatttgaactcttttcctaaaaaaacatattaaactttttttaattatttaactccctctatttcattttaatttaaaaccatctttatcatcataattaacgttaatgatgattaattataaaataatagaataattgcttgattatattgcacgtgtagatacgtataaaagccacagagtagaaaatttaatagattctcatgcagcttctatttttgagtggttctttacagccattaaacattttatcaaggctgcatgtttcaacatattccaacatgtactgtaaaaaaaataaaaatattccaacatgtattcaactaaattctataaaaacaaagcagtaagtgtcatgttccagtatcaaatgttggtttctttttgggcctcttgccctctttacacacaagatgaagtatcaatgttggttcaaaataaaacatgataactaatattcatagaaaaatattaatacaaataaatcagtatcaaaatgttgttccaaaataaaacatcataataaacaatagttaaaacaatgattactattaagaaaataattttattttccgtaataattatatctgactcaaatataattatttttcataaaaattacctttcaaagagtcatgattcttcattgccattcatcccatgtttaattagggaaaagacccatcatgggcttcatttatataagttgacctatatttttgtaagtacagcattattcgaacttataaccttatttaaactactcaaatttctcatcgtcaaacattattatgtttagttatcttatatatattataagaacataatattggtcaatataaaatgttggaatggatcac

SEQ ID NO: 863 - DNA, 1167 bp, Glycine max
  Soy_ogl_2537 Gm08:7346134..7347300 Cluster 3
tattttctcataaaaaaatattttggagttatttataatttagtttgaattagttttaaattcttgtatttttttattgatcaatcattttaatttcatctttagtttcaattaatatttttatattgtacagtattctgctcatcttattttatatctaaaaacatttaaatcaaatttaaaataaaatagaaacaatatgtacttaagtaggtgttaactttcattatattaattagaatcatgttaaaaattatcttgaagtgtaatgttaaaataatagaacaaataatgctgtggatagtgtaatggtcttaataaattgtttaatatgaaaattattaaaaaataatgaaaaaataaaataaatctataatctatcattatcaatatcttgaagtataatgttaaaatattaaaattaacattataaatagtttaatggttaaactaaaaataatcaataccatttcattaaatattagcagaaagaaagactcataatgcttgtatattcacagtttttatttttatatattattttttatcatatactaaaatttttattatttataaaaaatgtgaaggttaatatacaggtaaatacaaagagttatgagaagaatgtagaaaactgaataaaaaaatatgaaaaaataagatcaatagttaaagtgtgaaaagatatagagaaaagtgggaaaaaatatgagactcacctgactattgttgataattttagttaatttttaacattttttattagctaaaaaagttgtcaaaccttttacttctataaaatactttttaaactaaatatatatttaaacttctacaaacattatatacatatattaaatgataaaatttgttaaatttttctatcaaatgtaaaataaataaaatttaatgactatattttttaaacaatatatgatactaattacctatatgcaatttttaaggaaaaatgattacatgctccaagatcatcatatatttttatttcattttacaacacttaataaaactcgattatgttatacttaaaatttgctcaaaactaggataatcccggatcatgtaatagttctcctttcgaaaggtatatatattataaaagtcatcgatgcaataatatttatagataacgataagcacacccac

SEQ ID NO: 864 - DNA, 1754 bp, Glycine max
  Soy_ogl_2829 Gm08:40906401..40908154 Cluster 3
ttctattactttctatttttattattacatattttactaactcccttgttaaatatataaaatattaaatacttattatattcacaaattattaaatttatttatttaaatttaatattctcttgagaaatataaaaaattaaaaatatttcatatctatttgtcatatacaattagtgttaaaaaaactttacattatcaaccaataaaaaatcatttttaaaataatttaaagataattattattagagtcaacaaaattattatacataataattttgtaattgaatgataatataatttttttatattattaatgtattttaattaaattcaaatgtttattagaaaatatcatcttactcttatattattttatacaaatgaccattagctattcaaaattgttttctacacaaagtattttatacataacttttttttttataaaaaagtggattaagaaaaataatatttgtataaatagtatcaaagtttatacattacatctaatcacaaattttcatatttgttcatttttataataaatatatcaaaattcatacaacaagctttgatcttttaggataagctatgcaggataacttagtgacacttaaaaagtttcttgttcttcctcaaagatgtattatatgaaaattgaagacaagttttttgactaatgtgtattaaaaaaattgtttattatcaattatattacatttattgggcaatacactaatacccgcttactaaactcaaataaaaaataatttttataaattttaatatatatccttttaagattgaaaataaagtccaacatataagccatttattttatttttaaagaaatgtttatatatataagatgctaaaattattgaattagatcatttcattttattttttaaagaattttatataaaataatagatgtatatataaataaaatggacatgtttaaataaataatataattaaacacttattgaataaactcttatcaaagaaaatatatttaaaattaagcatgattttgatacaaaataagttaaaaacattttattaatttactaaaaaaatcgtttattatcaatttgtcattactagaaaaaaagttgatacagatcctaatcactatgctatattattattataatacattttatggttaactcttacaataattatatactaataaaaaatgttgttataattctttttcaaacttattgaaataatttataaataaatttataaaatgttcataactatttccatacatttaaacaaactctttgaaatgattttagttttatttttttggtttatcacagacatctttcaattgcaaacttatttaagttacgatcaaacattaagggattgtttcatggttgattttttttttcttttctaaaatataacacaatattgttatttctagatattttttttaaaatgtaatatatctaataataataattttattatctcatgataaacgtgataataaattttttcaatttcatatttttaaaaataaataaataatcctttgaaacaaaccccctaagacatattttaatgagttcaaaccttagtttactcgggattaaccccttccaccaaaacttaagtaatcctagctaaatcataaacaagttttctataatttatccaaaatacaaactagtcacctcattgatctcttcaattctaaatatccatgtgtctcccgtctaagatga

SEQ ID NO: 865 - DNA, 1181 bp, Glycine max
  Soy_ogl_4240 Gm13:23833720..23834900 Cluster 3
actcaatgcaccgaatacctattgtccactaactgtaatatattaaattaagattaagataacgattgaaagcattattgattgattacattatttcatgcatgttttatgtgagagagaaagatgggcaagcgcatgtagcatattagttaaaataatattaataatatttgcaaatgacttaaatatttgacgaaatattataagtgatagaacaattttgctatattgagatttatttcttttttttattaagggatttgtttcttttcacttcaattagctaatagaaaaattatattattttttcatttttactatccattaccttaggcaatattaagatattaacaaataaataattttactataaattgtggtcaacatttattttgattattaaatatttcatttttaatatttttttataaaatttttcattctttaacttttgttgtaaaagtatttggtaaaaataggagtaattttctttgagatattaaaattgccgcaaaatttacaaagttcaacaagtagtttataaattcttgccaaaatttatttgtcaataaatatgtacgctcacctaaaattacacacagcaacatacataaataatagttttaattaaatattagttatacacaccgaaaatacgcgtatttaactttttagtcattaaatgaaaagataattaattaaccttctattgatacgtatatgttaaattaaattaaactcttttgagactgatgaaaatttttagtacattctattctttaaaatttaaattttaaaactatttgtttacaatccattatacatatatttattataataaatatttttatttttattttaaatttaaatcatatacattaattttataattttaagtatttgtttaaaatatttacaatttatttttcacattgtatctaaatttaaaaatagaataaataattattttggttcctgaatatataaattgataacaattttgaatcctgaaaaataaaaattctgatttaatagttaaacttataaaaaaaatataataacttaatattaaattagtctttaaatattacaatttaaataaaaaataatcacacaaaacttaacaataccatatattttcatattcttttcaattcaaaatccttaaaatatgagtaata

SEQ ID NO: 866 - DNA, 1709 bp, Glycine max
  Soy_ogl_5180 Gm15:49769492..49771200 Cluster 3
gaaactaataattaacttctaattatttttatatgtgattagattgtttatcttctttgattataagattattgttatgtgttttttttttgtttaattgttttgtccaaaagatttttctttgaaacagaaataatgagttataatatataggtagaatctttagcaacaatcttttaaaacaaattaagattcacgttttcttttttattgtttgaaatgaaaatcatttaagttttatgtacaaaattagtcaatattttttgaaaaagtcattattaaataattatttattagaaattatatgtataaataactaaccaacatttttttttttaagtagaactaagtttgaatatcttaaatctctattcgagttttatggataaaaaaaatatatttgaaagaaaaaatccattaaagataattagttagattctcaagttaatagctaatattatgaaaaaatattttacaccagtaatataatgactcaaaatattttaataatatcaaaacataaaaaaatactcactgttatagatttctggatgcatccctcgttgaatagatttattataggtgataatttcttttaaatatttaacataattacataataagagtttaaacttgagatcacgtgttaaactagaataatcacatcctaaataaccccatgtacagtgtcaaaacattttcttaactataaaactgtggtatacgtacatgatgtacatatattttagggtcaactttttttttaaagagttttaaggtcaacataaattgcataattttagtagtttacttgattttttaagttgaaagattattgttattatatatataaaaatataacaggttaataattttaaaattaaataattaattcttatatttcgatgtcatattttacactaattgaatcattaactttataacttatcttttttaagtacattagcttactaaaaatgacttaactcattatgaaaaaaaaaggttaaattgacattccaattcatcgttatggttgctgaatataaaaagcttcttgcagtcaattcaacatttaaattaggttttgtttgaagacaagtaatggggttgcttatgctcttgcaagggtagctccatcctatcctaatttccaatatttacataaatttcctccatgtatagttgatctcattatgaacgaaatcccttgagtttgtttctgtaaaaaaaacaaaaaaaaaacttatgaacacaaaattaaattggttgtttttccttcttttcaaaaacagttgtacttggtgctgttgatttgttgttgtcaaaatgtagcactgttcagattggaatcgtgttgagatgagaaaagtagttgtgcaacttttggagggggaagcagcaataattgaagaagcaaagcaaacttttttatgtgttgacgaaggtgtcaagctaaagaagagtgtgaccgtcaccagcaacatctacaccactagtctttcttctctcattagattcaaaaacatgagtgcgactatgcaatactatggttttcattattgaatttgaagtcatttagaagattttactagcattaattaatgaactttattaggctgatgtaccatcatggtcaaggttgggtaattagtagctgacccagggaatttattttagaaaaataaccatttatttttttcctaatt

SEQ ID NO: 867 - DNA, 1366 bp, Glycine max
  Soy_ogl_473 Gm02:10337135..10338500 Cluster 3
acccatataaaaaaatttatcattatatttataactaatgtaaaagataaaaaaaaaaactcacactaaaagatattacttaggatgacatttttcactatatgacaaaataacgtcataaaacaacctgtatattattttggtgaatagttgaaaaggtcaaattttttggttaaatacgtcactatacttttttggtgaatattttttttaacactattattgtcaaaaggtcatttttttctattttttctttttactctatcaaaccaatccaaagttaaaatcttcatttaaattttttataaaaaatatcggaatgaattatctccattttttacctccttttgataagcttttgaaaaaataaataaaataaagataatacatattttatggagagtgatatttattttttcaaaagtaatcaaagaaacaaagagaaaaagaaatggagataatctttgcacaaaaatatctaaataactgcattcaaggtttgtaccactatgtttttcaaactttcaaatcataataataatgtattttatagttctatcatcaacgttattccaaagaagaaaatttccacattcttcacttcatacatacaaactacagtacacagtgttactgcttgatgttttccattcagaagaaacctaattcaacatagaggaaatcagatgagcatgtttgtgtgttttctcaactgattgacaactcagctaaccattaaaaaagaaatttaagagaaaaccctatttttgttcacagctctcattctgacctataaaacccaatcgcagacgttttatttattcctgtcatctgaaacaggaagtacggtacggaacatatgtttatccgttgaagagaaattttttaacccatcacacggtgtgtttcgataaaaggaattatgtagtttcttctatttagttaaaagataaagtggaaaaaaaagggagaaaaaaattatctgttaatatatttttattttaattttaaattttgattctctcagtttttccatcataataaccatatgactaaagtaacacactattgtattgaattttaaaattagttattttatgttaatttatttaataatattattattactatattattttttttaaatatcactatattatttaagaaaaaataatttactactaaattttttctaccaagatgtaacaatatcaacgtatcattttatatcatctttcaaatgtataataatattaatatgatagtttaattaaaataatttatgattaaactatttttgtagtgtagatatagaaatacatggaaattaaacctcaaacataacttatttttataggaagttaag

SEQ ID NO: 868 - DNA, 1200 bp, Glycine max
  Soy_ogl_1455 Gm04:47058601..47059800 Cluster 3
ttgtcttatttgtcctaaagaattttaatgatccccccataagatttgaaccccacaatatgctaaataggaaagtgattataactgaaatgtctacacacatcttttcggtagatatgattctaagagatgtttgtatatcgttgagattaactcttttctggatttcgaaatttagttaaacgttacgtcttaattaatttgagtgattgaacttaacttccgtgattgaatgacctggaattttggataaagattataatatcgttaatactatttatgatgaaagcaaaatgtaaacgagtgcatgggtctattctgctgaactttttgaatgaaatatttgagaatttaaaattttaagaatatcaattacttcaattgtttttttctgttaaagtggtcaaattaatgcttttaatttcaaattctttgtatttagatgaaataaataaatttgtttctaaaatttcttgttttaataaaataaataaattcttttgtttcaaaaaattcgaatttaaacagagagaagatagaaagaaagatacaagactacgagaaaagagaatagagagataaagcatttacagagaaaagatctcattaacattctcataaaatctagaaatcttgaattacagttaattaaaattttcatttaaaattattaacttttaaattccgtttaatatcataaaacacccatttagtaaaatatccaaacaaattctaagccaaagagtttcaatttttcctaaaaatgattttccctttttaaagtacttcatccaaatacatccctaattaaatttaggataaaatatattcttgctcatactaaaattgtagtaatttctttctctattttttaaaaaatgtacttctatcttcgaaaaaataaatgtaagaaaaaggtgcacctgaaaaaatattttaaaaattagtatatttagtttaatacatttcaataataatgaagttaaaaacaagaaacaaaaggagcatcttaaagacatctttctgttctttgaaaattctaatggcattgcggtttattttgaataatgaattgccgatattaatacttaaaaaaaaaaaaaacgaacgagtatcttaaaaagaaataaaaaagatccagaggatcaggtagctaacggatcggggtttgaacccgaaaccttctgatttggagtcacg

SEQ ID NO: 869 - DNA, 1300 bp, Glycine max
  Soy_ogl_3687 Gm11:2274901..2276200 Cluster 3
aaaaataatgtttaaaatagtttaattgattaacttatgaaaaaaatagaaaaaaaatgagaaaatgaaattgttagaaataaaaaattggtgaaataattttgatttctaactattaaagatgtttctctaaaaaaaactgttaaggatgttaaaaaaatatattaagagactaatacaatatattaattataataacaaaataataacagaaatcatgtcagtcaagcagagtgcttgtcctattagaggaccaacttacataaaaaaaaataattcttttttatttttatcatttattttcttagaataactctttttgatgtaagttaattcttcctcatttatttatttacataattatggtcttaataaaatgtatatgacctattgggcctctttaatacaaccacccacggaaactgtattgttgtgggaccaaaatggtttggtccttttgaatttctacaatccacatagctgggttcgcctgattgttgttcgggtgtgtctgctaaataatactaataaatttactaacaattctctaacactttttattattagtttttttttttactgcaacagtttttattactagttaaaagagttaaaaaatcacaaaaatttataaatatcatctcttatttactgagcagcacgcatgatttattggtttccaataaattttactaactatctaataataaaaaaaatgttgctatcactcctaaaaacaattttaccgggttaactatgttgtggttgttaatgtactggatgggctgtgtgttgaatgtcattgaaggttaaatctctacttactttactttgatattacttaccaaaataattaaaaatattttttatttatattttgttaaaaaaaaaacacactgcaaatttttaaaagtgtttttttaaataataaagtaatttttattaactaaattaaaacacatcggctcaaaacatctcaaatttaaaataaccttcttttttacatgatttaaaaattatttattggaagtatcaaacaaatgagtccttaaacactttttttttttactttaattaatgtattgggtgggttgtgtgttgaatgtcattgaaggttgaaactccacttattttactttgaaattacttatcaaaataattaaaaatatttttatttatattttgttaaaaaataaacaaacacgctgcaaatttttgaaagtaattaagtaatttttattaactaaattaaaacagatcggctcaaaacatctcaaatttaaataaccttcttttttac

SEQ ID NO: 870 - DNA, 2000 bp, Glycine max
  Soy_ogl_4376 Gm13:30998201..31000200 Cluster 3
aatgttgttaaaagtctttatcaacatttttataaatgttgttattagtatgaaaaaatattgttaaaagtctttaacaatatgaaatatatattacacttgataaaatatcacaaaaacttactagtaatatttattcatgttttagcgacattttataaatgttataaaaccatactttgttgtattgacgggtgttgtctcttgagtttggttgattttccttcccccactcttctctcttataaaagaagatgcccggggagtcttttttagcgtttctctgtttgttttttccttgttttataaaaaaaatacaaaaacttcgtaatttaatagcatgtagcgtcctcagtcataataatcttctgagcttaaagatttatgatcatgcggagctgtggatcatatttaggaaaaataaaattatagatttaattttaaatactaaaagcatacattaagtcttttataatactttcattttaaataaaaacatacattaagtgtaaataaattcgtaaatgaacgtgtacgtaaatatctgtaggaatatgggcccctctccagcaaaaaaaaagggggcccaaaaatatgattgggaatatggacttaaagaaatttggataaatttctaggcctcaaacaagctggatcattattgctttcaagttccaaatgctaaaagcaagagtttataggacgactgagaatctgagacgagtaccgtgttaaaacttgaaaatgattcttaattttttatttttttttgctgaatatgattcttaattggtatgagaaagaaaatcgattttgagaaagaaaaaaaatcatctgggtagaaagacaatgatgagaaaatgatattttttattattccaaaaatagtaaattataagtactaattattcttgaaatttcataagattatataaatattttttttcacatttacaagaaaaccccttatatgtaatatttttcaattaattaattaagaaatttagtatagtatataaggagtgttaatgtattttttcaaataattaaggaaaaacaatatcaagatagaaaaagcaggataatgtgtgtaattttacaaaatttcataagtaattaatgtaatttactctaaaaacaagaaaaaagaaatatgaagagaagctggaaagtaactatttcttaaatatacaattatatttctattagaaaggatgaactattgctgcattaaaatatattttaagataaaaaattacttgtcagttgtcacccccttttcttccatgtgagaaatagaaataattaatcaaaaacttggatagctctttttttttcttttttatttattttttccaatgaaagtaggagaatcttctcctctcctatttcattctcaccaatttcactttaatcatacaaaagataaatacacattatattattaggagtagaatttaactaatttaactcaggcttaccttaacaaaagtaagttcagatcaataagaataagttttactaagtgaatttactttattaattcaaactcagctcgcttcatattcacgaattaatcgagctgaatgagtcagtgccaaatcctactggctcattattttttatttaatttttgcacagtatttaattgagaagcatgtcttagttgtactttactttaaaatgatattttgtcattgaaatctcagtcactttattctaaactttacttgtgacaacatggggcccgccaaaaatggtttgacaatttattatgttgtttgatctgtgcattggtgattgaatttgtaccaattaaattagattaagcagttcatcaaatctatagtaatagtaacgtcatcgtcatagccatagtaggattaggaccactacattatctgcaaagtgcaaacagtttaatttgttcattgattacattgcatttcatcaagtgatatagtaaatccaacaccaacacctatgggaccactaaactc

SEQ ID NO: 871 - DNA, 1713 bp, Glycine max
  Soy_ogl_1908 Gm06:11780701..11782413 Cluster 3
aatttggtcaagttgagttattgaaattataataaatacaaaagaaaaaaaaatcagattttatgtattttaaaatatttataaaaaatgaaaataaacttgaaaagaaataagaaaatattctaaaaaagaaatctatgatgttaggtttaggttggctagatatatgacttgataataatcgataatcttgggtcatattttttttttataactgagtaccaacttttatttttgaccaaatatctttacaaacatcaacaaaaattgatccaattgataagttagtaaatctataaatgtttttagccttaatctgtcataattttgattaaccttcaatatccaacttcttaaaattttccgcaccaaaaaaatattttcgaacttaaatatccaaactaattattttttaatattaattgaggttcgtgagcgtaccgaataagtggggcaatcaactttttttaatactaaatctcatatatataatatttaatgcacaaaacaatgatttatgacaattaatgtttttttctaaataaaaaaatgtaggagcgcttgttttgaactaaatatcttcaagaaaacatacacaaattaacatttggtggaagcaattgaatatgcaataactttttagcaaatagatgaaacaaattattgaaaacactgggtaagatatgatgcgttccatattaacttctttctccttggagggacacgagtaggggtggtctatggtatttaagatttaagccaaatttacaatagagttttctataataatgtaaaatgtatgtttggaaaaatatataacttttttttctaatttaaaaatttactattaaaattgtgtaatataattcagtctagaaattaaatatttttaattgataaaatggacgacttagtattttatttttcttgtaacacatctgaatacaaataagattttattaaatgtaacttttaaaattttcttttcactacagttatttaaactaatgttttgggttacaactaaatatagataattgtgattaaaagttatttaaagttatataaacatcaaataacgtttttaaaaaatcataatttgtgtgctttaatattatacgatttataataagatatactgattaatatatttttaattctcttataaaaaataactgacttatatgtgctttaaattaactgtggagtgtggacaagagcccataagataagagcttaattttccagttttgcgcaattatactgagtggtgatagaaaacagtacaatgataaagagatagagtgctggagtttttttgtttggataagttcctttatgagtatttatagaatgccaaattaaaaaaaagttaaaattagcttatatacgtataaaatcaaataaagctttcgagaaactaaaattaaattatttagtttctccaaaaacttgatcgtaaattatgcataagttcattttaaattacaaagaaaatttattttatttttcttttatatttttgaaatttaaaattttaaaacatttttcattttgattattaataattattactgctagtttttatcaaacatgtttaaaaaattatgttttcctttgatatttcacttatgttatgaaattattgagtattgtgtgaatatgaaaagtaaggtcatggttgaaaaaattagctgaaaatgtaattagaag

SEQ ID NO: 872 - DNA, 1277 bp, Glycine max
  Soy_ogl_3775 Gm11:6624624..6625900 Cluster 3
atagaaacagcaaatcaacctccttttctgttattattttatgttttatctctttgattaaaaatatatatctcaaaaagggaaaattattattcaaagatatattactatttagaaggaatatttttctttttcaaaaatttcattaaatcaattaaaggtgtaataattaaatgaataaaagtaattaatttaaatttttcttaatttaattatgtatcaggtaaagaaaatattaaatattttcacatttcaagaagttaaatgtattcatttttctattttatactattttataaaacattaaaattaataaaatattttttttctaaaataataatgtaatatttaacattttttgtaatatttattattgcttttaataaaaacccatacatagttaattttataaaattaactaatgcaaataaaaaaaattgaaaattaaaagagagacagagagataatttttttaaaaatgtctacttataaaattaaaatacattgttaaaacatgtttagataaaatattaaaagatggtgataattgtttaacattttgtaatatatataattttctaaaagcagctaaatttaattattggttacaaatgtaaagattcctaaatctatatgttaagaggctaatcgttttggttatttggtacatacattaaaagctttaattcaatactcaaggtcaaaatttgtattcaacttatcaaattaaaaaaattataaatataatggaaatatagaaaaattataaatataagaaatgtttaggattttgtaatattaatcattaaaggctagtttttttttggcacatatttcactgaatctgaaatttggaggagtcggaatgaagaaaaactattcagacattcatatttaaacaataataaaatttaaatttaatggcaaaagagaaactgtacactgctatcaaattaaaaatacattatcaacatgtcattatcagaagacttggaagcaccacatttagaagattaatcgcaatcaacatcatatattgcattacaatgcctaaaagcttaatcgaatatatacgcgttatttgttcaattaccaagtttttttttactgcattcgattaccaagtaagttattactaaaggttaattcggaagaaatatagtcatgaatttcttaatttcatttgaggaaaccaaagaaaatatctgtcgaggggggcgaacttactgtttttttttggtttttttataagagggagggatttacatgcatcattt

SEQ ID NO: 873 - DNA, 1100 bp, Glycine max
  Soy_ogl_166 Gm01:45132701..45133800 Cluster 3
caacttgacatcaatcattaaatatattatgatgaaagcgcggttatgagaaaggcttctcctacgccacagaaagaggatattaaactattttcatgtgggccccatccatactaggcccatgtgcgttcactacggcaatgcattaaaatatcattcctatacaatttggagttcaatgcattacaggaattggcatgcccaaatatataaaacgacacccaaagattaacattttaaaattgattataagttaaaaattgattttagataaacttataagttattagataaacttttacttttctgatgttgtataaaattttaaaattaattctggatcttgatttaattttaaattaaagtaattttaagtaatttttatattagattagaaacttttttattaaattttacttttaatttgattctaaaataaaaatatccaaacataaatcatttcactttaaaattaattttataaaattaatattattaaaaatcaattttatttaaggttgatccaatcacgtcctaagactacgaggcttgagtatttttgccaaactaacactgaaatatcgttaacaaacaaagctaacactaaaatatctaggcatataaaaataatgataagaaagttaatttcttcttccacgtctaacagaaaatacattacttcattttgaagttaactatttgataaaaaaattagatagagaagcatgcaaattatctaagagaggatgtgagagtgctgtccataataaatatatatcattattattgtaattattaaagtactgtgatatagtagcctacatgcatgacgattaagcttagagttcaattatccatttcaagattggttaagatctatggattaggtcataatgaaaattttgcccaaaaaaatctccaaattatatcccccggcagcactaattagttaaatgaatggagaaactgaaaaatatctaacacttgaaaaattaaacatgtttagaagcatattcattttaattagacttgatattgtcccaagccatgccctagtatctagaattatttttaatctgctaagatttccacagtggcaa

SEQ ID NO: 874 - DNA, 1100 bp, Glycine max
  Soy_ogl_167 Gm01:45137101..45138200 Cluster 3
atagtttttactacataactcaattcacaattcaaaatattaaataagaaatatagaaatcaaactagtaaaaaaatatgatgatacattttccaaatgtccatatatgttaatacctattagacaaaaaaaaacaatcaaatgcctaataaataaaaaaacaaatataaattataaaatattaaaacttttcacaaatagaaaagcaatgaaaaagaaagactaagttacgtatgaaaaaaaatagtgtaacacatttaaaaaaaacagaattttaaaaaattagtaaataatatagatttccccacaaattcttctcttatttgtctttgacgtttcacccttcttgaaggctaaaatgtgaggaaaaaaaaggataaaataattgaacatgcaaggtatgtcaaagaaagaaataaaaaaaacatcaagtatatatgagtatgaaatatgagatgaaaacataacaaagaaagaaaagagagatatgaacttacttatatatcagtgtttcttgcttgtattaattccgtcgttattactaaaaaataagaaatgagagaaaatgaagtgtatagcgcaaatgaaaaataaaaagacttgatgatgagaaattgtcatccacacgagtatatataaagatattattcaaattatatttaaaatcttacaattattataagattgtcgaagttgtaataattatgattatcatgtttattactaaaatattattgcggatattttataattccgatattcttaaactagtatttaatataatataataattataatgtttattataaaaatatttcatataagatagtgtatatgaatatttggcatgtaatatttttgtactataataaatcttaaccgactggaatatatgtcaaattgtctacattttaattttcgtactatataagatagtgtatctcaaactatctacattttaattatgttaaccttcatatatctaatatttttaccttaaaaatgtacttaaaattaagacaaaaatttagagcaaatattcagatatactatcttcaaaataattaatgttaattaattataatattttattaatgatt

SEQ ID NO: 875 - DNA, 1878 bp, Glycine max
  Soy_ogl_458 Gm02:9653201..9655078 Cluster 3
gcttaggacaactttttcattagtcttgtagtattcatgacttcattgacttgcattcatgatatttttcatgagcatcaacatattatatagaatgatggaattttattttaaaaaattaatcttattttataaatttttaagtatttattatggaaagtgaaactttcactcctttattgaatggatgtttgttcaagttaaataaaattattataaacaataatttttttaaagcatttaacgaaattacattcttgagaactaaaaattacaagtttaaataatcttatacttgataatctatgtgtttgatagtatcatatttttgatactcctatactataaaataaaaatagagtgagactctgaccctccccactctcatttatacagttaacattttctctctcttatctttctgggaggtgcatttcaattcacacactatccttaacaaaaaaagaaaaattgtttctcatccatattaaattattctcttttatatatctctatctctaaattaaattttaatgtttttaaaggacttgtgaatagttaaaaataaccttatatcacaatttaaattatttatagatataatttatatattcaaatatatttgttttttattatttttaagcaaaatacaattatttcattcaaaatgagaaaaggcaggatggttaacttagtgaaattatttcattcatattattttcttctgaattttatttttctttaaaaaaaagtgaattcgttttaatgatcatcacacagaaattttagttgccactcttttcatgtattagatggtacctttagaaaaatcatttataaaaaaaaactttgaagaaaaatattaaaataagcagcaactatcgtaaattatctctgatgtttaaaatttgttttttcctgttaggtaatctatgtaactcataaatcataatgtttatgtgacatttgatttgaagagtttaaaaaacatacttcaaaatcttataatttgcttattgacaattcatatcaacattattatcagtattttcagtactgtgcagccttttccaatgagtgaaaaaatggattaaattaataccaacattattatcagtattttgaatattgagcaaccttttccaatgagtgaaaaattggatcaaagtaagttaaactgatcgcaaaattatgaactaattatatttatgattttaatattattcaagaaccccagtcaaaaaatattattcaagaacaacttacttataaatttaaaaagttaaatcaatgtaatcttgatttaaagttttcaatgtttgaatatctcattcaattattacaagattgaacttttttctttgatttgtttgctgactgtgtacactttttcttcattaatttgttgaaatgtccaaagaccatctacataaatttcaatggaaaaacagtaccgtgaagactaaattgaaaatttagaaagaaaagacaagtaataaacagtaaatactgtttaagatatgtttcgtcgataatagagattaatgttggagagttttgaaatattaacaaaataacaaaagtttgaaaaattgccagtcattttgtttttttaagctaaattgagaattgggcttaattgttactaaaaatatcataatcatttttttatctaagaattaaatatcttttcaaaagattttcaacattcatatacttactcaattaattacattagatctcttaatagtctacaatatgatggaataacatactccccacatcttaacccacaaataaatttagaattaggatagattactgcaagacaatattgatgacccataagtcttcttaattaatcattattcgtaagac

SEQ ID NO: 876 - DNA, 1000 bp, Glycine max
  Soy_ogl_854 Gm03:5190101..5191100 Cluster 3
taaatgtgttgaaatgtatatgtatgtatcctttttgttgctctttcattttatgtacaaagtgtataagtaaagaaaagttaaatatatcattttgaatatttttaattattgtaaaaaagtaaatattaaattgcatgtttttgaatttctaatatgtagtagtttcttttaataatatcttttatttttacactttttttcttcctaatacgtactgttattggatatgatagaaaatcgtttttgttgttttgttattttaaaataatgcaatgaagataatatataaatacaattgttgtaattacattaggccaggtcggtttgacataaagcacattctgcatgctgtctgtcagaaatagttgagggtggggaagagttgaacattgattacttacatgttttttggaatttattgcacaatctggtggatggcattttcgaataaacagtcgttttatcaagtacagtacccgtttactccaccacatgtattttaattataactttttattattattaatattctctataactattttaatgattaagaaaaaaaattaaaaagtggaataaaataaataatgtaatggataccgataaagattcacattagataaataatgtaattaatatgatgtttggatagtatgtacaaacaaatttaattaaaagtgtgtttattgtgttaaatagaaattattaaaatagtcgcaaacatgttatagaaaatctatacttaaaaaaaatgttagaacaacaataaccaaaattattcaaccttttttgaaccctaagtatgaatatatacattttacttttttatagtttgtccaaagagatatgaaactctttgggggtgacaactctacacgagactcttcttttcttcttcgtccctttgtgggattctgagtttaaatgttcttttttttctttgactttctccatctccatgactatatgcttgagtaatcaatcttgtttaaaggat

SEQ ID NO: 877 - DNA, 1462 bp, Glycine max
  Soy_ogl_1994 Gm06:16858611..16860072 Cluster 3
ataaatttcattatatatagtaatgcaaagttaaataacaatttatacagtgaaattgtgtaaagaataaagaattgatagaattattatctgttttttttttttttttgctgaatagagttataatatgttgctatatatgattctaataaactcacctttattactatatattggtgaaaaataaaattttggtacttgaaaattatgttaattttttgcaaaatgtatttcaaaaatagaaacaaaaatccgtaaagataacaaatattataaaagattagaggaaaagaaaaataaaaattacaagtatgagttgagttatcaaacagatatttccatatttcttgtctgggatataaagtaacaaataaagcaaaggaactttttttatgagtaaagcaaaggatcttaacaaacaactaagtcattcatcacaatcataatttgctcacattttacaataggaaatcatgtactcgttatgccaccaataagttataaatttgatattgaaaaacatcattattttacaataccaaaaaaatattattttattagatgttacaataaaagcgaaacaaacgtttttttattaaatatatgcagaaaaaaaaatcaaacataaaatgttctgtttgttcatatatatttacaatttgtcttaaatgtaattttcaatttcatattttttttatccacaattttgtattctattttaaaattaagacacttaatttttttattttaaaaaattaacaattttaattctcacattttaaaatagatacatttaattcgcatatttctaatttcatcaaagtatttgtaaaaatttaaaataactaaaattggtaaattcaatttaaattagtaaatctcaattatttttagtttcaagagttatttatagcattgttaaaaatttaatgtttttggaaaatatttataagagtttcaaataatttaaaaattttgtaaaatattcataaaatacatataagaacttgtcctttatgctaaaaataaaatgattaaaatacctttttattgaaaaaaaaatacacaataaattaaaaaacttaagaataattaacaaaaaattatataaatactgaatttttcaactttcatgcgaaataagtcatttttatattactttatttacgaatctattacatgcatgacaaattaagtactaaatctattaaatgtacaataaattcaataatcaacttttgaaattttatataaattggttatagtgttttatcataaactaaattattatataattaatgtctaaaaagttgttttttactttcaatttttgttatttcagtgaacatcgataataatacatacaaaaatatttttgaaaaggaatgtttatacatgacattcccaagagctctaaataataaattcattttattttttaagataatttatttaaaatcat

SEQ ID NO: 878 - DNA, 1569 bp, Glycine max
  Soy_ogl_3065 Gm09:20211232..20212800 Cluster 3
tatgatgtcatataattattgtacaatttattgtatgtgtatcatatctctatgcataaaaaattattataatatactgttatattatcatttcatgtaccaatagtgttttactaattatttaaattttattagttattaaagactatatcagctaaattaatatcaattcattagtatatttcatcatcccaatttagcctgcatgtaacatttgctcatggaattgaaattacctgtaaccattgatttgttttaattgaaacattattttaattaaagatgtgaaaaataagataaaaagaaatagaaacacgtaatttgagttcaccttgaagtttaatacagtactaaagtttataatacatgttcatcgctattcatgacaaaaatgatatcaaaatcatgctacttggcaactaacacaaattttacaaaattttaaataattttgagaatatttaagattcttattttttaatactagtattattttatttattggtttaagttaaataaatataaaaatggatctgctgtactacttatttatggctattaatattatcttgtaagtattgtcatctgctcccctaaatatttggtttctaaacaaagtaatcccttgattggacctcaaactcgcaaatacaacagctaaaatggctttaatgctgctttgtcaattcaatcattattatgatttacagaaaaagtagtagttctcacctcacgcaactaatggtagatagagatgcacaaaagtaaacttgtctttggaatttgaggctcttcagtcctaatctagaaaacaatcatttaatgttagtaatggtaaatatgttactcagttttaaattactaaaatatggtaccaattatagaaatattttaaagctattcttttcagtgggataaaattatacttttttcatcttataataatagtcatttaatttatttatataaaaaataataataaataaataattattattttataaaattaatcttatatcatcactagatcattttaaattttataatttatcattaatatataagaaatatgattcatattatatttaaaaattttagatgataatatattgagatattttttttacattaattataatagaaaggtaaagtatatgattaatatgttgattttgagtattaaatatgagattgtgataaatattgaaaatcaaaactttgtccttgatgttgttctatcatatttgaggagaattatctttagtagaataaattttatttttatcggtcaataataattactaatttttgttattgaaagaaatttaaacttatattatctttcttttctttttctttttttcaacaaccaacttcaatttataactcctcaatagaagatgcgtgtgttgcataacatattaatctcaatctccaagggccattcatgtcttgtgtctaagaaatcaaagtactaattgattttgattcggagtaaacttaaattctttaaaattgaaaaaaaagaactatcaacaaccaatgagtcatggatatcctataatcatg

SEQ ID NO: 879 - DNA, 1501 bp, Glycine max
  Soy_ogl_3421 Gm10:33826601..33828101 Cluster 3
ttggtttaaaatggtaaaaaattgattaattgaaaggtatacataaacaattgatcggaaaacggatgtattggatgctagaaagtatgacagttggaacagacttgacttgggaggtaagtcacgaatgagtgactcgagtagcaagtgtgatctcaatatatataattgagggtttttatgcaacattaatgtttttttatccataaaaataaaaaaatatcaagagattaatttacaataaatcatacatcttaatccatcaattgtgttagactcttcataatattaatgatttaaaccaacaagacctaagaaaaactacaatattaattgggggagggatatttttaatttttttaaaattatatgtgattcttttagtaataaacttttgaagttatcctttctaacttttatatatgattctttcagtgtaagatttattagagtaacgaataagaaaaataatcacatattaagaaaaaaaattctgagaagaaaggacaaaacttataagtgcttttaatgttatttttttaattaaattcgaaaattcttcttagtttatggactaaatatcaatattttttgttgaatatataaataccggttagtaaaataaattttcaattttaattaaaaaacttccaaaagcttcttaatatttacatcttaagtttttttcatcaaaaaaatttatgataattttgatataaattagaatattaattatatttcataatatataaattatagatttgaataatagatataaaatgaaatgtgcctgtactagggtaccatctgaatatgcctttttatattttaatagtttattttaaaaaaatatatcttttttgttttttaaaaaatatttttgttttttaaaatttatatttaatgcatgcaagtttttttatgataaaaaaatctcattgaaccgaaaatcacttacgttaagcaagagggaaaataaggccgtacgacacctacaaatataaaaggtagttaatctcaaggaaatgataaggaagaatctatttttgggagctcaaacacagctacaagggattcatttgtatgtcaactaaatataaatactatctagatgataacatcaaacctttttgtttctctcgatgatctattatagtctttttctggtcactggttatgttgactgacaattttgatattagatttaataattataaattaataaataagagtttgattttaaagactaataatattaaaccaaaaacactttaattttaaggattctttatatttaaattagtaatcatttaaatttttaatttgatatataaacttataacaaaaacggactttatagtaaatacaagtcgagtaacatggttataatagttaattcttataagtgtgaacatttttcttgtacaagtataaaatattatttgaattaaaaatatttatgaatacaatggtagatttataataataacactatattatg

SEQ ID NO: 880 - DNA, 1636 bp, Glycine max
  Soy_ogl_4017 Gm12:7814635..7816270 Cluster 3
caacaacaacaaagttacgtacgcgcgtactatatgttatatagcttcatccaattaagtggagctttaattacatatttcataacgacaaatagaaaggtggtgaattatgattaatacattgccgtatatgtttggtttggatgagcaatatcgcgtattaaattattctctttgctcctttttatttatctattttagaaaataagatactgtgcagattaaaaatgtaattattatcttcatttgtattaaaaataatttaaaccttttgatattatatttttttatcatttatgataagtgtgaaaaatatttaataattaggtgcaaataaagatataattaaaaaataataatatatattattttaaacttttagatgaacaaataaagagaaataaattttttcataaggtgaaaaaacaaaaagaaacaacgagaataataatccatcataatttttaatacactacaattgaaataaatatactgtcattgtttttagtaagaaattgtttattaatgaaaattgtatctatataaaattttgcatgaaaattataagaaatagataaaaataaaaataagttataaatagaataattgacttgataaaagtaaaacataatataaatttgtttatggataaatattctgattattaatatgaataattctaaattctcttacaattttttttcgaattctcttactaaaccaagaaaatattaattttttataaaaaaaaatagtgcattagatgatgtatttatttttatttaatactttgttcataaaatatttaaaaagtgtataaatttcaaaggaacaattgcaatcggtgaaagaaatagtttttaagcatcattttctgaaaatgatgaacttgactaacgtgacagagctcaaattcgaggaagaggaggccaccactggatcgagtcctcctctctctgccgtgtcaagccaaggaagacaaaaacaattacagaaaaagaacaacgaactgaaaaaaatatgtttgctaattatgctatgtttgattcacatatgattgaaatagtgataataaaaagagaagataaatttttaaattaaaataaaatataaaatgtgtgagatttggatggaaccctcataatttcttctctattcttctcttctccctcttaccaaacattaatgttttagaatattaatgatgaaaataatccgcataaattatttgatatttttaatttattagatttttgaacttgtatttatttattttaattaagtttaatacatgtttagggacccaattgcaaaaataaaatattttatagacctatttaaaattacaaatagtttagagacttttttttaaatgacaaatatttttgaaaaactgtaattttgatataattgtctactttgcatacatattttttctttagttttggttgaattgaattctagctcgattcatttaagtaatataaataactaatttacttagtcaaaatgtaaaactagctaaaagaaatatatgtcaaaatttaggattaaataaaaatgtatgaactaaaattgcgtgagagaaaaataaatggacacaaatttgaaaactaaaggagaaccagaaatgtaa

SEQ ID NO: 881 - DNA, 1247 bp, Glycine max
  Soy_ogl_5082 Gm15:22982901..22984147 Cluster 3
tgtacatgttttaataaagtttataaaactatctaaaattacacacgttaacttcaagtgactaaatataatttctaatttcttcattaatcaaccaatattattccataagaaatatatgatattcggagagtattttcccactggaaaaataatttcttatgcagccaaataagaaacatcaattaaaaatttatcacgttcatcaactaccagataaacaacaatttaaaatgattttaaactgtctatttataataaataacataaaattaataattaatgtattctccacaattatttaatcaataaataaatattcaacatatttttgataatatattaatttttgaaaaactataatcaatgaaaatttacgatacaataacataaatttaaatgtaactttataaatgttgtcgtgaaaaaatctcaacgattagcgaaaatgaatttagtcggctatgactgtttcagcacgatttttgaatagtgactcaagtgatagccgtgtttatgggtgtgactgtttcagcacgattttcacacaattatgggtgtagactctcaagttactacataaagcacttgatgggggcatatattggttgtttttgtgattgaaggtgtatacaaacatttaaaaactactatttatacttgaaaaatctaaattaactgatcctaaaccgtgtttatacacatttgttcatgacttcttcagttttagctaatttcgacttatatcctcacaattcacagttgggctagacaacagtgagacacgcttcccacattcccccgatctttcgggattcacttcctagatcatggggtcttcgaattttcaaccaaatttaaccaatatctcgtgatattagctacaacttgaactttaacgcgctgatgtccccattcatttggctaattgaaaaatattttgactggtaacaatattatatatcatattttataaaattagatttgaattatatatacacattttagaaaaataatttgaatttcattagatttaacattaatgaaggattaaaatatttaaaataactaatatataatttaaataatttattattaactaacatattttaaaatatatttcatgaccaataattaaaaaatatattttataaatatgaattaaatataaactaatttataattaatgctacatattttcaaaaaatttcatgaataataatgattaaaataaggattttatatat

SEQ ID NO: 882 - DNA, 1476 bp, Glycine max
  Soy_ogl_5130 Gm15:46734201..46735676 Cluster 3
ctcatattatattaatgtatagtacctaaatcacccactaaattaaccttagttagctttgaatatacatttttattttacaattcattctattaattataaaatgattataaccatcatacacttatctaaattgattatactctactattaatttttgtgtattacattgttatatcttacaattcattctattaattataaaatgattatagccatcatacacttatctaaccttcaatcatcctccctaggctttcctcatgttgtctctgtcattgcctgccctgtcaagctagtaacaggttaattggttaaaattaattttttggaatgcattgctttaaaaaattaatatctaggcgtattaaaaaaaaattgggttttaaaaaattaatttttaattgctttctgaaaattaatttcaaaatgtatttaatacttaatattaaatacattcaatgctcaacattaaatatattacaaaaaattgtttcagaaacattaattatccttatattgtactccctccatttgagaatatacacatttaatattttttcacaatattaagaaataaaattaatttattaaattttaaaaaatattaaataatttcttaatatattttttatttctctaattaatgattcatttattcttcctatacattatttctccaaagtatttattaaaaatattcttttaaaaatatatttaatgtaacattaattttgtaaaacaacatgttttaaaataaatttcttttttctaaaacgtcagatattctgagagagtatttattatcatattaattcatcaactgcactcttttcatttaaaaaggaattcactgaaattatgttggctaaacattagtaccgagtactccttacattccatttaacttgtcttttacagtaagattattacgaaaaaaatttaagaaatatgataaaaaattaattataaaaaagtaattatggggtttcttatttgatatattttcctttttactttacaatatatgtaaattaatccaagattaaaaaaagagtataattgataaaaataattaatatgatattaaattttgcaaaaccaatcatataatataaaatctccaaaatataataataaaatatataaaagtaaaaaagagatctaataaatattttaaataaaaaatattaaatataaaaagttagaagcttatatttttaaaatgttacttgaattaggacaaatggagagggaacatctagcccctctcccttgacatttttcatatacataggtataaaagttagttgatgtaattatataaatttgatcatctatattattattataataataattaagggtacttagtataaaattaattgtgttataattattgtaatggttaagataataactaaaaaaaatataaaactaattatgtgtttattgtttttatggtaatggttaagg

SEQ ID NO: 883 - DNA, 1548 bp, Glycine max
  Soy_ogl_1969 Gm06:15658650..15660197 Cluster 3
ctataactattaataatgagaattattccatttgatgtatgtattttcttaacagttttaccctccatcagtttttttttaacaacctcccccactaccttttaattggttacttcttttccttactttttttaacttctaaacctttcttttttcttttattttatttttatttaaaatatatagagagactcggagtctttctctttccctaataataataaatctagttcagttaccaaaatttgaagcccttcaacaaaaatatcaagttgatggaagcaatcataatatcttaccccaaaattttcagaaattgtagtttgctcgtctaagcaaatactcgagggcttaactttttcttcttttgattgttggtaagagaattcgtatgcttctagtggcctcaaacctgctttcaatgtaggaaaaaaattaagcatcatcaaaaactacaattctcacaaaaaatctcaaatgttattcaaaagatgggatacttaagttttaaacttgtaaattttaaatgcctcataaatgtcattaggatcccacaacctaatgtgactttcaaggtctttgctagactctcaacgaacttctctcaagctgtttcttgtaaaccatcaggcatactacccaattatcctcatagatatgagagctttatcttttagcctttctaagccaacaatcattgaataagagtgggtccaaaataaagaaactaaacttatgctttaaactcaccaataaaaaaaatatttgttattagtatttataaaatataaaaaaatatcatattgaaaaaaaaatgttacatatattagtaaaaggatataacatatttaaattaaaaaaaattaaaatttactttaagttttatttatcgttcagttcaatcaattatgattttcatcatctttcaatgaagagctgttattttctaatatatgtgatttaagaaagaaacatgtaagatctagatagctagataggtcttatttactctttatgatctaaatcataataacacagtttctacatcataaaatttaaacttttgtaagagacgtcttttcaagcttgtatagcttgcttttccatacttcctattttttttttccgtcaaatagtagacatcccaagtttcaagttgatgtgaccacacatcacagagctcaacggaaaggagtaccaacaaagtaactaattatttatgattaaaataataaaaagatataattgttttgagtttataataaaaaaattgttttgattagctaataaaacaaaaatcttgttgtagtctttcatattttgttttagtttatcgtaaattagtaaattttgttaatttattattagttcttatcaagtattttttaaaaagactaatatattttcaaaagaattaatacaaaataacaaaaattacatgattctaaggcagctcattagttgataccgtaattaatttctaccagtaaaaaaaattagagacaaaaaaatcactaatttaagggagtaaaaccaaatattaaggac

SEQ ID NO: 884 - DNA, 1744 bp, Glycine max
  Soy_ogl_2768 Gm08:19237057..19238800 Cluster 3
taggcacacggcatatcctcgccatagagaaggagaaatttgatttttagaagagggtttgtttcatcgataatttttttagtcttgaaaatatatgagtgagaaaatttatgttatgtttattacggaataataaaataattaattcctgatatattttatttatgctatgtttattacagtaaaaaatgttcagaaataattaaaatatattccctatgttcggattaaatattagttagatatgaaataagtttttcctatatatcctcttatcaagattaaatattagtttaacatgacattatgattttcatttatttttaatagttaaataaacacattttctataaaatattggaaaataacattctgatgttatattccttgaaacaatattcacacgactacagaaattatccgtaaaacaaacatcttaaatgtcttttccctcttcttacccaagcataagacacctatagtcactggtattcttgcaaagtagattttctctttacataattaaatttcgaatttaaactcatttttaagaccaatttttcaaaaataaaagtttttcaaactttttatattaaataaaattagtgcctcttgctatgttttcacaaatttaatattttctttttgtgatacactgtgactagtgtgtcaagttgcccaaatctaaatctaaatatgcaaaattttcaattaaaaaatccagatatataacgtgagttactaccataacccaattttttttattggaaattttatattaacattgattgtgaaaaatgtgttgattttttttataatgtcatcaatattaaatgaattaaatacgtttattaaataaaaatacaataataaatagaattaaatatttatacacattcaacttcataaaatattttaattaagtaacattatataatattataataataaaataaaaataaatattcttttctaacttcttgaataagaaataattattaagtttctaagcatgttagatttaattttatttgaatgaattaattgcaataatacaattatctgtgtgttcacgttataattttcctaataattcttttaattgttattaaaaaaataattctttaatcatttaaacaagaaattacattttttattttattttttatgcattaatttaactttatttgacattttctataataaaaataaaatttaacagaatttactgaaattaattcttcttatagaaaaatattcttgaatatttgttaggtttctatccgaggagagaaataaaggatagatttgattggtaatatataaattatccctaatctcacatggttgcccgtgtgaacattaaccatgttagaaatcaagactctaagttaaggagaaaaacaaattccacaaatgtttataattcattgattttaaaatacaaaacttggaccaaatttaattggtgatgtggatagatattgtgcaaatattgtggatcaaatttaataggtgattttgagaaaaagataccacttcataaagagacaattgcaagtgatagaaagattacaaattacatttatggtagaacaaacattattattttattgcataaatttacaaaaggggatgatttgattagaccttccttgacccgttttgctacttcttacttgaccttgggatgcttgaaatagaataagtgtccattaaatagaatgttcacgttcaaataatg

SEQ ID NO: 885 - DNA, 1573 bp, Glycine max
  Soy_ogl_3398 Gm10:62711..6610283 Cluster 3
ctttctgtttttttcctgttggcaagcataaataaaataaattacacagcacaccaattttgaataaatagtcctttctagatgatgacatattgacatgtactcgctcaatacccacgttaaaatctttcgtctcctacacataacagaaaaggtaccccatctcctcccaagatattacttttgcattttcgtttcagcatattattattttaaatgtttaccttcattactgttttaatgcttaaatttgagtgtatttttttctctcaaatttaaaaatattttgttactcttagttttgataaattattttttttactctctaacataataagtttacattttatgataattttaaaatataaattcaagcaactaaaaaataaaaattaatttatgacaactaaaaattatcataaagtatcaatttattatgtcaaagactaaaagaaataatattttatcaaaatccagaaactgaaaaaagcaattctaaattttagggactacaaaaagcacacactccaaatttatggactaaaacaataattaaccttatttaaactagttttaatactaaaaatcaatttttatatttattttaaaagttgttgaaaccagtttaaaaaaaaaaattgattttccaaattaaattataatagtgattcattttgaattggttgacaacttatgggataattaatatataatggtacatgtttttaattaataaattaatttttatttttaactgcttaaatttatattttaaaactatcataaaatactaaaactcatcataaaatgtcaatttattatattagagactaaaaataataatttttcaaaatttaaaaactaaaaaaaatatttttaaatttcagaaactaaaaaaaaaacacattctcgaaatttaggaactaaacaggacttatataagcctaaatctttcaatgtagtattttgcattttaaatcttatgaatcaggcagtgagattaactttcagaaacaaagatagtacggtaattaagtaaaactctgtgttacaggtaaatttattttaaatcacaggttattttcactatcacaaactactttaaactatgttggattgatggtaagtgatggagtagagaatagtgagtgaatgagaaagttgatcccatggttgttgtgtaaaaaataagaataaatcataatggaattaaggggatgagacatgatgccttccataccattatttagtccaaatttaattcatcctcaatactacgggatcaaacaaaacttttaaaatgaaaaatctctatttttaccggttaaaaacacctaatccttgaaagttatttttaagagagagtaatataggaactataaagttatcatatatttcgttccaaacaataaaatgtaatttccatttaattctatttcattataaaatattcaaacaataaaatagtatttctaattcatttcattctaattcattttgtcacattatgttttgatccactcttcgggggtttttttttttatcattttggggtatttttttaaatagtact

SEQ ID NO: 886 - DNA, 1076 bp, Glycine max
  Soy_ogl_6716 Gm20:30990525..30991600 Cluster 3
ggggaaaagaggctctcctctctatatattttaaataaaaaagaaagatttagaagttttaaaaaaataaaagtaactgactaaaaagtagtggggtaattgttaaaaaataaataaattgatggagggtaaaatagtctaaaaatttgtagaccaaatgagataattctcattgttaattaatagttatagattattaataagagagaaaagacactaagtgtcttttaaaatataatcctttcaaaaataaaattagatagtttgtaggatgtgagtgacatggattagttgaaaagaataattatggtgataaaaaaagaattgaaagggtagtttttggaataatatggaaaaagaaatgcatataccaaaatattttattctctctattgatagtatagattattattaatattagtaaaaaaaaaggtactttgtgcctcggtttaaaagttatttatatatgtagttggatgtaatttattttgaaagatataactgttattaaaagttaaaataaaatataataataatttataatagttgagggtaaaaatattcaaaagaaatatgatatcaaatgggattattttctttataataaggacaaattaacctacatgtactttcattcctattttgctatcatatttattgtggtaaaatttatacttcctcaatatcaaacgaatagttgtataaaaataaaaaattatttcaaaataattgacattttaatttttcaatataatattaatatttttttttactaatgccccttatcatattaataatatgagctacaaaaataaataaaaataatgataataaaattaattttataaaactattattatatttatctatttaatgatttttcttgaaatgtctaaaatacctagaatgacaattacaatgtgacgtacgaaatacattacaataacagtttctcttttatatatattttgatctacatattattttttgtttaagatgttttctaaattcatgtttatgtgcgcaattttttttttgcgctaaaattaatataccacgttttaattgacatattt

SEQ ID NO: 887 - DNA, 1400 bp, Glycine max
  Soy_ogl_400 Gm02:5351701..5353100 Cluster 3
attgtttggaactatgttttaataaataaagggctataaaatggcataaaaatataaatagaatagagagggtgtgcttagtaagtgccaaaatagcaagtagtggacctccactggaaacggttacattacgaattccaaggccattgttattggcactttaccctaccgcttacagaaatgcattttcatttattagaaatcataatagaaatttgttttcattttgtattttggatgtgtattcccaatataaaacaaaattttaattagggacttaaaaactttaatggaaaaaattgagaggttttgttcagtcaaacaaaaatttaaaatttaaaaattattattttttaaatattagagactaaaaacttaattaattcttttataaaataagtcaaatcaaaagaattagataaatagtttgtttgacctttagaggatttttttccaataacttcaaacaataaaataatgaaaattttatggctatcactcaagaaggttgagttgtaatttctttaagttaaattaaaaaataatttattttacttgtttttttgttttaagtataggtatgtggggggttgttatgtatctttatgtgttatgttctttgtacctctcttcaccaaactttgacactcatcttgtgtcatgtttggtttcaaataataatatctcatttgctcacagaaaaaaaattaagttaaattattctataaattcttgtaattttactaaatttattgaaccttgggttataaattttataattataaagcctttataagtttacataaattaagcctaattattacttacctggcttgatatgttttatatgtgacaatcgtttataattatgtattttagtgtatgccatcttataatacctaaaataccaatgtgacttctaccctaccatttctatcttcctcttcctaatgaaatcaacaaacaacgacatccaacaacactatgatcataatcagggacgaagggacaaatctactttaagaggattgggggcgatctgcccccactaagtatttaattttttcaacataaaatatgtgtttataaattgccccataacctaaaatatatataataaaaaataatttgtaatatagataatgtccgcactaatttataaatgtgaatattggttctcacaattaaaattttctagatccctaacatcatgatataaatcttagggacaataccattaattacaagaaacataacaatgttggaatttaaaattgttacctgttttgtactaggcttgaggcctaatttgcatatgactagacctacttctctcaaagtgttgtatcagcccaaattgtaagggatgatcaaagttaacgtttagatgtaggattttt

SEQ ID NO: 888 - DNA, 1091 bp, Glycine max
  Soy_ogl_1285 Gm04:7787625..7788715 Cluster 3
gatgaattaagtaatttgatcatatatatagaaacagagaaaataatttttttaccaatgaaaagtgtaaaagaaactaggatttaaataataaaaagatgtagggacggtactttttttgggtgaacatagagacggtacttaacagtaagaataaattaataaataatatatttcttttctgtgaaaattaaagacaactccatcggaagttgacaaactaataaatgacatatagagattaaattgaaaatgtcacgatgatctttatgttataatttttaggacatttaaacaacatttttttcataaaaagaaagatcgtttttaagaattataaaggataaagattacctttaaaaaaaagtaatcaacaatggataaagaatgataatttctctttctgttttcctggccttaatttttaaggatggctacgagtcagcctataaagtttggtaggtttaggtcagatttaaaccatattttgctcgttgcccatgtctggggagacaacactcaacccgtctgtaaaaacctagcttcatttattattttccctttttttaaattattttgctggctggggttttgataatcaaacggatccgaaaattaaagacatattttattttcttctcatttttttttaaattttttttaggtcagttaagttttttaggatattttgagtttagtctctgaatttttctgagtatttttttattttttttagtttgggctcgacatttcatttttagtacatttgggtgagcgctaacaaaattatttttggacgaaactgaatttgtaaaattaaatttctaaatgtttttattttaaattaatttagtaaatttcagtataattttttctgtacagtgcaaaagctaactaaattaaatggatttaattcaaaataaatttggagacagagtccattatttaacgtgaaaaaaaaaaacgtgaacatgtaactaaaatcgtgttagttggtatttcaacataattttgaataatctaatgtgaaattaaatagaaacttagtccttaatgttaaatttaaattattaataaagtgtgcgcgcggg

SEQ ID NO: 889 - DNA, 1774 bp, Glycine max
  Soy_ogl_3859 Gm11:16990627..16992400 Cluster 3
ggagaatatacaatatcataagctaaaacaaaagtgcatctgacaaccaaaaacaaaaatacaaaaagaaaaaggtttcgaaagtgcgtcttgatttaattattatccgctattggttgatacggaatttattctaagctgaattagtaccatttccatttagcaaatccaattttgcacatatttaagaatgtttccattgctaaacaaatagacctaaatttggtgggacatagacgtggaagtttccctaattattgagagaaaaaaagagagagaatatacaggacagatattatattatatttgtatgataaaattatgcaataacttatataatacctttttttttctttctccataatgtatcttatatttctctcttttatgtatatggattgttatacatatttattattgtacgaatataatatactaattagatttgttatggtcaaataaagaaaaataagtggcaaagaacgcggcaaaaaaagtgaaaccccgactacaaataaacattaaaaattaaaagaggccatatatggcgtacccaaatgcaaaaatggtagccatgaaagtggaatttgatgcttgtgtatatgcttcgatgctgcattagtagatttctttagatgcatttttattgtttacggtgcaatggaagaaaataagcatctgtttcatgatgggatggctacgtagttcaaagtggggctactcgttggagctaactttctagttgatgtttggaccatctattttttttagttaaataaaattatttctaattttaaactactaaaataattagaacctcaaaattaatctcacatattaattttgtaataaaacgtatatataataaaaaatgattttaaaaacaaagcaacagagtctttatttaatgaaattttgcgattctttataaaaaagagagacgcgcaaatagatcatacatactttgcagcaacgatcataaaagtctgtttcccgttagtaagttcggttacatacaaatttcttaaaattggtttttttaagtattttttgtacaggttgtataccttttgaattaagaaagtaatgtttatttcgattttcttatgacatggagtttttgatattgtgaaaccttttctactagcgacgtttttttagagagaatatgagatatttcttatttttttagcttggagttagattacctatcaggagatcctcacctcaataggttatgtttcgattgaagtttggaaaatactttgtaaattttaatacacaataacatattctaatacaccaaataaagaagaagaaaatattacttctatctcaaaattacttttaagctctcacaattttaatcaaaacatatacccaatgagagttgaactcacttcttctgaaataagttttttttttttatcaactagatcaacttttgttgatataagctaatagactaaaatgatacagaacaaaaaaattgttttgaatcactaaaattttgccaaatactaaaagttgcatattggattaacctctatttattgaacactcaattttttcataattattaaaatatattgttttctattttatataaataaataatgcatttcgaatttgaaccagctcaagaccaatgattagagagagagaaaaacacaaatgaatggacactttcagctcaatgcagaaaagaataaactattttaaaatattggatcacttgggcctaataaaaaaacaaaaaagagagagaagaaaa

SEQ ID NO: 890 - DNA, 1380 bp, Glycine max
  Soy_ogl_4181 Gm13:21072898..21074277 Cluster 3
atttttatttcatgatataatattgttaatcttgcacacaaattaaaatatgaaaataattaaaatggcttattataatttaattagaagaataatcattcaaaaaaatatatttaataatatcaaatattggttttgactattatctttttaaatttattattatttttaactaaataataacatgatttaattatgtataagtgtcaggtatttaattagaagaataatcatttaaacattttttattttacttttatctgtgacaacaaaattatgtacttacattgtaattgtttatatattattatttaattatagctcataatttatttataattttatataattattttaaaacaggaaaataataattttttaatgtaacattattttacatcaacgtatcatcattatattatttatctattattaatatattatataatattagtagaataattttaacgataatactatcttgatacgcctgttgtgatgatattataatataatatgtgtcatggtaagcgaaatatataaaaaacaaaacaggaaaatataaagcgaaattctgtgatacgacatttagctgcaaagtatattataattaaaataattaatttccgactcagaagtttttggttgtaaagtgtattttataattaaaataaaaatcttgttaatgagtattttaggacattgattaataaatcattaaaaaatattattatgtaaaaattataaaagaactttaaaatgttataatcaatataattttacgtatcttactaaaaatatttattcttttaactccttaattaatatcccaaaaatacatgtttgcatttgctttaaaataattatattttcttatgaatttgacaaatttgatacacacccattcacatttcacacacaatggaggcgaggagacaaggtcaaacatgttttatatttaaaataaaatgcaaaaaatagaaagtactttttaatataacatttttggacattaaattacaatttaattagagaaagaccctactttcattttttttatagagaaagaccctacgtgtttcaaaaattcatcaagcggctggttaaagcatatattaagaggaagcaataaaagaaattaggattatttatgtatttgtttgtaaaattttgaacgaaacagatttgaatttcccaaattgaaaagaaaatctaaagtttcaaaagtatcttcaaattaagtgtaaaagaatctttaatttgatattatatattaagatttaaaatttaaatcaaattaaaagtaataaatatgtttgaaaggaataaaaaagtaaaataaataaattaaatgtttaatatataggttaggataaaata

SEQ ID NO: 891 - DNA, 1400 bp, Glycine max
  Soy_ogl_496 Gm02:11625901..11627300 Cluster 3
ttttctcccacttataatcagatcttttgattatgatttaagtttttatttatatgcattatcagtgtaaaattaaacattataattaatacgattttgaagataattaataaatataaaaattaataaacttattatacacaactacttaaaatcaaatgtctagggtaaaaactctttacattttcggtaagtaaactatttattttatgatttcgacagaattagtaaacggataaagtgaacataacatgccaatcatgagtccataaatgtaaattgaaaaatacaaaatattgaactaccattatctaaaatgtgctgtgattgtattgacttaattgccatgttaacgatattcgggagtaaactatttcttaattttatgacaacaataaacaataaaaaatatattttatactgtaaacaaattaataacttaaatattagataaaatcataataataaatgtgagtaaatatgataaatctaattgatgcaatactaaaattgcacaattttaatatttaaaaatttaaaatatctcattttttttattattatactgctgttcacatttatatattattgtttttttatttctaacgagtatatacatttctttggatgagaaagaatatttatcctattaattatacacttttctatggatctaaacattgttcatattatgaataaatagacctgacaaaaagcaaaatcattaaagaggaggcaaaagcagaaatacaaaatgatggcaactgagacccgtcaccgttttccccgtctttgctttcgtacctttatcttttttccatacattgcgtttatcgtgtttctgatcatttccttctgttctgtcatatatatctctctaattaaccacgcatgttaaattaattgttaatgaattttaaggtttgacttagatgctctgcagcttcacccattctcttctccatccacattttattaggttaaatcataattgtgtgtctttttcatataaaattgaataaaaatgcattttttttttcttttttcagttatagtaattagagttttgacttttgagtgagataatctcacaaactttcgtcttttttttttttcaattataagacttataataaatgtaagatttaatcatatttaaagtttattatctttatgaaagattttttatgaaaattaaatatcgcttttaattcattatatttgagtgtttttctaatattaaattttaaattttttatatatatttttaaatgtttcgttttagttattttttcaattttttgttaacatggtctatattttgaattttaaaataattaaactagcataatggtgactaaaaatcagtattatgtgtaatggtagatggttatgaccat

SEQ ID NO: 892 - DNA, 1141 bp, Glycine max
  Soy_ogl_4686 Gm14:5536160..5537300 Cluster 3
gggaatagtgtctctctcatccatgactgcgccaccgaccaaactaatcatacttcacgtgtccgtgccggagaattaaaagggaattatcattctgcaaattataatctagtgctcaagtttaatgcaagtctaattattatttaaagtctttttttaattaatatttctatcatgacttattatatgaatgcattttaaaaaaataccaattactttattccacgagccatctagtaaattttcattttgcagtcttcaactctacttccgtcacagagagctgagtgagcacatacctcagtctctttttcacctcttctcattctctctcattaagaaaccattcaacgttgttgcacacttcgttctccttcaacattgttgcacacttggctctcgttctctcattcgctctctatctttctcattctcacagattcaaacttgttcataggtttctcacaaatttgaacctgttctaaactcgatttgaatcgccctaggtttctaaactcattttctcttaaatccacaggttgtctctcgcatcggagttttgcagaagccctagctttcagtttgattaggcgattttgtgactcattctcattctctcgcatcggtattgctcattctcattctaacaatgcaattgttgttttgcttttctctgattttgatttctaatacagtgtgctactcaaatctggtgatgtgtggaacaaaattcccttgctatctctgttgttgtttttctaatagtaatttcaattaaattttcatgggtttgtgaaatttcttattgaacctcatatagtgaacttcagagtaagaaatgcaccgtattacatattgttttgctcaatgttttgattattttacattttcaaaatgaatttggctagtggttaggaaatatgctatgaaaagttttgaatgaatactagtacaaggtataattaatagaatttttaaattttagcgagataaagataagaagggggacaaaatctgcatatgctccactatatcagaagccatgacttgcttgccttattccaacaggtttcatttaagttatttataacagttgaaaagtttcatttgaagcaaaactgaattacttattcaaacgaaa

SEQ ID NO: 893 - DNA, 1600 bp, Glycine max
  Soy_ogl_3866 Gm11:17343601..17345200 Cluster 3
gttttctattttaaatttgaataaaatatatgagtgaagcataaaatatatttaaatgttttttattttaaaaaataagaaacataagtctcatatttagaaatattaaaagcaaggaaaaaaattatcgtcgtttttactttggacccataatgatggtcttaatggtgaagtttggaaaatttgtacaaggttttaggtttaatttttgttgttgttatttattatatataaaaaagtaaaccttcattataattatagattttttgtctttattagttttttttcacatgtatttttttaggtaattatgtttgaaatattagtgaatattaaatgtaataagtatttatcttactaaaaattaaatcttcaatgcattatattatgacattaagagagatcaatctcttttatcaaacccaaatctcattaatttccctacaattatatgtggcacgacactacatgaaaaccctgtctctataattaatattatcaaaccttgttattattatgatgtgactatgactaacacttaagactccaaaactttagtaaccgtcgaataagtaaaagtatcacaaacagaatcaaatgtccttcgtttgtgtcacctctaatcctttgtggcattgagtactctaccaagcaccaagttcataagtgtatgtatccaaaaaataaaatacaggaaatcacaataaatatatttttaaatgtttacttttttaaaatataaataaaaccaagtagccttacatttttcctaataacctacttaattactttcatccaatctcttagaatatgtttgtatacacgttaccaaaataatattttgtaagaagcaaaaaattattgtttttggttgaacgttggtttgaggatcctggaacgaaaaaacaaacatgccattatacatgaagtttaaaagaaattattattacatggtgtgattgggagaatttatttagaggttatttagatttgtcttgaaacataaatagtacttatgtaagtatttgatagaatttatgaaaatacgcgttataaaatagtactaacttacaacttacatggaatttgtttaactacatttgtctttcaattgtaaaaacatatttttttaaggaattgtgaaaacatcttatatcttatatacaactacaagtgtttatactttatatgataaacacttattctataaatacttattttaattatttgttcaaacacatcattggtgatttattgtatagaattagtattttttacgaaataaataaatgattaaaactattaatgacaagaaagatgtttcgaactttaaagcatgttcattgtacttaaccaatcaacactttctgtcaacatatatctcatatatttcttaactattacctggaaggataagggattagttaatttaagtttttatccttattgcattgcaaatgacggtcaaatttggaactttggagtcaattcaatcaacatatttatgcatcaaaggtatgtttactcgttacttggaaaggaaacggagcaatataaactataaagttattcagagataatggaaatggcagtgtggaga

SEQ ID NO: 894 - DNA, 1900 bp, Glycine max
  Soy_ogl_1340 Gm04:41749801..41751700 Cluster 3
ttcacttcaatgatttctacttcttaagaattaagaattagtattatgacttctaactataagataccttactttgattttaaaaaaaaaatctaacttatataacacatttatgtatagattacactttatacatatttttatgagaaaaaaaaagttattttctttttgtcgacaacttaattcacaatgtttattttaataactaaattttttctttcttataaatgaatgagaccaaacactaaatgttcctttcttttaataaatactaactatatcttcagttttttttttttggaatccaactagatattcatataacttgataattgctacatttatacatttttaaaaataaaaaatatcactttattattttaaattaattactacaatatttaattttcttataaattatataccaacgtcatgcgtacatagttaattaatgtcattaagtataatatgatttttaaattatctaatgttaatgcattgattgaataaaattaattttaattatctgatacatatagatacatcttgattaaaaataatagtgtagatgcatgttatctttagataagtaactaagcacaatagatttagaaaactaaaatttggagaataaagaaatctctactttgagttttatatgtctacatttatttaatcatgtttcacaatatcattggcctttttcgaaaattaaaaaaattataatttttattaaatgaagatgatgataataattaaaaaatatttctttactctattatttatttatttaatcttgcatatgtttcacttttctttaaatctaaaattatagtgtttttttaatcatgcatatgaaaatatacattaataaatttccttaaaatacaaatatattgtaaactatatcgtataaaaaaaaaaattatagattatattttcacttcacctcttaaccttacatgcatgttgtaataataagatttgaacatgtccacatcaaacatcttagttggcagaattgtgagacatgcaatgaacatgtgaggagtgtccaagctgcttttctgcggttcgtatgtcattctcatcgttcttgtatagatttctcataagttcatttccataagttaaatgcttataaaaattagaccttattatgtccggcctttgctacctagggttatagcaaattttaagggttaggctgtaatgcccatggtgaggccattcgatgtttgtgtgtgtgagagtgacagacattagagcattgagaagacatttctttacgagagcataaaatagagcacaccctttttttcttagattgttttcttctttcaaaagaaatcttatttgaaatacaattatatcactgaaaatactcttcaacaatagtagaaccttaatttcttatatataaacatcttaaattctcttccactaaatcaaatcccattaattaatttttgtaaaaaaaaaaatcctatcaatttaagtatgtcaagtactgcacttacattaatgattagataactagatgcaaagcatattattgaattgatataggtataagtagttcaaagttattgatttcaccataagcaaatcgtggttgaacaagtgatgtatatacgtgtgcaatatttagaatacactaattttattattaataagaaaagatgagttggagacttaagagagagcattgtccatcatgcttgcagcattagtttcatttacgatttacaaatattttaacataacaatataaaataaaataatattaaatttaaaaaataggaagtgtcatgagctgatgagtttaagtgacatgagggccgaggggtatcatttaaagcacagtggaaaagaaataatggatgatgtatgtatattc

SEQ ID NO: 895 - DNA, 2227 bp, Glycine max
  Soy_ogl_3435 Gm10:37753801..37756027 Cluster 3
aaaccttgaagatgacatgatagaaattaacgagtctttgaattggtgtagttttcacccataagcaggaattgacagtgtgtgagataaatgaaaatacattgaagaaatttagagcgaaataaactacatcattgatcacaattaaggagactgaaagtgcgagaagttgagggaattatgtttgatgagagaatgaaacttctaaatagttatttgccaagagagcaagaaagtgatcagaaatctagtttaagaaattgagatgggtgtgtataccaaacttctgaagtatgttttaaagaatgaaaaaagattgatggatggtgtacaaaacaagagagacaggaacaaaacaagataaatgataaatgagtgaatcaatcgttgatgtgctagcttgttggttttagtcgcactcaaccaatcatttaatgttaattaggtctagtttctaatactaattaatatcttttatgagtatatcttttgggatcttttgaataaatacgattggctgttatttaaagatttgatagttaacaaaataagataaaaaaaataacaaactattcttctaatttgaataaatgctaactagtccaaattttaattcttttaattaaaattgaaaaataggataacagacttttaaatattactgtcatatacaatctttaatgccattttttatagttttttttaccagatcaaatatgataagaaattaaaaagataaaagatacaaaataaaagttaaaaaattgaggtagtgtgttttttaaaagagattgagtgtttataaatgtagtattttataaagagaaatattttaaaattgacttaatttaatttttattttcttagctatatatcataaattttcttcggtaaaaaaggctattaattttcaagatattttagaaaggttattttatttttaattgcaattttttatctagtgtgttttctacaaatataattttttttgtcatcactatttaaaatttaatttttgcacttaaaaataaaggatcaaaataacataactatagtaattaagggctaaaatgaaattaaggtattaaatttaattaaaaaaattaaggtgttaaataaagcatagaacgaaattgtccaaagaaaaatttaagagttcaaacaaaattcatttggcggattgttttgacgccaaaaattaaattaataaaaatttgtatttttataaatagtgtcaaattaaaaaaaaaatgttgttttctcattataaatttagtacaggttgtacttcttgtaatcctctactcgagtcaaacaaatttgtttccggtgtccaatagaaaatgtctgtagtctaaaagaagtgattccttcatcattcatcgatcatgattcacgatttatgattaggtacttatttttcatatgcaaatatcctattttgttctttttagtaggaaaatgtctatgtactacagcactgtcacgtttttgcacgatctcgtatgttttctgggcacatttcatatgcatacacctatatgacgtacaatttggagagtgtaatttttatttctctctattattttaatgaatctggctcttttaataaaaatttctcttttgcttcttaaaaaaatcactcaatgccattgtttaactacaattttcttcctctaaatttggggtgcatttgattgaataaaacttttcaattataaaataattattttatctttgtaaattttaacctaaacatgagtctcttaggaataaaatatttaaaataaagataacattagtttttttataggaaaaatgaataatattgataaaatttaatttaacacaagttgtggaaattggaataacaaaagaggcaaattgcatgtttcatagctttgatagaacctcttaaaaaaagctttaataggcaaataaggagaacatgagaatgtaattaaaaaaaaaaaaaagaacttgagagttaaaaagttatgacgactcatttcggctctgttactttttcaaacaatggaatgaaatctttgttttgttccattgtaaaatattcaaacaatgaaattacctttttattcgatttcatttaattctctatcactaatcccaacatagccttaattagacattcttaatttttcttatgtgcattttacacacctaacaattagctaaagaatctttgtctcaactatcttaaattatc

SEQ ID NO: 896 - DNA, 1500 bp, Glycine max
  Soy_ogl_3470 Gm10:40324801..40326300 Cluster 3
tcgtagttgcggttgatgctcttgcaaggcccatctcattagaaggggactgtcgtatttatgatttgaatcctaactttattcatataaatgttattgctgatgtagcttcgatttctttcccacttgtgttttaataaaatctcttctcttggtgccttagcccagtattgaaccccccccaaaaaaaatgtacaatatgattaataacgtattttctctttctaacaattttttcttatttattaaaatccatgcaattttctttaatttgaaaatatgatccacctattaggacatacgatacctatatttagtagaatacatataaattttacacaaatgtattaccaaaaatactactaacatttatctcttgtatacacatgtaattaatttttaattattcaggtttcatgtaacttgttgcaaagaaattagctatgttattttataaatatgactggtttcccgagtgatttgttggcttggagtttaaatctcagaccttaagttctccgctccaaaccagcaacatccaaaaaaagagttagttatgttacttatgaatacgagtaatgctaaaaaaaaaagaagaaagaagaactacctataattattatagaatgaatttgccaaaatttaaaagggttgttggatggaaaaaaggaatgaaaatcatttatgcatcgaagacttacaagaatttcaacttattctataaaaactctgactccctaattctttcataaatgaatattcttctttgtatgtggagactggagtttcattttcattcgtaagtaaacgattcccccgcaaccgccgaccccccaaaaagataatggagagagtagttaactaatttagcaaaaattatagggggttgatggatgaataaagaagtcaaaaccactcatataaaaaaaaaattgactccctaattctcttataaatggatattcttcttagcaaatgaagtttcattttgataatgtgagtaagcaatccgctgcccaaaaaaaaattacggagaaagttcagagttttgagaaacaccattcaaagttataaccgcgtgaaggttaaaaaaatacatttaaaattttgtttactattttatttagtttttccctctcaaatcaaaataaattttattaacattacatttaaattttatgtttattatattttgtaacttaccagttctcctacaacttcataaagaaaatgctaaatgaaaaagtaaaacatgtaatgtctaggaaattaatgtataaaaattttgtttttatacattaatttttaagaatttcaacttattcttttatgttttttaaaatttcattttgatatctttttttcattttttgttaaaaatattagtactccatcaataatttaaattttgatggaacattaaatataagtaaaataattaatttaaaataatgacaattaaaataattaattatttcaaaatttaaaatatttatatca

SEQ ID NO: 897 - DNA, 1693 bp, Glycine max
  Soy_ogl_4299 Gm13:27261122..27262814 Cluster 3
tcattttactatataatgtttataaattcaattttccaatacaatccaaagcaagcaacattttacaaatcctccggaagctgttgaattgacatgatgtgtagttttttttatttattatttcttaagtttttgttactaacttactgagttgttaatatttttctcgtgtgtccctcaaaaacaagagacttttttttattagtttcattgattttttaaatttacactcttagaaaaatagaaggacaccctacatcaaaaaataaagtcattgtcttgttttccccttcagtttagattagagagtgcatagataacctcaattgcaggtttgaatttaataggcaccaccaccaggttgtcagatcgtgcaaggagcaatgtccatgtgttggaactgaaactcccactaattgttaaccacgttggagtgctagacaattggccatgacaggttttgcatgtccaccgtaccccataaatggccttaattaatctcatgtggttaagctcttaaccttatgaatgatgtatgggaagaatatatggtataccctggcttattctcctagcactagatctagctagcacaggataattaagatcaagaaaaccagatagtagtattatatacttgttttacattcataattaataaatacgtatcacttcaaaaaagtgtatcatcacccatctattaatgatattctacaagttaaatataaccatatgtttaaataactttttttaataagttcttatatatatatatattagaaaataaaataaaaaagtaaattaaagtgaactaaatttctttcgtaaattaaaatcaatttatacattttagcttttagaaaaattaagtaatttaacttattagagaaaattttaatttaatttaattttctatttttataaatgcttatgaaaaaatggatacaaagaaaactaatggattaacactagttaatttctctctccctctgataatttatacgtagctaattataaatattgtaaaaccaagtgtaaagtatcttgttctcttgatgttgattgttgatcgatatcccttctctgtagtctagcttcattatcctttgccagatctatactgcaaggggagtagggtaccttattcttctcattcattatattgtgtcctgtgtggaagcttataaatatctaatatatagctgattagatctaacaggttaatattgacattataattttattgaatttttatattgcaattatatatctaatagctgattagatctaacaggttaatattgacattataattgtattgaatttttatattgcaattattttgaaattatttttattataaattttttgtttctttataagtattttcttcttgaagcaatgttactagagatattgtatcgaacactaaatgtcaatattttttcaaacgaacatttgaaccttgatcattcatcatgttcactatgtggaatactaatgattttcactaaattcaaccttttagtatatttattttctatatatataaattggaataattattttccttcaacgacagtattttagggatttttatttaataagatcattttttgggtttttttaacttatctctttcaatttgttgtattcacctttattttattttatttatttatttaaaaaaaca

SEQ ID NO: 898 - DNA, 1900 bp, Glycine max
  Soy_ogl_5354 Gm16:26852301..26854200 Cluster 3
gtgttgctcatgaattagttaagtaagataggagtatgatcactaatcacaagtatggtctaccacatgaagaattagaagaaaaaaaatgtgaaatcttgaaattattttataagagtataaatatgatctttgattcatctgataaaactttgaactcgtattttatgcatgttgaaaaaattgaatttttgtttagtaaaattatgttgatttcattaaataaaaattcatgttttatttaaaatctatatgttaaatctatatataaaattaccttgagtgcatttaatattatatactaattatcaaattagtttaattgatcatatatgagcgaaaaattattaaatatcgtgtatcctattcctaccagggatccaaaactcttaattatgatggtaccaaaataattaaatatcatgtaaaagtaattttaagaccattataagagaaattaaaaaaatcaatcatataaaatattttataaaaaaaaaaacttatcctaaatggtggtggaaaagggattcgaattaatgtatcatgtaattttacacgtaaatattgtctcaaattagtataataaacaactaatgtcatgtttattttgactgaaattaaggaaaataattattctttaaaaatttagaaaaaaattaactaattttcaaattatgttaaactaaacacactaagatggttaatatgttaaaataaacatgataaaatgcatctaaatattattacaaaaaaataatataataatgtaaaatattatttaattttgaatgagttctacagtatataaaaatatatagaaataagtatatttggattaatttaatttgaagtaacgaaggttgccatttaaatattttgattataatatttttgttaaaacaactaattttattatatatatatataatgtttatttattaataaaaaaatcatagtaacgaacaataattagttatattatgcataaacatgtccaagtgctagatgagcataatgtaaattcttggattatactatacaaaaataatgcatttttagtaacttacaatactataaaaataaaaactttttaaaacagctaaaaatgactttttgagattaatagtatgtaaaagtcaccttatagaaagtcataatttcttagatcggtcattttgaaaaaagtcaatcttttagattggtcattttgaaaaagtcaccttataaaaagtcacattttaaatataattttttagataaccaatctaaaaaattaactttgtattagttatttgttataacggatttagaccattacccttttagattgattataaacatattcaatttaaaaagttattttttaaaaaatgttattacttttgtttattttattccctataatttgaaaaacacacaacagccacacaacaacattaaaactatatacaaagttgattattattgttatgaagcacgatttctaataaaatttatacaagacagattaaactattaaaaaaagaaataaattcaactaatatacaattagacatgagcaatgaaaaaaaatatagaccttagttcaaggcttgctaagtcgtgatcagtgctagaaatagaatggtcctgatagtacaaagaaacaagaaattagtaccaaataagtgatggcaagtctaaaatgataagactttgtgcaacattcactgaactggtacaaaaccatgaatatctaactcggtgttgtgacggagaagtaacactattgccacttactttgcttgtatcagcccatgtaatgcaaataaaaagtagctttcttttagactaggtgaaccttactaactaaacaatcatgctgaaacaaagaaatcaatgattttcttttcttaatttc

SEQ ID NO: 899 - DNA, 1591 bp, Glycine max
  Soy_ogl_53 Gm17:37637210..37638800 Cluster 3
atcattcttaacctatatttcatgaatcttttgtgtttcttcttctggcgtgagctaaaaaagtatattaatgtatatttaaaatagttagctacaactgacctatactgtttgttaccaagattcattatttcattatcccaaaagaattatgtatttagttaaagtagtccttcaaagttacatgtcactggcaaattatttccggaaagactacatgcctaacggaagaaatttttaagaattattttatctctgaaaatatttcagaaatcaaatagtcaatgtccatactttataggaatgaaaatggaagtttactcgtttttttatttgagtgtttaaaactatataagtaattttttgaataaaaaaaaacagacaacaaaggacaagtaatttttttgtctattataaccagacgagctagtttttttcttaaattttatgataaaaagtttagaataggaaaaggaatactcctttgcaaaactaggggaaatcatcaatctcacaatgagaatttatagtaaaatttattactattaataaggaaaaattgaaaattaaatttaagtcacaattatcctgagcaataaacttatctcgatcaaatgtgttaactttttttttctttgacaaatccaatgtttcaactcttatttacatcaaatgagaatttatagtaaaatatattactattaataaggaaaatttgaaaattaaacttaagtcacaattatcgtaagcaataaacttatctcgatcaaatgtattaactcttttttttctttgacaatccaatgggtcaactcttatttacatcaaatgagctagtttatctatctaattaaactttcaaataaaataattaagagtattcatgagaatagatgatgacaagctcaatttgaccggatcaatccaattattttggattgaactttttgagtgtgtgaatcaaatttaactcaacccaacacatgttacaccacttagagaaacacaacacaatgaaaattaataaataagatattgatgcaatagcatgtaacaaaaagtaattaaaattagtaaataaagtaatttatgcatgacacatgttaatataacttctctctaatttaattaggaagtatttttaatccaaaaataatcaattcatgagataatatgaattggatcttatataaaggaataaatcagtttaaaaaattgaattttataaatagaaatggaggtggtatatttttctggtaataagtttccaaaatgcttatatatggtcaaaaagttgattcttcagcatgtttggaaataatcttttcaataagtaattacttgttttataaaatccatttagaaacaacagaaatcatcattttttaaaataagttaaaaaaggataagtttagatactttatataaaaagagttacatacttttaactcaaatcctttgaattaataataaaagttacatactttaattacttaatttataatttctttaataaatatgtattttttttaataaacaaatagtacaacaaaggtatttcaaaccatttgtttataagttagtttgataa

SEQ ID NO: 900 - DNA, 1511 bp, Glycine max
  Soy_ogl_6211 Gm18:56788501..56790011 Cluster 3
agaaataaaggatttctgatcctcattctaacaccagccaatctcggatcacccatcacacgtttgactataattttatggcggctgtatgccttgttgagtaatttggtcataatcgtttatttctataataaatattttttagtcaaacaaaatattcatagaaagatgtatactgtaatataaaattattatatatgtgtgtgattttattaacaagcttttaattttttttactaaaaagtgaaaacaaaatatttaacactttaaaattaaaaaatgttttttaattaattcttaaaacaataagaagtgtacaaaatagtggatagcatttgtcaacatagaattatataaacttgaatgcaccctaattatcattaattaattaggtcaatggagatgacggataagatggtttggtgggcctctcttgggctttcaggttttccccgtgtgtgagactgaggtatgcagtaggtctcatctttatccccaccacattaactaactaaatcaagtcttatgttgtgattagctatagataacccgcattgaaatcataggcacattattttcttaacgtgcgctgcttttataattaaaataatcacatacttttgaacgtctttttttctttttaaagatacatcgatgtgacattttaatttataataacagtgaaacattaaaggtagtttcaaacttattctacctactcatcaactgatccagtgtttggagggttacttggttttgtttaatggtaatcttgggtggtgtctcatgctggctagtgtttgaagttttaggaccagaagcgataatggatccagttttttgcccacaaaggtttatttataaggtttttcgagtcggattaatggaggtaaagaagtattcttatacgtacattcgagtatttttatattttttttaatttaatttactctaatattgagttaattgaacttttgttttggtcttctaattttgcaaatatggtgtcttattctttttcccatcaatttaattcttactgtttttattacatagttgcaatttatcctttaatgtgacgtctaatatttaataaaatgctaatgctacagttacgtcaacacaaaaataaaatgtcacatcaccattttcattaaaataacaaattacataattaaaataataaaaaatagtaattatgaaaaaataaaaaaatctcgaaatgacaataataaataaaaaaagacaaaaaatgtacgtaccagtaattaattgtttttaagtattactcatgagttatcgggcatgtcacatgcaatgcatatttgcatggtcgttccatcatcaccaccagctatagtccctagcatgtatctaattgaattatatagtgttgattttaaaacatgccatggaaacaccatttgattctagaaaatcaaatacagaaaaatcaacgcattaaatttgcaattggcgttgaattttgagcaccctgtgacgtataaaat

SEQ ID NO: 901 - DNA, 1662 bp, Glycine max
  Soy_ogl_28 Gm19:1614101..1615762 Cluster 3
tttcaaatggtagtgatcatttgactagaaaagaaaggcaattattacaatggatttctttatcctactttggcgatcacttgtgtcccccctacttgtattgatcgatgtgtgtgataacttaagatgtgaaaagtaatagacagataaatgatagatcgatcaatgaaatcattaagttgcattgcttctaaaaatatatatttgatttgtgatgctaattgagaattgaattatcaaatgtgattgtgactagacaaagcacatttataggtacgaacacacaatggacacttctccaaagtgttttaagatatgaaatcactaccatatgataatctcctttatgcccaggaagtgtatcgtctaggatcataatcatggttgggtaaattcaggaaactattctatttatccattggaagtgatatattgtattatgatcccattctagcttgttttggtaccacttcaagagatttttataaaggaattaaagagatattttaatacactgaaagccatattaataacaataataataatgataaaaagcaaatttttgtttttgaaactatgtaagaagtactaaacgaaataaagaattaaaatagaggatcagagagatcgaccctgcaaaaaattatagtattcatgatttttgtttttattataaaggctacacgttccaaatgaaatattacaatattcctgccctttgacagacagaatcttataaatacgggttcccttactaataaattcttttaagtataactcgtggtcttaataagcagataatattatatatatgaaacatgaaacgcataacatatataacaatcattacattaaaaatgcaacaagataatatgttggttcatccatccttagattatttaggagaaagttagcacataaattagctaataaatatataccattctaaatttataataatagacattaaaagttttaataatattgcttctttaattattttcattaattacttttatactttatcatcgatgttacatatctgaataccaaatcattactgaattgattaaccccagctcctcctatctcccgtactttcataaatttgggttaaagtggtgttccaagttatcaaagctttatcattagttgataaagaagatttttgtgtcgaaaaaagtacattttaataaagaaatgagaccctaccaacaagatgctccacattctaacgtgctgagactgtgaggtagttggccatctctcgggtttataatatatgtgtttggaactcagttgagttcaactgaaggcaaattcattcgccttatttcttcgacctttgttgctttagaaagaaaaacttcccattttcaagattttaaatggttcccaaacacatttttagtaaattcatttggacagatcacagatgtgtcgaataaagcaaaataaataaaaataattttatccttaaagtaaataagaaagagtttatttacttttaattttattttcattatactgaaattttaactcactaaaattcaaaaaattactaatcttttttaaaaaggtaatatgtttagtaatacattagaaagaaaaaaaaaagatgtgaaattgtattagatgcttttatacacattttttatacta

SEQ ID NO: 902 - DNA, 1600 bp, Glycine max
  Soy_ogl_1984 Gm06:16290501..16292100 Cluster 3
tttgcattatatgaaacattttcatgatgaaagaataataatcgattattaaaaactaaaatttatgcatttaaccctttattgaatcaatgaaagtcattgattttaaaataaatctatagaaattttgtcctttattgtgattgagtgtttttaagagattattttttatgactatcattacaatatatgtttgaatgaatttaattattttatttacttttgtaaatcagttctctctctttctcatattttcaactaaaaggatgcgaaaagtatctcgtttaagctcccttatttaaactaatatggtgcatgcatgtattatttaaagtaaagatttatttctgcatgaaaagaaaagaagtaaagatttcttttttgatagctatttaaagtaaagcttataattcttaaattgcatatatgttagttactcaaaaggtattacagacgagagtaatgttctattttcctatgaaacacatttcaatgatttaataactattatataaaggaagtagaagaaagtagtaggatgatttaaaattattaggaaaaaaaatggtctatatgaagacaaaattaaaatttaaaatttgcctatcaatgtatcaccaaattgcacatatgtttctgtgatccaaaaggatgcctaagatatcgtgcaatgagaatccggtaatattccagagcatattttaatacttgtattgtcaaatttattatcacatgtttttaaataagcaaagataatttattaaaagagacattatatttgtataataaattgtatatcaaaatatacaattaagagagaaaaaaagaaaaaataaagataaatttaaatttaaaatgtaattgttgtactcaaaaatacaaattgcataaattgttgtacaaaatggtaagataaaagagagttagatacaaaatataaattattgtataaattgttgttcatgtattatgattgtgatcaaaatcatggtgatggtgaagtaactcatgagagtgttgtttctttttacaacatatttgttttcgagttgaaaatgcagtcacacgaattctaatgaacaaaacgcagaagtaacaaactttgagttttgactttttatgtctcggagtggagtgactttgttaagaaacagctacacaaacatacaattagtcattcaccacgattttggatgcccaacacaattccacagcttatccaaacatgccataaaacaattctgatccccatttggtggcctattgtccttagtggatgaattcccctgctacgctcctgcactgtaaaacttatctacaataactcattgatcaagacaaaactaacatcgaggcttggtgcgtgtgatccacaataactcattcatattgtttttaatatgtcatttctgcagaaacagattgcaacctcagaaaaaagccatttaacattttaccaaagcttcagtttactgtcgataccgaaagcaagttgtaccacgatgagctgctaattaataatgccctagtaggcagcaggattggataatcaacatggattaaatcttattataacgtgaagataaaaattgacaaaacc

SEQ ID NO: 903 - DNA, 1200 bp, Glycine max
  Soy_ogl_155 Gm01:43802901..43804100 Cluster 3
taaaaataaatggaccaaacttacgggtaacttttaatgtaaatgttgagttattgtcgaataaaaatggagttttacattagcaaattacgtaagaattgtattaaatataagtataagttactgaaataaaatcttgttttaattaattgaagaattatatgaaaacatttaataaattatattaatttttatcttaaataaaacaacaaattaactacgagaataaaattacataagtcactaacacgtatgcaaacatggaaaaatagattatattataagttgaagtgatagaagcccgtaatatatgtacaaatcattttttttttgtacatatgtacaaatcattaatatttcttatgcattttagcatcacaaaaattatgataaaaattagtcttctcttaaacatgatcctatgaaatttcaataataaatttcacttaaaaaagaaaaaagaatacacataagaaaactcatttttggttctcgctttccgaaaatatctaataaattataattgcctcaacaccccttcggtgcacttctcctaactgtccatctattttgcaagaaacaattaatttagcagtgattttttttttctagtaccagtccttaaacagaatacttgaatgcatggaatatctacgaatacacagagtgaatatccacgtcaaattctatgaactatttctcattgtccagaatcgatcaaagataaagcaactaaaatttacgttttaggcttaccagtaaaaaaaaattagttattattaatactcataaaataaaaaaatcttcatacattaaaaaaaaatcacgtgttaataaaaaaattcaacatatttaaaataaaaaaaattattttaaaaaatcttttaggtcttattttttgttggaccgatcctgtccctgacatttgttaaatcatgtgagaattgccttgttggccaatcatagtaaaattgttacatttatgtttatttcttttattttttatattttaactaactaaattaattaaaattattaaatatttatttttacttcatcatatcacagtactgacaaatcattaatcaaccgttaatttaaacagcaaacatatataaaattaaatattggactaagattgacgattttcaaacatttgccactattatcggaaaaaaaatagagaaaaaaaattcagtt

SEQ ID NO: 904 - DNA, 1785 bp, Glycine max
  Soy_ogl_3422 Gm10:33828401..33830185 Cluster 3
ctttggaacatatagcaacacatcatcaactgacttctttagatcttgtcacttgtaatgtgtttcttctcctttaacccctcttcaattgtcatctaactatcaatttcagcatttgaactcattttcgattcattttcctttccttttgaatcagatccctcaataattatagatggtcttttccttataaatatcaagtcgactaatatattcttttgattattgtctctttacatatcttttaatggattcaatattctcaatatttaattatcattttcttcccttaacaataagaatcttatgtcgaaagaaattttaacttattatatcaaaaataatattggaacactcccaacaaaatcataatttgtttaattatgcttcacgcatcatcagatgaagtttgtgaagtttcattcttttagtcgaagtggattcaatttttcttgtctcacatgtgacgacaaattaaatataattgtggaggaaatgacggtaaggtatagtataatgaaattttaatctcaaatctagaacaaaattttattctcgaagctagattattaaacctttatttgaatgattaaaatattagtctaaaaaatacttttaaaatcgtttttcttttatattttaaattgtatgttatataaatatagagtcagttgatataaaaattagtagatattgatgtaggctaaaaccaatttagaaagtcaaataacattttaaatcagttagaaagttaactttctaaattggttatagttgtaatttaagtatataacagtacaagaaaaattggttttagagaccacactatcggtctataaattgagaaaatcagtcactaaaccaaccggaaattgaattagaatataatttccgtaagtagctaaacccttggcagctaattttaaagactggtttagaccctgtttcagaaaccaattcagtgatcaattatgtagaaaccaattcagtgacatattatgtataaaccaatatttttggtctctaaatcagcaatatttaatgaatttcttgttgtgtaagttacccaatatgtagtttcaaaatatagttatattatgactgaactagattaaattatcatgcaaaattctgcacatacaaaattcattccatgactatatttagagcaatcaaatttaaattagacatatgcttctaatttaaattattatgcaggatttagaataatcatcaatttcaaaacaatagcctgaaagttcatacaaacagcaaccttaaactcctcttgccggcggactattgtttactcctcactggtgagtaaaactcctcttgcgagcaactattttctctcctcactggtgattagctcctcaagttaaccaaacaaataaaagatttcacttatattctatgggtacaattgacactttagtcattataataaatattatttaactttttttgcgctctgttcactactaaatggttttaatatatataattaaattattaattaaatttaaaatacattttaaaactagtgacgaaatctaaattattcagaaaaaaaatccacatctttcaaattagagtcactaatcgccaaatccagtagacccaaaaggtttctggtgcaactagagtcttcagtttgatgtagacaccactgtggcaccgtgagacgaattgtgacgtatcatttattcatgacatgaccattttcaattcacgttaattgttattgaaaacgagtttattaaggttgtgtttatttctttc

SEQ ID NO: 905 - DNA, 1268 bp, Glycine max
  Soy_ogl_1601 Gm05:5233233..5234500 Cluster 3
ttgcaacttgactcgtttaccacatactcttttaaatatattttttattggttaattttttttacatattacaaaaaattgtgaatccgacatcttatttaatgactctttcagtttctattaaattttaattgacaatagagtgtacatcaagaaatgtgtgtttttatcacttctttctaaccaatttaaaatgtgaactcatatgtgtaagtccatttagtctacaaaagatttcattatgattttgtgaaccaattgtttaacccatatataatttgttttaaaaaatggttatttatgaaaattaaaaaattaaaccctaaattgattatttatgaaaaaaaataaaatgaactcaatgtgctagaggtattcaagtgttagatatatattttgtgtttggttattactccctctcccaagttaattgattttttagcattgattttttttaatagtggttgatgttcttagtttttaatgagatattaaaatacctatttcaattttttcctctaataattattattgtcttaaaaaatttaataatacatttattaaaattaagaaaaagaataagatactttaattagtaaaattgtcccttaataaatgttattaacttggaatatttgtttttcttaatatgtgtgaaaaaccttaaataactttaacaattttgtttaatcaattgagttcttcaacaatttttctattaatcttaatacctcaacttttatttattattgtgtttagtcctactcatcaaatattaccattaagagatgatgtggaactactaatatgatatattggtaataaaatattgttgtttctaaactttttttcttctttttttttttacaattctaaggtgttacaaatttaatgttggtgtaaaattactagaaaatataatgatgatggattgacatacttgtacattatgataaaattaattttaagatttaaagagaaaaaactaaaaattaatgaaaatataaaaaataattataaatttaactataaatatgatattttcagctattaattaagtgatggaaaaatatttttaaaaaaattccatcatctaagtatacaataaaatatcaaagagtcaatgatcaatcaacaataaatattgaaacacttttttatatatttcctctgtcccaaattgatactctctctattcctttttaattgtcagatattttgaaaaattttgtttatatttatttgttatttataaaattcaagatctc

SEQ ID NO: 906 - DNA, 1298 bp, Glycine max
  Soy_ogl_1999 Gm06:17148301..17149598 Cluster 3
cattctgctctcttttgttacaaggcggattttacagtgaaaccactatttcaagtagtttaccggtgaacaaataattataactgttagatacattctaaaaaaattcaacggatcaaattcaacgtattataaaatttagggttaattgtattttttattctatttttttatgaatattatcttcaaaaaattaatttgatgtatttagtatttaaatttttaaatttttacataatttacctttcattgttgagctgacataattataaacctcatgggtaattaatataatttatgctattttttaaactgtttcacacccctcttcctttttccctttgatttccttttccaatcgatcacaatgaaaaaaacaattgttgagtttattattattgaagattttagtttgactataaatatatttacattcaattatatttaatttttacatttaaatcttttgaaataagatatcttctcattttatacgaaaaagaaagatttcaagcatagataaaaaaatttaaagtaaatttaataaatttttaaaagatatttccatgaagaaaaaaaaacaataataactagttagaaaatctaagagaatggatatcaatgaaaccatagtaaatttatcttttttatttggtaatcaggagggtaaaatgtcctgtaaatttatctcccctctttctctctctatattatttttatcttataataatgatgcaaagttgaaaaaactaatgtgttcacatctcaattcagtgtacttaaaattttcacaattttttaggaattgtgtatttgggctgttctatatagtttagtgataatttgaataaaacaaagttattataaagacacacaaaaagaggtaactattaatgatgttgtacaaaataaaatttaaataatcaccaaaaataatttaaaatatataatatgttggttacatacatgcacatctaaaaattaatagcatattgaatatgtggctgttagatctatttatttatttttacatatattgtttataaaaaataatttgatttgagatataatagttgaataactattattattttcaatttagaattcttattaattactttaaaccgaataaatgttagtaattgaaaaattgagtcatgatttattaattgattatatcattaactatttttttattttatatttaggatacgataaaattaccatgaatctaattatttctgctttgttaaagtaatgaatgtgaacatctctttcaataaataaggagtagcctt

SEQ ID NO: 907 - DNA, 1700 bp, Glycine max
  Soy_ogl_2331 Gm07:11012901..11014600 Cluster 3
cttttgataaacagaaaaaattagatatgctcatttatcaaaataccaggaagaagataacgaaaaatagaaagaataacaaacttttatttttttactcaaaccattttctactgaaccttttttctacttgaaaacctgatttttaatttattttattttattagttgtaaaattcttattggttatgcccaaaattgagttcttaggtttgtgcccatgcaaatttctcttaaaattaataattttgaacttattttttcgtttttttattagtaaatctgtttcacttttaaaattaccaattttatatataaaaccaaaatgaattttttaaattagaggaatgaattttaacaaatgaagagattatattgtactttttataaacagaaaaaaatagatattaccatttataaaaaaatcaagaataagatgaccacaaaatagaaagaataacgaactttttttttttactcaaaccattttttactgaaccttttttttacttgacaacctggtttgtaatttattttattttattacgtgtaaaattcttattggttgggcttaaaagtgaatttttaggttaattagtgtacatgcaagactttctcttaaaattaataattttatttttttatttttttattagtacatatgttttacttttaaaattatcaattttacatataaaaccaaaatgaatttttaatttttttactgaacattttcttacttgacaacctggttttgaatttattttattttattagttgtaaaattattgttgattgtgcctaaaagtgagttcttatgtttgtaccgatgcaagaatttctcttaaaattaataattttaaactcatttcttatttttttattagtaaatctgtttgaattttaaaattaccagattaaaaattactagtttgcatgtaaattggaagtgttattaacttattataaagaaaaaggtgtgaggggcgtaagagaatcaattttgactttttgtaaagggaagaggcagaaggaagaaaatggaccaagtggtgttacatgattgaatcaccttttatctttaaactaaaaatttgtgttcttgttattattttagaaaagaagcaaacctttgaaatcaattttgatgttttagaagagggaagaaggaagaggcaaaagagagtggaccgtgtggtgttacatgattgaatcaccttccatttaattttgcattacatctattattttcattctaggtacaattattttcaactttcaataaaacaaattataatatcaaactatttaaagatgtgacaagaacgtattcaatcaaataattatttaaaaatttgttatttgaattaaagaacgacagtaatatatgaagtgttatttaaaaaagaaaattagatatgattaacgattagtgcatagagtatatatgaaatggacacctaaaagtaacaaaaatataaaatttatatttgttaactgtgttgcttctaattattttataatttgtttttctggataatgcattttgtctttgttccgtgattatgtttttgccttttatttcttgtatttctcctccaagtttttctttgttgttattctcttaattgttgaatatttaaattatccataatctatatcatctattaaaaaaataaaacaaaattaaaaaataaatag

SEQ ID NO: 908 - DNA, 1300 bp, Glycine max
  Soy_ogl_3102 Gm09:33315601..33316900 Cluster 3
agaaaaggcgcacaaggtctcaattaaatttacaaatttaaggcaccaaaaggagtttttcattcaatttgaaactgtgaaaaaaagatttttccatgctacaccttgaacagtcttgatctcttattttgcacgatcgaaaccaatagtgtattggacatatgaatcaacattcacttgtaaacaaaagctcccagaaattaatgaatgtggattcaccttaatttgtttaagccaccttaaagcatccaattatatataagaacataattcattctagtttataattgattcacataggactcatatgatttgcacctttaattcgattgtgaccaaataaaagaatagccataattatatttaagcaagctctgatagaaattgatcattttataagccctcaacatagatggatcaaatagatacaagattataacatatcagcatatgtgaataaagagagaataagatgatagaatttgcgtacttggtataaataatcgatttgccttattcttcatgagatttgactataccactagaaaattagaatgagagaagactcccctcaataacgattggctgatcaaagagagcattagtagtctaatgggacaacgattaagttattgtatgagggcatggacctctcattatattgagcatcaattgaatatcttaatccatcccaggttattcagagcaaaagcccaatacaatatattctccatttggttgagtgctataataataagccctagcatgaaataataaactaataattgatatatgctaatttgtatgatagattaatagataataaaaagtatcttagtcaaacacgttaaataaactatcaagtctatcatacaaaatgctatccttgtgtcttcaaagattctaagaggcaaaaagttgttgcatctatttatcccttttatttgaaataaattatattgtgattaatgtgatataaacaaactaattatttgattattctaattataaaaattggaatcaactactattatcataattatcatgaataatgtcaattaatgcactcttatttgaattttttaatgtgattcttagaataaatgttgattatttataacctttttatctttattttatttatttatttaataatgtgttataattattaaagaattatattagataaggaaatatcattactcttattattaacgataatttaattaagaaagaattttaagcacatcaaatatattatcacaatttgtgtcttcagaacttctaagagtaaaaaaga

SEQ ID NO: 909 - DNA, 1400 bp, Glycine max
  Soy_ogl_4034 Gm12:11910701..11912100 Cluster 3
gatatttgttagaaaagtgacaactaaaatttttatcctaatttttatatgtaataaattgacatttaaagaaaaaatgaaaagtgataactatattgtagaaaatgaaatttgaaattatataatatgctattcaatcataatttcaattcttttttttcatcctaaaattaaaaaaaattggaaaaagataatgaaacgaagatatttgttagaaaagtgacaactaaaatttttatcctaatttttatatgtaataaattgacatttaaagaaaaaatgaaaagtgataactatattgtagaaaatgaaatttgaaattatataatatgctattcaatcataatttcaattcttctttttctcatatattattaaaaaaaaactatttaactatgcatggcaggatcactagattttagttatataagactagagcatcgattgatttattttattgggtcccacggttaatatatattgataaggttaaattacttcatagatttttgagctatttgataatttttaattatatcttttgaattattttttaatttttaattatatcttttgaattatttttttaattgggtccttcatcttatatttgtctatcaaatgcattcttttgtttacttgtctttagggaaaatttatcaaataatgtgataaacataatttgattttaaattgtcgaatgatgctgatttattgacaccatgtgcttgaaaattcttctttctttatttttttaagataataaaacaaatatgtttggagtgaatcatatttatatagggaaatgttgagaaatgcttgaagattattataatcggagaataaaagtatttgtaatgtattcttttcatatgagttcttttacaaagttttttaaatttttaagaaaatatctgtcaaattttttaagaaaataagacaatgtctttataattttctcacgaacgactgataaataatttcaactttaaagaaaaaagaagaaaaagaagaatcgtaatttgccataatatatgcataggaaattaatttaattcctaagtagataatgggtctttcaactcgtactcaatccatgtggatgatgggaccacaaggggatagcattaatttttctttggactaaaatcatgctttcttactactacatgaaaaatgactcacaagtatctctattgatcaatggtcctaacaatgacctaatatacatttttttccttttagaaagggttcctgaaaatagcaacaacgacaattattgctacgggtgattttacttcttgtaaacaggaatctagatttctctatcaactatgggtgtgtcattctcaatgccccaaagaccccatagtttgtcatccactaagtgatgactaagt

SEQ ID NO: 910 - DNA, 1034 bp, Glycine max
  Soy_ogl_4685 Gm14:5529089..5530122 Cluster 3
cctgcctcttaatttctcttaatgcttataaatatctagctatgtctcaagcttttttttttgtctgaagtatagctatgtcaagcttacatccactttttgctaaacatatttaaatcaaataatgaatgattagtttcagcaaaaaaaaatgaataattagctacgtgtattattaactagatttaattaatgtttaaggtacgcaaagtcttgataaaaatctcaattataattctcttacataaaaagagagtggatatacaattgaacagggtccacctgaaaatgatagaaacgggaggacggtgaaattctgtcgagttagcaaggactgcatcattattttgtgtgccctatgctgtatctggccacacaacatggatgttcataaattaaaggcataaatacaattcttttaatcattttatatattagtgtaaggtatttattatttcttttattattaatttttattagataacttaaccgatcatctttatataaatctcttttttcaacacatttttttcatctcatacaaaaactttatagattttaagtctaattttattcgaatcaaagagttaattatatctttggtaaaacataaatacattagttagcgaagccagtgataatctctctctcttcaatccaagaaattcgccaatttggttctttccacactggcaacgaaaacttcttccgctaattttccaggcagaaactaattaacaagcattgagaagtgaaagaaaaggtggaaatgaccccaaaacgccatatacagattgccttagagaatataaaatttcaattgaacaataatttgatggtatatggataaagtgattcgttgcgtattcaagtaccggtgatttggattgcataaagtgattcgctcaagataatgactctattatagtaaccaaaaattcactttcttaggaattaattaattcctataataaatactttatagaggaagaaaaatattgacaacttttcacataacgtacaatatacatacc

SEQ ID NO: 911 - DNA, 1375 bp, Glycine max
  Soy_ogl_4736 Gm14:13012501..13013875 Cluster 3
tgcaggttatttttttcttttttcaattgctacacatttttgcttctttgaagaggtatgttgttcatagtattttcctatgatatgaactatttttattgtctttcatatattaagatgctttatttttgggaaattaattttcataattttttttatttgaaagaccaaatcaaacgtagatatcattttattattttttggatgccattgacattgtgcctttgtaatatatatgcatccgtctttttagtctttatggtgtgcatcttaacgttaataccaattgggtaggtatttttattcattgactatatcttggtaaccttcattcttgcgtgattctttgcattctacttttttaaaaatgttataaatacggcttttaatagattttttgaaaagtgtcaaatgttctaattccataggaaactagaacgactaatgagttgggtaataacgagtaatatttggagaacatccgaagataaaacaaaattttaatgtacaaaggaattttaattaaaaaaagtaaaatatatgattagaggaaaagggaaaaattcataaattttaacgagtaagatttcgttattaaatatataaatattactatagctatttatgtaacacattagtatgtattttaaatatttaaactaaaataactatttgattaattattttgaaatttattaatgtgagaagttagtagtttgtgattatttcctttatgttttcaaaagttttaaattttcaggtttagtagttcttgaatattcatgtgcataataattgatttggcgttggtattaattgagtaggatgttagcaacctttcattatatagtgattgtttgcattctacttatttaaaacatttttaattttcaatgttataattatatagaaaataattaattggttttaatttagactattgtgtcataaactattctacaatttctcatactttttcaactagtcacgttaacaagaatcgattatgaattgaagagaacaaaaatattatttttatggttgatatcttttttacatattaaaagaaattaaagattttgtgttagatactaatttatccttttaattatatttaggggcattgctggaaaaaaaataactttaaaaagttaaaagaaccattattttttagcaaaaataaaaagttaaaaaagactattatattgaaatggagtgggtgcaaaaactaatatttaattaaacataaacaaaattaaataataaataactatattagaacatataaggatactttggatcattgcccttagttttttctttcaacaaaggttataataaaataaaataatgctttttcctttaagcatgctag

SEQ ID NO: 912 - DNA, 1939 bp, Glycine max
  Soy_ogl_4741 Gm14:13703932..13705870 Cluster 3
catctagatcattcattttgttcgcgatatgagtgctgaggttgaagcaaaattgagacagaaaattgtagagcaacaacaaaccattgatcacataaataatgtccttgcacgactttatttgctaaacatgaaaacattgatctagatgcaatgaacttggatgaagatgatgctgtgatgggtgatgctactgctagaagtgacgctacaagtgatgttgatcattaatgatcacgttttattatgttttacattatattcgttctaagttattagaacttgactttttggttatgttcctaagttattagaacttgacttttgggttgtattaatggaacttctattttgatacaacttaaatatgcttatgttcaagttattatatatagaattgcattggacaaatttcaaatggataaattcagtgatatttgattagtatttataaattgctggtaaatatctattttataattatattatgcttaccataacattgttgcaaaacaacatatttcaaaaataacagggacgaaatagtatttaccaaggtcagtttgtttctgttctgcatatcttaagatacttcttttacaaattttatgaaattcttgcttttagaacttgaacatattggcctcttgtgtaatttatggatttccacttttatatgcttgcatgaagtttctggaagtacatatctggactttggttcttgtctttcgatttgacttcaatatctctttgcataatttgttcttctaagctgtaactgtaggcaaaagtttatttttctatgcccttgtgattggatatgctcattattaataattgtatatgttctgtttccttattttttgttcttgcagctgtttattatgtctacctgataggttttcaattaaatttgctgacactgatatcattatctaatttttatttttgcataaattaacttttcctcctgtttcctttctcatacctgtaccaaacgtattgaaaaagcttgatatatatacatgcacattatgttcttttcttcttacataatggtatctgtaggcccatcaatacataagagtttgacttccttaaggttaagctcagttttttttttttggaggataaagaacccgggcatttttttatggtaaagaacccgggcattttttacaacttcattttctcattcattctttagaattcataaatacaaatggaaaaacaacactactttgttattgtctacctcttgagtaaatctattgatattgtattgtgatctgatagtgtttgctttatatgggaccttgaaggctattgctggagaagctggtgttccatttttctatcgggcaggatcagaatttgaggagattaagtcttccttttgcattttatagcttaatttttctgtgtttagaatacattatatattgtcttatttttgaaacaggatattaggatctatttttctagaatgtaataactaataaggatacattatatattgtcctagaaagtttgttaacgagggtacattaatgtcctctgtaatacatgtattatgtttctttatcttttctaatattgattattgggtcttctttattgtagaaagagagagagaaagagagacacatgagtaaactgtaatgggataaacaataatgtgcagcgaccctcatatttactttactaggttatgtacataaaagcatgtaggctgagcccatatacatacagtagtgctaaatccctttatatatatagtagttaaatactaatacaatttaagttagtaattagctctagtaagttaaattagcatgtcgtttgtgatttttttattactggctcaaatatgtgtatttttacatttagtaaaccacaatcatgcactttaacatcacatcaatatttgaaggggaaa

SEQ ID NO: 913 - DNA, 1200 bp, Glycine max
  Soy_ogl_4777 Gm14:44824201..44825400 Cluster 3
cttatttttttaaaattaattttgtaatttctaaatttactatgcatctccgatcctattaaaaatgattcagtttgttatgcattttgatttattattcttattttttaaaataaatttataatttctaaatttattatgaataaatgatttttgttctatattaaacaattgatcgataactttatagcaacatattaacctaattacctattgtttatttttaatgtctaaaaacaattagctcagagttaattaaatgacatacaatgtcaaattaattttaaagtaaatttaacttttttcttatttattatcttttcaattattacttaaaattttattttacttggaccaatttatgtttttaatacattaatatctataagtaaattttgttaatataaaccgtatatatacttaacaatttaatttcttaaagttttctaataatatttataaatatttttatatattcataacaacaacaaaaaatatatttgtgtatcgcatcgatgacccaactagttataataaaaggaattacttcattttcccagtacagcgaacttcactaatattccactgttcaacttgaatctttcaccaactacggatacccccttcaatttttattttacagaaaacttatgcatacattttgaacatataattttaatttactaattaatataattacataattaagatttgtttcttaatcccttcgctgtgtttttcgagtccatttcgatgtccagtacgcataatctgactttgcgttctagttctagcctatacgtacgtgcttaacctttgtgaatgcaacccatgccaacttctcaacaatataatgtctttaaaagaaaattttaacacgactctagaattattcattgcaaaaaaaagtttttttttttgcaaaataagttgactcaaattccaaatgatgtttccagcctcccatgtgattttacaaggctgaaaaacgtgtatctaaacctgctgttataaagaatgaatttaattaaaatattaaataaattttattaaatatttttagttatttaaaaaggttatgattgaatattttcaattttttttcttattaacatatttttggtatattgtataggtaattttaaattcaatcatagatattttaattatattcaataaatatttcattaaattaaatag

SEQ ID NO: 914 - DNA, 1830 bp, Glycine max
  Soy_ogl_5709 Gm17:23583101..23584930 Cluster 3
gaatttaactagttagctagttacgttgcatggtgcacattgattgcggggaagtgctgctattgacatttgtgaaactacgagacacatgtactcttaatgcagacgtccagctaattatgtaatatggttggattctagtttagaaggatatgagaatttggacaagacttaatttgggctctgtttatatattattatattgttaataagtgttggtagatatatagttgatggtgttaaaagttataaatataagtaataattgctttcgtcagggttagctttagttcttataaaatgagctattttcattttcattttttaaaaaaaactttcgttttcatttttctaaaacataaaatcacagttttttttaatccttttaatgtttattttagtgtagataaataatatttattttaaatattttaaaaaacattcaaattttcatatgttagcatggtatttacgaattttatctaaaatatataattacttaaccttttataagacacataattaaataatttcacatttttttaaagatgaactttttttatataaaaatcaaaatttcctccaatgacgaaaaacatatttaatctagctctatatattcaagattacatttgccaaggaattttatcaccagctagaatccaattccacggatgtatgctaaatctaacaaatgcgaaattctatacattattggataccgaaacaaattattcctattaggaagataaccatcgtgacgaggtaacaaaactggtgcgttatatgtattaaaattaaaggacaaaacataaggatatttttatttattaacatgttgttcgttggaattcgagttttctgaatagaaaaaaatagaaataacatagttaagaaaaaaatcatattaaaataattaattaaattttttataaaaattattcatcaataaaaaaattaggtatttttttactccatttacatgataacttaaattaggaaaatgtttgatgaacactcatgaacctattcaatatccaatatctaaagagattaaaaagaataaagataatatatatatgatagggtttatgatacgatcaaaatagagaaaaataaaagatattgatgaaatatttaaaataaaaaattatttgtgtattattccaccttaaataagggcattctcatttagcctagtagaatacccgtgtgattccagacatgttttaaattgacttatgtactatactaataagttgatatacattaaatttatctatgcaatgcactaccataaattaatatatatataaattcctaatgagaagcttattcacaattaaaattttcggagatgatattggtctccaatgaatcagggaacatatgacaaaaaaaatgcaaaaagttgaggttttaattaatagtctttatttatttctatgtgtttaactattacaatttttttaatatcattataatataatttttcattataaatcatattatttgatcattattcatttacatcccttcttatttgttccttgttcattagtatgtaatatattaatataacttatataaaatattaatcattgttaaaatattttttttataaaactactttactaaaagagttaaatagtcacagtaattttatttgaatattaagttttaaagaatatatgaatataattgtagaaataaatattttatactttaacaatgtattgttatcataaagaaaaaataaattcaaataaatccttatcctaaattgagtaataggtatatgcaattttaatttcaaaaacaaaattattc

SEQ ID NO: 915 - DNA, 1200 bp, Glycine max
  Soy_ogl_5940 Gm18:5377401..5378600 Cluster 3
tagaagacataacttccgaggccgtaaggtatgtcccctttacctacgaagaaccttttcaatggtatagcatatttatttatggatggatgttaaaggagtgggtatgtagtggggcttggtattggtatgagtccaggttataacgttttagaaactatctcaatatatgcctatttgtgtgtttcttttatgatggatcgactttgcttttcttattcatactagtttagtgtggctttttatcattgatgctaaatgcttttaagtggcttagattgacaataaggtgctgttacaaggcatgccaattgcggaaattaattaaggtgctgttaattccgtagctgcatcaaatatgcatgctctggtggtcatttccactaaacagtatgtgtacttttttttttcatttcacatttctattttttatcaattatttctttacgtgtttatacttcttgggtgttaatgaatattttttttataaaaaaaaaaacagactatgtaaaatattttaggttgtaattataagatttaattactgatctatatcttttttaagtctctgtacttcaaaaaaattcacctttttagtcctggtatgtatcattagtaatccctttgagtctctatatataatatcattgtaattccttttagttctcatagtaaaaacaaaatgattaaaaataacgtgtaagaattaaaaagagatatttttaagtataaagactaaagagagtttttttttttttggttgagaagaagagagaatttttataactatagaaattcaataaatcattcaacctaattataattagagtctttctcgcagaacaagcaccttcaccgaactaaaaatgttttcaatcatcaaataagtgtttaaattaagaattatgttatgtagatacagttcaatcatcaaatacaccttgagattgagagatttacctaaaaacgtgacaagtagcaatgtggtaagagacataatataattttaaaaaaaatttaaatgaatgtttatattttattatattgtagaaaattaaaaaaagggaataatatttatacaactagcattcctccgtgatattgcatttctgtaatttcattccaaaaatttattaatataatcatatcaattatgcttccttcttagttatcattcacttctcgcttaatttcctttgt

SEQ ID NO: 916 - DNA, 1484 bp, Glycine max
  Soy_ogl_6023 Gm18:11971401..11972884 Cluster 3
ttaaatttttattctttttctgaacatttgatgttttataatttcaaagtctaatgaatatatatttttttcaatatatattcttatttaatattcatttctaatagtgcaagtatagaaaatcaagatattaaataaggtcattttaatctaaatataataatttttagttttattaaatatcttttaatctatgtttaataaccttaaatatataaaaaaacatgagaatgaagtagtagttactaataaaggtctctaggggtgaacataattgcatataaaaaaatcctctataagcataagtcttgtatgatcactgataccaattatttaatgtaaaaattgagaaggcaagtaattttttattattattataaaatgagaaaactcttttatgtgaaatcaaatcttattataaatctgataaaaaaatattattataaatagttaaaatttaaatataaagttgttgcataacctctttaattaatgatgatgtgattttagttagcctgtaatttttaccattcaggttgattgtatgattaagatttattctccaacccaaaagtcactttctcattaaatatatctccctattgtgtgcgtgcatgtctatagatatataggtgacgtatctaaggagattgaaagtctttatatgaaagtgaaataagtaggattaagattaaaaaaatttaaaggcacataattacttaaaaagttacatgatatctaaaaaaaaaatcacattatgtgtgttttaatctttaaccattttattgatcattatatacagaggatttaagattcaatgattaatatttattatattgatttttctcattgtaatatcagaacagtttctaactaaatacatattactatagtagtatatatgtgtaatgtgtgtgttttacatgtttatgtaaagaatgccaccttcaaacatggaagtcattatgcacgatcaaatgccaattgagccctaaaaattggctcacaatttcaagttatatagggttttgctatactcacccttttattgatattctcacccctgtctttttaaaatcctggaaacagacttacctacccctcccaaaatttccccacacccggcccccaccctcccctcctccttcccttttcgttgttttttttttccatttttttcacaccccacataataggtcaatttgtttaaatttatttattaaaaaaataattatttaataaaataagtaattttatgtttttagtgtcttcatctaaattttttatgcttaaaaaatatttttattcttattttaagaatcaaatcttatttacttattaaaaaatgttttttaaagaaattattttttaagaaaattaagtttaaacaaactagtccaatgcttcatctttttcttagttttttaactttaaattttattaaaaaaatttgtttatatatttcattttaaattgtgtttaaa

SEQ ID NO: 917 - DNA, 1100 bp, Glycine max
  Soy_ogl_6423 Gm19:38467301..38468400 Cluster 3
atgataaaaacatcttagaaagagaagttttgacgaaaaaataaagagaaacgatagaaacgtgaatcacaatgaaaaatgcgaggggggcggtcagataataagactggaccccacacggggtcataaataagactggaccaaaaatgtgaagattttttcgccagtttttacgttgtcaaatgtcaactcaggaaatccgacggcggtgctttcaacatgggacccacgtctagattaaactggtgatttatctatctgtaaatatagattaaagagttagtaattttaaatattttaccaaaaataatattaaaaattatgataaaatatgttcataaaatttttatgaaaaaatatttttaattttcaacatttttctactaaatgcctactcaatctataaaaactacatatccagatatctttataaaaaatatttgttaattcacgttgcatgatgatcatcgttatctttatttttgtttcgtaatttttcccttaaatattattattttttaattataaaattaataaaaaattataataccaataacttcaattacttttaatttttttggtgaagattttataaccaggtggatttctcataatatcttgatgtcataactaggaaatatatactgagatacgatatccatagaaaatgttagtcttattttttaaaattatgtttgagtaataaaattattatcaacgataattttattttttaaatatttaacataattaggtatccatgactcaaattcgatgcctctaattaaagttgaataactccacatccaatcaccaattcatgtatggttgagagggtgcatgacttctaaaaaaaatacaagtatatttatttattgttgttattttttgcaaccctaattttataatttaaacctgctgctttcaatttttttagctgttgccaaattttgttttttattaactagttttttgttatattttatttcctgttcagctcactagatacttttaaactttatccagttggacgattcatttcttttttagctcactacatttgattttaatatttatgactttatttttatatgtataat

SEQ ID NO: 918 - DNA, 1721 bp, Glycine max
  Soy_ogl_6680 Gm20:1641601..1643321 Cluster 3
ttggcgttcccacgcacataattaacataatgataatttttaattatcagtgtaatatttaaaaattaataatcccttctgaaaatctaatagatttctgtgctcaatttttttcatttttgctccatgaatcttaaaattgacatgggcttactgtaaatctatgtatttcaatcaaagcgccctaaaatttgcagcaaatagaagtctagatcaaaataattgaattagtcgtgttaaactgtgcaaaaaaaaaatgagtttctccaacacagaaacttgatctaatttattcacttaaattctttatcaaattaaaacaattttttaatatgttgcttgggagagacaacctgaatccctcaatcaactgcaggaaaagtgaactcaaagcataaattgaaacaaacgggattttatcaaattcgcaacatgaaaatgtttaattctcacacatgttacaacgaaattgagttcatgatagactagttattcacataaaggggttcttaattttttataatttttaaataggtaaaatttaaagattaagtgggataaaattaaagtttaggatgtctacttaaaaaaaaaaaaaaagagtacagtttaggagggcttaatttttctaccttttaaatattatagttacgtttaaaaatcatcaaatcatcactgtgctaattatgcttgtgaaaacacatcttgtccaataagtattgttttgtgataatttttaattggcaatatgttaaaaatattattaatagcattaattcttaattgacagaaaggcaaagttaacccaaatttaaaacaaaatatttaattgaattttttaaaagataaattaaaggataggatctaagaagaaaataaaataaaggataaatgtgtaacttagtcattataaaatttttaaaattaaaattttttgcatttctaaataaactagtaattacaattttttattttttttaatgtatctattgtacaagaataaagccacgtactaatatatgttagatctagtgtaaagtttttttattaacaacaatcttaattattcgattttggatttagtcatgtataaagcttattattcttctctccaatttcatgaaaatcaaacttaaattatttttcacaaatttaacgtatattatcaagatgataaattggaaattttactgagaagaaaaaatcctcaccgaatatttgaaaagaggtaaagaagttatatactaccatgtgatatcacaattcacagcctacaattagatagaataaagaaacgaaaataagttcggttaagtgtatgataaaaaggccggtacctttctaagtgtaatgcgaccaaacatatgacagcatatggcagaaagcaccaacgtgccatactacaagagctttgtcctctcctagctatggcaatcatcaaattttccgtacattattatattaggttccttcatttttgcttataaattatggtacatagagaaagaagaaattaaactttttgtaaccaaaataaagaattaaagaacacctcccagacactcgtgtctcgtgatctttatgcttattgtactttttaagggttaacaccccaaaatctactcacatctcctgtttctattggaagcaacctatgtgccactgctaacattccccacggaaaatcatgtggtgtctattctttcatgttaaatggtgcg

SEQ ID NO: 919 - DNA, 1551 bp, Glycine max
  Soy_ogl_6688 Gm20:1889901..1891451 Cluster 3
caacaatagcttgaagaataaggtgattctttgttgtcgcttcatacattttttgttatgatatgcaagaattctaatactcagggaacgtttatatcacataatcttattaattcaaaaataaaaatatatactctgatatttattagaagataataaaaaaaatattcatagatataattcattttcacaaattcatattatatatacatgttcttatatcagtttattttcatgtaaacaggtgagaatcttatatatttccacgtgaatatttaaaataatttatcatttatcttttattctatctcatttatttaatatatttttaaactaaaataaatttaaagaggttgctaaggataagaattgaatttaacaaacaactttgatgagaataacattcctatgaatattattcccaaaaatataatcaaatgtttccatcaacttttttttgggaaaaacgtaggttaattaataacaacaataacaaaagccttattattgctttatttcaatagatgaaaaaaaattgagaaacatatttagtaattagtagcattacttgcttttgtattaattgtgtgctcaattgttaaatggtggtgtcttccggatccttacaacaacaacaaaaaatacttcattgccgaacttcttaattttcaaaaatcattatttgatattttatgggtttttcttactgacttttatgattttgttatcatggttcattattttggaataaaataaataaattacttcaattcaattcctacttcattctcttaatatatttaaaaattaatttatttttacttttggtgtaggaaaaataaaacaaaattcttcttatataaacgttatagttaccatgatttgagttttggaattacaaattaattatactcatgagtctttattgtatcctaaaagaaattcaccaccaacctaagtaattacactcaaattatgatattgatataagtgaactaatttaaaaataatgtttttcatgaaaatattatacatgttttccttcttatctcttctttttctactctcccaatatccattaataccaacaagataaaattccaaagttcaaatcaagataaaatagattgtctataaaaataatatatataaaaaaggtgtttacttgttaaggttcaaaacaagaagagcaccgacatccacatctattctgcaaagcacttttttttataaaaaaaaagagaggataaatatattatatcatgaaggatcaaagagttaatacatgtagtattgtgatcaaagaattgtggccaagcaaagtaatttttatgatgcttaaaaaatatttcaatcttcttgtgaaaaagaaattcaataaattcaattatttataaattaataaataacatgtaatagtaagtctcgtttcatccaaaaaactaaatgtgtgtctgaattcaagcacatgatccatgacgccagcttgcttttcctaaaaataatagaagtcataaaagttgtttctaataaacttaatgatggatacgt

SEQ ID NO: 920 - DNA, 1100 bp, Glycine max
  Soy_ogl_6687 Gm20:1884880..1885979 Cluster 3
tatttgaaaacaatttcaattcagtcgatgtatatgaacgatacactataaaaaagttgttgtttaccaacaaacaaaatattttcttcaatatcatagcttttgtctaatgaaaattaaactgttagcatagatattaaaggtttacactaacaaaataacgcattagatcattttcattttgtgtgaaccagtatccagatgtatggactgaactcatgccacgtgattaaaagataacattatttatcaattatgataaatcatgttaatgaattgataatatatatctaatattagtaatatttagtggtgataatatattatattgtttgacagtatattatattgttaatataaactcataatgtttatactaacaaattaatttttattaaataatttaatgtctaatagtaatataaaaaaatagggaaggtaagctcaccttatttgatactctataatataacagaatagaaggaaatatatatatgtgtaatcaaattcagtaaatatgaaattattttagtacccttcattgattaataaaatggacatgtaggtaaaataagcaaattaaaaaataataagaaaaatagaaaagtttcttttttgctgaaaagaaaatggaaaagttcccctctcttaattaattcctgcaaaatgaggggaaagaatgatgtgagaccagaaataatcctttttcttttcagctttaagttaattaaacaggatcaatcctatttaaacaggattattctttttctaacctaaaatggcatgcccgacaaagtctagagatgcaagtttgtttgcctgacttgactgttatgggtgtattgaaaacttactaataactcgttttaaatgggtcgctgatattattaattattacactccaaatattctttcagcagtaagttctagacctttcactttatatattttgaaaaagaaaaaaatatatgtcaaactaaaatattgatgtggccgggttgaagtgccaaactattcttagttaattagttctttaagtatcttccaaaaatggtctacttttatttgtgttattctttttttttttgagatcacatgtt

SEQ ID NO: 921 - DNA, 1810 bp, Glycine max
  Soy_ogl_1304 Gm04:38225701..38227510 Cluster 3
agcaccaacagagtagccacaggaagaagaatcatcgctgataattttacgtaaatgtctaaaatgtaatgtgagatggtggagaggggaggagagaccagacagagaaaaacttttttttaataaatatatcttaaatgattataataacaagaattcttttaataaaggatattctcggtatatatgtcctaaaatttggacgtaggggttaacatattccaactaaatttttggtgtatgttagcaatcccttatatatattacatcatcccaattttttttaatataagcaaaggtaacatatattatttatatgtatagggtgtttctaatctatatattatgaattttttatattattatttaattataaatctttttagtctatattaaattgattgaattttataataattattttaaaagtttataaagatcgatttataattaatttacaattctattaaccttatattaaatacacaatattaatttcgttgggatgcaaaaaaaagaagcttttaggcagtaaaatagtataaaaacaaatgaaagaaaaaataagttggaggaaaataatcataagctacaaatgttcaatttcataaaaaataacttttttcttagaaagaaaagcattttgtaaatttaatttaggattccaaatatccaacttaattgtttcggaaaaaacttaaaaaaaaacagttaaaattttagattatgagttctcccaaacattttaatcacataaccttatatttcctagattaatacttaacctttctactatttttgtcccttttttttctctcttcttcaatcaatttaattttctcacaatcttatctaatattatcaagtgtcttaatttagtcatatttactatatttttttaaataaaatgtttaataaaaaaattaatgaaacatataaagcaatgaatataaaaatgtgaatattaaacagatgatgtataaaaaaacagataaacaacaatttgataaagcttgaaaaaatgatatatttttttattataaccctatgatccaaatcaaataaagccatatcgatgttaatagaataattttgatttgaatcaggaaaaaacatttttaaaactcaaaccaaagcaattcatttaaatttacatttgattgatagaaatttgattttacactaaacttgaaccaaattgtgaatactcctggccagtcaagcactagttgtgtgccaatttagcttttctaaagacgtttagatgacacgagcaaataatgaataaactattttttttatcaggatggctaaactaaattgattggtgatgtataattttagagatcttgttcttttttaatttcatatactaatttgataaactattacagtttcatgaactaaaataattgataatcttacaattttagaaattattttatcaatttattgattttagtaacttgaccaactattataattttggagacaaaattggtgattcataattacattaaaaaaatggtgattcattcatgtatttcttttattgattttgcttacaaattgttttataataaataatacttttattttaaaatatttattttataagttaattatttaaaaaaaatattttctattaaacatttataccgtgattatcatctctagataataggggtgttcatgagttgattgaaccggttatctaacttgatcaaaattttatggattggataggtaggatatgtgtcatttttcttactaaccaacataatcattaacaagttaagttagattaatc

SEQ ID NO: 922 - DNA, 1249 bp, Glycine max
  Soy_ogl_3375 Gm10:5322716..5323964 Cluster 3
cattgtactaattctcatatgaaaaaaatgtgttaaaattatcataagacaatgattttgagtcaggtctaggacgaactatgcaagcttttttttttttttctaagatatcatagtccacactcaataagtcatgagagagacacttttgagtaggagcaatgcgtacacttgcacgtgggaaatcaacaaaaccgtcagagtatgtaataattaataaacatactagtcaactgtctgggatttatattctcttcacactttttctttattatactaaataaatattaaattatttatgtttcaagactttcttctgctcacattttaacttttaagggtgaaagcgttaaaatatttaatcattaaaatttgtaagtaaataacagattataatatttttcttaaaaatgatttcatataaaaacttacagttcgagataaacaagttaatagtatatgtcctaataatataattttttttatataatcttattctttaataaaatttgtatgatgaatttatttatttttactttaattatctttaaaatcacatctgtaataatttttattatttcataatttttatattaacattacataaaaattaaatacaaatagcaacaattaaaaattatatctataataaagggagagatcaccttacaccaactctccatactcatcattcttttattttggatttaacggataacattaataattcattacgatggttagatttcaaaaaaataataaagaagatgaaaaacaatttaagaaaaaaatacttttagtataagttaattcctccttatatagatatagataagatttattaatatactccaactaaaaacaagggatacattcacaatcttatctatatatagataagatttattagcaaatgtacaattttattttttttcaattttaaatgtgcaacatgtactttatccaccagaaaatgaacatgagtctctctgctctagcttctgggtagctttttctgggctacagacttaagtcaaatctgatttctgaattttgaaaaataaggatatcgtttatatatactgtgtgcggatgcatgagtatgagtaggtgtaaatgtgcaacagtctactataagaaagaatcgcgtttactttgttgaccataaataaagaccagaaattttcacatccatttattatttaaatattacaaatcaaaatcaaaatcaaatctaattaattaatta

SEQ ID NO: 923 - DNA, 1087 bp, Glycine max
  Soy_ogl_6659 Gm20:718201..719287 Cluster 3
aacttgccatgatggtaaatcaaacgaaaggcaatcagaatcaagttacaacatcatagaaaaatagctacatgtgagatatcctcctacaaagaattttattttccacatatttgtaagatattttaacttaatttttattacatttctatgataactttcaagtgtttatgtatttctatttttaaaaatataattgaaaaatataaaaaagaaaaaaaataatatttcaacatttttttttaaaaaaaatactcattaaattaacaccacatttacaaaataaaaataaaaacacaagtacaattttataaacaaaaaatgaaaatttaaacaacttttattttcgtttaaattaaataaatacaggtggtgtttttataaaaataaatgcgatttgatataaatatagacattaatttaatttgaattgtaaaaacatgtcattcatttataacccaaaattattaaaaaaattaaaacaaataaaagtcatatttaagagcatgaattcattaatttaaataaaaaattgctaaagttattatttcaatgatgattttaataatttaattttaaataaatgaaatactagtgaaatcgttattaaaaacatgacttctaaaaaaattcagaagaaagtgaaggaggatgacatgtccaaagagtgagatatatttgcagggaggtgatttcaaatgacaaaagatgtgaaagagagtgaagtaatgggaatacaaataaagttaatgatttatatatgaaaaatgctagtatatataccttgttttttatatggtcagtatcttctaagattatgatttaaatatagaaaatgatcaattaggtttctcataaattaatcagttaaaaattagatcaaatataatttttaaaacaaatatcgttatataattgtttaggaattggatcagagtttttcttttaaaaaatacttaaaactttcccttttacttcgcgttcccattttattttatttctgtcggttataataaaatattatcaacatatgaaaataaatacaaaacagagaataatgcattttaatgttgaattattgaaaaac

SEQ ID NO: 924 - DNA, 1900 bp, Glycine max
  Soy_ogl_4019 Gm12:7902901..7904800 Cluster 3
ggatttataattaatataagatccagaattaaatttacttgtacaaagtaaatatcaactagttagaattgttaacttaattattgttctctcctattaaaatattaattatttaaggttttccttcaataactactgagtattaagttcatcaaatgttgttttaattaaaagcaaatataatattgtattatttttttaattgcattcggtattataggttaaatatcatcaaacacgtgaatcgattggaatcttaattatgaagttgtgttgaatacttaaaaagaaagatttgtcatccataatgattccatatgacatggacaacattgcttccaaaggatgtacttgtggtctagaccaattttttatatattaaatcatctctatttcatcaaccctcttactcatatacatataaagaaaatacctagaaataattataaaattaaaaaacaataaatatttttttctatctttctaaagtgtgatatttgaaataaaaaatataccttttattattttcaaagaataaggatgatcttcaataatggaggatacttgtgatctacataaataataataataaactaaattgttatttaagaaatacttacattatcctcctctttgattttaaaaattgtacatcttcaccaggcgaaattaattagaaattaattaattctaatgtaaacaaactttttagtttttcttcttcttatcttcataataggtaattttaacatctattatctgtgtgagactctagaagataaaacaatgattttgagtgaaattctaaagttgattaggggggagcattttgaaaaatttctaaacgaacaatctcaataaaatttttaatttttttattttattttattatgttcaatactccatgcgtagagtacattgtacatacagaaatgactataaaagagtctcgtattcatattaatagctactttaggaggtagtcttcctttaattcatattctaaagtctcaacaataagatgttaaactttttgttttatcattataagatgttaaaattagttactagttaggctgtccatgaattggttatttttaattttaagagaaaaatctgaactagctaaagaaattagtttaattttataatttttctaatgacccaaatcaacctcaaatataatggggtaatttaattcagttcgttgagttgttccaagcttgtggggggagaaaaaccttgaatgagagtgatgcacatgatcaaacttgtgacagatcaataaacttaatgaagtcaactctttatctcaactttcccatcaacataataaattgataaacaagatgattgagcttcctttgtagaatgaatggccagaatggagtcaacagaggagaactcgtacccgaagccacatacatatgttgcaactaaattcaaccaaaagggcaaatgaaaacatatagtcaaataatttacgtttgaccaaactccacatgacacatgtagcaattgttggatgtgaacacgatgcaactcatcaatggagagagggcatttatatcctgcactcttaataatacattttgaaatggactttctaaaatgcattaagaaggtacaaaatataatagtgggagtgcaggatgcaatagttggaaagaggagtaaaggaagaatggcttaggcatagaatagtttgggtcaaggacgagagggctatgaggtctataaaaaaatgcgcaggttggataacgggtcattaggtttctaaccgagtgattagttttatatatcataaatataataataaaatattttaaatatcaaatatttcatttgtatgctgctatataactaataatagtatatttatctatcttaactcaaatag

SEQ ID NO: 925 - DNA, 1500 bp, Glycine max
  Soy_ogl_5361 Gm16:29041301..29042800 Cluster 3
ttgttttactattaatttgggtagaatgtaaaatcaaataggaaatcttaacattataatatattttcctatgaatgcacaacttatctataaatgtaataaacatgtccaaaatattatttcatgtcaagctgtgattactctcttttctttttcaagttttattttctggtttttattactttgtgcttatgttttgtttttattactttttaaaatctaatatgcttatgttttgcttggcttcgcttacttttttttacaattgatgctatcttctacaaggtatgtgttcaatattttttttttcttacatatttcttgccttgcaaaggaagagattcgtgcacaaggtgacatttagttctactttaaaaattaactctgactgctttaaatatttttttatttttatttatagaaaataggttctctttttcaataaaaaatactgaattataatgattcctccttattcaaaaaaagaaaaagaaaacatttaactagttaaaaatattttaatctataaaaaaaactcttaggaaatagtagttaattatcctttagtgtctctgtaatttcaaaaaactattagaaaatgttcatctattattactatttcttaaacgactctctgaaaaatctaaaattattttaaacaaaatcatattagaatcttaattttttattaaaaaaataatttaagactattctcagaaaaatcatcttaaaaatatattttaagataattttacccaaaaatcagaagatatatttttcctaagatgattttttaggcaccctcataaaaagtattaatagatggttaaaaataatcataaaaaaaacctcaaaattgtcataaaaaataattttttagtagtaactgtcaaaataaaataaaaaagtgacacaattgcttaacgaaaatgcatttaacaaaatttaactttttttcaactccagccagctgcttatacgtcctgtgtccaaagcaaagtttgttatgaacgttccctaccacttacttaaaagcaataaaagattcaattagacgatgtaatttttaaaaatatttttcaattaggtctctttacttttaaaatatttaattaagtcatttattttttaaatgagtttaatttagtctcatatttctttcatttgctttgaaattttttaaaataaaaataaatttgattttaaatggaacaaaattgagcctactttaaaaaaataaggaagttaattcaaacttctaaaaataaaaggattaaatcaaagtattttaaaaaattataaaacctaattgaaccttttattaattaataataagagaactaaattaaatttaaaataaattaaaatctatttttttggggagtaattaaatccaaattttagcatatatatcacctcttgtgtggcatcaattacattaaattgtagttgatatatatagacacggcgatatttattcaatgcatttaaaaatatatt

SEQ ID NO: 926 - DNA, 1500 bp, Glycine max
  Soy_ogl_1948 Gm06:14719101..14720600 Cluster 3
attgtggatgaaaaatagttggttatatgcctcttttgtaccattggatctataaaaatgcctttaaattctacttatttcagacaatgaatgatgtttgttaaacctaatactagtatattgaagtttgaacgttttataaatgatgcatcataatggttgatttgggtcctattatttcgatcccatccttttcttttgtaacagaaaataaaggagtgctagctagtagcatgtattgttttatttaaaacttattattactcgtaaaacgatagctagaaaaaaagtgtatttcttcattttttttaaaacaaaattcaatatcactttctgttcgatatgtttcacctgtaatctcgtaaatcataataaattttagttaataattaaaaataaaaaatattactagtatttctcctataatatattactcctgttcagccatgctgatttaaaaaaaaaaaaaactcatgtttagccatagagaatttaagggctttgtatttttctaattgctacaagtgacatatatttttattttatgatgatatatgtgtgaaatattaattaacattatcagttgttaatttttgtaaaaaaaatctaatttgccacatttaataaaaaatttcttcccaacttaattggtcgtaatagttctacaagtgacaccattttttttaataatctaaattacttaattggtctttcaactatttgaaaattttgaagtaagtacttaaactaaataaaaaatttgaactaacttgagaaacttattattttaatttaggtactcaattgaaaaatattaatttagaaattcatctaaaaattctcaaataatttaatgacaaactaattaatttaacccttaaaataactaggtgaaaatgtgaattttcttttcaatgcagataatacatgaatgtacattttttttatcaacaatacatggatacatagagaaatgatatatgaacatttacatagagtatatactttatttttttattacatcatattatttattatattttttctttttttttctttggatatagattgacacataagtgttcatgaatattttttatatacgtatcacctaacggaaagtatgtgtcatgctttgaccaaatttgccgaacaaattaacttcttaggagggtgtaattttgaatttaagcataaaatttgggagattcttgagtactaatccatcaattagataataattttttgaaagtctgaacacaacaatgaggaaatggaaaagggtgtaattttgaatttaagcataaaactggggagatcctgtagttctaattcatcaattagataataattttctgaaattctgaacacaatgatgaagaaatggaaaacgacggctttgatgtgaaacatgtgcactcctaatcacagttgcatcttgcatgtgcaccacaaagaaactatgaggatgagaaagaatgcaacaagacaaggagcaat

SEQ ID NO: 927 - DNA, 1482 bp, Glycine max
  Soy_ogl_25 Gm15:16655101..16656582 Cluster 3
ggcccatgcccaatgacttactaaagtttttttttttttaagaaaaaaggtaatgtaatgtgctataggttaagaattgaatttctcaattattttaacattcaattgcttcccattcttttaacattcaagggctaacagtagttgtccacaatattgcagacaaataaggttgctaaaaaaattagtttaaaaaaatgactataattctaatataactataatcagttttatataactagatatataaaagtagttataaaattattggggtgtttatcttaggtgtagatttttaagtcttgggaatacaagaggaaaaaagataattatgttacaagtaataaaataattaattttaagtatattttttacttttgtaagtaataatcgcatttttaaccaacatttaatcttgactgaaggaatagggaatacttatttccatgggacaaaaatctcatttgtgggtaaaatatacatatacctatttcctacccacaataatttttctcctcttttaaaagacaaatatgctcctctctcaacaaaaaaaatattctaaagaaaaaataacatcttgaacataataagaatattttagtaattataatatataatcctagaaaaaaaataatttaaccaaatatatgtcttaattattcccaggaatataaaaaattattcctaactaattttatagttaaccaaacatatttttttaaatatccgggaaaacattctcatgttttattcccaaaaataatattttcgggacttaaaaaaactatcaatgaaacaaatgtccccttaattatagttatttcaaataaaatatttttatttaaaaaatagttataattataaaattataactagttttataaaaataattattttaaataaattatttttattcatttataagtggttatgtaaaggattttaaatataactaatttactcataactaaaataaacccgtactttaaaaataataactagttatataaaattatttataattatagttatcattacttataatctaattatttattagttatgattatagttatataaattgctatacaaatagtcaaactatgaacaccccatcctactcgtagacaatgcgaacatcaacagccttatggctatcgttaaactataaataattttatattatagtctggatagttgtttgtgtttctgtcaacttttgcgcgaattgttgcttataaaaaaattatgcgtgaattattatttaattatgcaataactttgaagaaatataattaattattgagaatccttaattaataagttttttttattaataaggttaggagttagttagattgatattgcaagttcggttacacggtgatcatccttataatatacataaattaataagcattattataagtaatatgtatttcttaaaataatgatttaaaatatttattttaattaaaa

SEQ ID NO: 928 - DNA, 1141 bp, Glycine max
  Soy_ogl_2368 Gm07:19449001..19450141 Cluster 3
ttatcgattataatattagagaagatattgaaaatgggacaagagaggagattagagcatgtattcttgtggctgttagttgaagttaagaatattaaaaacatagatattgaatttttttgtgggattgataaaaaaaatcccacctcaaattggcaaaaaaattggagaagatatctctttttcagcttttttttagtttcttaaaacattaaaaaaaatgttatattaagaaaaacaataaagtaaaaagtttaattttggatggttaaatttaaattattgattaatataattttttataactatttatttatttcactatctttttcattcttgaaacaagcagaaataattttattaactttcttcttcttatttatttcaaactaaattaaacatgtttttaatctatttttatttcaattacttctataataatcattagataaatattcaaattaaacaaaaaattaatttctattattgaccgttaataaattcatttatgaaagtatttttacatcaagctgctaaaaaaattagtaacattaaataatttaaaaataactaaaagattgaatgatggcagttttttttttctccctctctttgttttatatctaaccactaatatattttctcatttttcttagacaggagtgatctttatttgagttttagtaaattttggattaagaattagtctcattctttaaagaatgaaaacttataaaaatataatttgatatcatcaaagagagtcaatatataacttcaattatgtttgttaccaaaaatatattttcattaataaaatttcttgctttttttttttttttatgcttctgccgtcgtagaactgtgggttcgatgattttagaaattatcagcgaaccacaaaactaagacgacaattgacataaaatttgtttcctgtgccttgtgttaatttcattgtgtcacccaagttcaattaagaatatttatttgaatatataaattatttttattctaattatataaattaataaacttttaatatttttttaggaaacttacatgttaatattttcgttttaactataaattttttagtaaataattttttaataccaattatataaatcaataaaattac

SEQ ID NO: 929 - DNA, 1500 bp, Glycine max
  Soy_ogl_2377 Gm07:34828901..34830400 Cluster 3
ttttatacaattgcatatttaagatcaataatttttatttaattttagagtttaatccattaatggtgtaaaatagttttacattgtcattcaaccacaaatcaccatttgaattatttcaagataattattttaaaagtcaacaaacttatcatcataatgagttgtaattagatgattgtgtaaaactttttatattgtcattacataatcttttttctcttaatattaatcctataaaataatttcataattaattaatttttttaataatatttattttatgattttaaactatttatactaaaatttaatttcaatctaattagttaatatatttattacaaagtaatattttgactctaaatacaaaaaagtttgttgattaaatagttgtataataatgttaattttttagataaatacattatagtaaattcattaaatatattttcatcacaaaataattttaagttacttcattaataatatcatgaactatattagtttatattttctaaggatagaaaacacaaatattattcacaagagacaatcatgctcaaatcaagtagggtcattataggctacaaatcaatttctctaagtatttaacaaaaatccatacctaatactcaacaatatttttccttttatttttcaaccatataaaatcatttttacttaaaaatggtataaaatagttttattaataaatattttgttgaataatatttataaaatcatatagtcaatatatttgttacaaaataatattttgactctatgtttaataatgctaaatttatatgtatatatataaataaacatattaaagttattttattaaataaattttattacaaaaaattgttttaaattacttcatcattaatatctttaattaaatattgatacttttcacagtagaattcacatgtattctttccgagagataattctacttaagttaagtatgatcattatagatgatactatttttaacatgctaacaacatataatattgttataaatccttcatgaaaattttattgaaatactcagacaaaaatatgattatttttttaactcaatacattttcttatgatgggtcaaagatgaacattagactttaaattattcgaaacattatttataaactatatataaatattataaatttaatcattttattaataatacagttataaaataattgaattatgtcatcatttcacgtttcaaaattacaaaactattttaattaaacatgagttaaattctttctaaatttttaaacataaatttctcatacaattttatgaatattttaaatgaaataagaaataactatagtattatttctaaataaattttgttacttttgctgatataattttttgattaaaaattttagaggcatttgttattgtgagactaactttttttaatatgtttcaagatactattttaacataatttatgcaacattaagtag

SEQ ID NO: 930 - DNA, 1386 bp, Glycine max
  Soy_ogl_2831 Gm08:40915201..40916586 Cluster 3
acaaagggatgtggattttcacttcactcaatcactttacctttcttttcaacttagcatgccctttgcaaaagagaatggttttgggaatcctatgcccttccttgtttggttgtttttgctgtgtctcttgagataacaagattcccacttgttatcactctcatatattggccactcagtgctttaaaattatgttactgtgttttagatagcaatcttttctgcaaaaaccagtaatgcattgatacagtaatcttgtcacgtacactgttcatttctacgtacttatatattatgatgctttgccaattttataacagattatatttaccataccaacaaaaaaaaagttcatgcatattggagatcactgttacaactctcagaacaaattggaccaagcccatgtaatttcagaattcaaattcgaccaatcttcttttcagaatttaaacatgatcatgttaataatgatggtgacgcaagttgagctagctagtacttatcaacgtgtttggataaaaataaagataaagacatcttactttaatttaatagttgtaaaggcccagaaaaatatggggtttgatcaagacacgagaaagcgacatttctcaattgcctcaaattctggccatcataagtttaaagtgcagttaatttgcttagttgttgcgtgataactatagccacataagcagaagagtcattatgaaattagtagtaacaataatttaaaatcctcttatgacattttttttactaattctcttagttgttttgtataatgttaccattatattataagtttcaagttgattcaagagttattgatgagtagttgttttgtataatgttaccattatattataagtttcaagtttattcaagagtaattgatgagtacaataagattcaaattcacttctttatgaaatatgaatttgatttttatcaattaaataagtttttattaattatttataaatattttattttctcaatcttaaagttttttatataaaaaatataacagagcccccaaacatcaaaataaaccatatcaaatgtgaggatcggatttgaggtaaaaacataaaggaaaggtttttatcatgtttttaatgcattaaacatattcattttttcatttaatattttctgaatagtaaattagaaagatttgtaagaaaaaaaaattattaatcccaaatgatgttttaattaggtggtgaagaatatagaaaaacgcatgatggctgaagtaaatataccggtcaataaagacgataaagtgtgagaacatacacgttacgtactaataatatgttcaggtttttcttctttttttaagagtatgattaaggtttttgtttgagaaga

SEQ ID NO: 931 - DNA, 1300 bp, Glycine max
  Soy_ogl_5720 Gm17:33885401..33886700 Cluster 3
gaatttaaatttagaagattaaaattataaaaaaattaaaattacaatttaacaaaaaatatatataaaaagttaaaatatcaaaagtaatgaaaaggagaggctattgagaggttcaaactcatgtcttttttaagtgcctaaaacaacttcaccaattgtgccaaaaaactacttggatcacaaatttaattattatagaagacaaagcatataaatttatttatatattatacatcaatttatgtgattaaattatagtgatccaccaattcaactttggatccaatcatccaataccctaattgagtcggtcacttatatgaattttaaagctatgacttattggtctgaattcgttgttgtgaatcatgtactcccaatttaatttttaattcataactaaggatatttataattaaggatgtgtttggttaaaaaaagaaaaataaaagatatttttttaaattagagtataagaaatacaagtcctacaaaataaaatataaaatttttcttgtatattatttttctcctttaaaacaaatacattcaagggaaagaaaattatacaaaataaattatatggcatatgtcacattaactatatgtcacttcataataataattgacatgaaaacttggattatattacatcattaaaacaatttagaaaattattaaaacaaattgatagagacattaaaaaaatttatggaaaacaaaactaattaaaatactttagcaagaactaaaatgaaagttggatatagttgtaattagagacatatttaaataaaaaatatttatttaaaataagataggggttaatttaaccaagctaaatattgaaagaaagagtttgtcgttgtataatgatcttaaatgattcgaggaagaatgtcacttgaaaaatatatttttaatttctaccaaaacaaaaaataagacataacataaaagaaatatagatgaaaattgaagataaagagaaaattataaaagatagtttatttgtttatacttaaattcttatatcacttattatatttttttatttctttgctaaaatactcttttactcttttagttttcggttgcaatttgattttctaaatttaaaagttttacttttatcatgtatcttcaagttatctttctatcaatttgtcacactaacttagtcaaattagtaaacacataataaattgtaggagatgatacatcacataagtgtttatctcataaatcaaaattaacaaggttagaatatttgagaaaaaactttaagctgaaggaa

SEQ ID NO: 932 - DNA, 1212 bp, Glycine max
  Soy_ogl_6048 Gm18:153689..15749900 Cluster 3
aacaatacaattaattccttttgtataataaaatataaaaaaattaatttaatttttaataattgagagaataattaaataatttaattgaactttttaataagtgatggatctaattgaatgtcttaaaaataattaaaagatttgattaaactttttaacaattaagcacaaagataacaaacttatctttttgagtcacatgtcggcacacatgaggtgctctcacttgaatcaattttttttatttatttaattaaagaaaaaaatgaaatgcttttttatttatatatgtgcttacaattttttttatcatgggaattaaaaaaagttagatatggccgccatctattaatgcaatgaggtcataggagtagagtgcagatgggcacgatgaatgtccgtgtgtgccggcttttgcttccatttggtgtattactttagagttaaaatgtttaggataatcattgtgatcacttattatttacccaaattattgtatttaatatattgtgcttcaatttataaaaaagaaaagcactatttagccgctgactcaccttaatagttactttatcttccttatatcctcttaaaaaatatataacagggtgaaagacaaattttgatcccttaaaatatataacattggcacattagtttttataaatgtccataaactgtaattcataaatcatattaatccatcattacgtaaaacatataaattaaataaaaaattaatgtatgtttaagaattaaaataaataagtgattaagtttaaaagtttagttgtaacgattgaattttttttttggtagataacaattgaaaattttataagatttatttaaaagtttcttattttgagggactcacatgacatcacttatttttaaaaaccaaaaaggtgatttacttgatataataaaaaagcagaggtagatctaagaacacatgtgagattttatttaacatgtaacataattaaaaattaataattattttatggaatgcattaatattttaatttaagtaaaattaaaaaatatagattctctatttttatttgtccccttttaaaataaattagtttatctatatgtttatttcaaagtttaaaacaatgttagttactattgtgattatatgattattatttatatctattttttaaatactttttatagttaacaaaaatgaaagagaaa

SEQ ID NO: 933 - DNA, 1086 bp, Glycine max
  Soy_ogl_6370 Gm19:8675301..8676386 Cluster 3
ataaaagaaaattttaaattattaaaataaaaaagtttattatgcttacatagttatattaacttttgatttgctgacactactactgtataaaaatgtatgctctgaacaaattatagtgtcggtactcaactagaaaaatagttaatatcgatgtttttttttttgttaaaaaatataagaaatagggttgaaatgagtttttttttaaatattttataaaatcaaaatatataacaattttaaaaaacattgttgaacatatgcatgggacgcttagaaaaaaaataaaaattagaaagggctttttttctctccatcctctccaagccaataactcaaacatttttcttcaagcctctgcaaatttccctttcccaaaacttgggaaagaaaataaatttaaaactatatgaagatatatattgcttgtcttctttttttttttttcctgaaagaatatatttttttttgtcttagtgataactatttatgaactaatagtttagggcatgtacaaacaataaaagaaatgtctgtaccaaaaaaaaaaaacctgtatcaaaaacaataaaagaaatacagaactttgaatgtgtgttgatttagtccaaggcagctagctatctttatttcttcaatttttagtatttatatagttctatacattcttctagttgttaggtataggttgaacccatgcatgtaatatatatatatatatagagagagagagagagaggttattttttttatctctttgcacataaaagtttttttattctcatactgataattgataattgtgtcttttttaaaaatatttttagcttctatgtgtagtgatccattgaagcaaaatcttaagtttgagtttatttatttaattaaataaacaagtttgattgaatatttaactagtcaaatttaaatagttcacaaataatttgattcatttatatccttacatattggttaaaagttaaataatcacttcttaaatcatttcatatcacaaagaatcttagaataaaattaaattttgtgacaaattaattaatctaaccatttttatcagtcttgatg

SEQ ID NO: 934 - DNA, 2495 bp, Glycine max
  Soy_ogl_884 Gm03:35522206..35524700 Cluster 3
aaaagacaattcagaatatgtagatattataagataaacgaaatatgtaatgaaaaactaacaatactaactctatgaaataaaaaaaggaactatataaataacctttttaaaataattaaataaacaacttagtatatttagggcatcttaagcacaattacaagagttgttttaaattaagaaaggtttcttaacaaaatttatcattagaacacatgataactcgacatatattacttatacaagcacgactctaagtaacattgattaaaatttgttaagaacaaaatatacttttttatggtcttgatgagagaaattaatgaattataggactcataaaatcaagttaaaacttacattaaaaattttaatattattcttgtaaaaaaaaacagtattaattaaagttaagttaagttttctgtagagtacttaaatttatataaaattatattataatgaagataaataactcatttgaataatcatattgatattcttacaaagattaataaaaatatatttaaatatttaataaatctcacggtattaatacatatttattaaggactttaatatgggatatagccaattttgcttactatatgattttcagtctctttatcagtatatacattaattatagaacttataatctttagtccaaaaattaaacttccagacacttatataaacaatctgtaattagcctaaattaaaaaaaactgtaataaaacactaatgtaattttttttctgagaaataaattatacttcaagaatatatatattttttatatttataaagtaaaaatataaatgaattatcattttaaagaaaaatataaaattataaatttgtggaacccaattaaagttcttaataaaattattgttggaataaaaactttttaaaattcttaaaagttgatatgacacatgagatccacaaaaaaattacttaaagactttagaataagattactattgaagatgctctaaagttgtcttgtaagaattgaaatgagtcacttacaggatcctaactatgttaaaacttcatcctcatttttattattgcacacagtatttactagtattcatataaccactttgaattcaattcaatgcaatgttttagtatttcaataatgtcaatatataataattaaaagttacaaatgatttcaatataacgttagtgtgagttaactctatgaaaatattagcattggtctaaagtttaagtaatgcaaaagtaagttaaccaaagaatttaacttaattggttacacatgatatataaatattataaatcgtttgatacttttctaagatagacagagaaaaagagagtaaaaaatttaatttacaaccttgtgttatatataacactgattaatttagggtgaacttatgattttttaaggatacctaaaaatttaatttgttgtttatcacaaacaaaaagtatctatgcgtacgtacgtgatactgttagtgaaaaaagatgagatatttcattttcaatatttttatgccataaagcattgtttaccaaattaaaatttgtggcatagcgagtcatgtgaaccaatgccacaaataaataatggtacatcataaaatgtcactcaatattgctatattgctatattgcaagctccaaatgatttatattttattgatctctctccaaatctttgataatttattgcgagaaatccaatctaagaggacatactacctagcatgattataatagtcaagttaattgtgcaagctgggatatgattgatggcaacaacactatatccattagaagatatatataatagagaaaatagtaaatatatggcgaagtggggggagggaagtaaatgcttaaactgttctgagtctcgttagtgtctcctagctagggttctcttgtctctacacaacagagtgctttacaaaagattgagtaagaaacctagggccagatattaaactaagaatatgtggaaaatagatgttgcataatcatttttcttaggtagtgactttcactctacttattaaatatgtccaaattaatgtggtatatatgctgtagagtcctgatgatccttcaaacaagagtaatgaaattcaccacccattaatatatatatcgatcactcacgaatatgccataaccagaaattattttaacaaatcctggagtatatatattaatattttgatggataatttcatttatcgtttgcacaaagatttcatttcttgaataacatatctggctattttacatttggcagtaaaaaaaataataacatttcccaatctcgttagtgtacggtctacccaaaacattatatatatatatttttaattagttttatatagtgcttctgatgtatgatttttcatgaataattaggttatccattgaacgagcgtgtcgtgcactacaaaatataaacagtggtttaacatgtcccccca

SEQ ID NO: 935 - DNA, 2100 bp, Glycine max
  Soy_ogl_2314 Gm07:9746001..93100 Cluster 3
cacatcaccggtatatttttgttcatcttctttctctttgtatacatcacatcactgatcatattaatttaattcctaaaattattacacatttactgttacataaaagatttttttagatcagttaacaattatattttttcaaatcagttatacagctaatgacatgccacatagaaaattaaactttttagaccaatttcttaaaaattaacaaaattaagaacaaaaaaatcattaaaactataattcatcactcatgttaatcatcaaatctaaataagattcatttttttttattaaaagtgtctacatgacatgttacacatttatatgacatatgtcatatggatgaagtttctattcttatatgaattccaaaaattataatttataaaatattattttagtcttcaaaattatgacaatatattattttaatctttgaaattctaactcgatgtcaccttaatttctaaaattaatgaaattaaaaagaaaatcaactttattcacttctatttttttttatcgtcaaagcaaaagtgagtcattgtctaccataattatcatataaagaacaattctttcatgtgcttatgaacacatgatatgaaactagtattaaattacctcgttaaatgttttaaattatttaagaaaacatgttttaaacgacctttatttttttatataataaaaaagacttgttttttcaatatttttcttttacattttatttcttatcacgtgctcattcatgcacaagttaaaaaaaaagaaaagaaaagagtatagtattataagtatacctatctttaagaactgaaaaaaaagtgtggacataacaattgttattttattttaaaaataaatggtagtgctggcataaaaatactctcctggtgtgaaacacttaaatatatatattacagtacacacactacgcactttcatttaggggtctaatctttaaaacctcgctgaaattagcttattgcaatttgcaaacttggtaaaggaaaaaatatttatattgtataatataattgacatattattatatctcttaaatatatggtacaaaatttaaaaagtcaattcattaaagaatttcggcaattttaaaaattaatctctaactttccaccagaaatacctacccacccaaaaaaaaaaattaataaaggaaatgatttatcagtgatgttgttataatttttaaatgacatactaaacaatgtagtaaagatattaattaagactttttttttataaaaatatataaatttgtgttattgataatttttcttatatttttttataatttttatactaaatattttttttaaaatttcttaactaatatcttaataacatgataacgaatgcctgtctctatctatcaagttaagagaatataggaatacagtatataattaaagtagattaataaatggcaatgatacattaatgggtcatttattctctcttttttgaccaggatgatggccaaatatatgggatttaaacctgtcttatcgaagttaatgtcagagagagatggatggtgttgctgagttggtggctgttatgttatgctatgttaggtggtgcatggctgaggctgatgacatgttgaattgaatggcgaatatagtccccactgggagagacatggaagcttctttcatgggggtgatgactcttctgccaatagcatgggttttaggcaaagagtgcagtggaacaccataaccttgtcacccctccattgtgcatttgtcagtgcattatttgtttttgtccctttgcttcacctccctagtccccaaccatatcccctcaaatatattcccattctatcaagtcaatacccctctccattgccattccatactttcaattcaattacctaaatcttaatcaactaattattcacaagatatttgttaaagattttcaaaacaataacaatagtttttattaactactgtgctatacaaatattgtttagaaaatttttagtataatgtattgaatttaaatttacatatgtatttgcattaaataaaaattgtttatactaattttatttaa

SEQ ID NO: 936 - DNA, 1907 bp, Glycine max
  Soy_ogl_2716 Gm08:15824701..15826607 Cluster 3
gtcttgcattgttgacttcttttctttgttatgtctcacgattcactctttgtatacatcatacatatatatatgcacccacacggtaatcgtccttatcactccaatgccgtttcttttgcatttgcctcttttgtcttgatatgtatgaggcaacgcaactaaagtactataattaaacatctgtaaatttttttttgtattttcattagattaggaatcaaataaagggaaaatactatgaaagcaattttttcgtaagaaaaggttttcctaaaagttactaatgaaaagaattagaaagaaattttatacctctcttttccttgttgcttatcttctgccaaataacctaaaatactgtttttcttcatttttttaaaccaagaatacaattagttgttttcttcttcaatataagaggaaataaactcatttaggtctcataataattttgggttccgccacaaaatagaaggaaagtagtggagaagcaggcttttaattatataaaaacgaaattaacattattcttttaatcatattcctctcctttttgaaggtatttatattattttaagtatattttctttggttgttaaaccgtgccaaaattttatatcttcatcaattttttcttaccagacaatttaaaatcatctcattttcttctttctactttcttttcttccactcttcttctaaagtcaaacacatccataagtaaatttcttacatgaaggcactgctaatattttctctattgaatttgttatcctcagacaaaaaagagaaaagcttgattagtattcatgtcatgattctgttcattttcttttacacgatcactggacgatgagatgggagagggttatgatgaagtagtggttaggggttgcagaaaagtggtaaaacattgagtgaggaaagcacatccttcaaatcataaccgcgcacgttttgctgagataatcattattcattcaaatccttcaatttggtgcacgaactctgtgcttctcttcatcatccaaatcaaatcctagcccttgaattttatcacttcaattatttttcataaaaaggtggctccactcttcctagtgctcaaccgaacccataattgcactcctccttctatcacctatctctttaccagagagtccaactaattctatccaataagtaccagtgggacataaccaaactaaatatgtttctaaatataaatatatttctttttgtcttactaaccaggcactgatcaatttttttaagaggaaaaataatatcataaaaaacacaattttatgagtttaaaaaatatttatgcattgatagtgtaaaaaaattttacattttcatatcatcatttaaattattttaaaaaccaacaaatttattatatataatacactcatcgtataactatgtaaaactttttacaatatcaatgtataatattttttctcattttatatatattaataaaaaaaattaatttctactttaaaagttctttaatcagtgtcctaacatttctcataattttttctttaagaaattattgagtaaataatcaattaaaagtcatgaatttgtattttattgtcaatttagttactaaaattaagtaaaacttaaataagctcctatttttaaaaaaatttcatttaaatttctaaaattatctcatttatcttattttaatctctaaacttatattattgttattattatcacttaaagttcatagactaaaaaactaaatgagaagaaatagtaatttcaaggactaaaacaaaaaaaaatacaattttaggactaaattgactatttacttaaaattattgtttaatatggtacgctttatttaataattttaaaagttcaaatattaaccagcg

SEQ ID NO: 937 - DNA, 2200 bp, Glycine max
  Soy_ogl_4364 Gm13:30555801..30558000 Cluster 3
catagaaacttctttgaatgttaggcaaaacatatttcagaaaaattaattgaccgcaatgtatgtacccacgcaataaagtttcacgccaccttcttatatgtcaattttttctacaaacttgcacactactatctatagtggcttgaggaaacattaccaaaagcattaatcagaagctggagaaagccacgaggataatgtaaaagctctagctcagtctattttgctgataaaacttctttatactctgcacatatgtgggcaccaggtactgttggcaaaaaaattaaaaagaaggtaaataggaaaaagaaaattataaggaaaattaaaatattttaactggaataataacccgtaagtgaaatgcaatctagaagagagttttccacatttatatacattaatataaatagactatcacacagctagaaagtaaaatgattgtatactaattaatcactataaaatatcaaatattcagattttctatattaatataatttctgtttaatagaagttaaattattaatatatactattataaagctctactaataatataaatgcattatatatttatagtacggtgtataaatcattaaattgtatatattgattttttataataagattttttttcttaattcaattaatgtattatgctgctaaccattgggaatttgggattagcgaaaatagttaatcctctacaatacgatgaacgtttaatattctatattactttaaacaagattgcctatgaaaagtgatatctgtgagggtacaaaaacaatgtattatgtaatgtttatcttgacaatttaattttcgttaaatataatatatattaactaaaggaaatccaacatataaacattagttacgacattgtctttttatagttaaaaaataaacttttatattacaaggctcatttgtcttcaagctatagctggcaaagtaatgattttgaattttcctgaagcatcagatgataagaagttgcacttttttaactgataggatgccaatgaatacaccacacagcatgttgagttgcaccatatatatttgttggggaagcagatactggtacagaaaccttagccaaacaagtacacgcacttatttaattactatatgttatttaccactccattttttgtgataattgagacaacttcaattaatcatttcatggcactaaataaagaaccaataacgtttttacccttttgataactatatatatttctgctggcctctatataattaagtatatatttaacattaaataaatctttgttattttaattttttacgatattatttgatatgaatatgaattcctccctcccattttaaccaaaagggaaaagtgaaactgggcgatgattgtgtctccccgttaagtgctcaagagtgtcaagagctagcaacagctgaaaattgtgaagcaattatgtactgacatgagaattatgacgttgtatgtgcatgtgaacagtgagttccaatcatgattctgttcttattcccatgcatggcttcatcttctgtcaacctcaccttgtaccaactttcaatcaaagttagagaaaataatgatatctcacacataatggccattttatgatacaaggagtgttgtgcagtttttgcagctccctccattgacacatcactttcactcttttaaataggtatagtgaatagagacaacaaaatttttaggtttttttcttacagatgaaatttttaggttaaaaactaccttactattttttttagtgccaaagtattttttaattagaaactaattctttaaaatatatatatataaatatatttaaaggactgacatctcttaattaatattttttatatataaatatttggaaattaaatgtctgatcacattagtattcaaaagatataattatatatcaatcatatcataacatacatcaataaaattggttaatatatttcacgttaagtgttggtggtggtggaggccagtggggccagcaattcctgaagaactgagaggaacatggatgatataacagcgagaatatagcatcttgccatagaaccaacattttccagatggcataaatgttactgttaattacaacttcaagaaagaaatgggtttatatctggaatttaatttgcatgtatttatatc

SEQ ID NO: 938 - DNA, 2792 bp, Glycine max
  Soy_ogl_6145 Gm18:52862609..52865400 Cluster 3
gtattaaggataaaagaaatataaaaagttaaaagctaaaaaatattagttcaaatcacgtttcaaataacactagactttattaaaatattatttaccaaacaattcaataaatttttaagttaataaaaaaattaaaaattaattgaaatgtcttgcataatacgtaattgtatttactaaaaaaaatattgtatgtatacttacgtgttttggtaattttaaaaaaagtatttaatttgatgatatttttattttccgaaaactattattataagttaacctcttttggtgttttaattttttaaaaattatttagttgtttaaaaatattttaaacatgataatttttatgttagaaaaacactgacaagctaatgtaaatcggaatcttatatcattcaacaaatgctacaaggaagaaactaacttgcatgtattctgtttgcgtcaatataatatataggttctcaaactcgcttataatacgtttggttttaaacttgatcgggaagtggcttctctttttactaacaaaaaaagtacttcttttacttggacaacagggtatgtcaatgtcactttgacaaaaaaaaaaaaaaaacacattttgaataaactatgctctctccaactttaaacatttacgtcctaaaaaaaaaattatttaacattgaattgccaaaaatagaaggttttactgttttgggtgtggtttcagaagtagatttatgacggttttaactttagctcaaataattgaggattcttaattccacactgtataaaattataatgtttgagaaaatatttagagtaagttttatgcaaattgtattttgtggggaattaaaaccgtgattaaataaaactaaatatgggaaataacttgtgcgatagtggcatttaaaattgacaggaattaatttaccaatttaaatctatgcttagtgacaactaaaattgtcagtaatttaatctcttgtcactacaagtttcattttaatgtatttatttacaaaaattcaaaataaaatacataaaaataaaattactgcatgcacttaaatatcaaagaagtgcatagaagtctttaaaaaatattttttaatttccaaatttgcaatatcgtatatgatcttcactttatagtaataaacagtaaattaggaagtgacttcaataggaaattaatatagagaaaattaaaattgtaaagtaataaataaactataaagttgcaactaatatatacttattcaattaataatgagttgttaacagactagatttgaaactctctttagtaagcttcgacactattttgtgatgaaaaaaagaactcaacgacctgatgaaatgataaaatatcttacagaaaattccaaaataaaacttgcttattataaatacaaaaatatattagacacaaacagatcaaatatatgcttttctagctaaaatccaattgcctagttaactcttgttttttcatgcggctgaacatggagataacgcaaagtcaagtacatgttcctacatagtttacttttgtcaatttgcatattatgtaagtacccttgtcttcgctagtgaaaggtcttataaaaaggacaatgagaatttattattagaagtaaaataacctaattaatcccaaaaataaataacctaattaaggctaaagtttaataactaatattataaataagaaaaatactagtatccacgtatgaaatgcaacaatttaatttattttagcaaaatcctttatcagtatatatagatatacaatactaataagtttagtccaggcaaaactcaactcaattttttttttaagtgagatttcgaatttgaacataaaaaaatataatttaaaaaagagacctcagtgataacaaggcaactttacatcattaacataaaatggttacccacaaaatatagatatatactaataattctattaaacactaggttaaaaaaattatatcgtgataaatgtttaattagaacctaatccattatttattacgcgatagtaatccttttcgaggaagaaaaagcaacccctccgaaacacagcaagatttttccaaatttaaaacaaaagttaacattaagcaaaaactaagaccaaaagtccaaaatcttagaagagtttgtccaatagtgacagtgatgtgtgtgtgaatgtaaaaataataataaaaaaaacgtacaaaacgaagcgcgttgaatacttggtgaggtcccagatgaatattccgagtcattgtatttattttcaatatcctctgtccttatttaacattccatccaatatattatgatcacaattcacacaccaaccaacaattctcaaacgagaaagcactcatcctctcatctcagggaagcaagaaccaaacatgcctctactgaattccaatcatttcacttcaatgaggttagtacgttacttagtgtaactagaagtactctaaccacaaatatgttatatgctatttcccatcattaaccctgtttgaaggtgattctaacatcttttgcatgcttcacttgcacaccctgctatcgattttatctcatttcttctttctattattcaccaattggacatttttttgttgtttgtgttttctgtcacattctgcgttgagcaacatttatttatagcagaattgcatcataattctagtatgtctaactttttttttttacctaacgagtgtgcttagagaccaagtggacagtctattcaaggaattgaaagaaatccatcacaa

SEQ ID NO: 939 - DNA, 1400 bp, Glycine max
  Soy_ogl_3135 Gm09:36653701..36655100 Cluster 3
attttttagagtatttttttatgacattgaagcaaagtattttttttgtgtatttttaagtcattataaacattttctaagggctaatataagtttaatagtaaattttaccaataaacttgtattattttacaaattttaccaccttagttttattttttaaaattttactataactttcacaattttatgaattttatcactcaatttgtttttataaattttcatttaaaattttgatttttgtgtattttatcatcatgttagtaaaaaaaatgtaaaaagttacttttctagatttttgcactttgattatagttataatcgatgtagaaaaaaaagcttttagattagttgtggttataattgatataaaagatcaattttttttataaaatcttatttatgattacaactaatatcaaaattcaaaattatcattctttgataaatgattttcgaaatcacttaatttgatatatagttttacaaaatcacctactttgataaaaaaaaaaaaaaaagtctctctgaagtaataaaatgtgtaaaaattaaaaacttaagtgacaaaatttgtaaaaataaaacttgaaaataaaatgaacaattaacccaatcattttctaagggccaattatttatgatttaattggatttgagccaactcctataaataattaatgttttttctgagataatgagcccaacatttaaaataaaatgaaacaaattgaatttgggtcaggaaacaagccttgtctcttgtcgtgggctagtagtccacgggataacagagaatacgacccattaaccaagccaagcctaataacaacaatcacaatagtatcttaaaaaaaagctgagttttgacattgatagtaaattagtgatcaaatgaaacttggggtgttcaaacataatcaaagatccagcaactggtgcaagccgaataaaatacagcataaaaaaattgggaatttttaaaaatacattgtaaaacatccaaataaatcatttcatgaaaaggggtcttatatcttttaatatatataaaatagtagccttcattcactaaatcaatgcccttaagaaaaggagtgccaaactataagttaggtaatgcaaagcgtagggcaggatcttaagccttgcctgtagttcaatcttgggccacagaagtgaatgtaagcttggttactgaacaatctaggaaagccaagtcagcaactgaatcaacattaaatatggtgtctttgaagctaatgtaaattaattaaatcaacaagttttgaatttttaatccatgtatttttttttaactttcattatttatttggttttttaaaccgacgggttcatggttgcctaattttattttataaaaaacaaaaaggaaa

SEQ ID NO: 940 - DNA, 3127 bp, Glycine max
  Soy_ogl_6113 Gm18:50172606..50175732 Cluster 3
atgaatcatttattattctatattaaattcccaaaaatctttcaaaatgaatcccttagttccaattttttttaccagtaacttccttctaattaatcataatgtgtagtactaataacttttctctttcatatataaaagttacaggttatattttttcattaacacatttcttcctttgtttaaatcccaaaaaaatgagaatatcatatgaatagtttgatggaccctcatttgatcttgccattgacaacgagtgcatggttcaagatttgattaaaaatgatgctaaactagagtttgaagatttgtcacttcttattgttgaagattcaatggataaggaagagaaaggtgaccacattcaagacaacttattctctcatgaattcaaagttatttctgcccacaaagaggaggtcacaacaacagaaactgagttatcaattggggtcgggattggaggtgaagcatctgtcaatgagaccgaaaatcattttgacctcaacaaagtgcatgttgatggtgttgaagaatgtgtattagttttgaataaattgctagcagaaggaatggacttaggatttgagagtgaagaattgaataaagaaaggatttaacgagatgatgaagatttacttagggttgttatattattagttgtaatttgaaaattggtgctaaaaatgcacgagaaaaaaatcatttttatttgtgacgataatttttttgtatggtgattgttttagctttagtaaaaattatatgacattatgtaatagtaatattataatactcttagaatgcatcatatggctaaaggaacttttacaaaggataatttctaaaagtaaataaactagcagttagttatatgcaaaagtcctttggtttgaaaaaagacaaaatcacttgaagggtacaataacatgcaagtgcatggtacaatagtatttaggtcccatgccaatttacttgctagcatccttttagtgctagttgattgcctttgaatagtccacatagtcaaagttgttaacctgcatataaatttttacaaacgtcaaaattctttaattaaccaatatgttttgtaatttaaatataaatttatatagtaataagtttcataccttattcaatgttgtttaagtattcttcaacttcatgaactaattgtcaatcacattttaggtagttcacctttagcaaacattgcatctttctttgaatgagggattttataattatttgatctttttttcatgatatcaatcatacatgactgaatagttaggaaaaaaaaattcgacctttgctagaaaatgcttcataagatttttgcatagcctcaataaggtcattgactgtcatagacacttccttttgctgcaacgattgaattacgctaaaaaaaaacccaaatctagtgtatttaaatcaggagaattaggtagttgacaagttaaatgcacattaaacccatctttggtagctactctacaaaattcctcggcatcttctcgtggccatttttctttgatagttggtaacaccttgttaattaagaacattcggctaacttctttagtgatagaagtaattggttttgtttcaagtgtccccgatgcttcattagcacttgaccttttcgcagcaatttcaataactagaggaaacatgctaatttttccattaaattttccattgccttcatcatcaaatctaggcctagccaccgcaaccaaaaacatgaccttgccaatatagtttttgtttttgcatgtgcaatatggatcatcctcagttgcaagtaggtaaaactttgaagattttgggcacatgtaaaaccatgtctcatctatatgcacaacattatgcatggatttaaacattggatcatgaggaatgctactttcctcaagcatggacaaacaaaatttaagtttggctttcatattactatccttcaattgtggctttaatgcatttgaatgttgaaacaaaacccttctataagatatttcgtcaatgttgttttacttttaacccctaaagcatatgctagaccttgaagagtgctccgcttaggtaaggaaacatcacacactttctcaaaatctatctcaatactttttcgaccacaatttttggctttcaagtggcaaacattacctgttagtttcaattgtttctaaatccgataaataacatctttagagaccaaactagaaagagccacttgtttagcaaagccatgattaagttttccattcttacttgaattaatcaaaattcgacaaataattttcctttggtcgttatccaagaaaacatgttgccttttagatggcccctcttgttgaacaatgttttcttctacaacaaaattaaagagagactaattaaaatcaacaaaactaattaaacatggaccaattcattaatttttaaaaaaactaattaaacatggactaattcattaaaattaataaaactaattaaacagggaccaattcattaaaattaaaaaaactaaagagagactaaatcatttaaattaataaagataaatagagactgattaaaaaaactaattaaacagagactaattcattaaaattaataaaattaattaaacatggaataattcattaaaattaaaaaactaaagagagactaattcatttaaattaataaaattaaggagagactgattaaaactaataaaactaattaaaatgagaataattcattaaaattaataaactaattaaacatggactaattcattaatttttttaaaaaaaaaactaattaaacaaggaccaattcattaaaatttaaaaaactaaagagagtctaattcatttaaattaataaaattaaaaagtgactaatttaaaaaataattaaacatggacaaattcattaaaattaataaaactaattaaacagagactagttcattaaaattaaaaaactaaagagagaataattcatttaaattaataaaattaaagagagactaattaaaatcaataaaactaattaaacagagaataattcattaaagtttataaaactaattaaacatggactaattcattaaaaataaacagggaat

SEQ ID NO: 941 - DNA, 2021 bp, Glycine max
  Soy_ogl_474 Gm02:10392880..10394900 Cluster 3
gttgaccttgctaaaaaaatttacacttacgacatgtcaacattaaactcaaagaaaaaacactcacttttcgtataggacaaatatttaggagacctttcggccttttgtcatttcccacaatattactgtcaattctatatatacatgaccgcaaatcaaccatcgaaaagataattttgtatttatgaatgcttataaaaaagtttcattaataaatatgttgataagggatatatcaagtagaaagacttttattatgagagtcggaaaaataaatcttaagcataagttaaaatcataaaaagttaagattaaagaaaaaaatattagacatttttaaatggtcatgtaattggcttaaaaaaatatcatgcaattattaaataatttttaatctttggaaaaaaaaaacttttaatctcatctatcttttgtatgattgtatgacttaatttttaccctttatcctctcagacgactctcatcaagcactcctctcacttaataacactttaagttcacatgtataactctttctcaaataacttttatgtccttttgtttgtgtatatttctttgaaaagaatttgaaaagaaatagaaaaaacattctatgtaccttaactttaaaaaaaaagtagtgtgcaaataatatgctgattgcattgaattgctttaattaaaaaaaattgttagtttaataaatttactgatatattaaatttttttaaacaattttaatagtgatgcaaatgaattttgtgttacttaattatgcttgttcgagtctaattaagtttatgtaaccaaaccaaggttcaattaatcgatccacttattagcaacgcatttggttaacagttggtacacttcacaaagcatccaaacatgaaaagaaaaataaccatgaattgacattgatcgtgaatatgaaggtagaaacaaatacagactaaattggtgaaattccgttatttacaaattcataccatgtatagaaaatgcgtcgaaggcatattggtacatgagaagaaaggctggagtacttttataataaaaataaaataaatttgatttttttatacctaattttacactcactatttttttcctttcttttctttatcacctcatcattcctttatttaatgctcccccggccccaaagtatatttactctcccagtgagtagtcttttctatatatgaagcatataaaaagtcatgaaacttggaagatcttttcttttatgactgtcagcaacatactgctttgaatctactccttctattagttaaaatttgctaaaatttaccaaattatgaatgaatctcgttaaagaagatgcaactatcaatctttaataagttttaactgataaaaaatatatagaaaaaaaatgctaaaatatgttactatcatttctttttctcttttgtagtgaaaatgcaactatcgatctaataatgcattgccaaaaaggcatgcgcatgataacattttaggtcattatcggtcaatattcttccgcgatcagaaacaattgaatggaaaatacaaatagcggtaactgataattaaccgagtataaaggaaggcagcttcacttaactccttaaggacatttttatcaaatgtcaaaagagaatattactacgaataaaaaagataatacattacttatttatcttctactagtactaataataattaataaatgctttgtttctatgcttagcagcttgaaatgtttgttacgtatggcattaattttctatctctagtagttttcttccaagtggcaaattgttactaactctaattaattaagatccggaatctatacgtcaccatatacaagctcaacgacattaacccacatgagtggataaaggttgctaattaaagagagatatagaaaaacacccttttcgtggttaattggatacagctttgaaccacaataagaacagtatcattaatgatcaaaaggaccacatagtggaagcagggatgca

SEQ ID NO: 942 - DNA, 1200 bp, Glycine max
  Soy_ogl_2637 Gm08:12638601..12639800 Cluster 3
aattagttacactctacaaagataaatctattagtctggtactaagaacttttaatgtaaagtaagtttttaaatagtttttaggatcatgctaaatttattaaaagctaaggccatgtcgtctaaaaaatgttcataacagggtattgcacacaatcccagactttacgtttagccaacaaacttgactcgttttaaggcaaaagttcagctattttacgtatctgtacgaaggcactcttccgtagatgtagctttcaatatctgagtgaagattagtcacgtatactaaaaaacaatgagaaaaagagaatattcctaacgaaacgtgctaatatatttgtacatgtcttttgaaaaaaataatatattaggatgtaagttacatttccgcgaatatataaattaaaagttatacttattaatgttattttcttaaaaaaaaaagtgttagttttacagttcacctcaaggtaaacccactttcaaaagatacaaaaatacaaaatattgcttctaaattttgtctcttgaaaagtgtgaacggaagtttaggtgtattataacggtttaacaaaccaaaaatcattagaaatgaccatttgtgacgtacgtcaaatagaaatataaattagtctagtcgagctgagtactagaaatttagatttaatttgtgaaaaaaaaataaaaattcaagcttaacttgcttatttaagcaaatttaattaaaaacttgagcttgtcttatttaacaataaaataaaattcaaacttaacttatttagtttatttataacttagttattttttagtttgtgaaaaactttcttaaattatttttttaattttattgacttagtatttaataaaacattttaatactaaataataacctataaatagaaatatgtgttaaacaactgctataatattgtagaatttataaattttattttaatcttcactattaaaataaaatgtaatgatcaagtttgatttttctcactctaatatacaaaacaccttattattagatatactccctaaacaagggcatatctagtgagagggtaattttatgagtaaaaataaatctagacatataaatatacataaaagattaaaatttaatattatgtgatcgcttaaaaaaaattatatatttttttaaaatcttaaatttgtgtgttttatcttgaa

SEQ ID NO: 943 - DNA, 1869 bp, Glycine max
  Soy_ogl_2692 Gm08:14739501..14741369 Cluster 3
ttaactaaaattcaatttcactaaatcattttttttgttttaaaaaaattaaaaatatttttgaaaattagttaaaaattatatcaactccattttcatcaaatacttttttcaacatttgaaaattataaatcaaaaacttgaaatcatatgcgaaacggacatatactttagctaacataaattcttaaaccttttttatcttctaaatcctcctaatatgcaagggacaataaaaatatgaggaaagaatttagaccccttattttttcctcatttttttttctatatttctaaataaagaaaaaaaataatgaaaactccactcattgctttgattctccgccgactaagcaacaaaggtatcatatcctttttatcatccctaactcttgaggaccgtctatttttacgttcctctatgaagataaatgctgcaagacttggcacaatatagaacttacattgtgctgcttttaaaagtctgtttactaagaatcatgctaaatgtctcggctgccaataccatttaatttatggaaccaagaatatttggcttcctattaaacaagataagtattcgagaattcaatttggcacacaagacaaataatcggatggcttaaatccacgtgcaagattcattgttaatgagagaaatgtcttttcaaaatcattaacatgcactaaataatagatggatttaaatattttgaattgtggagtacattttaaaataaatataccatagtaactgttggttaagtaataagtgtttaacaaaatatatacacgtataaaataaatcataatactattaaaatttcaatcaatgttttttcttgctgaaaattttaatcgttgtccatccgcatttagctttaaagtacatcatgtatttattattattttgaaagttaaatccattgttattagggttacttttgttgatatagattttttaaccaaaaatataaattatttgtatagaaattctaagtttgagctgataatataatctattatactaacaaactatttgttagtatacaaaattagtatatagtagtattatctcttcaacacactattagcatagactaaaattgtctatattaatcgataaaatttaaattcattatggtccattaattaatgggaaaatttggatagtttgtaaaaggttctgtattgaaactttgttttgttaccgtataaaacaaaaatccttcaatctttggtgaaatttatattgattaaaacgaacttaattaattaacattttttatttgttagcattcattgaatatgaatctggtgaaatgaaatttattagcggaattcaacttgttttatacacgacaatgacctattggtagcattaagataatttcccctctcttttctagcttgcgttatagaaccgttgcaccataaaaatagtggtgtatatatggttggtaataatgcagaataggacaaggtaatggctactggccaagttttcaagtatagtttccactttccatgtcaaattttacgactattgcccgttaatgtatctcatatataattggtttcttttaagtctaaagcgtcttttgttaaaagactaaagatgtataagttctaagttttagaaagattacgtatttattttgatatttgcaaatcaattatatttttttatcaatcaacactacaacaaaatcattgttaaggacggttaatgaacacaagttgtcgttggctaagtaacgatcgtgtagtcattgccaattaaagcgttgcatacttatttgtgtcgaccataaggggtcgacgtttaatagtgatggatacataagtcgttgcttaggtcgtcgatga

SEQ ID NO: 944 - DNA, 1900 bp, Glycine max
  Soy_ogl_2736 Gm08:16933101..16935000 Cluster 3
gtttgatacacacacattaacgtttaaacttcaaattatatatattttgttaacgtttaaacttcaaatcaactcagtctaaattaatcattcatatgatcacgactaaacacaatattagatttattaaaatattagaccaaaagatataaggttagttgaatgaatggttatgacttgagagagaagaagagatgagttcaatcattttttgttaacaaaaattaataacaacaataatagttaagatttactgataaaaaaatattaagctgaaattaggccaaagttaaatccattcaattcaacctaaatcatgaatacaacttacaataataataaattatattatactaaataatctatataatttttttccattgtcaatcaattttcatgcaattgtagagcttcacgtatttcgtgtagtggatcttagttattgtgtggagctgcatgctataccgtgtgtggatatatgcatgtagaggggagattttgtattatgggttaagagttgtatgcagtttttataattcgtgttttgttcaggttgtatctatttactatttttattatccagcctgtaacacatgttggtcttgtttttatcaataaaattctttctgtctatatattaaaaaaaatcctaaacatcacccttaaaaaataattattataaaaactaacaattttaatttttataataatctatgattgaatgagatttcatttttcattccgagtttatttaaattttaatcttaatataaagtctatattatttgtgaagtttatctataataatgtggttacttttatatctaataatagtataaagagtttcaaaatgaaagcaactattaaatataaaatcagtttgaaaaagtaaatagtaattaaaatagcacttttaccaacaagatgaaattttatgaaaatattgctcctaaaatataaaatgaacaacaattgttttaaccattgtttcaccttggaatatcggttatataatcgtaaatccttgtgtttttttaaaattattatttttatttattcaattggaaaaatttatatcaaaaaataagaaagaaagaaaaagggcaagtaaaagagatgtatatatttcaattaaagtattacttttcaaatataaagacaaaagaaatgataagtaaaatgaattggaaaatttaaatgtaatatacttcatacctacttattttccaccaagagttaatttttgatattgaagacaggttttaatgtaaaaatttgtcgataaaattaagttgaacaaatattttaaataagtttaactgtttataaccaaatttatttaacttaaaaataaagattgatttgctctgacattttggagtttaattaggaaaacattcttcatcttgtagcattagcaaactaggtaaaaggcaccatattttgtcgccatgtacatttgaaatttcttctgttcaattatacccttgggcatgccgactttctttttgttccccttccaaaatcaaagttgatgcacaccaatcatcatcttaattcatatgcacgcgcacgattaaattaataaaataaataggataatttttatacattttaagtaatatatatagagagagggagaggtaggataattttaatgtatattcaggaaaaagatgtatatagaatatacagggagaggatccatttccgaggaaacaagataataaagtggcggatcacactttattttgaaaaattaaattaagtgtatattttatctcccttaattttatatatttaaatcttctatccttaattttttcctccatgataataatattaatttttatttttaaaataaattatcccctaactcaagactctaaatctgcgacga

SEQ ID NO: 945 - DNA, 2000 bp, Glycine max
  Soy_ogl_3043 Gm09:7658501..7660500 Cluster 3
aaatgattttttttacatttttttcattctttcaattaatttattatctatattttattttcttttaagtgtaacttttacttgcaatcactgatagtctaaaggttttctctctcttcttatttttacatgcttttaatattaatttagaaataaataaactacaaatattaataaattagaagatttattattattaatagaaaatttaattttatctttactatactattattcatgtcatattttatttcttatgatattgcaaaagtttgaatatctatttatctaatagttacatgacactttatttgactttaaattataacaagtatacattttttaaagaaaaaataaatttaattatatttacaatgagtaaaaaatattttatcctaatatttatcattaattttaatcatactattagtatgcattactagtaatatatagacctacaatatatttgcaatttaatgtttgttacataaaatgttataaaaaaagttttcctaacacaacaattttatagtgcataatatatacataaaaataaaaatctcatactaattaaactagacagaaaacaaacctagccttggattagataatgatcacgttatatctagtatacacaataggggtccattcaatagcccttttaattaggctcaatcaataaaagcaagaatgtgaatatctgaaagacataggaacccaacatcattgtccataatcataaatgttcatatatactagggtaggaagacccgatcggtcatagcatagtcaccattggctccaacatttttaatttgtgcccttggcttgattacggattgtgaagtttttcgtaatccaattgacaaacttgaaaaacgggaactctgaaagtgattggaatcgaaaattaaacatgccaagaagaataagcaactattgaagtttggctgtattaatataaggagagtagccccaatgtccacgtgaaactgtaccattaggtagccatgcatccctgaaaagtagctaccatctttctggtaattgaatgtggggttcctatggacgaaaggctcgtattcagcaattgtagaggttcgtgccagtaataattagacaagtaacctagctcatatcatagaaagaatagctgggttgcaacgtagtatggaccaataaaataattgagaaacttttctgtttcataattgctagcttggtataatgaaaagagtgatcatacatgaacaattatattttttaaatatctaataaataatttttattttttttatctatcttttcatgtcaaatcataatatttataatatttatactagtaaatattgtcccttattaagtcaatgtatgcaaaactagtcctctccaagtttccaataatagtgttatatcagcaattaaacatgacaaatgtaaaaagtaaaatatgtttgtcccaataaaattagtaaatttcgattttgatctctattgatttttccttttattttcataattcatccttttattttcataattgatcctcacctttgttaagttataagttgtttaatagatgttgatgttaatatactactcatcacgtacacatgccactattaaaaggtcattgatccaaattttaggtagtttttgtttcacagaactttatataggattcctgaaaataatatttccagaaatattagatgaaaatgatatttttgagtatctttaaaaaatatgtatttaactattaaaattagttggaaatttctttttaaattctcgagaatattttaaaaaaattatttggttcaaactattttttttctaaaaatatgttttattactaaaatattttttccttaaaaaacttattgtatatacaactaaaacagaaatgtgaacataccttacctgaccttgttgaactaaatcagtctattcccagaatcaggtgatttggagctggtaacaactttacgacattcaaa

SEQ ID NO: 946 - DNA, 1722 bp, Glycine max
  Soy_ogl_3133 Gm09:36589731..36596 Cluster 3
ttttaaataatacgagttccacatttgatatatctttctaaatattacaagtttttcatttgatcctcccatttaaaaaagataaatgaacaaaattatgacattaattagagaaatcaaataagaaaaaaaaatagaaaaatgaattaaaaaggaaacttgataaaaaaatatgatgattttaaaaaagctgaaaactcaatcaagcctcaatataatgatatttagactttattttttgattattagtataaattgattgtcatagaagaaaactgaagacaataacgtggttatctgaaatagacaggcaatcaaagcatatcattttaacaaaataaaaatcaaaggttaaaataaataacagctcttgaaaatttagttaaattaaaaatacacaggctatacaaaaactcacagtttaataatatgcggttgatttagaaattagagaaaaaaaataaggaaatacagtaattcccctttttatgtgtatgttacacgaaaaaggaaaacatttgcgaatcacattgtggtcctaaaaacatgtcctttgctaaacatggaaatttatatcctcaaattctacttccgatgagttggtgtggatcacttaatgtttggaatctctgccaaatttgataaatgatcccacgtgaataaagactaaagtgtgttgtacagtttaccataagaggggacctttctcattattattaaatatattatggggaggaattttttgttttttaaactctttacaatagggtttgaagttgtgacttgtgttgtgacctccagcaaaacaataaaaaacaaagggaaaaattatttaatgctagatttattgttataaaaaagggaaaaagatttaatgctagatttattgctacatataatctctattattttctttttcacttataataagtgtctaaggtgttaaagaattagataaagacaattgataagtaataattaatattatctcaatttgtaactaaacagatgaataaaaacagttttgtttgaaaactgtgcagataaaagaaatacacttaactctataataaatccgttgacttctattacaggtcatagccgaacctaagttcatcaagagtattcttgaataataggcaaaaaaaatgttatatatcaggcttgaatgaagtagtaaattactaatgtgaaattcaattcttttttctcagtaaaaacagaacaaagcataattagcgtgactaataacaattgatagaaagtgatagttaggctaaaaaagattcatctaattaataaaaattaaatttagttatattctataaatgtaattaaattttattgttaatgtaaagatcttgtgagtaacaatatacaaatactttataagcatttaatgaacttctaggactctagtaaaacctcgaaacttaactcaatttacctaaattttcttttaaaaataaaagtcatatatatgtcatttttatcagatatactaattactatatatatttaatctcatctttggattagattataggcatacgtgaccccctgattgtaatcgtctaacaaacttttcggcctaaacttgagtttataaataagtctcagatatgaaacaatataattataattctctaactcacccaaacattgatttgagggtcggaatattcataggtactctaatgctattgtgtcaccacgacgcca

SEQ ID NO: 947 - DNA, 1468 bp, Glycine max
  Soy_ogl_3860 Gm11:17080201..17081668 Cluster 3
ttccgtgtgaaccggaaatccaatgataatgtgtttttagcaaatcaattttaaaagtgttctcacattatcggacctaacctgatcatgacacataataactgagctaggacctgattaattataaaaatatgagtgctaagtaatagaaaggagtgcaaatctaaactaataaattaaaaagagaaagagtgaatcagagaagctatagtggacatatagcaaagggcactggtccacctatgaatcatccaaaaagctagcgtatttggttatgcatgtattaattaataatgaatttgctacttaactatggaatgggaattaagcacaagaataataaatatagatggttctatcttgagtgtttttttataagtaataaaagagacatttaatccttaataaagtagcttaacaattttcatatatgaaaaatcataagtttaagtttttatttttttatgaggtaaatataagtattttataagaactttttcatcatctttttttgtcttgcattaagacgccatctccttgcccaaaattttagtgtaaaaaaatagtaacaatataatattcctgaaactgataaccacatgaaaatacataattgatcaagatgggatcgtgaataaaataaattagtactatactctcatatttatctatatatttatacagccatttttttaggcaaaaacttctatttacatagccatgaattgtatagtaattcataaataaaatttacgcatgagtacaacatctatttggattgatttttttttaaaaaggttggattcaactatattttccttaaaaattaattagatccaaaatctaatccatcttatatatagatttttttgtttattttattttcaattttgagctttttgggttcgatttcgggtttgcattacattagattaatttataaaaactcttaatcaagatgctagctgtagtgattcctaataatactgattgttaatcttaatttaatgatttattcagagcatagggtgtactctaacacgtgtactaatttaaattaacaaaatttaacataatgaccaaaattttgacaataatgaagtagaagggaattttcctcatttagagtttaagttaaataagaaccaatgtttttcgactaacttgaattaaagtacattataatctttattaattttaaattaacaacttatattctttcagtactttatctatttcctcactttagagtaaataattttttttggtaaaagtattagttttttctataatgttatagactagaattaggaaatccttaccttatcagcagagctaaaattaaacaatgttttaactctctttgttctagtttatatcaaccaaaaacagtttatcaactaaataaacgatatgtttttcttaagattattgatttgtttctccatcttgattttagtttttatcc

SEQ ID NO: 948 - DNA, 1380 bp, Glycine max
  Soy_ogl_4992 Gm15:11300421..11301800 Cluster 3
aaatgaaatcaatacaattgaatgatattaactaaatattgaaattagcataattaatttttttttattattatttgagaccaaatgaagtatatacacaagagaagaatcctaacaacactctttgtaaaacactcattccattattgactattgagtgaattttatccaaaaacataaattttagtgagtcttatttttaaattaacattcgatcatctctctttaaaataattttgctactaaaaaagaagttaattatcaatcttttggagcattagtgttgaaattttgtggatataaaaaacatcattgagagaatagaccccaccatatatgatcttctatggctatgttggagagagaaatattggtttgaactaatatgacctaaatagttttgcagttgaaccactatttattccatttttttaatgcaatttttaatgaaaatacaaaaaaatgacacacccaaaaatcaaattcatgacctggaaattgttgaatggatcaattaactaccaaatcaccatgattaattagtaaatttatcacataaataatatatattttatattttgttatttatactagtttgtgctattaaactactaactcaatgatttaaccaatgactcatcaacctagtaacttgatctaattgacaactaatctagttttcaaaccactacattgaatactcacacttataatatattcacaattctctcttcctatttttgtttgtccccaaaatattagaagaatttgaagaggagaaaatataatttttacttttaaattgtatccactaaattatccacaaatcttatattacatataatcttctctcatgtttataaaaatataatagtatattacccaatttttgcctccctttacaaactaaaaaaataaaaatcctatcatatactaccttccttttaaaccaaaccaaatctttcgactttaatgcaaatatatgttttattaatactaatatcagaacaaagttttaagatgtatataaatgtgtgtgtgtgtcaataatacattattttgacgcgttgagttgattgttttctgaaaaatttgttattacaaatatattttattaaaattgatgtatttaatttgaagcaataaaagttcaccactgggtcgatttagcatacaaaattatgcaatgaagttatgtatttggctcctacgtgtcaaatcaacggctgttttgtcttaaacgagaggaattgaaagcacatgtactttacgcggttttggtatattctctgattattgcttctaagccacgctcttgcaattttgtaccccaaaaaaggaaaagcttaaatctagaactgtatatatatgatctcccat

SEQ ID NO: 949 - DNA, 1634 bp, Glycine max
  Soy_ogl_5936 Gm18:5156867..5158500 Cluster 3
ttttgacgggaaaataggggagtgattattttaaaaaaaattgaatcagtatttaaatacttaaaaataaaagtagtatattatcatataactttttaattattctttatccattttaaaaaatatttcatacctctctcaatttaaaattaaaatattaatatttcattttcttaatcttctattctctccattcaaacatatccagcttaagaaggaagctgccaacgattctgccttgaaaaaagacttgtgggtacgagtgttgtattcataaagataccatgtcattttttggaaattgtatttattcatcttcaagactcacaaattaataaaattaaattgagcactacttttgtgtttatgaataaatatatttgtattttgggtccgtgacatggtcaaaagaagtatataaattgcgaatggattactaatttttcttttggttgtgttagtagggctagggtattgaatgcctctctctctctctctcgtttttttataaggttgttgacatgaaacatttattgcacgagtccctgaagcgaaattcgttatatttaaattgtatttgttttcgttaatccttaaatattacaaaaaccatcttttttagtttttggtttctaatggtatactaaaaatatattacttttagtaaatgtaaaaattataattaaaaaaaatttaaataaggatcgaaaaaaccaacatatttttaatgacaattttttttatagagactacatgcaagagaattttatccaaactagatgacatttaacattattacatatctagaactttaactagagaccattaattaagataaaacaattgtgtactagttcatccacatgcttaatgatgatcttaagtcatccattttttttaatatagaagtgcacttttttgaaacttacatataattgaaaccgccaaacaattctgtagtatatatagtttctaattgttatagaattccatgtgaaagatatttttatgtaaatgaaaatatatttatttttaattagaattatatatatatttttaagtagtgttggccacatactttttattattgacaatttttttattgatatggaaagcaatttgtaaatgaacaaaagcaacttgacatacagttttaagaaaatgtttagtatttgtgcaaggagtaattttatctaaaaaaaattgtggaaggagtaaaatgttatatgtcatttcataagcaatgctgatcttattttttttttaattaggcgagattagtctcatgtttaatgtgaaacgtttaaggaaaaaaaatataatatgtacttttatattataaatatttgtgtaatcttatattgacttgttaaaacttaataaagacatatgagtttttttttaatgtgcatataatatacaatcttttgcattgcaagtatttcattttcaaccattaataaatgaattaaagaatattttcaaccaaagaaaatctccaatatttgtcacattgcatgaaatgtttcttggtcctaattatgcaagtaccagcaagaaccggcaagttattgcaaagaacagccctgaaaaataatctgtacttaagtctactgtaccatgctaaatcaggg

SEQ ID NO: 950 - DNA, 1304 bp, Glycine max
  Soy_ogl_6336 Gm19:2281897..2283200 Cluster 3
taacaataatatttctcgataaaaaaaatagattaaaatattatttttctcttgaacaaatttatcttatatatgaaataatcagagtatttaaagccaccaaaataaatcaagagcacctaacaaaatgcttttgagaaatattgactcatgaagtggttccgacactgaccacaaatatcatgaccatgaggacaatcaacaacaaatatagttgaaacttgaagtggattagcgagacaaaatgatcacaataaatagtaaaacctgtacaactcaattatgccgatagagttagggcactcaacatgtgtaatattagttcttctcccacttgacttgaaataaaatttataaagctcccttggaacctaatcttccttacaatattataggacaagttattagtttttatcataattcaaaaatattatactcaataaaatttctattgcacacatttagtttaatatattagaaagtttgacgtcatttgttttaattttaagagtttataatttatatatttgttagaaaagttcacttaatatcagtttattttaaaatcaaacctaacatagcatgttctatcacgcatatgcggaggagtgttgaaaagttttatatagggcccatttgtttaatttatttttaaaaaacatttttaaaaataaataagcatttttcactttttatgtttttgtctaaattatttttttcttaaaaaaatagttttatacttttttaagaagaaaatcatatacgcttcataaaatattatttttaaaaaaataatttttatattaacacaaactagccattgtctactttatatcataagatgcaatttatactaactattggcaatttcctttaggggacatttgatagtagagaagttttatattttaagaaggaattttacgaaatgaaattacattctctcttcttttttaagtgattgagggaaagaataaaagtaagaaatgaatcgaattcaccaaagtcgttttcattgataacatactaattaaattaagcatatctagtaatgattgtttgtaaattaaattcttaacaaatcaactaattaagttaatagtgtgatagattaattgatatcctggtccaagaccaaatctaacaacgtaattaaagtaacaattaatttcaaatcgcatcaatatctacaatgatagtgtagaatgatgtttaattaaagttaattattagttttatgtcgggtaagaaataccatttttcttttatatgacaaatcaataatcttcctaaatataaatcaa

SEQ ID NO: 951 - DNA, 1410 bp, Glycine max
  Soy_ogl_5738 Gm17:37119691..37121100 Cluster 3
ccaaaatattttatgtaagaggatttaaaaatggttacaagaaccacaaatccacaatcaatgtcatatacagaaattacggtaattaaaattgatcggatttgtgtaaaaaaaaaatgatcggatttgcagtcaaaaatatttttaacggggtttcagtaaaaaaaaaagatttaaaattacattctaattatatttacacattttacaggactaaatattgtaattgtgaccataacatttattcttcaattggacttacctgtgaccgcaaacatattgtaattaatgatgactcaattattgcaattacatgactattttatatgcattaattaatggaataaatttaaaaatagtatttaattacttccttaggtagcatgtaattacaaattacatgactaaatatttcaattgtgattgctccacctttatcctgacaccctaataatcatggaaattattagtagctaatgtttatattttaaaattcgaacagagttagacagattaattctaccaatctcctttatcctaatagtatattaaaaaatatttcatttgatttgctgtaaaataaatatacttaatgtaattaattggcatgttttgatttgatttttagaagatagtaattgaaataaacttttggtaaaataaaaattaaaataaatctgattaaatttctcattttaaaaatatttcctttatattttacatttttttaatttaaggtaaatttctattcttttttcattcttttgaaataaattatattagaagataaatactcacttatatgtgtattttcacaatccataattaatccatgataaagattaaccaccgcttatgataaagactacttcttatcaatattaggaaaaaaaaaaaaaaggcaatgtattgggtgcggcaactaaagcatggagcctaaactggaccttaaaggtagatattatatgtcctttcagataagtaggacatgtaattctataatgcctataaacataacttccttaacctgctagataattgcaaaacttgaattgcattgaataaacatccggatattccttaaaaaaaaaaaaacatctgcatcctcaatttttttttttttgcataacataactattacaatatagaattattcaaagagggtattcataaaagcataaaaaagaaatatattgctacatatatgttttaatcattttatataatcttctctctgttgttatttcatttttaatttaaaaaacatataaaaaaattatattcgttgaatcttatatcacttattatatcatttgattgttccttttcaaccaaacatattccctttttatcatttttatttgtgacaacaaatagtagatgttaaataatatataatattggtttaaa

SEQ ID NO: 952 - DNA, 1500 bp, Glycine max
  Soy_ogl_168 Gm01:45142601..45144100 Cluster 3
ctcatacaaacatttatgttacaaggaaaaaaagagaaaaaattaaaaataaagtagtgaagataattttaagtgcgaaaattttataatgaatataatcttatttgtgtttttgcatttttatcaccatcaatttattcagctagtgcctataattgtatacccctcaacaaatatatatagtatcaatacttttttttttattaatggacctatacaaatgcctaattgacttttaatcactaatttgtaaacatgacactggaataatttaagtcactcatttatcttttaatcttactaattaaattacctgtgatttgtgattttaataaaggtgttttctataacaattataaaattaaatcacaatcaataataattagatgttttatattttttaattaagtgatttatgtttaaaatcctgacttatttttggatatgaaataaattttattaaaaaatatatttaccttataggcagttatgtttctaataacaattagtcaagcatttccgcttaaaaaaaatcacaacaaaaagaaaattaccatatgctactcattgtaaaattgggtttttagcttgaaagcaagtacccccacgctctccaaacgcgagttacgctgtagctttgagagctattttcctttttatatctgaattttctttttacggagaccaacgagacagagaaaaggtgaactgggctcgcagtttcttcataatttttgtttccatatctacccttaccgtctttgctgttccctcgagttaagcgagacgaaaataggaacactatggtaatttaataaccatatgcaacattggcctgtctttcgaagctgaatctgacgacacgacataatgaaagctttttagaggttcgaaaatatcgaggcagatttggacggacaagatttacagttgtaacgtgaaaacctatggctgagatgcttggcaacgtgttctacagtatactttcaaaaaattagagtaaagactcagtttcatttttgaataaaaatgtttatttctacaacagatctttatttatttcgcttatttaaagtatttacgaaatatttaacttgttgagataaaactacattattttttcttttaaaaaaataaataaaaatttataaggtagcaaataaaaaataataatgtagtttttttttctttaacaaaaagaaccctacattagtttttgggtttactatcttattaatcttttttttttttgaatttttacttttagtctcaaatctaaattttaatccgtagaacttttttttatcacttttagtcctttcatcaagtaacaatattaatttgtgacacaataacaattataaacttgtgatattattaaaaaatttgacgagataatcacataatttttttttaataaaatatatgtttagttccttattaaatgttttgaacagtaaaatgagagattaaaattagtttataaaagaaattatgcat

SEQ ID NO: 953 - DNA, 2153 bp, Glycine max
  Soy_ogl_504 Gm02:11849313..11851465 Cluster 3
tatctacacaaaccctatgttagtttacattaaaaaatcatgtttaaaacatcgtaaagtttatattgcaatatatttcaaatgccaattaaaaaaattgaacatgcattgattaatgataaaatttagtgaggggataggaggaggaggttggcatactgtcttcacgataatggcttcggattcttggaatcttaggtgcatcgttattattgacatttgacatttgctagcgatcaccatatccatatatatattattcttacaagaagatatttatccattatactagtactactatgtaaaatcgcagaaataacagtcaaataataatgaacactagaaaagtaacaattaattaatctaaactcattttggacgtgaacggaaacaagaatcattgcgaatttgcaatcattaatcggttgcactcaggaaaaaagcacaccgtactaagttgaattcaaatacactctttgacatgaaattaattattatttctttcattttatattatttatcttttaaaataagtgtttacgtactcagaatataagattacttatttttataagttgtatttaagtaatttttaaataatagaaaatgtaaaagaatttatgttaatagtgtataaaaaataaattattaataattaaattattgtgtaaaatgtgttttataaaaatataattataaaattatttttaatgaaaaaccagaaaccaagaaaaatgaacaaatgattacaccttaatataaatcgtatccagttttttcttatgaaaaataagtttaaagaattagaaaataatcaaaatatttaagtgggatattgataaataaagatggtactattataaaataattaatcttttaaatattttttgaataaattaaaatacggctggaagagacttacagtcacattttacaaaccaacactatcattgggttagtttaagggaaattaaactcaaatttcttaaataatgttttgagtataagctttaaaaaagaaagataattgtgagaagtgatttcattgacactaaatagggtggattttcagagagaaaatgtaaaaatatgtttgagagtaaaattagtttgtaaacatatttaattatctttcgaaagtatatttcaaaattgagagtaaaattttacttgcaaaatcaattttagagaattaaactttgtgatacttttgcaaacttataaggttatctgatttaaatttaagtttataaactttaagttaagtgtataagattttataacgacgattaataatgaacaacgttattggatatttcacacattatataatacaaaaaaatcataaacacactaattatttatttactggcaccgtataaagcacagaatttccgggttccatgattcaatcatattcaacgtgcgaatgaataggtgcgcgtgcacacatggtctctccgtatgctataagaacccatagtctaacgactaacgacttgtttctaactgtcacccactaaaccccttcggaatgtgattagttaggtaagagtaataagagtgtcgttcatcgaacttggtgcaccgtacgcttcctagtcaacggtccacacgattagaccccctactctatctttttgtagggacagtttcgtaattttgaactctttcttttttctttttaccactcactcatttgtcatattttgttttttactcgttggtaaaaggtataaaaagatttttctttttttaacttcattgtttaacttttcgagatggtacagtatcacgtgacatgtgggcagatcttgtcaactgctactagctggcatgggtgtcactgccccagcacgtgtggatggatcataatgttcttttctttttgtttgatcattttttttttacaggaaatcgtgaagtgtgagatggaataatggaagtaaatgttccaaagacctttgggacacatgaagggtctacatggaaatcggaaaaaagggttattaatggtttatatttcaatattatttatagcttgtccaaaataaatattggttataagagataaaattagctgaaaagataacttaaagttaaaagttaacttgaaagttaaaatctgataattaattttttttccaattaat

SEQ ID NO: 954 - DNA, 2213 bp, Glycine max
  Soy_ogl_509 Gm02:12022988..12025200 Cluster 3
tatgataaatatgtgtagtatatattttttttatattttaaaaatgatgattaatagtatttttttataattggtgaatttttatcctttacactgttatcctaagtttcataaagagagacaaataaattcattaatcacaaaactatgaagaccaaaatttgtcgttttttttttgggtcacttttattccaaaatttaccgtttttaatacataaagattaagataaattttgatattttatcctagtaattatttagtcaatctacgtagcggatgagaaatcataattaacaactagtagtgtattcaagttggcttcgtttttttcacaagtggctgccatcaatcttcagtataatttctctgccgtcgcatcgatttgaacgttttatttattttttatatggtgctaagaaggcaacaaaatattaagaaagcaaatttccctgacaacaaaatatagaaaagaagcaaatctccatttcgataatttctaaaaatgtgacttatttagggcattggttgaaatggacacgagcattattttatgtgcgggttgttaatattaatcaactatccagcaaaggttgaagtgctacaaaacaaaggttgccgatgctgatgcagaagatacacaaatattagcaaccaaacccaacaaacatcacatgaaatggtcccactataaccattggaccagaatgttttggctcttcattatgtcgagaggctgaatcctcctaatcaatttcaattagttattaatgcatcttatcatctcttcaattctctcctgtctacaagaaaaggagagaataacaaagctgctcttttctcttctttcccttgcatcataattacactaagactttactaataaagctattgaaaaaatgatgaacttttaagtgtgattaaattttggataatgaattaatttcattatcaactcaagggttgaagcttgtgggagataccttacagtgggacttaaaagactctaatgagggtggttgcaaaaaaaaaaaaaacaccaagactcaatttggattaattttttaagcatttataaaaaaaaatttcttctataagttaaaatttatatatgcataaattaaattaagtttgttttttcttctaaaaactaaatgattttagcttattcaaaaagctcattttaactggaggaacttatttcaattatcgttttattttctcatatatagaaaagtttattcaaataagtcctataaacttaattttgatacactgttaatttaaagatttttatattgccagtaaattagaaatgatctgatatatgattcttaaaataattatcataaaaataaataaaatggctaaagtttgatttaaatgcaaaacaattaataattattgaaggtcaatgattcaatggaatatgcagtaactgtatgaagagacaaatgattctaccaacaaattatatcaatttagactagtttcttaagaaaagtgtttaaaagggctgcgtaaaacggggttattctgtatatagtatatactatctactggggtaacttagcatgtcattgtcaacaattttgtctttgagacagctagataaacatagagagatttggtgagaattttgatgaatgataatctaagttccaacaacttttcctgtgggtctgataggattttgcatcttatataatcttcctagtagattaataatagttgccattaagagacataacttagccttgaatttctgcaggaaatattagcctagtggtaagagattggcctgaagattgtccaaactggaaagtgactttggtgaagtggcattctaatctgtagctatatttttcttttttagttttttttttattgccacttgttctgaggcttgaccagtgtgagggtctcccaatgagaagcatttaatggtttgcattgcaagttagaatgatacacctgagagggggaaaagacaagaggaagagtggaactgggacttgtctcattgtccccttgattagcatctcaaagcaatatgtgattgtaaaggttttgctatatatagcttttttcaatttgatcaaactggatggtaattgagattagaagcccagattcaaaatcattactcctgtaaaaaaattggatttgttaaaaatccaaaccgatccatttctgaagcacttaattttaaaca

SEQ ID NO: 955 - DNA, 2163 bp, Glycine max
  Soy_ogl_527 Gm02:13091338..13093500 Cluster 3
acataaatttatattgaaacatgatatttttatgcatatccaaacacatgataaaaagagtattagaaatatattctctaacataatcaaaacatattctctgtaattagttaaatttattaaaattataaaattagaaaatataatcattaaatatgatgtttaacccccacaaaatatataatcattttcaataaattttaactaataaaaaaattacataaaaattcctaaccttcctcagcacactaaaatgattacttaaacacacccataatttggtccttatatgtcatgagaagataagcatgattattcaccctaggtacctatgccttatccatatttagcctttctttttcttttcctatttactaactacctctgttcttgccctggcactacacaatattgtgtggtagtggaaggctggtcaattaaggggtgtggctttatgaaaaggtgaactctcattcactcaaggctagtttgtccattcaggattgaattattaagacacatgttaaggaattgaaaccagggcaaccaaacaaggtgtgaccatgtcaaactgggcacatagcaattccatgataggtcttaagttggtatggtactgagggatgttagtgtttttcaaaacaatgtgaccccaacaagtgtcaagtgtcaactcacgaggtgttagggctttgacagcagaggctcacaaatgcagtggttcctttgatatgaggtccattgaatggactatattgccttgaattaaaggttttttttttcctgtattggaaattattcctataaattttaatgaactaaatacttattctattccatttttgaaaaagatataatatatatctactattctgcttgatatgctgcattcaataggagaaaagtggcatctagcttatatatactcatgagttaggccggttggcagcataaaatatattagaatttcaagcaccaacatctttattgggataatggaaatcagaatccaataatagaaaataaaaatactgaagaaaaatcaagtgacttcactcatgaccgtatgaaaacaaaaaagtctcattacaattccatgcacgaatcactcttcaattggtacttggtagtatagagttggttcttatagcacctctaaggctctaaccgttgaattgtagcctttctgtctcactattaaactacacaatatagagtgaaaaatatagtaggaattttttttttttaaaaaaaacactaacattgcttctatgagtaataattctttttttatcatataaaacttatgaggatcgctatagttccctaatgcaagcaagtttaaaaaacacttttttttagtacagttccctaaatataaaaatatttatatttatcgcataaatttaaacatgacctgtcagataggtgtttctgatttactatattcgatcaactctagtgattttttttttttttgagtaataaaagttacacatgaatgttacttttttaaaagttgaggtaagtaactgaccttaaaagttgctcttgatttgaaaataggctggacaccactatgacagtgtgattgcttgaggcaagtttcaattatatcatacacttgcaggttacttgattgaacctcactactttgaatgcaggcatggtatctgctttaaacaacatatggcatattctaatttatttttttggaaaggaagctagtgcaatgaaatcttggagacaggtatgtaaaattggtaatcagattccatttctcacagaacactaatatattcatcgataagaatgaagtaagaaaaggaactcagaaagttaattattacttccccaaagggaactagcatgccttcatattaaataacatttgaaaaaaaaaaaaaattacaccactaaaagaagtacatggataaaaatggttgtcacgacggggaacaagaaaaattttaaaagtaaattggaattgtggtcattgattattatgtatgaaaaatgactgagaaagtcttcaaaattaagaaaggttgacaagcaactgtgctttagaattctatgatctatcatttatagtttatatctatatctataatctataatataaacatttcatactttatatacatttaagattttttatta

SEQ ID NO: 956 - DNA, 1789 bp, Glycine max
  Soy_ogl_839 Gm03:4448550..4450338 Cluster 3
cttaagatcgagatcaatccagtctgattaaataatatttaaattttaaactacatcaattgaacaatgaattaagaaaaccaaaaattgtatcagatgatatttctcttcttcataaccaatctaatctactccataaactcctcttaattagacgattattaggaaagtgaaaagaaaaatataaaaaattaaaaaaataaataattcgactttgtaaaagtcataaccacattttttatcatccttctcttctccgttccctcattgttacacctgacacatttctttaacatgttgccttattttttaatcaatatgaacatgatatatcgtctctttattttctgatcatgcaattgcattaatttattttctgttcttataaggattggttccacattattattatgtcatgcacttcatcatggtacgttgcactaatattaatgatcgttctacaaatctttgttgtaccccttaaatttcattgacttctgtcttttttttttcctggtggaaattaattaattaacattggtttttgaagtgcttgttaattttcttaagctcatcaaaatattcatagaaattttataatatttcctacataatctcgtaaaaaaattgttttgcataaattaacttaatttgtattgtgtttttcccgattcaatagcatatgagagtacaaagccgtattaaaaaaaaactaaacagtgttattagtaaagtggaaaatatgtatttaaatattataaaataattaattaagaaaatagttaacgaatgaatagtataattaattgcttaaaatcacctataaaaatgatattattaatattattgtatttaacttatatattataattttagttatttaggcttaggtatacctataaacactattattaatattataggtatagtggtttaataaacactattaatgtgtgacatgggattgaatcaaactataacattttatgaatgttttcatcattttagtctacatcactttgaaaactaaaattctaccattatgcaataaaaaaaactaaaatgacatgattataaaactccctaggactaaaatcaaacaagtcaaattaaaaatcaaataagatgccaaattaatcactatctcagtttaatgccaataccatatcaatcaatgccgccaactatcaaaaggattaaaatctcacacttataatattcaggagactcaattaattagagaataaaattatattataatgatacatgagaaaataagtataattaagtcaaagttttacacataaaaacttaataaaaatcataagtttattataaaaaaaatcattatttcatgtatatgtctcctggtagaaaaagtcttactcaaaattttatctagtgtttattttttttaatgtatcagcgttgaatataagaagtatgtacattttttttatttagtatcaccatatgcaattaggatcttaggttcccaataatattctaatgtatattcataaactttgattatttgaattaattttcaattagaagtgagacttaattatacttaaaatttattatttcttttaaaaaaatgtattttacaaaaatcaaactcaaattctaatccataaacttaacttatattatcaaatgacttatgttattaattctacctgcatattatgctttaaggttgcaaataatacaatcatgcgagaaagaaaaataaataaatttattgacgatcaatagaaattagatagtatcaacaagataaata

SEQ ID NO: 957 - DNA, 2358 bp, Glycine max
  Soy_ogl_1301 Gm04:37995443..37997800 Cluster 3
atatatatatatatatataacaaaactcagctatagataaaatcaattctcatttgtcaggtatacacaaattaaaatatatacatcattgatattggagaaatgatcctcacttgatacaaaaaagaagctggcttatatgaatcacaaccaatttatcagcatatgaatcactgttgagaaagaagtcagcggaagaaaaaagtcagtgaaatattttgcagataaattgatctatctagtttggcataagaaaaatatttgttcatgaaatttgtttgttacacacatgcgagtaggaaatgcaggtagccatgatttgaaggaaagaaggaatgggtttgggctagaggttttcagcataagcaaatacctagatttatcttttaatttctgcaatttctatttgtgtaaggtgctagttttttgtgcatggtactcagagattggtttagtggagtcgttgattggttaacgttgcccatatttgattccctaaaaaacatgggatttcattgtacatgtcttgtttcaaattttagctggctcaatttaggcgttgttgctgccatctctgtaatgccatatgcacaacacatagcaccaggaaccaatttttgcactgagtggctgaataattcggtttggaaagtatatatcttctttgtcattgttttggttagtcagaaaatggaggatgggaaagtttgcacaataactatattcaatcattcatattcttttggttttggttttgtcttattaaaacagaaaactagccatgatttatatagttcctacacactgtccaaagtcaccaccaatagaattaggacttgagaaaccagcaaaagaaaactgcttagctgggacaaaatgctaattttcactaccccacttctactattccatagaattccacagtgtcaaaattgaaacaatcaaattagtctcatagattaactaaacctttcaattgttgtcactagcagtaacattcctagctggattcaagtgttcaaaaaacatgtctttttaagtacatgtcataatcatggctagttacctagctaggagcctgcccgacattgttgccaaattaactagttttctctaacttatgatcagaattgaacttactgtacttaatactttagtcttcttcaaactactagactgtttatgcatgtacttaaaatatctcattttatgcaattatagtaccattggtactactacagtttaataaaatatctacctgaagtgacttggaggatggatacataggcatttagccttttagcatcatcatgatgggtggtgtgcattgggcaatgagcatgttcactgcctgtaatgttgtttctctctatctgaagtttctttggtggccattgaacaatgatgaacaaaacaaggccatgcaatgcatacttttatctagaggctaaaagcatcaatatatttgtacctcttgagatagaggaaagcactccaggttctctctactcaagccgctaccccagatttcaattggttgctatatttaccatagtaagtaagtagtagatacctaaggattatttatttttcttttgtgatattaagacgtgttttctaatttctagtgaagaacttggatggatgtataggatgtggaaccttgaaaattacttttcaacgtcccactcactttgacattgcatcaatgtaagtttctcccttaggggtctttttggtcctttcctcaacacaatgcctaatgctaaagcagcagtttcaaagttcaaacattcaccatgtacaagttattagaacacaaagggtggatatggactggaagaatatcccaagatcattaattttcatttcccttctttttttattcacacatttgtatgattatttaatgcttatgaattgttatttaattcattattataaataaatacataaaccaatgaagtcaatccataaaggaacacatttttacactttcacaatctactttttttagcaaccggcttaaagcacataaaataccagtaatttccctgcctgtaaccaaggtgtttatgtcatacgtgccttcaaatgtgtagataggttctatgtcacagaatgcctgcaaaattagagaacaaaagcaaaacacatctgaggaaacaaataaagcattttagtgtctttacatatttgcctgctaccactcttaaaaaccatttgccaaaaacctaagtgaggcatgaaaatatagttgaagataaaaataagattgatttcgtgtgaatattcttgaatggtcaatacacacttacacacactcagttaaacgatatgtatacagagattgttaat

SEQ ID NO: 958 - DNA, 1527 bp, Glycine max
  Soy_ogl_1617 Gm05:27127001..27128527 Cluster 3
taaaataacaataactaattatgaaaaaagtattaaaaagaaaaaatgataattagattttttttaaaatgagaaaataatgtaattatttccataatagaactatataaaataaaatattagctaaaaaattcattatcatctcaatgaaaatcctctccaaaagtaggaacttccaaataaaactatttatcctaacattaaaattgtattcatgttaacaactttaatgagaaaaggttagtaacatgcatttacatgtgacactgcctatgtatatttctattaggcacgtcaataattatgtgtatgtttaggttacacttttctaaaatggatttttttacttttccattgaaatgtatttgaattttcgcttttaagttttaacataaattcaaacatatcctaacttaatggagatatttttgaaaagttaaaatattatttacataaattctatggtatcccataattttgaggattctgatactactgatttttaaaccaataaagtgtaaaatgaccttgtcatgtcattgttttaatatttaatactaaatttattatatatgtcaatttagtccttgctcaattgaaatatattttaaataaacttactaacatcacgaaatcaggcctcattccttagcaaacatatcgaaacattacaaaatcaaacctcaacgaacataccaaatgtgtgtgtattttaattaaacaaggactagattgaaatatataataaatttagtactaaatattaaaataataacataacaatgcaattgtactcttttggtttaaaaaacaacagtaccaaaactcccaaaaaaattgattagagtatcatataaattctcataaataacagtaccaaaacctccggcacttttggaaatatcataaaaattctcataaataaattaaacaaagccctagtagtgtccaatttaataaagatcaatacatcagaatttagatagtgaaccccatgcagaaaacacctatgcggtgagcactttttgcaacccaacttaatggagtcaatgtcaagactaaatttaagtatttaaaaaataaaaaacaaaattattgatttcaaaagttaaagattaaacacaaaataactcatttttaaggattaaaatcaccatttaaaaggccttcaagcccttagcaaaaaaaaaaacatatatgcatatttactttctttttttttggttacattcctcttatatttaatatagttacatatgtaggatacaaatttaaaattattagttaagtgaaaacaacttggtaccaactgatccatatgtttagtagctcatattcacttttattgtttctccaaatgtatattaagtatttaaaaaatacagaagcaaaaatgactgatttcaaaagttaaagattaaatacaaaataaatcaattttttaaggattaaaatcaccatttgcaaggcctccaggcccttcttagcaaaaaaatttttaccatatatgtatttttttttgataca

SEQ ID NO: 959 - DNA, 1400 bp, Glycine max
  Soy_ogl_2370 Gm07:19636801..19638200 Cluster 3
aatagcacagacccaattctatgtgaaattcaaattagcatcattatacattttatattctcatcataagcatttcaagtttttaagtgctagatcaacatttttttctactgaacaatagcagtatactagttgcacagatggggaaaatcgatcaattaaattttagttaagagtccttatggaataaagcccacgatttccaactataaaaaatcaatcaagcattgagaacatgtgtactactagataatatttagttggttgagtactaggtgatattgaaactaaataattactaactccaacttaatattgtccagagaagctttgaaaatcttgaggatataagaaagggtggagtaactatttaaacattagtcacactacacagtacacaccaaacagaatatcaaacaaattattctatataaaaacattttcctaatcaacttcgaaaatctgattaataaaaggaagaactaaagttaataaccatagaaaagatatcatgtatatcatcactcatattaaaaatactactgaagtataaacatattaaagtttacctatataattcaaggagcaacacaatttgcattcctgcatccatgcgcactagaacaagataaatgccaaaagacgtaccctttcaaatatttatagcagaaggggtctcaggtaacttccaacaattccatgaattgaaatcctcttgcaatgcaatccatattcagcaagaacaagaccaaaaagtaaggtacatacattagacttgctattaattctattagcaagggagtaaattatattaactattagtaagagtgtgtgatggtgactgagagggagtgaaattttaggttttaggtttgttaattttaattttaattaaaaataaaaacaaattacagtgaattgtatccactataatctttatttcagttatagtgggttttatgtcctataacttttctaaatctacaaatataattattttaaatcaagtaggtaccataataaaatacactgtagtaatcgatagttaagtcatctataattacagtggattaacccactctactcacttttattattatactggaccttaaaggaggtaaagctcactataagtttatcgacggtaatacccaatataatgtgtctatattatagacggatttgtagcccactataataaattcattgtaatagtaaaaattcttgtagtgttaatatttaaggatctagtaatctattaatatgttagattttgtcacaatttcaagtacttaactgtgttatacattttttatacttaaattttttgaattatatattaaaataaatagaaatggcataatatttattaaacaaatcatcgtgttaagagtacgctc

SEQ ID NO: 960 - DNA, 1582 bp, Glycine max
  Soy_ogl_3034 Gm09:6764819..6766400 Cluster 3
gactgactacgtaacaatattttattaagacataacaattaagttgaagcaatagatataataatatgtatttctttttcagattttttttctttattaagactaattaagtattatgtttttgttctttaaatataaaagatttataaaacttgttactgttttaagtttttttagtatataattgtagaagaagaaatgaagaattattaagtcccacattgaaaaaactgtccctatcaactggagggatggctctaaatatcctcgtatgatctttaatggtaaaatcagttcttattttgggaatacgcacgacagtcattcttcatctgatcttggtagatatgtcgtatttgaatctttaatcaaaattctcggtaaaaacaattttttttattgatttgaggacattttcatattaatgtggtgatttaaatactttgaatgtactgccgtaaaaagaaaaactttaaatacattaaattaaaataattcaaataaaacacgcataataaattaacttattgataacgaaacgtacacatttatttcttttatatacattaatattattttgatttaaaaggtttgtagctatgtaagggtatgaaactctaaaagaaaaatactttgaatgattaaataaaaataataaaaatatcttaaaaaatatacataataaatgaacaaatgaactctttaataacaaaaatgtaaacattttatttcttttatataaaataatattattttagtttaaaaggtttgtaactaagggtcgaaaactataaaaaaaaatgaagagtggatcctttgacaagtgacatcctttcaaatcctttttgctagctcatgacttttgtaagcatcttattcttgattggtttaatgtgaagagattcttttaatatggtattaaaggtttaattatcttacatttttttctcattctttattatattaatttttaaatttattattttcattttttttctctcccctcttaaatgtgaaaaatattaatatttttcatgtatataagaaaggcagtactcaattttttatgactagtattaatgatttgtgtgggctcaacaaacacatataaacgtttaagggaaaaaatgcgcagaaattttttattctttctttgaatttctataatcatataatcaataacatataaatattcatttaaaactctataacatatttttaataggaattatttattatagaaaacatccttatatcaacatttaattgaagatccaacatgatgataagaacataaaaaccttcattctagctatatggtaaaattataataaccagtaaaagcctacgaacatttgaactcaattcttgtttgtcctagcctaaaataatattacctttcatctttttttttttaaagaaataagtttaagtgtaaaatatactaaaacccgtttcttgtaaaaagaaccagtttgagtaataaataatctttattgagatttagatgttcttattaataaggtgatatatatagtgtgttagaaagagaatcaaacacaatttttgtaaatatactact

SEQ ID NO: 961 - DNA, 2313 bp, Glycine max
  Soy_ogl_4040 Gm12:14935501..14937813 Cluster 3
tattttagtagtgaataacctacgtaaatgtgtaaatttattgtttctactagtgataactaatttatcgcagggtatgagggagtagaaaaagtttcttaggtaattaatttacatcatttacctttagtgaagttaaatcacataaattattgcaatacttcttgtatttcattcacgaaactcatctctcctaactttagaataataaaaataattccttgattaggagaaagaaacaattaaatcatccacaaaacactgtacaaagcgcgggtttaaatctagtcttaataaatgctggaacaaatgtttcgaagccacaaggcacaccttattccttgcgttttggtaacgaaacgggaagtaatatggtacacatatattgatatccaccaaatgttaattcagtagttagtaggtggtaacaaaaataaaaaataaaaagttagtgggtcatccaaatgctgaatatttcagtttgaaataatcacacataattaataagattgagtcaactaattgctattattccaactcgacaagataccttgagtttgaagtatgtataaaactacataaaatgctcataatatagaactgggcaatttttttaataagaaaatcctttataaaaagatttcatgaccaatatttatttttcttacttacacttgtgtatgtaaatctggatgtgggcagtgttttaagaaccgaccaagtaattgactcgatcatagcattaagtcattgtgtcactgattgaatcagtatattagtgattaacccatatgacccgagtttatattaaaaaaatataaaaattttatacaagtcttaaaatgtgttaaaatatagaaatgtattgtgtttatgactaaataatttaaatttgacttaatttcacttttttctcaaaagtttcacaatgttgtgaatttttccccaattttaataattttagagtaaaacaatgaaaagaatgtagacgtagttgtaaccggtctcatcaacacatgatatgactataaatatatataaggaaagggaataagtaaagtaatgtttacaaatataagttgaggtaaaatatattaaaataatattttttcacaaatagtaacagtctgaaaaagtaattaaatctctaaatttcttaatcataatgtgagtgattacaattatatttttttctatagacgttgactgttttttttttcaaattctaaggatatgtttttatatatattggctttcacaaggatataaaaatataattctatacactactattacttttaattttggaaagaaatataaattgataaaatataaaactattttttgtattgtcaaaggggcttaagctaaaaagaaaaaaaagaggataaattacattaaaatcgagcttaaagtagaaactcctaaggcatcaaagatcaacaactgcttcaacgggtttggaggttgctcatatgctcatagataaaactattattaaacaaaatatataattagtttatggaaaaagttaagaagaacatttctttacgcattgagtagcaagttccaatcttatttttgttgatttttcattgagaggtaaatcttcacatttgtctctataattttaaaaggaacaacaatatcccaagaaaaatagaaaattatttataaatattgtaaataacaataatatttgtaaattatttattatttttcctatgactgacattttaatcaaattgagtctcttcattataaataaattattaatatataactgataattaaatataatttaaaatcatcaattacccaggaatctaactcatttaatttatcatagtgcatcaattattataaatttattagtgtgtgtctgtgagtcgtcattcattaggatcgggataaaaaaatatcattgtcatgtttcatcatgttccaattgtcagaatggatttttgttattaaaatatgtaatatagaccgtacgtaatttcataatcattctttttaatggatgatatcctataagtatatctttgggaaaatcatgttatcgtataaagtatttattcattttattgataattaatgtttgacaagacacttagttaatcatttttaataaggtttttctttttttaattttatttttcctttcacactgcgagaccttgcttaatctatttgaaccaaatatcccttaaattaacgatttattagttatcatagatatatattcaaattaaattaaatcaattcttaaatttataataaatttaaaaagtctatttttaattttgttta

SEQ ID NO: 962 - DNA, 1345 bp, Glycine max
  Soy_ogl_4067 Gm12:33477901..33479245 Cluster 3
catttttttaaaactataaataaaaaataaaccaaaattcaaaacttaaaagtaaaagtgattttgacttttaataatttcaaaactaaaaaaaataaccccaaactagacgttaggtgaactttacaacgggaaaacacatatcaattgaaattataaccaccgaaggagaaagcataaaataagaacagaaccacatgaaggggacacgtaagagaatccataacattctggtttgagcatgttgctagcataaaaaagaaggagctacctttcaggttgctacttgctattggcactttctaatttttaagattaaccaacaaggaggggattttcgaagtgaagtttataatattaaatgcagcaaaataaaaaggttctaatattaaaatagaggactgcagatcttaagcgataagacattgaacgggttttcgtttgaaattaaaactgcagaaagaaatatccaaacaagccacatcatacgtgtgtttagtacaaatattcaatcatactaaataacattttccttttgctaacttgattcaaatataattattacctaaaaaatatgtttgtgatttcttataaaaagaaacccacagtcaatatttaatcatacggtgtcttcaaaaatattaaatgtaataatattttttttcaaaataaaagttatttatgatttggtattataatttaaaggacactgaatatatttatgataaaaatacgaaaaatatttgattaaattatttctcattccatcgatatttttattcgacttcgttaataaaggtattaaaatattatcaatgttttctaaatgaaaataattaatttttagtaatttagggatttaccatgactattgaatctaatatatatatatatatattaatcagtattcccatcgttttaaattatgtgacgttttaataccatttttttaataaattaatgtggttagatcatttttaagttaaagaataatcaagaaaaataatatagtgaaattattttacttattaatatatttatttattttttaaatctttataaaaaaataaatgtcgaattatttaaagtgaagagactaacatatactatgattaatttttcgtgtatgaaaagtacctgaaaaatatttgttgcatttactaaatgcttaaatgaagtagtacgattagggacaactttgataaatagcagttatcaatccaatattaaaaacaagacttcccggcctggccacctcattaattagaaaatttgtgaaacaattgagttagtaagaaaataaaaaaaaaaagtcacactaatcagaatgtccttagtacactaa

SEQ ID NO: 963 - DNA, 1937 bp, Glycine max
  Soy_ogl_4204 Gm13:22280764..22282700 Cluster 3
gataaagccaggcatttaaaaaaaggtgtaaataggatatcttattctcaagaagaattttatattatttatacggatgtgaattagagagaatttaaaaatgcaagaaaaatatgttaaataataactaataatggcatattggatttaaagaagaaagggaaagaaaagaaatgaaatacaaactgtgataattttataggttatagggtatgaaaagaaaatgcaagaaaaaatgttaaatgtatatataaaatgacaaagtctttctaataaaaaaaaagtaaaattaatatgtaaagataaggttatttttatcatttaattataacaatcactttcatcatgaattttgtcgatttggaaagattgaatatcggtggatcttatgtaaacatttttctttcctctacatcttaaaaaatcaaattggagaaggaaagaaatgctcagtgctttctgtcaatcccttttcttttccgtgtgtttcatgtctttcaaacagaccctgaaatatgtgtctaaagtaaaaaaaataatgaaatatgtgtctaattttcttcttaatcaaacaatataaaactatttttttctttctcacttatctcttttcaacttctcttgaaataaacatatggtaataatcattagatagattgatccaccattggttgacattcacaagagaaatcaagtaaaccaagtggaggcatgattccaattggataaaattcattagggtcggtttattggtggaaatttagataatttgtatggaaatttaactttaaacttcgtttttattattgtaaaaaaaaatgatacaggtcaattatacgaactttctctctgctaaaataggcaaaaatttcatcctttcggtttgcgcaataagcaacacctttcacatttcagcactaaaatccacaattatttaaacataactttcctattttaatttaattaaacaataagaacctcatacccaattttgttaccttcttctacgggtaacagcatctcttctcttccttgaccttagcaatgttcttttgttacttttccctgtaaaaaagtcagagaatcaaataaaagtgtgaggtagtggatatggtgtagcctgtttttccttcatagcccaaccatatggcccgctaaaaagtggaacctcacatgctacagtcaagaaaatacccaattttcagtttcttggcaagttggtaacatacgcgcaaagtcgtaatcacttgaatttggaatacttttcacactatattttctagttgttattctctctccctcaatgacgtaggtactacttagatagtttttaagacacgtcgtctttatttaagttccactcgggttttctttatttgttacaaagatttatgaagagatgctatcttagtctaagacagaaagcttacaggttttaaaaaattgcttacaaaagatatttatatttatctcacttcaaaaaaatgagtaaaagattgaaatagaatctacatcctataagatgagagatattatcttacttgactcaactattcccttgaagtttttttttatcaatatccccttgaagtttggttccatccactatatttgtatataatttattttataattgtaaaaaaatttaaactagtcactcacgaaataatctaatattttgtctattatattattattataaacaaattatgacaaaatcatttgggttttatcaaattatacataatctcatttttattttatttttctacactaacttttctttaagattgaaaaacattacaataaccccttcttatatgaaaacatacactcctttagcaccccgtcaatcttacactaacaccctaaaaaaagacaaatgacaaatgtaatgattaaaaagacaaacaaacaatacttatgtaattacacaa

SEQ ID NO: 964 - DNA, 2200 bp, Glycine max
  Soy_ogl_4251 Gm13:24652401..24654600 Cluster 3
atttttttttctttcaagttttcatgtttctaattttccagtttctgattcttctgatcttcctctttctggtttgtttcctattattttatctttgatttatttgatttttgttgattgtgaataacatttgagttagaaaattatttgatatgttaagaatcgtcattccctgtacaagggcatgcagtcgttacatttgactaccacaagtacttcctccaatgataaacttccatagaagccaattctcaactttaaaaacattttttttcatgtgaagtattgaggcttcttatttgacatgcaactaatcatttccaattggatcagttcattatgaaataaaatgatgcctcttgttgcgattttaaaacttatgttaattaagcaaattcaatgaaaaatgctaacaaacaaagtactaattcattttaaaaaataaaaatgacctattaatgattatattatctaaaccctttatcattatttcattattaatggcttttttgttttgtcaccaaatgattaattactaagaaatcaagagccctaataacctttatgtatacagcgagcaagccaggcaggcatagcaggttgacatcatgggaatgtggaaaaggaaaatagagtttgataatgatatttataaggaacgtgtttgataaatttctctaaaattatttttaaaagaagaaaatgaaataaattttttcataaattaaaattaattccctatttagttaactggtagttaacttgtaaatatcttcttattttttagagaaattatttgaaagaacttctataaattaattaatggttaattaataataaaaaaatttagcttatgaaaaaattattttatttttttctctaaataatgcatcttattaaaaaacttacccgaacagattcattattcagcgtctttttgttgttggtcctcatgatctgcatgcgacttccttattattaaagctttgattagcttaatagagatttcaattatatatggatggatacatgcaattgcaggcgcatcatttgctgccacaaatcacacttttcaagcctaagatcaagaacaccctggcatattaattatcattaacatattcattaacggcaaagaaacaaatgaccaaaactcattgtcgttaacttaaaatagcatctttcacaatcgctcggtacactggtgtttctcctttgcccaatgtttggctatatatttaacataatttagaggggaaataagtattccgttccattataattgttcggtaaaaataattatttcaaaataattgtgattttaattttttaatataatattaattatttttttacttatatctcttgtaatattaatagtggacaataaaatctataaataaactaatattgatataagattaattttataaaatcattactgtcttttttatatttattattttttcttgatttttttgtaaataacatatgatgactatcattttaggacggaatgagtaatttatttattattatttacgtgaaaaactcaatatattgtcaacattttatttagaaatggagattgtaaattgagagaactttttggagcttagtttttgaagactctagaagtgcctggaacaagaattcacttagccacgatagatgcctaagtgaattagccattggtgaaaagcaggactctggaagtttggctaattaagcgaggacaagaggctataagcgaaatactgttgagagcatcgtatccaaatttgactcaatttttattcccgggattttttttgtaaattagctaagccagcatagattttttgttcatttatacaaagggtctactgtcatttatggcatggattttgtacgtgctttgcatgagctagcacttctctatatattgagagaaaaagcttattgtcttccccttttctccatgtattttgttactactcatgcatgaaaatggatagctaatttcctctgtgtgtgtataatgatactaatatactaaatattaattcaaacataatgtgagtatagttagtttcatataaaagatcatctcaatttctacgtacacacaggacagaaccatctcaatttctatcgagggtggggacaatttccttttttttttaacttgatgttaagcagtttacattttccagggagt

SEQ ID NO: 965 - DNA, 1186 bp, Glycine max
  Soy_ogl_4739 Gm14:13285601..13286786 Cluster 3
gaattaaataatcttttgatctccatagaataaagttttttttagtcttttaatttttttaaaataatttatttctgtcttataaaattaattacacacttgaacaacaatactttgttttaattgaatgagagtacttttagaaactttgctttctcgttaagggatgaatttgctctacattaaatattgagtaaattatcccccactatcttaagagatgcaaatattacattgtaatctgtatttaaaaattggaccagtcgttgatttgattaaggtactatggtgggttatcatatcagttgaaagtatctcagtaattgaataacatgaaacaatataagtaataaaaatataattataagtttactaattatccttaactcattcgatgctttaacattattttcttcctatgcatcaatgttgtttctcttcgtaataagttgcaagtaaagtaaatgtttttgaagtgacaaaatgtctaactaaatttgttttttataatatataaaaggctaaaaatggtgctcaatgaagaaataactcatgaacaaaaatatactataaaaatcaaataatttagtaacataagtttttataaataaatgcacaaatcaaccaatgggatttttgtaaaatatttattctttaacagaaattattatttttatagaaaatataagaaaactatgatgtattttgatttttaagaatttttttgataaaataaggaaagagaaaagtgtaatatttaattcccttttaataataagaaatgtgaaagatattccagtcataaaattatttctaacaatttttttaaatgaaattgtaatatattgcatttatatatcaatggagatgaatatatcttagcagatgtacctgaaaaaatgaggaatatatcttaacagaggagagtagtatatttaaattttttaagacacaaaagtgtatatttaaatatcatagcataaaagtgtatatcttaactgaggtgagtagtattatcatatcatatactcaaatttgttaagacataaagtgtatatttaaatataagagaggagaatagtatgatgccccccatctttcaagaaaggataatgtaattaatttactcttaaatataatattttgatatttaatttatattttctatttgtctcaaatattgtta

SEQ ID NO: 966 - DNA, 1801 bp, Glycine max
  Soy_ogl_5099 Gm15:39874401..39876201 Cluster 3
gatccacacaataaatacacgtgacaaaagtgataatttgttacatacattagccttccctatcaactcacaagcaccaacatcatgtccttagtagttgacacattatctctaacttataaccattcaaatatattgatatttctttatcacgtggaaggaacccttttatcatttaaatatattggcatctccttatcatgtgtaaggtaacaataagagtttaaaaaaatatttaatttagccttaatttttataacttattttatatttttaaaaatattttaataacaataaaaccaaatttgttttcaaattaaagtcgtataccttcaattttacttattaatcatataaaaaattaaaaataaataaaattatacattgaataataatcatttaaagtatttctaatttattagctagcttaatgaattcttctttttagcctacttcttcaagtttcagtaatgtttttgaatatttatttaattttttttataaaatatttgtaatacattttttataatatgatacaagatacacactttcaccctaaattattacctaacatctaaaataatgtttattttttctgtccggacaacatatatccattacgggaaataattttatttgaattagataagattattatagtcaataaatttttttcttgaaatatttaacataattatattattaagaacttataacctagctgacttttgacccacttttattttagctaaagtgtagtgttggaatccagattgtatcagcttcggtttactcgactgacttagtttaaagattagcatctgcctcaagttgacaaccgtcacaacttgttaatataatgtacagttacagaataagaaaattgacctttctacaagttgttaaattgctttacgtagcaaacaaattataaaaaagtgtaaggtggtttaccaaggatctgtatatgttaaaaaatatctataagaatataaactctgatgggataataatgttatgttgcaatgtcaacttcttatcttaattttaaatttgtaaaagtaaaatttaaatattctttgactttttcttccttatttttataactcttcccactttcatcttgtgacagacatatcagtgctattaataatttataatattaagatttaaataatagtgttaaataaggagttactttttatagttagagaaaaagtcaaagaatatttataaggaattacttttttaatccttaaatttttttgttttgattttaatttatttatttttgtattagttcctactctaaaataatagtgttaaataatggtataacaacaatgttttggtgattcattgatttgtcatatcgttaatgaatctaataatatttttttttataaactgtgtttttaaatccttcaactagtactataacatcaactattttgaataaatgaggatgacttctaaactcattctcaactttcttttttgtattattctttaacaatataattatttgcctattgaacattgtataagacagaagatattatgtccgctatatagaagaagggctagttggattctatctcttcactctactgcatgaatcattgttgctggattattatacaagaagggctagttttgtttcaacattctgatttgattatgaaggcataggttggacatatgtgttgtacctgtgatctatcttggctggagggggtcttttattttgttaattagctttactcaaatcataagtactctttgtttattctcttacaaa

SEQ ID NO: 967 - DNA, 1900 bp, Glycine max
  Soy_ogl_5119 Gm15:43422401..43424300 Cluster 3
gaaaagttgcgaaaggaattaaatgaaactgaaatgccaaccgtggcatggatttgaggatttgtttggttgactattaaggtgtggatgattgagttcatacagaataataatagtaattcatcctaaaactgacagggaattattttagtttagcaagagtttttatgtttagagttttagctacgcaaatgcatgtgttaaaatttgaaggaagaattttattattcataatgattttattatatttgaataaaattatctctaagtaaaagatacttgtagtcttttaaaaaaaaatgaagtttaacctcgctaactcgttaatgtggaatggaattctaaaattgatttttctgattgtgaagattctggggctgtaagaatgctcaaccccgtccccctccaatttgtcgtacatgttgaaatttttatgaagaaaacttgaaacgacttagaaatttagaattgccatgattgcatgattacttaatatcaatattcttacgaaccctttttcgaaataataatttcatgagtgcgtagcatgtatgcaacaggtaatgtctggcccaaatttcagttgtagactatacaaaaaatgtgcactcgacagatatatcataaatgataactacataaactaattaatctttcacaaattaaatattgtttattcagacattttatgctttacaaaatttaaagtttttatcacaatttgtgcctaatttacttatacatgtatactttctatatttttaaaaatatttttctgtttgaaattaaacatatggatatgaatactttcataatttatttattttttcaaaacttgaatgatagatgatctcttaggttaaatggaaaaggagtgagtaaggggagaggatcgccagatctgaggctaaatgtcatgtgaaccactgaacctctgtttggtttgagtctgaaatccttttatgaccggcattaatcctgaccataaattagttagattacataaaatatataacttatgcaataattcttttaactatcatcatattatgttttgttatatgatcgaaagattatttatacctattatttgaaatgcgaattttttaatgagtgtcgaattaaaaagtttcctcgatgatattcttattcatgaaacatgatcatacatatgaatatgaaaatcaaataaaagactaatgtttaatagatttaaatctcttatactcagataacatatgatagtaattgtgaatattcttttatgagatactaacatgtaattttttgtacgtatcaaattatttagtttctttagttgtggttggcttcttacaaacacattgatttatcaataatatatataatttatatcagagttatttaatgtaattgagtctattctccctaattgaataggctatttgaaattaaaaattttgaattaattttctcaggttttttttcattttaaatataatatttccaaaatttatatttatatactttttaaattttactgaagtgtgtgtattattttttataattttaaataaatatttttagactttttaaattttactaaatttaaacgtacacgaaaaaaattcctggcttggaagtcaaaattcctttttttctccttccaaaactagactagtacaaaaataaagtaagaaaaaaaaacatttttcatatcatcattctacacaagtcttggaaactggtgtagaatgtaaagtagtgacgattttataattaactaatattgtagcccgtgcattgcagggtcaaatttaatttgtaaatattaactttgaaggtcattaatgttttatagttatgttattaaaattaagaattaaaataattaatagttatctaggttatgttattgaaa

SEQ ID NO: 968 - DNA, 1540 bp, Glycine max
  Soy_ogl_5127 Gm15:45933861..45935400 Cluster 3
cacgtatcatggggacactcgggaaatgtacacggggctcatgcaagctgccaaatctcaacaatccataattctctctcgaatgataaggatgcagcaccacatatcacagcgtttaactatcagattgtcaacaaatttggtgtgtgcattaatttgtttcccatgcatactgcttagtctcttatagtgttatatgcaattttctcctccaaatattcatgatttcactaagatgtatgtgttttttatcttttaccttcgataacttgaatattaatttgtacattttctttcaaatacacccactttcatttaacttttctccttttcatttcccaaatcaatgttttttttttttttggaattcctaaatcaatctgtttgcttctttacaagaatggtataatttacttttgaatttgttgaaatagtatcctttaaaaaaatatttatcggcgttatgcaagtcgactttgattttgtaaaacagcaatttctgccttttttcacctcaaaaatttttgtgatgtttttaagcctgagaaagtgtaaaaacagctggaatttgtttttacaaaatcaaaattaactttcagaaaatcgacttacatcatatgaataagtccctttagaatatactattttttgataattttaaaagtaaaacataccactttaatttgaatgaaacaaaaaagactcgtcatcagggtttaacttagcttattgatttagtagagtgcctaatttattataaatctctgacactttcttcaattataaataatttccattgatcaaaaaatgaaaataaaaaaagtccatcttttttgtggagaaaaaacgcccattctatcacataagatattaacaagaattgaaatataattgcatttctggtacggttttataacttagacagcccactcgcatataactttcgtacaagacgaaacaattggttcatttactttctatttacaattataaaaatgttaaatttgtaatttttaaataattttataagaaactagtaaacataatttaaaaatgaagtatatacctttatagttaaaaagtatttagcataattgatttaaatatgatttttcgttcctataatatagtgttgatttgatttttttgcagaacattatttttagttttcatcccaaaaaatttcaatttgtatgatttttgtttttatcatatgttacaaaaaaataacgtgattaagattgagatcaatcaacagtcaataagacctaaaataaattctaagagaatatttttaatttaaatgtgagttaaatttgaggcttttatgttaatatgtggcattttttttaatacatgaaacctgttttgctttataaaaattaataaaaaatattttttattaataaatctaaagcttaaactttggttgttttactctcttggattggttttgataactaataaacttaatgatatcatcatgtcatacacactaccatattaatgatgttatgataattttactttgtcatcagtt

SEQ ID NO: 969 - DNA, 1985 bp, Glycine max
  Soy_ogl_5733 Gm17:36475816..36477800 Cluster 3
cccctgagaaatatttacacttgaacaaaataaattcactttaaaatagtcgtgctcaatagtaattcgggaattaaatattatgcaagccgagaataatgataacatcataacgtgaatgacattaacttaataagtctccttatattttttttttaagtctaatgtctatgttatgtgatgagagtatatttatcatagataataaattgtgattgaaaaattgtgtaatgccatcagtgtataaactttttttttataatatttttaagtctctttttatatctgaaacatataaatataaatagccaacgcctcccctgttcatttgttcgctttccctttattttctagttatatattgaaacgcacaagaccttattttattgttttcaaattcactcccctctatatatatgatataaattacgctgttggattggacgacatagaattgaataaggtaaccatatcatgtgaatatatcaaataattgattagggtaccaaaaatatcaaatattaattcatgattaaaagaaaataagataagtattcgattatatcctcattaccaaaataagagattccttattttcttgtattaggatattcttatcatatttcatggtctaaagagttttcttaattctctatatattttgaggagtgctagcacactcttttttttatattcttttagcgattggttgaaataagacttatcaacattgataattttttttataaatttcaataaaccacaaagaatttcagaaagagaacattagatagattgttgctagttttaattctcatatatgtttattgtatttatacatttgattccaactaaacttaaacaatgcaaaattttaagcctaagaagattattctcttcggctcccttcaaaaaaaaaaaaaaagacattccaaatgtctttttctctgtatgtattgttaacttgtcttaatttgggcacattacccctttattatgatttgttttggtacaatacccctttatcatcttttttattttgtttaacaacttcagattattatatatattgattgttatttaaacttgctatctttatatattccattccttttatctattttgaattattagttattttacaaaaattatcttctttcaattttttagtttcagaaaatcagatatgtttcaacaacctttttatttaattttgataaatagaacaaaattattgttgatggagaaatagtattttgaataaaaggtaattcctaataataaaacatatcacttgatttagcacaaacatgaaattcatatatcttttcattgattcgatgtgacgttcaaactcatgctttgatggttgaagaagatacctacaacttagaaagacacgagaaatttaattgaccacgaaattcatcttaacttacagtagtttcttttttgtttttttctttcgattcactaaatatattcgcacaattgaactaatgcagaaggaatataaaccctagctagtacctcttactatggcttctacgtcatcatcaaagccaaaggaacaaaaaaatgcacaaataagcgatgaaaaaaccttgagttgctctctcctaggactcttcacttgttcgagcgggttacttcctaaaaaggaaacaaacaagaatggaaagctgttaaggaacgagaaaagtaacacacagcttcagtatgactcagcaagttatgccctaaattttgatgatggggcacaaaaggatgatgccggttttccatgtttcgcagatcgatacgcaaacccaatggggcataagagtgcgacaggagtcaacaaagaaacaaaatagacctaggattgtcatatattagtatagattattaatctagagtatcacttctatttcttaatctttctaggagtagatgaatataatgtctataaaacattattttaaactgactcctgcacctattat

SEQ ID NO: 970 - DNA, 3004 bp, Glycine max
  Soy_ogl_6059 Gm18:18501560..18504563 Cluster 3
tgatttgcctaccaatttttttttgggtaagacaatcccatagcatccctaaagagcagttgactcaattgagtaggttgttggtcaaacattgcatgatctactcctaaatgttaatatttaaacctttctccctaaccattctaagccgttgaaaaactcctcataattcagcaattagtagcaattcttttggagaaaccaaccatccatctaccttgatgattctgaatcaaacttacacaattcgccttgttgtcctactccttaactgccccatcagagttaaggaaaacccaaccatctgttggtggcttccaatgcacttgaatatgttgtttggaccttggcatagtcatagatttagagctagatgcctttgtatactcctttcatctttcctgcaccacacgccatggcctaaaaggcctcacaaatccagtttcatgaatgtgtttgttatgccatctccaaagataatagcaagttataacccaaagtttggaccacattaaaccattaccatgccctatcttgtaagacaaattgtaaagtaagttatgctcaattaatttggtaatttaccaataagtcgttggtttaggtggtattagattcggttcccttaagtaagatcatgagttctaaccttgtggatgacaaaaacgtgattaggagacgaaaacttcactaaaggtgaccgaccaatcatcttcttcaacagagattagtcattggcaaagctgactaatattttgtatcaataacatggtaaaaaaatattaatttagtaattttaattttttcgcatattataaagataaatatgcaattatataaagtaattatttttaattgccacaatttgatgagtcatttattttttaatttttttttaaaattatttgtaattataccattttaatttcccattaattaattatttttaatatcccattttatatcctttgtaaatatatcttatgtaattatttgttgttctactctacaaattgtttgcttgtattgggtatctagaaatttgagaggagttttaacaactacaaatttgtgtgtgtgtggtgaaggttgtgtactcaaggttgagttttgaaaagtcacattgtttggtgtgtttcatttcactattgaaaatttataaaaatgatgcttacttttttacttttattattattttttgtattaggatggagatgttggagaccgacgatggttagtcctggactattgttgtttcaaaaaatacttgtttaggtacgaaatctgttagtgagtaactaacgattttcattatgcgattcttttattttgcttttgctttttatattattcttttaattatttgttgtatattgttgtaagtgattccttcaaaaacaaaaaactgtagtgattatttcgcatatacaaagactcattaacctgctacttgaagatgaccatatctatgattgtaaaattatggtcaatagcagaataagaaatgtagagcaaaatttatgcgaaggatggtacgatttcttcaaggataattgtttgtgcattgaggatattttgaagttttggtggattggactcgtacaactttatgtaaatatcactagtgaatgaatcctatctaaatgatgagttagagtttcctctatagacctcaaccttagtaacttgcaaaggacatcaagaaggcctcattatattttatcgaaggctacaatgaaaatacaatattagaacgatgcaaaaaatctaaactagattcaaggccttaaagaaacttaaccacaagaatttgaaggactttgaaattgaagcattaaaatgatagagcaacatcatgtcttccatatgattcacaatcgataaggtttcatcaaaagactagatttggcaacatcagaataatgcatgaagcaacatcatgtcttccatatgaatcataatgtatgagaattcattagaagactaaagttgatgatagtaaaagatacatgaaacaacatcatgacagtcatatgaatcataatgaatgagaattcatcataagattgaagttgatagcatcagataatgcatagagttgaagttgagacatccttgagagattttgatgtgaaacatcataataatgttatgaagattgttcagaagccttcaccaaggacaaattaagcaagacattaacaacaacctatataagctatcaatgctgaagtaagctacttcagaatgattcttgttgtaaagaataaaccaacatgatgaatccaagctatgtacaagtaaacatcatgaagtcttcatcagaatgaacctacattagaataggttctttcttaacaacatcagaataaatttctgatagacattcagaagctactcctatttaaacataaaaatgaatacttcaaaacaaacatcaaatttgtcaagtcaagtacaactaccattttttgaacttcactttatgaagttggagagccaagggccccatttccaatgactattttcttagggtgttttaagagactcaaaggaagattttaaagataacttgaagcaagcaagaaagagaaaatcatgataatcaccttgttgaggattatacacaagtgttcaatttagttcaagtctctctaattaagagtaaccactttctacataaacacaagtgacatttatatttttaaaaagagagaagtgtgatttgtattccctaagctagtggaaaccctatgtttagagaaattttttattctttgcagtgaaccacataatacctttattgtattgataaagtctctaagccaagactaggtgtggtgttgtggtgagggagcaacagtgttgtgaaccttgagccattatgggtacactgattaagtcatgtcgttgtaacaccaagagctcaggtttagctttgtgaagtggagaacctattgaggttgctattcaaaagccaaggttggcttgttattgtgttgtt

SEQ ID NO: 971 - DNA, 1200 bp, Glycine max
  Soy_ogl_27 Gm18:37800601..37801800 Cluster 3
tttttattcgtttactacatctgtttagccgtcacaaatagttttgattcttatatttttcgattaatgaatttaatctttcaattttagaaaatatatgcatttagtccttcatttaactttgtgacaattataaaccatcactaatattaattaaatttaaacacaagaaggaattaagttcacatatttttaaaagttaaacgactaaattcatcaatttaaaagtatataaactaaaacaaaattttaaagtaaccagaaacatatttttccatggtgaacaaacttcaggtcattttttctcctctgtgactgttaacatcatcaacaactagctttgatcaatccctattatatattctaggactttaagagcagaataggcattgagtaaagttaaagttgatgatttgaaatatcatttcatatattaaagtccaaaatttgataatacgatgcttaaaattagttatcatcaattaattacattagaatggttttttttttatgaaattatttttatagctgaaagtcatgaaactaatcaattagatgaagagatcaagatgatattaatttattaatcatattagaggattaattatttctattttaaaaaatgagtaggatgtaatttatgaattaagaaagttatttttttcatctcatagaatcatgtttcatgaaaattatatttcttgaaaattatgtttcctagaaattcataaatatatttggtatctctaagatattttttcgaataagagaaataaaataaaaacatttttccatcatggaaacattggattttcactccttacatggaattttttagtgaaaaacttataaaaaatatttcccagaaatgttagattcaaggaaatgatttttaaaatatttatatcaatcattaaaaaaataacatttctaatctaagattgatttcagggaaacttttaaagaatttcctatcaagcacccctagcgtaattacctctaaacttatatggttatcagtgtaatgatttatcataagtaatagtcataaaaaaaaatgtacatcttaatcccctctgttaacttaatttgttaaggatccattcttaattccgaatgtttccaaataaagaatttttttttcatattattatattgaatattgttcatcatatccatatgcgtctcaagttattatta

SEQ ID NO: 972 - DNA, 1349 bp, Glycine max
  Soy_ogl_6715 Gm20:30979952..30981300 Cluster 3
gaaatttttattaattttagtaattaaatatttcacttacaaaaaaaagagaaagaggatcagatttcgggttctccaaaaccaatttcttaccctgttaaaaaaacaaaataaaggaaggagggggtgtgaattcggatttaccagtaccgaattcataccatgaacagtaaaaatgactagttagataaataaattttaaaagttgctagttgaagaaatttgatttgttttggctaaatggggaaatttgtcatgccttggaaggctttcttatttgattttttttttctattttgatctcacctctgtatttactaaagcatttctaatttctatttaggataggatgtgtgcataaatattgctaactattactaaatgcatttgttaaattaatgacttaactgtctaattagcataatttcacaaattttatcatttaagtttatttttcttaattttaccatcctaagttttttttcctcattatctattaaattaataacttaattgcacgtcttacgtgttacagaaaaaagtttaataaaaaaaaaatgaaaacattttgttatcaatttttgtgaaacatcattttaatttgttaccaacatatggtgaagtgcacaaaaattaaaaaatgtgatagtaaaattggtgaaaatgaaactttatataatttcattatataatttatagttagtgcgaataaataaatgaatatttatttaataaactttatttttgttttaaatttcacatatatgattgaattcgtttacctaaagggagaaaaggaaagaaaagaaaaagacctgttccccaatgaaaagaatcccttgtttcattcggaaatgtaaattaagactaaaaagtaaaccatttcagtacaccaaattgcatagaaaaaaaaaaaaaaataacgtgtgtgcagaaagaataatggaaacacatgtgtgagcagcacccaaccataacacctgacacactccatcatgtatcaattgggcgattaaatcaaacggaaatgttatatatgtgtgtttcgttcacacgttactataagccacctcttgttaattataaatgcattttgataatttggcaaatagaatatgggattgtaatattttcatctaagaatagcaatacacatttcttgagcaagccttaaaatatctatcatttctgaactcaaatactaaatgagagtgaattagagacatatttagaaggataatctgaaaggcagggttatctattggcaataagtaggacataagggacatcatatgagcaatatgaaaactaaaatggagaaaacaaactaaagcaaatctcatttagaa

SEQ ID NO: 973 - DNA, 1395 bp, Glycine max
  Soy_ogl_2796 Gm08:23661706..23663100 Cluster 3
ttaaagactaaattggctgtattattgatgcattgcttttttttttttacagaaaatgtattgctcatttaatgacgtattgatttatctaaagatttaaatttcttaagtaataatttgaatagttaactttttaatgatttgattttattataatagatggttaaattatgatagaattgtatcaaaatctagtaattctttgaaggtactagccttattaattttcaagaaattgttgaatttttattagttcaggcaatttatataatttttaccaaaataatctagctggttgagtagtgcgcactccttcgattcctacatacaaaaagaaatatataatttgtcgcatattacgtagaaatttatatttgttatctgcggatgaaagtgccggccaattattgacgagttgagctattcttacaagaaattaattgatttatttcttcaaaattcaaattgggacgtaaaatattattgatgcaacttaaggcctacgagaggacatgtgacttacatgcactaatccaattatcaatttatttcaaaagggggtttgaataccgacgaagaagtccaatcccgcacatcaaaatggttcagattccaatcgatatcgacccataccatatggttcttatttcttaaaaggcattgcgaaatagtatatgaaaaagaagatctaagatttgtctgatcataaaagttacacctgtcgcagtttttaaagtaataaaataattcatatttaattaggaaaaagaaaataattcatcctaggcttaaatgcttaattacaatttttaccttcaattttttaatttttaacaaattttacctccaactttttaatttgatgtattttacttctaattattaagaattttacaaattttatcttctgtcatttatccaataataaacacaaaagttaggaataaaattcaccaacaaattaaaaaattggaagtataatttgctaaaaaaattaaagataaaaaatataattgtattagtagtaaaatgatggagggtaaaattggtaagaatcttaaaaactaaaataacatgcaccaaattaaaaaattacgagtaaaatttactaaaaattaaaaataaaaaatacaattaaaccttcatattaatcgacccatgagatcaacatattattaaataaatgtaaaagtgtcgttttcacataatttttaataagactacttaaaatatagtttttacttgtattaatttagaaaaaaatcaatctaattcattttaatatacgtataataacatttaaattgctcgatatattaaaaaacgaactaaactaatattcaatgcaaatgaggacaagattcaaacttactagcagctagaagtgtagaacac

SEQ ID NO: 974 - DNA, 1049 bp, Glycine max
  Soy_ogl_4119 Gm12:37346201..37347249 Cluster 3
gaggattagttgttgaagaattacgtactgtgaatcatattgggactaaggtatacattcaaagaatggatatatatagtatcatccaactacgagtccaatagagtttcaaaaatgtcaattttctcttgtattttgttatgactataaacaaaagtcaaggacaaatcatatcttatgttggatttttttttttcaaaagccaaatttttcccatggtttattttatattattgtttcaaaagtaaagaataaatctgggcttgaaataacgatttgtgataaacattaataaataaatttcttcaataacaaaaaatattgtatataaaaaatattctaaaaaatgtaatataatgtaacttatattctttgtgctctattatatattatttttcatttatttgtctagcttatttaagattttttattacattattttttattcttataaagaaaataaaatttaaatagagaaaatataatatttttttaacaattacagtaacacgggagaattatgtaatatttttcaaacaattaaaggggttagtgtgtgagggagagtaagtgtatattttcaaaaattaagaatatataatgttgcaagagataaaaggatcggaagaaaaaattgtataattttataaaatctcagaaataatttgtatgattcactcattaaattaaatacgtacgtgcataccacgggtgagaaactagtatcacaaacactgaagatactaagatagcacagagtacggataacttaattcatattttgcacgtttcttgtaaatataaaaagtaattggaaatgaaagcatgtcaatatttaatgagtaataatgttttctggacatatgtccctaaacactagagagataaaaataataatatataagaaaataattaatataacaatagatatgatataataaaagagaaagatatagagaggtcctgttttatcctaaaacgcgatattttgcttttaaatttacaaaagtagtatacttgttaaacaaaattacatgcatggagtatgt

SEQ ID NO: 975 - DNA, 2781 bp, Glycine max
  Soy_ogl_4198 Gm13:22053920..22056700 Cluster 3
gagtttagaaggaggaaagaatggtttgagtgggaaaaatcaatggttgaagatttcatgcagttcattaatatcaccaaacacttaaagtcaaacatgattaaatataagattcttttaattaattcatattttttaagaaaatttgttattatagttaataatcaacattaaatttattaataatttgtattattttactaaaattattcttaaaattattgaaactcataatctcttactttcaattattatttttctacctaattaattaatatatgttagtcttttatctaatgagatcagataatgcatttatcttttttagtacataatatttattgtaaagtaattaagtatatttgaataaaaaagtaattaaaaaaacaacttaaagagagttttataaaaatagacaaataaaatagaaaaaagagtcatatatatttaagttggaagggagtacatattaaagataaaaataattgattaatttgtatgtattaagtacgtttacacctcattgttatctatttaaaaaactatggcacaattgttttttgaggcaaaagaaatatatatatatatatataactctttacaatgagtttttggtgattcgcttatttacttaatttagaaactaaaaatagttctaatttcataagataacataacataaaaaattataagattaatttgatggttaaagagaagaaaaaaattatgaatttaaattcctcctattaacctttgccgataaaaaaaaaataagttagttaaaaaattaataactgcacaagtgtttattgtgaagcttaatttcttgatccttgtatatatattgagagcatgtgcacaataataaagaaaaaaaatacaaatactgtaagactccatcttatattcaaataacatgaaggtgaatgttttcagaatagttttgacaatgattaattatgagaagaaatctctataattaaggcgtcaatatgcccaatttggcaagttataaattctaagcccaaggttttcctgaatacgtgttatgacatacatatagtggggtgatttcttaaaaacaaggtaacaacacaatcactaatcagattgcaaatattatggattagttaataaactgaacttctcattcctcttgattaatcgtggcatgttatccctatagaaatgtctttcggggtttaagggaactagaacatgctgaagcaaaaaaaattagaagtaaatcttcaagtttgttgattagtacgcacttacatatgtatgtgtattcggtttgctgctgtgcttgaagtgcagttcccagtcattgtttgtcttcatgacacaacgccactgccattattagcttaaagttgagacaaacaaacactaattaactagtaaagaagacataggagtagatgacaaattaaagactaaagagactgcaatatgagattagtgcttaccatttttactctggttaaattatatatgcatcaatgtcaaatgtggaaacagatatagtatatcatctagagaaaagaaatatgaaatcctcatatattgctcaagttagcagccacattcagacaaattaaatgtcattgcgaaccaatttataacaggtgatctgacatacactaattgtgtatgaatttggaagcaagtggtaattagacaggtgcatgcatatacattatgaaaaagatgcaatttgatagtgatgagatgagaggctacgcgcctgtgtattgtgtacagatacatttgtgtccaaagacattttcctctcactgttcatacttcatacatttaggtgaaaatcatgcaaaggttgatttgtacttctaatttcttgttaaaaagacaaaagagaaaagagggctccattcatctagtggtgaatggggaggaaattataagattggtttattggttgaaaaaaaagttatgaaaaaaagatcttaaattcaaatatcttccactcataaaatattagcaacttcgacattatctgatagaaaaattaaataggcagaacaactatgcgattacactagctaatacttaaggaaaaaaaaaaaaaagaatgatttgtttgaaggcccgagacgtatggacatgaatgtgcgtattggaaatttatgacttgctgcaagttttggttaatttttcatttatggtttaattataatattagtcattcaaaaattcacaattgttaaatttttagatgatttttataaaatatttttgttaatttaataaatagtttttgttactttgtcaataattttcctgtagtatagctttgatttcagatcaatttgattttatttagtaactcgttttacaggaaccgaatgaaaaacttgtgatatttaaaagatcaaatgaagaaaaaaaacgctaactaaagaattattagtagcaaaaaaaatatttcagaaactgatccttaaaaaattaaaatgataaattaaataaaaaataaatttttaaaaagacaaataacttaattatactttaatttatttatcaattttgctaacattaaccttttatttagggattcaccatattatcggtatgatatccgctaacatcaaccttcaattattttgtagttttaaatttttatctaaagtaaaaatgctcatacatgagtgcatgacgtaaactccttaattagcaattgcttttaatttttacagataaaaaaataattttttttattaaaatgtataaaaatatcctcttttgttatttttaaat

SEQ ID NO: 976 - DNA, 2600 bp, Glycine max
  Soy_ogl_4400 Gm13:31941301..31943900 Cluster 3
caagttaaatgattagaaaccttggctgtagggacacatctatacttatatacctttgtatgttttttgggttggtaccccttatagtaccaaatttaatacgttttttttgttttggccgttaaaaaaaaaacaagaaaagtaatatcactcttgagaggcctcgatcgggtcctatgtcatgaaaacccattcatattatactcttataaatacaatcaacgtcactatatagtaaataaacatttattacatactataaccttggtaaaattattaataactcagccttgaaatgtattttgtaaataatcaccccttgctcacaatgttttagccttgtcaaaatatttttttcattatctggatatctcaacttttgatgtacacgaaaacttatcttaaacaacttcaacctaaatttgatcaatatcaattgtactatttcgaacgtatcatgaaattactaggatcgacctaatggaaaaatgtggagtaaatgcatggagacttatattcgatcttcattatcaccatttataccaaaaaaactcaaaggcgtcataagtcacgttcaattattgaatctattatgttttgatggataacaaatataagtgggttaagtctattaatttaatgatgtctaacaaaaatgagataaataaacatttaaatatgaacttattatattaaacttaacatgttgtgttttatataaaaccaatccatatgattcagaatatttatagtacttatcaaattaaatcatatattaattttggccaacctcacaatttttttcaaggctaacctcacacaaaattaagtatatatttatattttttcactttatcctgcttttttttttctttttaaaatttatgatacgattcttataaaagacgcagtggtggatatgatcatgaacgaatgtattaatttccaattctttcccattgtatactgtcgagggtcaactatatcattatttaaaataataagttatttctacaactccataaaggttctatcccgacaagaatgctatatatcaactgataacagaaacttgaattccattgcaagatagaatatattcttcacaagagagagagtggtatttatttaattttacttaagtatttaatattcttatataaagtgagatcattaagtttaatactccattttagtaaacccaaaggctataagattagttgcattgtgagaactatctatttagtgagataagtcgaattcaattctcagtggaaaaaagtttaggtcgatgaaagtcgcataccattaaccatattagtcttttgctaaatgaattgaaagatgtacccgtggttttaactattgacaaaaaaaaattctcaattttagcggtagaatgttgtaaaagcatcacctgaatgttgtaaaggcatcacctaattaatttttcacagtttaatttgattcgattaaaagaaggacacctcttttcttcttaccccgaaatttccaaaccataaatattagcaggtgatcgatcacctccgaattcatcatgaacatttatacatatccatcataaaataaaatatgtaatcagtactgtaagtcttattcgctaacaaacattacgtactcaacaacctatacgtacatgttcttgagtgatcggagttttataaataggaaatgatgaagtcactatatagcttgaaaaaaaaaaactaacaatactaaaattaatatttctccataaaaaaaaattatatagctcactaaacctaactaccgaagttcttatgatgataataacaatgaaggaagaaaaaaattacggctgaagtgacataacatttaaaaggagaaaaatatatattaaataattttgacaaaagaaagatacaatctacttgccaaactaactagtgatatgtacaatgctcttttttttttttttcgtgaatgtatgtacaatgctccttattaatgtcttagtatttttcacaatggattatttcgtaatggttacatgaagtatatatgtggcataagatctaaacaggtactgatttcgcgagcatgaacattggtttcgttgatcaaattgaatgcctccaatatctccatatatgaatgaatacattggatctgattcagatattgcacctttgatgttttcttttcgacgtttttttgtggggttttatcttcacatgttgataaaggccaacttggcaatgccaattcaaccaatagtagtacgttcttctgcttctatgtttggtatcttgcttggcttaatttggaatcaattataacaacaaaagcacatattctatggtaaataagcatgacaaaacaaaagaaaataagtgtgtattcctcgacaagagtacatcatgtccatcaccacaatcaattataagtggtgtctccgagtgtcttatctgtttcgaatatgaaacaacacaaaataaataccactaattacctgcgtgtttttttctatttatcttctcacaaggcgacacatgcccaggagcccagcgggttggcccaggcccccctcccccctcttttttctattacaaatcatt

SEQ ID NO: 977 - DNA, 2780 bp, Glycine max
  Soy_ogl_4760 Gm14:40891036..40893815 Cluster 3
tcatttaaaaaatatatggatattggttcaaaatcatcataaaaaacaataatatgaaaatttattagatgatccattattattgttttcattaattttttattctaaattaataaacttaaatatatgtcacataaaaatgaactgagaccgtaaatatatgatgtcccggattttctagtaatttttttttattaatgcatgtccaattgataaaacattgatgtcagtgacaaagttaaccaattgctaaaaatacgatttctacctagtggacaattttgtttattgtctaaagcataggggccatatatatagtccgtgaggaagtcagttttagattagagatatcttaatcttaattatatgaattttatgaaagaaagaagatgagaaaatcaccataggcacaagagcataataatgtagaggataaactcccggcttattgaaatggacttgtattttcactgagatttgtttggcaattggatgtacatacaaccttacgcattccaactaggatgaaaaactcttttaaattaaaacaaaattaatttcaagttcaattgatcagctgaaagtaacttgcatcttcttttagctaaaatgatctgttactttcttaaattttgtaacttaatgtgagtttctagtgttgcctttttaattgctatctattctagcttagggcttatttgatacagttttatatttcacattattagagacttgtatcatgaagttattacttgatgaagctgatttcccctgactaggcagtctctaacaagatgttttattttcttgtgcatatttgcatggattcctgttattttcttgtgcatatttgcatggattcatgttcaagtttattcactacaattgaatttattacatatttctatgcattcgaaagacgtttgtcaaacaatacgtctttttgtaattaattaattggtaatattatgctctttatcttactagaaactacaaaatttgcaatagataaaataaacgggcaagaaatacaatgatatttacttcttttttaattaataaatgttagtagttagattttattagtagaatgattcaaatttatgatctatctctcctccacatacatttacttaaataggaaaacaaccatgttgttttttaaatccacatatatttctccttttgagaatgattaaatatgttttaagtaattgtaaatatggcaatgtttattacaatattattttttaagtaatcgtggttgctagctagctatagtggactacttgttaacactgaatcatcagagagaagtaagtgaaataccatgtgattaagttcataaatattatactacaatgccaaagttataccttaataatattcattttccattttgtcatctacactagcatagccgggtgataaatgaaagcctgaactcccctgcaaagcacaatatggcacttgtagtggttgatgcattcctctgaggactctccaaagacactgcatatcagaattttgaactaaggtaaagaatttattatttttgtataaaagaggccaaagatgtttgaagttttagcccaatgtttgaagtttattatttttctataaaagagtttaattactttaagtatttcttttatttgatagtaattatctatccatttatacaaacaaggccctgaaaaatgcaaaaagtaccaaagtgctcctaacttgttgaggtgttgtcgtcttattttgttcctgcctaaaatcatccctgtgcgttttttaaatttttaattgtattggcaacacgtggcacgcgttcacgcgttttgcttcccggtggcacgtaatcgaagggtttcgcctactcaccattctgtttgtcatttttgttcctctccactagcgagaggcccgtgccgatgcacgagctgatactccaatttgagtatcgaaaagattgaatacttaatactgagctatatgtaggtaatacagtatgatttgaaggtgttatattgtttggaataaaggaaggatggataacaaaaatatgtgaatcaaatgattttatgattggataatatggacgcaactaagtggtgaaggaggaagccagtggtgagatacgcaagagcatgagtagcaaaggagacatgagaagcttccatgcgtgacgaccagcatagaacaacaacaccaaggaagagtggaggcatttggcgtgaagtataaaaaggaagtgttatgaagagagagaatgagaatgggaaatggtggtgggttattaagagagagaaagagtgcaaacatttggcgtgaaatgtaaaaaggaagagtgttaggaagagagagaatgagaatgggaaacggtaggtgagacttgttggaaacgtaaatgcgcaccgggagaagtaaaacgcgtgccacgtggccacgaaataaaatacaaaattaataaaataaaaataataaatacttgggcgggaatgagaggggcttgggcactacgacaacaaaataagtttataatttagcaaagcaatctataagatgttaagtcaaaattgaaaagaaatagaaaaaatgcttgataccgaaaggtattgaaccctaaacgtaaggcacacaggagattcctagaaaatagggcatagaaaaccaaaaaatacaaaattggttgttatcaaccgaggctgtgaatcatgttgtaggaaaaaataagcaacaacttttgaagcaaaaatggaagaagataattcacttaaatgaaatgg

SEQ ID NO: 978 - DNA, 1797 bp, Glycine max
  Soy_ogl_5120 Gm15:43433801..43435597 Cluster 3
tagtgttctgcgacttatacgggacattaaatttatattttataatttatctttattatttttatttagtgaaattgtttaattacaaaaaattattattattatttttatttagtttacctttttaatcttttaaaagaatgtaattaaaaaatggcatctaattttcattggaattaaaggaaaaaataaagtagatggcataaatatatttagtcatttgcctgcatatatttgatttttagtttattatggttaattctttttttaattaaattagtttcaaaaacaacttgtttgttaaatatttttcgtgaataaaggttataagaaatgaatctttattaaaataaataaatagataattttgggtgattaaatttcaatcaaatatttacggaggaatatatttttgtcaatgataaaatcatgtataatttttatttgtaaagtctaatttttaatatgttaaaaaaatattattaaataattttatataattattttataataattcattaaatatttttcatgaataaatgacacaagaaacgaaattttattaaaataaataaataaatgatttttccttcattaaatttcaaccaaatattcatggactaagggatattttccatcaatgataaaatattatatcatttttatatgtaagacctaaattttagtatagtaaaaaacgttattaaataattttatgtaaatatttataataattattataaaatataataatttattatatcattgttggactaaaatatacaccaaataaaacttatataaaaaactaaattcatataatagttagtgcaaaagtttagttgcagagtattttttattaatttggctgaaacaagtatgttattattaaggtaattatttaaaagatagatattattaataaataaaaaattaaaatgatataaaatatatttattattacatttattattttaaaaaataaatataaaaatatcatgtgacatcatcccatataatatgatagatacaatcactaacacatatatatttatccataattgttttacaatgcatatgtatcctaattatattttacatactatgtgccaacacctactggctccatgttttctgacgtaacaaaaaaatcggcacttattcttttgctatcaaaattttattataaaaacataaaatcaattaatgattactagctagctataatgaagaagaactataattactcgaccagcacacatattccccgtatactaattaattctggcctttttctacatgtaatcatggtttgagctacctccattacttgcaaagaaaataaattgttacgtgacaaatttccattactatctaatattggctatccaaacccattgatatatagaaaattaaagaaccttacaggttaaaaaatcttgttacgataaaaataaactaagttgatgtttgatttgcgtgtggggagttccaaactcagtttggagaaaaatataagtttaatattatatttaattttttcctaaaagtatgtttaatgttaaaatttaatttgaaaactcaatttaaaagaaataattattagaatattcttacaaactcagtttgcaaacttaaatttaactcaaacttaaatttctaaactataatttaaacatgcacaatacgtgactgtcaaaatatctttattcaatatccatgaacaaaattacctctagctcgcagaaaatacttatctctgtgtgtaaaaacacattagggttaatttgtctaata

SEQ ID NO: 979 - DNA, 1600 bp, Glycine max
  Soy_ogl_6403 Gm19:36657801..36659400 Cluster 3
tttaaatattaatttttacatgttttcacataaaaatgaatttagtcataagaattttgaaaatgtagttagattatgtaaaatttagaagtatatatataaaaaaaacaatattacttttttcttccatccttaagtataagacttttttttaggattaattaagtttttactttttaaacttttgtttgtttggtcaaagttttttagcttttttttattaagatttttcattcttaaacttttgtttcactgatgaaagtttcaaaacttttaaaaattttggtattgagtctctaaacaaaagtttaaattcattattttaatttatttaataaaatttcaagaactaaaaattaacttttttaaaaatttaataaaaaaatgtttagaaaccttcaccagtcaaataaaagttaagtttaggaactaagaatctaatttcaaaaaaaaataaaaatttaattaattcttctttttatttatcccttttgtaacatgtatttcaagattatcaataattattaagtgataaagaacatgacatattattatcaagttaacagagaccttttaaaacaaattaaaaaaatttgaaggttaaatctaatgaatagttaaaaactaaaataaaataaaatcacaagagactagaaaaagaaaaaacacatttaatcacttttttttatcattcggtatagattcgttatcaaactagcaacatttccaaattatagttacaactttttttttttttttgataaaattatatggttacaacttacaaactactaattaaataagaaatttataatactttatcgaccaaaaataaatcatatgaatgttaaaactagtgatcacaaaactacttctcaccacggttcggctcatttgatgcatggattggagggtcatttgtctccatatatgtgttttttacaaagtatcagctcgtacatgctgttatatccatgcaaatgtaacaactttaattatgattttcgtaccagttacatatctatatctatctacactttattatatataaagtcagtaaatcaatcaaaatatattatttaaaaagttattataagtaaatttaaatatgacattaaatgcatccaaatataataataaaagcaataaaacataaccttgagccattgaaacatatgtcataaataaaaaagtattataaatgtaatcatcaagcattaaataaataaaaactacgtattcactcacgtataacaaaataaagaaaaaaaattatcaaataaactctgaagtatcgtaaatttgaagcagtaaaacaaattttaaacattcttttatcaaagtcttgtaaatctgatcgagtttaggcacttgcagggaaattgaatgtgtggggtttgaaaaattaagcaagaaaaaaaattgctagttgtgggatcgagtgacaaattggaaagattgcatagtaaagtgtgaatattctgaagggagaaatgttatttacagaagaagaaaaaaaagtgtataacaaattttataattgagagaaaaaaaaaaacaaaaagaatgatgtaataaaaaaaagacaaacacaaaatat

SEQ ID NO: 980 - DNA, 1864 bp, Glycine max
  Soy_ogl_2243 Gm07:6951437..6953300 Cluster 3
gctgccatgaatactttttttcccacgagtctaattgatgaagaagaagaagaaatattctccatcaaaataaaaaattaataatattgaagtgtatggttaatattatgtcacgcttagttactagagttattaattagtatccatgatgagttgatgacagtgaaataaattgtatttatttacctaaccgttcaataaataataacagtaactcacgttcattattgaggaattacagtttatataaagtcccttagttaaatcttaatgttattgttctcattccaactcattattaattttattaaacaagtttcgatacaattagtaaatagttgagtttgttaagcaccttgaaagttgaatagaactacatttgtaacatttttttttccagtgaacatttcaaatttgttcaatgtaggttaaaaagactttgttgaaagaaattttactcaaataattatttttttgatataaattaatttctaatgattaagtatgatatactctttagtgaacacaaaaagtcgtcattagttttgcatttgaaggtaccactaaaccaaagaaattaagtaaaatatgctggctaatattaattaatcgatctatagagagagttaaacaagcttaaacttaacaggtaacaaatttctaaaatgataaactattattatttcatgtttattaaggtaaaattgtgtgaattaattcatgttgatctaaggaaaaaaatatataatcttattgaatgataaatttatgctctttttagaaagcttattacaaaataagattttaattaaattatcatgaaagtaataaatttatataaacatgttagacttttataaaatttagtttgtctatatctacatcagtgtcacattttaagtaataatgattttgatttttatatataaattattatttgtcttacagatttttttcaataatttgagtccattagtccatctagagagaaattagacatatataagagttttaatacgctcttaaataaactagcgactaaatatgattttcaaataaatcatattatagtaaagtcttgttggacttaatttatttttactcttaaatcttacctttcgttactaaaaagtcgcacaaaattaacaatcgttaattataggaagtagcacactggcgattaattgttcagaaacattagtttgaataaatttcctaacaattactaataagttaaaaactaaactacccccttcaattaacactttctcatctaatctcattaagttaaggtgaatatataaattgattttaatttataagaggaatttcattcttttttattttctgttttttctcttgtgatagtcaaaaaatttataatattccctctgaacttatatataaataaaaataattaattttatattaattaaaaaaattatttaatatcatttaaattttgtaatctcaagtaaaaaataaggttatttttaaaatatcttgaaacttgttatcatgaatttaaaaaaaccattgaaaataaaattaaaattagatgaaagatgttttaagaattataacattaaatatgataaaaataattatatttactgttcaaactatcatatatcatatgactttttgacttagatatgaatcgagagaaaataaatgataatgacaattgaacatcctccaaaacaacccagtttttaattatgaagctaatcaagtttcgcaattgttataatttgattaagtatgaaccattacatgagaattatattcatctagagttcaaaccattacagtactactagttagtatattaataacggttcccaatagttaaacacgtgat

SEQ ID NO: 981 - DNA, 2236 bp, Glycine max
  Soy_ogl_917 Gm03:36851565..36853800 Cluster 3
tttagaaccctagtacgtattttatttaaaataataaattttttcattagctttagaaaatctataatcaacgttccctccagctctcccccgagacacactcatcttgacccatccgtaacattgatttatctgctgcgataatcgaataattcttgtggcaaaaagtttcatatctccgaccacaaaaccctagccaagtacgatagaattgcataattttctacttgaaaaatttgtttcccacaccattccataccctctcaccttaatgaactttaacaacgcatagtggccacacatggggatacaaatgatgacagaaaacagaagaaggctatatgttacacttcccaccagaggataagatagcatgtgaaatagggtataaaccatattcgatgttggatcatgtactcaaggagtagtagcaaaatactatttagtacacttttctaacaagatcaaaatttattaaaaataatgtgtgaaattggtcattaagtaaaaaatgagacctaaattttgtgatttcaataatttcaattaataataaaacatgttttaaaaaatgtgtgtttatatatatatattatgttgctaaaaattttctcatgtgctcacaagtacctttgtctttgtctaattaactaggataactacacagctagctagctaataataatgctccaaagtttcttaactccacatcttgaggtctcttcaggtttgctatcaagagtgtggtgcatgttctcaatgtcatcttctctagccacatgatcatgatcatcaactacttaacttctccactttacacaattaggttagttggggacacttgttacttgcgtgttaatttagatcagagaaagaagtgacagggttaatctcattcataaatccactccatgatgtagaaaattaacgcattcagcatcagatatttttatttttgttttagcaaattaagtacaagcttttgtaatatttattttggacgattgaagctaaccgttaatttgatgacacccagtgtcttaatttctctgtgagcatgggacatatatatagattcgcagaatatatgtttgatgttgaagagtctgagaatagctacgtcagttaggtcatataggcatgtgatatgcctacaaatcaaataaattggttaggtctaaagttttattagaaagttacaagcacggggataccctttcgctatcacaaacttaaatttgagtctagagactttgaatgcaaaaatggtcctcttattaattgtcttaggacggatatatactccaatgcaaagacgaatttaaagcataataatggggctgtaatttttttttctcttttggatgcatgatatgtacaaacataatcattgcttgacataaaaaatataagattgatctagatcaaagaaaaataaaataaaatcacaggtttaaattctctcacttataaaaactaataataataataactaatatttatgaataaaaaaaaatcacgacttagcatgactagcaatttgctagcaacgcaagcccttgtctgccaaaagcttaggggtctgatatctctttgtcaatcattttcagaatagctgtagtgacgatgctccaagcttcgccaattcaccatgtgacaatgacttggtaccttatatctaattaatgtccccacccacaaacgatatacttgcagaaaaaacaatcagatactgtactatatgtaatttatatattgttggatttattatcgaacaaatcaactggtgcaatgctatccagtttaacaaaaagtcttgcagttcaaagttttggatatgtaagtagttaagttaaatatttgaagaaaaaaatttgtcattcatattacttgattatatctgatttgaataggatttactatatgattgatgatacatttgatttataccgaaaatatatattcttgttggttttattaaggacaaaacttaaatttagtttattaggtgtaagttgttgatagtattggagttttacttgctaatatatattaacttttattacatacattagcaaggtgaaactctaatcttgatataacattgataagacctagaaaattgcatttaacttttctccttatttttaatcaaaatccacgttttatcttaataattgtcaatttttgttattgaaatgaaaatagttattctaagatgaaatattaattttat

SEQ ID NO: 982 - DNA, 1500 bp, Glycine max
  Soy_ogl_918 Gm03:36858901..36860400 Cluster 3
ttagaacaaaattaaatcatatatatattcaatatttaatcttgtttattggattttctgaatgttgggatccaaagattctcttgtcatatctaattaattagcaaaagtattaatttggggttttcttgtggatatatgtgttaagtttgtgctttcagaaaaaaaaattatggaagtgaagaagaaaaataatataagagctgtttgaatcttcacatcaacatgtatagttttcttagaattttcttgtttaaatttgattgatgtattagttaaataaaattggttaaaatggacattaaaaaggtgttatatactaatgattatattagattagtcttatcgatggtataacatttatatgttttataagaaaaataaactaacaaatagtgataaataattttattaataacaaaagttccctgaatgttaatataaattattattttttgaacagcaaacaaattacttcatccaaggagtacgagaagtactagtggagacatggagctgtagtatcttgcatatacaaacaaaataacactcttacattgaatccactgcatgaaaccagaacttgataaaggaccaaaccactattacccccacgcgattatctttaaacaaaagctgacaagagcattacttaatgaaaccaattttcaaacaaagcatatctcgaacaattttcaaatttcaatcatataattttgctcgggcttgtacctgcacagcatgcaccacccatccacttacactcctttcttcccccctgaaacaaaccctgaacactaattagtacaaaaaggcttcactgaactttgcaacatcctgggctaactatctcctaatttatgcagacaataatgggattaacgcaccaatccaagattatgaaaggagccttaagtgtgattcattgccattatctcacctttattagaggaacagcaccacagaatgtcaaatcaacgtatcctaccaataagttttgatttgaatgttattgaatttcatctcattaaattaaataaggtaaggcatgagatttaaatcttatgaataaaaaaatataattaaaagaaaaaattctgataaaactgatcaattagattatttaataaatattaattatcaataaaacagataaatatttcgtatcaatcaatattttcatgttgatgaatatagtttctcttcttaattaatttcgttttacaatagaccaaaactggagacaatgatcagtagtctgattattaggagaatatgaactaagccaagagtacataaaataccacatccaaatagagaacttgcaatgagaaaataaatgagcgtagatttcaatttgattagaacaaaaaagggtgtgttagtttctaactaatatatggttggttattattaatgatttcaatttccttctataatatatggttttaatgatgtacaaaccttttgatctaaatatcatatcttatggttggctat

SEQ ID NO: 983 - DNA, 1139 bp, Glycine max
  Soy_ogl_1343 Gm04:42189462..42190600 Cluster 3
cgtaagaaataaaagaataattaaaactacttccagtcttgtggctcattttaactactttacatgaatcgaaaatttggttagtttaacagttaataaaattcaatttgtcatcaatccacataacttttcttaatttttcataatattattggattttcatttttgtaatctctttccagtaaattaattaatacttctcaattaaaggatttttttcgaaaaaataaataaatattgtagataatttagaaaggctttataaaaggaaataaaaaaaaatttccctaaagattcatataaaacatactagaagtagtaatttcaaacattgccccataaaaatgaaaattaaattataacacactagagttcttgttcctgggtgtaaaacgaaaagagatacctaccatatctccttaaacatttgaaatctaaaactgcaaatatatcacactactaagtttttttttttatatgtaaccatattgatttacagaatttgaaaaataaaagccacgaaattaagatgcctttttatttccttttgcccattacgctggcaattcgaaacatgaaatataccccatccaacaggaccgaaaattaacattgtttataacaatatctataatttgagtatagtattactattatttttattgatgattattagtgttacatgtcccttattttcttttttagtacaataggcccttcttttctagattatagccatattgtccagtatatattgctgattgtagtgcttctaaaacatgtaatggatgaaaactcagggtccaagttccatatatatctcctcatcatgcctctgaattttcttcaacattatttacttgaaacaaataaaaatctacatatagtgtgcacatattatattttggcactagccatatatgcatgccaaggactcatacatgaagaatttcattattaatctgagacatcatctcaaccaaatccagctccttcttaagttcaacctccaacatctctagtggcatctctgtctcaatatgattttcatcgatattgacaaaaggaacacacattgtaagatcatcacattgcaatttttcttcaaaatctttcttatccataagaggagcacaagg

SEQ ID NO: 984 - DNA, 2127 bp, Glycine max
  Soy_ogl_4190 Gm13:21783874..21786000 Cluster 3
tatatttagctttaatataattatgttagttcctaatgttaaggatctatacctaaatttgacaaagaaggcgagtgtgtgagaagttttcttcagttggaatggtagatatacttgttctttttatttttgatgagtcacttggaccaaagaagagaacaagagtgcccccttccgtgaaggtgcaaaaaatggtcatgcatgactcatgtaatgtgaggactccgtgaacctcatctactttactttgctgctaaatcgtgtggtgtgggttgggtcgtgtccatgtttatcactcgtttctttgatgcttccttatgttaattctgagtccattttttatatttgaattcctctaattcctctcagtatgtatgaccacttttgccgttccaccgacgagtcttttatgcactctaatagcccattcaatcctcagccatagttaagtttcctctcgaacttctagtaaaaaccttaagtaaaataaaagaaaatccttccatcaccaaaaaaaatatagccttacaaggcctaacgtatgacatttcctttttctatgataaaatatgacttctttttccattatgcattagtgattgtaatttttcattttcaaatcctcgtttttttgttaaagttatttttagatttttaagtctcagaataattaaatacaatattcgatctgaatattatatatgaagaaatgctggtgtcactttctttataagttgacctttgggtttgaagctggcttttataaggttaaaaattttcctattaaaaaaaggttaaaattgcctcccattgatatacagcatttaacaatataaacaactacatattgataatattttacctccatttgcataatttatgtttgaggaagatcaaggaattctacgccgttaacttcctaagtagaaattcccttttaaaagtaaggtctataagttataactatattcagcaacgtgaattttgtcaacctaaagacataacaaaaatttaagttgaacacgtctttatttatttcaaatgattttcttggttgtacatttctttttcttctacatgatatatctccacgcatgcttataatgactcaaatgttaatcccccagatcttagtattgggaacttacgttagggattttcaatcctgctgaaaaatgcagatttatttatttatctaattaacaaatacttgcttagtgaaagaaaaatgttccctttttttattttcttaactcattaagattttcgattctaaaatgtcatcatataaataaatagtaagtttttttttttttaatttgatctacctattttttatttttgtgaatatttgatgtactctattcaataatcagtatcgaatcatccgataaaaccattaagaacaatagaacttttcctatcatattttaatgtagttgcaattttaaagttggatctcgaaactataaattaagttaaaaaaaagtcctcttctaatagattttacaccgtgaaaatagcaaaaaatacatattaagatttacatggtaatagattttctattaaaaatgttatatgaaaaagagtagctatttagtaacaatattttaggcacaaatgcgtatgaattcatggaaatgatttttttaattggttgatttttttaattggttgattaataaattaaataacgattttctaagttgtaagtactttgcattaagtacgattgaaagaaatgtaataaaaaaatcatacatgaccactttatgtttttggaataattgacgatttacataatttttactatatccctgttaattaattatacctgaaatatcagcactcaaaagcattgatccatttatatatatttttttaaaaaaacattgatccattaattttgagtgtcatgcattttccattaatcgttaaactacgtatcaggtgtgaattgtcggttgtttcattagtccaagtcactgtgtacgtgttgatttgttgaattaatccaggttccaaattttcaaccttcaaatcaagaagaaaaaaaaccattttcagacaagcaagttagcaatcagcccagcagagcaagaacaggtctagccatatctgcttacc

SEQ ID NO: 985 - DNA, 1465 bp, Glycine max
  Soy_ogl_4332 Gm13:28684301..28685765 Cluster 3
ttaaaattaactgaatactattagtaataaatatcaactctagacaagaggcaggagtagtgtgagtgcaagactcaaatattgagtgctatttgggacacttgttatataagttgttcagtgtctgcttgttaaattttagtataactatttcaatgaaattgattttaatccattaattaaataataaaatttagacgtgtctaaaataatctattagatgtagattttatatcaagatgtattatgagatgatatagcacaggacataattaacacgactactgtcacattcactcattgcagtctcgttgatgctccaaattaaagatgaaaatattggtcaaatgggcatcgcacataaacaaaggttcaacactgcactgtgtgctgcgcatggtggtccggggatagtaatagtgcattgtttttaggcccgaggtatctcaagataggtggttttccttttactcttttttctttttgctaaaatatatacatcatcccctaattgattttttaattctaaattaatgctctaacattttaaagttataaaatgattcccttatttaattaatgacatgttaattcttttaaaaagtttgtcattttttattttaagacatgattttaaaccttttattagataaatcaagatattaaatttgtctcattaaatttgtctacaaaacaactttgaaacaaaaagagtcataaacttagtagaaattacatgaaaaagtaagtttcatcagcaataaaaaaacaaatgatattgtatatattttttcaattattcatgggatctatttttcatgtaatttttatcttatttaggttcctttatggttgttacattagttggttctcataattttcatgttaataaatttaatgagataagtttaatgttttgaatcaataaaaaaagtttaaaaatcaaaattatacccaaaaattacaaacaataggttttttaaaggactaacatgtgagggaatcatttaaaaactttaaaaaattataaaaaaaacaaattaagggatcattaatatattttaaccttatttttgttttaatagagatttatgtttcaaatgtaatgccatcatttgaattactattgaaattatgttagagaaagtaactttgtatacatataatgctaagatatatgaatggtccttatgcagtaaatcttttttcattttctattaaaaaaaactaaatttaaattttgagacttacttcatcttcttgacatagtcttcattttttagaattttaatttaatcattttagaatttgacatattctaagcttatttaaaaagatactttatagtaagatattttcaatggacaaaaatataaattttaaatagattaatgaaaatgattttttaataaattaacaagtatataacttcaaaatagtgtaagcaaaaattacaaaataataa

SEQ ID NO: 986 - DNA, 1600 bp, Glycine max
  Soy_ogl_4763 Gm14:43168001..43169600 Cluster 3
ttctaactggaacgggaagcaggcagtgttctgtgaaaaatgacagccacaagcccacaaccacagcacagtcacggaaagcccatcctgaatgctgatcctccgtttggtcaaagataatagttagatagataatactctttatttataggttaaaatattattgaataaaggtactattaaaaaatcattaacatgtttattgatgatattatgcggtgacaaataaattaagatagagatttttaaaaaactgattgtttgtaaaaaaaaaactgataaataaaataaagggggggaaataagtttattctcttttgttttttctttgtatatcatcctaacaaaatttaaatgtaagtatttaagtatttttgttaagtatcaacctttttttacaaattaaagatattatttactgaagacaacaaaattctaattttaatatttaatataattttatattcaaaactcaaacttataatatttagtaaagttaaaaatattcatccttattacatatgttaaccaaaagtttaaattgaattaaagatatcacactttttgtgggcaatgataaatatataatttgaattctttaatcactgatctcacaatacactctcatttgacatatgtttcatgttaaaagcaagttcgttgagattcttgaagaagaatctgttctacaagtggcattccaccacctcatttctctccaatgtaaaattgaaataagaactgagttcttattttaagaaccccactaatcaagaacttgcagtgaagatgccctctaactaacctttttatatctattcataaatcataatcatataactatgttggacacgtgagatacgttagcggcttcttgaacggaagaaaaacgggccccgaataccacgctcacatctgaaaagaaaagttaaaccgcgttgaaaggcaaagctgttgaatgagtgtaagctggggtagagggacccaccaacattcaaagttcaaaactgactttacttattatcaatcaggtttaaatattttttttaattcttataatttaattttttgttttttttttgtaaaattattttttttataaattatatttattttatttttttcatataacgcattagatatcattttaaatagttaaaaagaccatttaaaatgttataaagacgagaaaaaaacattaaaaacaaaatataattttacaaacaaaaaaataataaattaaaaagactaaaaaaatatttaaatatattcattattcatcaatgtactgagtataaaaggaaatattaccatcaaaactcatatgatatgactctatacttcatcgggtaactggctccatcaaacacgctccatgtgatgtgggattaagctaagttttgctaactataataactatacctcaaagaaattaattaccattctcgatcttttgcttaatatgcatgcatatatgtactggagttgatcgctgcatattggctattagtcttgccactcacgttacctgaagcttcttcattttgcatcaatgtattacactaattcacaaattgattagtcttgaacccagttaatc

SEQ ID NO: 987 - DNA, 1300 bp, Glycine max
  Soy_ogl_5742 Gm17:37305201..37306500 Cluster 3
tgaacttgggagactttgacattgagtatttgtgttcacacttgagattgccctagatgggtcctactctttcctacagcatgatatcaaaattcaactatatacgctacttttgaccttttgtctctctagccatagcccgggtaacaagtaagcgaatgtgctaactcaatttgcactctgcaggtgcaaagtatcatgtcatgtgcatgtagaaaaatgatagatactcaaatgaaaagcctcatttcataacgtaaagtagttttaaatattttcggctatgtgtaaaaacaaatggatgattgatgaaaacaaaatctcaactacccctcctatgttttttatgcccttaatagacttttttttttgtttttttgtgagcatctattagtattatacaagaatttaccctgaattgtcccagaagtatgtctctcactcactgtcagggtgtgtcaatattgggctaattcaccactttggtgttatttttaaattaaaacttaattgtaattgtgatttccttattatagttgtttctcatatttgatttttctctctttcgagatagtcttctccgtacgcacgattaaaaaattaaatttatgtcggcatgcttaagaaatttaattatctacaaattgtgttaaatttcgttggtttcttacatttgatttttctattatatttttattgattttagtgtttctcacttttttaattgtataatttaaatcatttattaaattgacatctatctaatatttaatagtgtcatgttagcatttctttaaatatagcacaattaaaataatggagcaactatcttaaaaaaaaaaatggaggaactaaatttgggaaaaaaattggaaggaccaaatttgtaaaatagcgataataggaggagaaaaattataattaaacctaaaattatttattattttgtttttaaataatttctccctaattttttaaggaatgtttacaaatcagtttcaatcaatttgattataatatcaaattcaatccgatcttttgcaatttgaaagggattagttattcaatttttactcattttattattgtggataacatatattaaataaaacatcaaatgcatgataaacttaataaaaaattattcaaagtattaaatatctcattataagtaataaaaatagtccagattatgaatcaatagttaaaatactgttaggtttttcaaatatataaatagatttttatacattaattcaacaatacatgtcatttctcttcctgataactgataagggtc

SEQ ID NO: 988 - DNA, 1900 bp, Glycine max
  Soy_ogl_5967 Gm18:6620201..6622100 Cluster 3
tgatattggtacacaaggatatagtattttgttaaaaaaattcaataaactctcaaattaatagttacctttactttttttttactccttccaaatttaactatttaacccttttaaaaatgtttagaaattattattttagcttattagaaaaacactaaaatggctcattatactgttaataaaaaggagaaaaaaaatcattataacttcttggccttaaatatgtttttttcttctttaaatttgagggcttatcattttgagttcttccaactaaaacttgtatttgttttagtcctctattttttttaaattatttttaataaattacgtatatctataaatattgtaaaagtttgaaccatttctagctacttataaattcatggtttgccccctcatagtttgtagttagttataaattcaagacttaaatatatatttagtattttaagtttgaataattattttttaattcttcaaaataaaatatttttttattcattcctcaatttttcgaaaaaactgtttttagtccctttgctaataatgtcatcatttgtaatgatttatcatcgttagaaatgtttttctaatttaatttctttaaaaataatttgtcactgtttaaaactgtcaaaatatgttaaaaatgtcactaaacaatacaagtcaaatattttagcaatttaaaattatcaaaaaaaattttataaaatttaatagctaaaaaatcatcataaattatgaaactatgaatataatgaacaaagaggaattaaaattagctttttgaaaatttgaaggagtaataaaaatattttttttcaagactacaaaaatattacctaaatttaaaagattaaaaaaatacttaaccctaaaataaaaaggaaataacataatcacatgtgatttcaagcattgtttaatttatcctcatgtgactttgcatctttgtccattagcccatctaatctgtttaatttgtgataggagaatggaagtgattacccacatgagtatttcagctgcctctctaaaatccaaaatccatattccataggtaaatgatgaacacaatttcatgttttttgagctagataattcgatagaaaattatctaatatccatatatataatgtgttcaaatatatcttttctatacataaaatgtttttttatactttagaaaaaatattttttcctctataaataatgtaaatttggctagtaaaaggcaatcatgttaaaaatgcatgctgaataaaaaattattactttggtaagcaaatcaaagttatttatgaagatttagccgtcgaaggcatagaaaacggaatcaaaggagaatcctatgtggatgttcttctagttgatttgatcatgtgaaacgatgtacaaccgactcgtgtttgtaattagtgagacaaaaaaaaatattatttttgttattagcattttccctttcttcgtgcacactcacacaaagggttagaggaaaggttttcgtatgttgaatcataatcaaaggtcaattctcactaaatccagaattggtcacggagactgcttttatgttttctccctttcttttctttattttccactagttaaggtctatggtttgtgggtgctttggcgacattataggtcattattaagaacaatattgagactaacatttccaaaaaaatatatatatatattgctcttttcacacaccatttttctccttcgattcaagcgtattcaaaacattatcacttcgtatagcatgtaggtatgtttagatgatttttgaaatcgaacatgatcggttgtgcaatttatccgtgagacgtgacctagttaacgattttagattttgccctttaataaattaattaacgtatag

SEQ ID NO: 989 - DNA, 1300 bp, Glycine max
  Soy_ogl_399 Gm02:5345801..5347100 Cluster 3
gaccctcctcaatgagtttgtggttttctacacacttttctctttgatttttgtcttctaccgtgtagcttcaacgtcatctacatcaaattacatttatatatagttgttttgggagaaattttgataagactcgaaaaaagaaatgacaaattctgattgaataaaggccaacgcattccttgggaaaaaaatgtcaaatgctggaattgaacaaaggctaatgaaatgcgttaaagatagctcggatatgtgctaaatatgatgatatcaaataggcttttcattgttactattcaacgataatgaataaagagtgtcttatttgttttaaaagtgagaataaaatatatttttagtttttatacttttagttaaatttgatttttgttcacctaattttaaatcaatgaatttgattcatatatttttaaaaaataagtaaatttagtttttgtgcacgccttataggataattgtttataacgtgcgttgtttggttaataatggatgacacaaatataatactataaaatttattaattttttttaatattaattatcttaatgtaatttacattattattattataagtaaaattaactaattagttgataatgtaaatttgaaatacataaagataaagttattgcaattcatagataatataaatttaaaatatataacaataattattgtaactagtaaataatatgaattcaaaacatatgttatgtttgctccacgggtagcagcaaggagcagattgattgtagtagaagttttttcctatactaagatacttttgttatcttatttatttgatttgctgatttaaaaatatatatattttactcattagttgaataaagagaaaccaatagaaaacaatccttaactcatgaaattggcttcagcacatattcaatgctattttaataattgacaatttttagcaaagattcagatatgcaacaacatcgcttttgcttcgataaaaaaaaaaaaaaacatggatgtatttgtcgagaccaatgtatttgcctaggtataattatcaatatattatcgataaaatgattggataacaataaatatttgagccagtaaaagataaaatatttgaataagcaatagtaactacagtattcttccttcgatacagtaccatatctgttatcgtttctatttaaaatattagagttgtttaccaccaagaatctgagcatgcaaagttttatcgataagcaattgaacacaactttcttgagaaacctaacaattgtgaaacaagatgct

SEQ ID NO: 990 - DNA, 1700 bp, Glycine max
  Soy_ogl_3134 Gm09:36643601..36645300 Cluster 3
aaattgggaggaggagactataaatagaaagtgaaggaagacactagctattgtactttcttacattgtatattctcgtttattctagctgtcctaatttgtgatatggacattgatcaattgaattatactttatttcaattggaaattaatcacggacattgattttgacacccaaccctctaagggccccttactattatagacaaagggcccgcttcaacagtccattgcaaattatctattcagctgttcattgagttaggttctgtcctctggacttgattgaaaggtaggttatacgtatacccatgcaaacaagtgaggtttcagtgtttcaaccttcttttatttcaatttgaggaaatttctttgtatgtctttttcaacaaatttctaccatgtagttgaatagttatgtaataatggtattaaaagactaacgatttattttatcgtagtttctatttttattcctaggaagatatctattgttattctttttgataaatattacaagatattttttttacagtagacaaaatactgttatatattcaagatacaaattcaaaattaatcatcgattatattgaaatatttttatgccaattatttgacgcacactcttggtaatatctatggtgtttttactcattcattattcaaccggtctcttcggttaggtttctttttttttttttttaatatatttttttaaaataattagttgagtcaaatcagtagctttatgactgcactaacacataccgatatgatcttcataaaatggaaatgagatgacaaaaaaaaaatgaagttgataagcaattaaatttgtgctagaaagtagaaagagtgtaaggcccctcccattaactattgcttacccaatatatatggaagaaaaaaatgaaaaagaattcggggtagtaaagaaatattttagttttagtttatttttcctgttttgaaagtgttttttgtttttaaaaaaaaaattgttcgataagagtagtttttaaaaattacttttaaaagtaacacctattttacagtttttaaaataaaaaaaaatcataggatttttaaatttttttgactttctacttttagtttttattcatgttcttcttttttattgtttaatctttcctccctcttcttattttcaaaaaaatagtttttgaaaatagttttataaaataaatttttaaaaagtaaaataaataaataaaaggaacaccctaaatttctactggttgattgagaggaaaaataataaagaatttatttggtggatctcacgtataagaaaatttcctctcatgaaacgaaagaagaatgttgttgcattgaattattttttgttttactttaaaaagatattttaatatcataaaataataatttattttattttaagcactgttaatataaaatattattttatcaactaataaagatatgataaatattatttttaaattaattattataaaaattaataatcttgttatgataatttataattgatgacaatgtaaaacaaatattgttagtacatgaaccatttactctaattaattttatgtcaagaagaaataatatagtaaaaggtttcactttttaaatttaaatatttctttatataattcatttatttattttcacttactcaatcataaaaacttcaaatt

SEQ ID NO: 991 - DNA, 1700 bp, Glycine max
  Soy_ogl_2788 Gm08:22362301..22364000 Cluster 3
ccttaataaaaaaattcataattaataaataattgattatatattcataaaaaatatgatactggagttatcgagctcgatctattacatcaacaattcttaatgttttttacgttattttggcatgccaattgttggcgtatgtttccgaaataattaatctttttatgtattttgaaataattaattgatctatacttttttttttgcaacatttaaatattggttattataatttctttgttttgaacaacttcattcattttaaagtgtaattcctctcggaagtataacttaataattggaattcataaaattatttttcatcaaaataaaattaatcttataatttatatataaaaaagtcaaataagtaaacaacataaagattaaagtaataaagatggtcaaaattcaaataactaaaaaaaatcatacatttactctagaagtaatgacaaaaaaaaaggtaatgaatgtaataaaaacaaacaataggaattatcattccaattaactaagaaaaatatcaaaggataaccaataaaataaaaacttaataattagaatattttttataggattaaaaaaataaaaatatttaatatgataaaaataaaccaaaaaatgatgattgtaatttactctatttttttaatacttcctctctcttttgtatatttttatcttttatttcttaccctgaaagcgtcaatcaactaatataaactatttaaaagaagattttgtcataaaaaatgtcatgtgacaaaaccttcctttacaacaataataatattgtacttgattttaattgatatgataattgataaatggggataaaaaaaatgaataaaacatgtaaagggaataaaagcaaaaaatagaaaaagcgggatatatacgtggtgttaatttgaacccctaaatgagaattctcatggggattgtcctatatgggcccgtagttggggattctttttcatatatattgtaattaacctaattcattaaactaatctaatctaattatcataatttaaaataatcttaactaccttaattaatatatatcggtcataattttcttaattcaaatgtatactcatagtaattatttttactataattatgtatttttatgaatcaaaaaataaaataacatattttagcagtatttttgcaagaaaagaatcaacgtggtgttgtcacttgacatctatctaataagtgacaaaatcctattttacgatatatagtttatagttgttaataaatacttattgttattttcttagttgctataattgtgtatttttatgaattaaaaataaacgtaaaaaaactttttttataatatataaattgatgattcataattcatacgcattgttctatgaattttgatttgagacaacgaaatcgtttttaagtaatttattttatatccagagaacttctaatcaaaagaatttttagttttatctatttaagtctatatacaaacatgctaataaagattcataattaataaataactgagctatgttacttaacatccccttaattctttttacgttattttggcatgcctattgccgggagtacgtttaattttcatcatacgtgtttcgaaataattgattgatctatacagtttcgcaagatttaaatattggttcttatagtttctttatttt

SEQ ID NO: 992 - DNA, 1400 bp, Glycine max
  Soy_ogl_5129 Gm15:46732201..46733600 Cluster 3
tttacttaagatattaaattcaaaccttgttgtcattgtaaataaagtagattttagggagggtttttatttaatcgtaattgatggatgtccgtgcttggatttgtttggttgaatcgtttgagttaggccatttatgatttagctcgaagataatatatgggtcattcatggttaatttgatgcccttttctttttgcacttccttctttttcttcacactcccttttttatctttgattttcttgatatttcaaaaatattcccttttcctgcacaccctctctagttagtcattgctcccatcctttatctctctttttttattatttattttttattttatcgtcctaggctttcctcatgttgtctctgtcattgcctgccctgtcaagctagtaacaggttggttaaaattaatttgttggaatgcattgctttaaaaaattaatatataggcgcattatatacattttggattgaaaagcattaatttcaattattaattgctttctgaaaattaatttcaaaatgtatttaatgcatttcacgtatttaatgcttaacattaaatacattcaatgctcaacagtatatatattacagaaaatttatttcagaagcattaattatccatatattggactccctccatttgagaatatatgacatttaatatttttacacaagtattaagaaataaaattaatttattaaatttcaaagaaaatattaaataacttcttaatttatatattttttatttttctaattaatgattcatttattcgttggccaaacattagtacccagtactccttacgttacatttaacctgtcttttacagtaagattataacgaaaaattttaagaaatatgataaaaaaaattaattataaaaaagtaattatggcgtttcttattttatatattttcctttctactttacaacaaatatatgtataaattaatcaaaaattactcatgtgtttattatttttatataaaactactcatgtgtttattatttttatgatattgttaaagttattataatttaaaatacaaattaatttcaattaagttagacatttaaacaaatattttctcaaaaatagtaaatattttctcaaaaaaaaatattacttattaaaagttagacatttaaacaattacaagattttgttaacctctctttaataagtttttagatggatctttgattagcttcttaaaaaatactagaagttatttaaaaaatatttatcaatagttgcttgtatgataaaacaagctttttagtttataaaaaaatatagaaaataacttaaatgatatgctagacatagtcaatatttaatgaagaactatgaagtatatgatatatttgaaggaaagc

SEQ ID NO: 993 - DNA, 1357 bp, Glycine max
  Soy_ogl_5695 Gm17:15596301..15597657 Cluster 3
aacataagttgaaatctacccaaccaacgtcgtttcatttttaaataatgacagaacatgtgtcaccgtcgttgctcttaaattcaattatctcaattgagtgagtgaataaccaaacaattcgactggtaacagtaatatatgtttcaaaaccttctattctttcgaaatcgtatagtatatattatgttcacctcatttatcacgacaaaacgttatgcacgggaattgttttgtgatgtatatatattgtatggaaacaaactttatttgaccattaattatttctcacacataaagaagcagacaaaattgatcaaacgatgcatgtacatgtggctggaaaaaagattaattattgtagttgtacattaatttaaatataaatagggttatttaaacaacacttttgtaatttttatattttttaaaataaaaatcgaagtagtttgaataaaaatgagttggttaagcttaattcatttcattagaaatatatttgttaattttgaatattaaaaacggaatttgagtctttttgttgttgttacagaacggaatttgagtttactaattagtttaaatactattttttttaagtcgaagcaacattatattatcatgaatttgagttggggacttggggtgtagacaaggggaaaaaatttgggttcactaggtctaaatatgtgtcatcaggtttcaaaatatagtgtattcacaaaaaaaaaaaaagccttcaaatcatagaattaatgccaaaataaaaattaattaaattttgttggtttggttcagtctaaatctgaatatattaaaaacattaaaataacaattaatttgattttctgtaaaagaaaaattaatttgatttaatatttcgatttggtagacctaaactatattactgtaaaaacagatctcaactaaattaatgaacaacctaactttcaatttaggattttttatgcaggacagaaccagaaaaaaaatctaggaagggcaaaaatttaaaactaatgataattaactcttactatcaatgattatctaaaacttagtctaattaaaaaactaaaatatcttatatcctattgttatattttaaatgtaaaataaagtatagtgaaatagaatggtgccagaagggaaataagttactatttcattgtttaaatatttttatgttgaaataaaaaagagtatttctatctcataactctttaattaaaggaaaacatataaatttaaaataaataaatatattttattatattatattttcattccaatttaaacaatgcatttatattttaatatataaatgtttgtcatatttttaacttagttaaataaa

SEQ ID NO: 994 - DNA, 1092 bp, Glycine max
  Soy_ogl_6155 Gm18:53434477..53435568 Cluster 3
catagaattaacatatatcaacggtgtaattaaattaatgcgttagttctcataatttagttaaactattaaaagaattcttataatttaatgtttttaatgaaaagtcttcttttaaaaaatttaaatatatctttacttattaacaatgattcaggtcttcattaacttatccataaaaaaaggtcttcattaacttatattaaattataaaaatatatttaaaaactaaaatgcaaatcagaggtgtcgaatatatgattcattagacccatatactctataggtgtttttaaataatgcccatagtttaataaaagttaacatttaacaatagttaccagagtgaccttttttcttttgaaattatggactagcgactagtgagtgttctgttgcttattctctattttaagaatgattttgcaatcattgataagagaattgtctacagttaaattgttacttgtgtttagggaacatttcctcagttgttgttccgaaaaatgtctagtggttagaaaattgatacatattctatatgttgaggatgtttttctcaataatagggttgccaaaagtaaaaatatgatcttttacataaaaaccaagcaactttaaacaatcaaacaagttttcgatatttaatatattatttaaaaattgaattgtcagtcaatatactttggtgggtgtactgcacctaccccaccatatttccaaatatcttaagatgaatgaatatccgaaagaaataaagggcttgaaaaggacattaataattttattttcttaataaaatttttacttgatgcaaagctatgtcaatcttctagaaaatgcacttcatctttatggactatatatgacttgggtagttatgcctccttcctaatgagaaggtaggcctaagaaatatacatctcatacaaactcatacatgtggtgattattttctcttcatcctgatggataattattaatttgatcagacatgagtataaatatgagtaatatttaatcttttaaaataagaataggaatgtgtatgtatctacctgtcttgtatctgtattcgtcttcacatccgac

SEQ ID NO: 995 - DNA, 1403 bp, Glycine max
  Soy_ogl_486 Gm02:10894301..10895703 Cluster 3
caattcaattttgtcattcaagtgtcaaaatattcaagcacttagtttttaggatttttaagagccttttatttgtcctgcaaaacgagcattttcggtaaataaaactttaaaaaacaatctaatgatttagttaagtttttcttatgttggtaaacaaataaaatttctttaaaaataatactatttcaccttatacatagaatcattttaagcatatcatgagaaatcaaggtaattacaatttacaaataacgttgaatttaaaaattgtaatttatcccaaagaagaaaaatcagggacggttaaaaaaggaatttgattgttaacaaaattttaaaaataaaacattattagagttttttaaatggattgtaaattagttataggaggaaagagatgtgctagtatttggacatgtgacacccaccaaaacatggcatgctttatggtgttgcaatgtgacagctacttgaggcttgctataattgaattgacatgtcaacttttgtgcatgattattatatgtgtgtgtattttcacactacacatacacggcaaatccaagtatacctaattgggaacttcacattgcaaaatttcaagtgtagaccagctactctaagacttgtttggtttaggatgagagagaagagaaataagagaaaaattgtattttttatgtgactcttatgctttttattttctatttcaattttaaaaaatattttatttttatcttttacttttttatcatctaaattaaatacactctaattttaattaaaataaacagtaataatacaaatcacacactttttaacatattttttattatgagttaaaatttattagtaaaaaaagtttaataaatcttacttcttatttaatgagttctatttataattttatatttttcttattttttttaaataatagaaaatatgtgtaaaaaaatatgttactaatcttcttttccaaaatcattaagaaaagttgttaatattcctccatatgtcattatatttgaaatcttaatttatactatatatgcataactacgtacttcaaggttttgattttgttatcaaatcgttttcaatcgtttctatatgaaagatattataagtttgacaaattcttcttcgttggcagtggtaaacttattttgattttcaatcttttccgtttaaaagtatttacatataatttcacattctacgaatatgtgttgacataagtaacaaagaattttctgtataaaaagaaacaaagcattcaaaattaattcacatcttttttatagatgtaagtttaattccttatggagctattaacaaagaagacctatatatggactactacattcagtctcaaatataaaaaaattaattttacctcc

SEQ ID NO: 996 - DNA, 1869 bp, Glycine max
  Soy_ogl_1308 Gm04:38578832..38580700 Cluster 3
gaagtattaaaagaaatactgacagaaaaattaatgtcatatatgtgtctaatgttgataaaatataataaataatacttaaaattgttgttattgtcaaaaaaaatattcaaaattattatttttagattcaattttgagatcatttatactgttaagatatagtacaataaattactattgaatgaaatctaaaaatattatttgaatattaaattttaattaacaatttttacataaaaaagtgaaaaaataaaataaaaattgataaaattctggtacaaaatttgtctatggtcaaaacataaatagacactgtctgtaacgccattccactacttcagacattttttttttatcattgttatcaatcttgttgtgagacagcacttgctttcggatgttttgatatttggttcttttctctttcaatatcttaaaaaattgttacgttttttttttacatatttccataaatttctcaagatacgtatattaaaataaaataggaaataattaaaatttgtaagctttttttgcagaggattcaggttcaatttgaaacttctagtgcttcggaagcaatttctagcagtttttagctgctaaaaaatgataatcagatttagaatgattttgtaagtaatttctcgccgttaaaatgataaaaaaaattgttacaaattaattgatacgtcattatttaatagaaaaacttaacgttaggattaaaaaatgaaacggacaaatagttggaggatgaagactagtcaacatttagttgaaggactaaaataaaaattatgaataattttgggactaaaaatatattttatctttaattataaaaattaaaaattaaaatttttaattatatttaacctgtgaattaacaaacaggaaaattcaagtataacaaatacttgcctataaattaaaaaagaaaggtctaattaatttttttctattaagagttacatactttctagattacacaaacatatctcctaattaatagtttgagagtaatttctttcgaaacgtaagagtcataattatttagaggtctacctattttactgaactttattgatgctttataaggttatattttaccttgaaaagttaactgattatcttattcaatcattagaaaatatttattttatgaaaacttttttcattccccagaatattatttccaagaatgttagatggtaatgacattcttaataattaaagaaaggtagcaccgaattatccccttcaaccttgtaaagaacaagcaacacaaaaagatacgtataacaaaactttaaccaaatttcaagtaaacaaagaacaaaatcggtaaaactgcctttatattaataattaaatttcaaaataaattgcaaaataattgtcttgtgtcttcaaattcatgctttatgttatcagaattgaactgtagaatctaaaatactaactcatatacaagtattgatattgaaagtataatataatttttacataattaatataattatcactccattggaatacatgttctcctcctctcttcatgaaaatcatctcaatacaaaatcaacatacacacagacatgtcactttcttggaaataaaaaatacttagaaatatttttcgattaccttaaaaaaaatgtaacaatatacatttatgagaatcttacaagattttgtgaaacaaacactaccttagtgtttcataaaattatatgttaaaatatctaacaaatgtaaaattacataaatggacatatttatataatatttttaggcttatgttagtgatccctaatacatacttgaatttcatttttgattcttaataaaaaagaatttgtt

SEQ ID NO: 997 - DNA, 1101 bp, Glycine max
  Soy_ogl_1319 Gm04:39336400..39337500 Cluster 3
aaagcattcaaaattaattattcattacactaaaatttgtaagaaaaagatatagagaacatcttaaaaaaaatttaatttttggtaaccatgacataacaattaaggtctttgattttttagaaccctcgaggcattttttaaaatttcagtttaatacgtagttgcactgaaactaatgtttgatttatatacacttgaagtttttttgtcactatctaaagatatatatttacgaaaatcaaactcagcttcttttttataaactcatttattattgatttaaatacattttttttgtttttgtaaaaaaatttgtatcagtccttaccaaatgtgttttgtttaatttttcatttctaaagcattttagataatatatttttttcactattcaaaacattatctaaaaatcttgaagaacaaaaaataaaataaatatattttacaaggactaaaacgaaaaaaaaattataggaatgaaaaaaaaaaacaaaatactaaattacatgaacgaaaaatatatttaagcttttattattttataatcactcatatcattatttaaagtctttttaacttaaaactaataatattgtagtatattgtagcccttaacaaagaaggaaaaaaaggtaaaataacagacaattaaaattaaaatttaagtaaagagtggaattcaccatttttaagtattaatagagatatcgagattttaattgtaaatgccaattaagaccaaaattctttggtggttgatagaagtagatagcttaccaagtacatccatatatgtatgattgatcaatataaaaatcactatggactcttttctatctctctttttaccttgattttgaacatatctcttaaatgttttgattcaacattaaaacagacaattttttctcactaacacttaaaactaaatttgttttcatcaaagatttttatataaacaattttctttggaacaaaagctttgaactgaaaaaaaaaatctttttttagatttttttgcattttcattctgagcttagaaagtttttcatgagctgtactatgtggagtcctttacaatgatcttttgaagacata

SEQ ID NO: 998 - DNA, 1600 bp, Glycine max
  Soy_ogl_3080 Gm09:29446293..29447892 Cluster 3
ttaaaaagaaataattgaatattttacgttgaatatttaaaatatgtttttacttaatgaattacaatgttgttggggaggtaccataataccataatctctaacccatgaagaaacaaatataaacgggtaataattatatgaaaaattataataacaacatttatcacacaattatttatttttcaataaataataaaattatatattttaacatataaatcaatcaaattaaaaatattttttgaagatgtattcctttgtcatttttttcttttcttgattattttttattctttaactttgtttgaattaaaaataaaaatagtagatacttataattctcataattatatataagagagtgattgtaaaattatgttcaatcaaaaagtattataaagattaattttttattttgaatgttataattttattaagattattttgtatgtagataattgtgcatttgtgcataaatgattatatgtgtaattaatttttttttattacttgcatatgttaatgaacaattgatttattaataacaataataataagtaaaatacatatgcagttgaaaaagtataatacatgtataattattataaataattgttaatcattattattacgtataactgttcttttttaaaaatattttgcatatgttaaatttttttattttttatatcttaatttattacattatttcttcctttattgttgttgaatcgattatattatttttttgatgatacattaaacatattaattagatctaggtttcaattagattaaataaaaaatatgcaaaatttaacttaaatttataaatttcttaaaatgcgggactaaaccacattaaaaaaaatcacaaataaaaattcttaaagagatctacactaaaaattattaaagagattttttaaattgtagatttcgaaagtaacatatgtcgacaaacacgtgatgtatatttttttacaatttttttaataaattttctatcaaataaacaaatataaaagagaaaacgaaatcaaccaagcacatgttatgttttgtaataaagagaaataaatactttttctctttgtttatttagacgaagaggacataaaaaaaattataagccttattttttcttatttcgtttaaaacaaaagtaagagtaaaggaatgtttttatattaaatggattttatatttttcatataattatgaggtgattaaatatcgtttcattcaaatttctcgctcttattttcttctgagggttagagagagatacagaaaattcatcagatctgcatattttttctcttctcgcattactttttattttctatttcttaaagactgtgtggtgtgcttttaaaaaaaaaaaactacgtatgatagttataatatttaattcaatattaaagaactatagcattgtggacttgtggctgggaaatccttttagtttgattattaatagtgcataataagaataagcatgtgtttaaatgcccttgatttgatccaaggtttataattaggctggagatggttggagagggagtgtgtaggagaaaatttggatcccaagaat

SEQ ID NO: 999 - DNA, 1100 bp, Glycine max
  Soy_ogl_5639 Gm17:11991901..11993000 Cluster 3
tttttaaaaaaaatcgaaattcaattttagttcttctaaacattttcgtttgattttagtgattctaattttaaaaaacaccacttttaattctgaagataatatttaataacgttataaaagtgttatctaaatcactttaaaaataaaatgatattttaaaattagaaaaattaaaattgaataaataaattaaaatttcaaatattttagagaaattgaatttccttttttaagtaaaactatttgtgaagtatgcaagtacaaaagtatattttttttataaagtttaaaatatatgatattcttaaattactaaaatttgaaaataaatgtattttcataattgcactttacaaataaaatatctttccactcaaaaaaatatcttaaagattttttttccattttattaatgacatgtatgctctttttcttattccatgggcattaagaagtacacttttctgttgatttttcttacaaaaaatagagtaaaattttttgcctttagattttcaccattgaaaataaaacattttatatgaaataataaaattaaacgtgtataaaaaaaattgtggatccatacatagaatcattgatgataaacaactgcaccacaattctccggttcaaatttatactgcaggtctcgtgtatatatataggggtaaatgagaaaaaaaaaatcaacagtaaaataaaataatttatactcttacattttttttaagttaaattttttatctcaattaacttttattctatttcagtcatggataggaagataggaactgactccctgtattgtaataccaattgataaatgttgaccagccatcaacgcaaacggctacactgttgattaataagcgtgtcagtgtcactatttacttattgcatgcaatgacgatgcatgtgcacatagtcacatagggttaaggtcagctcagagagtgacaattccctgcaatttggagatcacatgcacgatggattccaaccatgtatataacgatctaccctatgtttgcaaattaaatatatgcgtcaaataacattttcacgtctccttagagtcgatttagttgtggaag

SEQ ID NO: 1000 - DNA, 1689 bp, Glycine max
  Soy_ogl_6022 Gm18:11969612..11971300 Cluster 3
tatccgtggagtcgtagtataacactgctctcttgtttttttttatcagcaaaaattaaattatagtattaatatgggtacaagggggtacccaacccatttaccaagatagaatcaaatccttctctatcagtgaaacaaaaacaaccaccgatatcaaaacaagattatgcttatactcctatacacggacccaaaataccctgatacaaagctagttctactcctactgaaaataccttaaaaaaaactaccattaaagctataatataaggaaaataagataaatttgatatttcattcattgatgataatagataaaaatagatacacttatataaccctaagtgatcttaattaatcaatacataacaattatttaaatgtcaacatcatgttattttaacataaataaaataaaaactacaacataattatttaattccacccaatatagtattttaatcactttaattttagaatatatttaggctaatcctaacatatccctacgtgtgaatctctcttgtgatcgatccgctttaagtaaaaggaaattaagtaaacatgatcaagaatccaacatgcattttcactctgtgaatagacttcttttttttttttttctttcaaatcttacatctttggagttaggcgagcataatttatatggtaaagtacgtaaattatattaactaaaaaatcaagcgagtaagtttcataatttcattaatttttcaatttataaatctacaatttttctctctctataaaatgaattaactgttcactttagaaaaactagattggagaaaagcttgatgattcatgtaaaaaccttatgtacatttaattaaggaatacaaccagaaccagcaaggaaattcgaaaacttttgatttgagaaaatatttttttaattatcttatgtttaccttatctcttatagtcaaaatttatataagaaacggtgaaatagaaaaataataaaaacaatgaattttatttttattgtttcttatacaaaattttaaaatcatgaaacaatgtgaaaaataaagagacatttttgtaattaatattaaaattaaaaatagaaaagattttcttaaattaaactatatttaagcaaaaaatttatcttatcgtcaaatgtcaattgttaattattatttttttaaaggagaaatcgaacccacaagtctatgacctcttcctccctctcttattcttttagcaccaagtgaactttatagtgggggaaatcattaaatatatttaagcaaaagttacatattgaaaaaatttcaataaaatccacttgctaaaatcagacagcaacattcatctcgagactgattttacatttattagaacaactcaatacaaaattaccaagttagcaagaatagccataagccaacatctgataatcaggttgagctttgaaagccttacacaacttgtaataagtaaatgctaaaatgatttgcaacacccaaaccagactcaataactataataaacaaattcttggcaggaaattattttcacatgcactataaaataaaataaaaacacatgtcccgtgtctctcttaaatggacccttttctttggaggagttttcgggttgagtaaaaagattagaatagctgacatatctcaatgtgtagtgtaaacaaaatcc

SEQ ID NO: 1001 - DNA, 1809 bp, Glycine max
  Soy_ogl_6387 Gm19:33516592..33518400 Cluster 3
tttagaattttcactttagtctaaaaaatttaaaatcttgttgtccattaaatccaagttttcatattttttgttcaccaaaacaaatgataattttttataaaaaaaaaagcattatctttttttagttctctaatttttatttcactaaattcaaattaaacaaatatttttaataacaaactaacctaaaacatatttggtggtaatagagtaaggcaatctatcaaagtaatgctaattgctatttagagcaacatcaattgcctttgagaaatgaaagaattgattttttaagcctttcgtaattaaaatttgataatgatctcaatatttcttctttttaaatcacaattataagtgcatgatcataaaactcaaattttaatcaatatttttttcttaattacaatcataaaatgtatgtcatttattttattatatatttaaaatctatataactttaatatttgtatatttatgtatgtgattgttgttatttttaaataacctcattaaattatctcaattgaccttaacatcttggatccaccactctatacacagtctcttgttgtattagaatataacatttattatgatttaaacatatttttgtctttataggttgcaacaattttgattttgatacttgtacctatagtttaaaagtttgagtttggatccttataattttacaggtataagttttggtctgtatacatgtattttgttttgattttgatcatataattttattttgtttaggttttggtttctctattatatttatattagttcaattaaatagttttactttatagcatagactttgtgaaaagtctttgaagtctgacaagttaagtttaaaaaagaaatacaattattatttttgtatttagtttttattataatattacatatttattaacatatatattagacttactaacttatttagacataagtttataaatatattaaagagcattaattactaaaaatataaactttaatcaactttaaaataaagtcaacctttagaaaacagttaaatcaaaccttaataaaatcttatattagttaaataaattatatttataaaaaaataaaaaaaggtaagttgcgtagaatttcttcataaactaaaatcaacttattcaccttaattattgaagaaattaaataaaaaatgtttctataaaattaaatgcatacattaattttttcgtatggaaaaagttaagttcaactcactttacctgtataagttcaaaaacaagttgtttttcctttttatttttttctcaagaaatacttataaagatatttatctaaatagagtcttgattaattctcatatttaaaaataaaccaagctcaagcaaatagtgtagtgaccaatccatttttacccttacttgctactaacgcaatttatgactattccccctgtcccaaaactatccatcccctattttgtgagtcactgtgcagtccaagaattgcatcacactacatctgctaaaatctaatccatttttgttgtacacctgaaaactccaccatgcatagcaatagtaatatcccagccaaaagagtcattgttctggctcaccatagccattcaccaaccacaccatgccgctatcaattgctaagtttgtccaatcaatgaagcattctccttatcacttatgcaatgcaacttcattgtttgtcaataatgatcattgcttcaatccaatcccattacgattgaatcaatttgtgttatgcacaaaagaagaaaaacaataactagaatat

SEQ ID NO: 1002 - DNA, 1572 bp, Glycine max
  Soy_ogl_2327 Gm07:102488..10508059 Cluster 3
tcaaataactatatcaacattctttttatattgttttgagaattaaagattatttattaacctttaaaacttacaaacattatataagaaattgataagttaaattttgaaaaacatcaataaatgttctatctttcaattatcactttatgtatattgtatttatttttattctttcatctttgttcttattaatgtttggaaggtttcaatgtgttttttttatctcaagtgcaagagtccataaatatgtgctatgtaaacctatgaaagcatattatatatcatgtaaggtctatcataaagttgaagtctttgttatgacacaatattttcctacttctatttctaaactatttgaaagtaaattcaatgttgttggctactattattttaaaagataatttagtgagcgacataatttattctaatttagtatatttttttggacataataagatttatttttgaaaaacatgtttaacatagataccaatttttactatgaatttattaggattcttgggtgacatgtgaaattgatgattgccctttgtaattttaggtcttttaaaaaatgtttaatttatcttctatataaatatattctctaatatatgttcttatatggatttgaaaaacacataattatgaatacatttagtattaatttaatgctagctgactagaaaaaaaattgaagtttaatatttcgcctctcaattattaaatccttgatctatcgtgtttttattcaaattttattcgttcataaatttaaatctaagacttcacttttaaaaaaaaaattaaattcactactaccaaccattttttggtagatgtttgggaatgagttcctatttcaaagaaatttacctttgacaaataatttggtcggagaaaacaatttagaaaatcgatatggacgataaaaattatttaaaattgatggcaaactagaaacaggtaccgttcacttggtcactcgtgtcatagtcattatcactgtattatgtgatttttttttatacttatcatattatacatgtttttgtataaaatgtgaaaatggagcaaccgacgatgcaattcaattaaattatagttttattttttaaaatttaaacaatgctgtgatattttgattgattagaatcccgttcaccaaggaccgaatacaattgctcaactgctcatttaaaatatataaattactcacaattcgagacccacctgtttttgtttattttttaaaaattctcatgagcttcacgaaaataatcttttgactttaagcattgttctatttgaaattaaaaaagttatataatgaaaaagggggaaaaagtagtacatatttgaacacaatttgtctgctctactttttcaaactagtaaagcatcacattcgtgtttttcttttcaaatctttcacttcacacatacaaattcagatgaaattacgcataacaaaaattcagatgaaattcttttacaataaccctgcctttaaagtaagtaaataataaatagttatatactccgtacttaatttaatttaggtttatg

SEQ ID NO: 1003 - DNA, 1867 bp, Glycine max
  Soy_ogl_3119 Gm09:35870934..35872800 Cluster 3
agtaaaaaatatatatttttactcttaaagtattaactttttcttttttcattttatattaaaaatcacaattataaattaaaatttgtaaaagtattttctaactttaaactaaatacagccttcacaaaattagtggtcattgtgaatctaggtataatattttgtgaatagaaggtgcgcctaagtttttgttcaccaacccatataaactgaagagaatctcttacaacgagaactcttggtggttaggtaattcttaagatggctatattgtggtggagagtatatatatgtaattgaaattctacgtcaacctatcgtatgcctcatatcgctatcctcgatttaaatttacacattaattagtctttcagaaactttaatcattaacttagtccctcaaaaattcaaatagtcatcgtattattttttcaagaattttatgctaaattagtcccttaatatcaccacatatttttatttttttatacaaaaaagataaattaaagtgatggttaaaaatatcttcacggggcatagattaaatttttgagactgagcaaaaaaacaacgattttagtgataaaactttgaagaactaataataataacgtgttttttgtacataactaatacaataacgattggaaatatcggcctcaaaaaacgatttgaaatattaaatgagtattgagtaatacaataacgcatgtcattttggagaaccaaatctgagtttttctccatattttttacgttgcttagataaatatatagtttactttattctccaattttgttgattataatgcatatattccttacctgtgcattttgtctcttttccgaatgcgcatgatgattgtcactgtcattatatggttgaagttggaatttcattgtttttttagttgtttcatacttgttcttttaccaaaagtgatttgagttattcggcttggtgcatatgtgaaaaggctatatcttatatctcgtacttactagaatatttatatttatttgatagagaaagtgtggtatttatatttgtaaattgttaatcattcctttagaagtattttagttattttggttttattcatgtatggaaaagttatgttttacttttatagtaatatatattgaatagggaaagtatgattattattctcacaaatcgttttacattcgcgtaaaaatattctttattataacgatgatgaataaaaaattcaaaatataaatatcgaaagtgaaatttaactaatttattttgatttatttattttatgttaattaatttttacaatgtcacatcataattaaataatttatatatattttactcaaatgataatttgttttactcataagcaattgttgcttatataaacaatcaaagcttcattttaaataatctaacatgacacgtagattatctctaatgaaaataactgcatctaaaaataaataattcgttaaacaattaaaagatgtttttaagaagttaaattgatattaaatagaataagtttattaatagagatatttcacgagtcaaaccagttgaaatggctattcgatccaagtttgagacattattctttagacattcattttagacacattgattaaaaagccttgtgataaaaatgtagagtaatgatatgatttttcaatacataaactaattcttaaagtaatataacttgtatggaatatgtttttagtgcataaattttttgaattttttttagcctttgaaattttttttattggttaatgttcctaaatttttgttccgttcttatttgtattctttaattttctctctctctctctctcagttttagtgttttaacag

SEQ ID NO: 1004 - DNA, 1500 bp, Glycine max
  Soy_ogl_4764 Gm14:43193101..43194600 Cluster 3
ttgaacatctatagctcaattaattgatgctttacaattataacaacaaacaactatatatatctaaaaaaatattattatttttatctattaatgagtttgattttgtggcattatcaatatgagagtatttgacttaaaagtgaatttagtccatgtaaatttgtgtttttttaattttaatttgttttaataattttttgtttatttcaaatctttgtaagtttatattttttttaattttgatctttgtaagttattttgttaacttttggtccatataagtttgagtttttttaatttaggtctctaaattgtgaatttacatgaattaaaaatgaaaaaaactgtaactttaaagagtaaaattaaaaacccactaacttacaagactaaaaataaagaatttttttttactgaaatcaaaattaaaaaaaatcaaacttacgtgaatttaaaagaaacaatttttttaccagacctaaatttaaaaaagcaaacttacacaccctcaatattttcggattgtcaatcattacaagttatctttgatataatttttaagtaattattataaaaaaaataaatttttttatcacatattctaacaatttatgattaaatgatactctaaaaaaagtatttatacggttaatgcattcaaactaaatttcatttatatttcataagatatgtttttaagttctcttgagacattttgagacttttatccaacaattagctatgaacatttttgtgaaagttacattagattccgaaaagtaaacgtaacaatgaatcataaaataaacttatgtatgttccttgatcaaaagagttgtatatattttcacaaaaaaaagagttgtatatattattcattcaacacttttctacaataattttttaacattatagttttatttcttttttcctgattaaatcattttatcttattacctcacatttccttatcttctcttcctatttccctctccttgctgtacaaaattgttatacaaatacgtttcattgaatgttctatatcattaatgttattgtgttatttgccacaaaattaggaaaattttcatctgtaaaacattttggcataaaagaccctaccaaattctactggtcactgaagttcccagacgatatagtagtgtatagtgactcttcccaatacttaataattgagaatgtgtagattattatttatcaacagttttcgttttcttaagcttcatgtacatataaaaaacttcaagattttgtcaagtgtaaaattaaataattgacttaaagatataacactgttgaaaggttagtcgtgcgtgtgtgataggtgggagttgtttaccttatgtaacactggtttcttggaatgggggatttagctgtctgattacctaaaataaaatataatttaccaaatttcttgaattattatgctatatatgagatcacactatgcttcattcaactatgaaaggttga

SEQ ID NO: 1005 - DNA, 1400 bp, Glycine max
  Soy_ogl_6395 Gm19:36381101..36382500 Cluster 3
tctattaactagagcaatcttttatcatacatatatttctaattcacattatctaataactacactaatcttataatatcatgtcttttaaattctagtttgcttgtatgtatatgtatcttgaatcatcataaaatataataacaatataaattatattatgataattaatattaaaaaatatatttttgtaaattttatattattatggttatattatccattgttaatcaaataatgcagatagtaaaaaaaattctcgtaactcaaatatttaccgtgtgttttctcttttgtaatgaacgtgtgtgcacttatgattttgttgttactaacatttagaatatagtttaggattttagaacatttttgtgatgcagtaattttaatattctttgtcatagactaaaagtaattataaattcattgtatactcagggttaattacctaatttgtaaaatcaattacttccactgtatactcattttaatatttttttattaaattaatatagacacatatcttaattatatttaatgattaaaaatcaattgcacacaaattaattacagtcaactttaaaataaactagtagttaaaaaaatcaaaagtaaagcgggcaagaaaaaagatgaggtttaattagtacaaatcctttaaacggtggttgaacaaccaagttgtagttgcctattgggtctttaaaatatttagatgcataatgtacaggcaaagatgtatttgtttcaaaccatataaaattgctgtggattgagcactacaacaaccatcaaatgcagtattaatatagtattcttagaagcaatggtaccaaaaaaaaaaaacaaattaaaggtctatctagggaaaaactaacatcccttaatttggcgtccatcaaattactttaagattatttgattcaagacgtactaatagtctaatatgaagtaatgaaaaataattatgtaaaataataacaacatgtaaattgtcacattttaatatcaaagatctgtagaaataatatttgcaagagataattaagttgttataacatatatgcgtctcctctattaaaattgtaggctttttattagtgaaaatttaatatatactcttcgttggtgaacatttataatgcatgtttttataaattttcacagtaaaccaaatcagttttttaattcaagtaaaaataaaaaaattaaattaattgtatctttgatcagttaattaatgctcagaatttttaattaatataaaacaatatatttatgactattggttataataataatatttttaaggttgtaattttgtttctcctcaaattttaaatttgtgtgattttcgtttttcatttttaaatcaagatgatatttagtctttatatttt

SEQ ID NO: 1006 - DNA, 1400 bp, Glycine max
  Soy_ogl_5666 Gm17:13129101..13130500 Cluster 3
atgcccaatgcaactgttctgtcacatgtttttgcttgggatcttgatccacttcctctcattattaaaaactttgacttagagagtacccttcttttccaaggtgaagatagtaatctctgaatgagctcaaagtcaaaaacaactttaagaaattagccaaaaatgtttcaaaattaacttaaaatccaattcaactgtattttaatcaactatacaaattttattttaaaatctgtttttaagaaattaaaaactgctttactcgaaacaagcccaccctaacaataattgtgtcgttttatagcaataaacaaatatatataattttatgaaactaaagtctctgcatcattaattcaattttatacttttttataaatgaaatgtgaactattaaaatgccttgctcttataaaatattacagaagttcactttctagtgtgtatttgggtaaggtcttccaaacataatttaaggtagtgtttgttaaatgagcttattttaataatttccaaaacttaattgacaaaattattaagaaaaacaaggatcaaacaatgagtaagaagaaggcaaagaatcgataagtggaaatttatgagattaaaatataagtaaattgacacttatcaaagacccaacaagagagaaagtaaaggatatgttgtaaagaaagaaaaaaaatggacttgcattgcattatatttcgacaaatggtgatggctgaatagactttacaatactatgatttgaagaattcaaatatattcttaataaaattttgtattatagttatatttttttttttattgatgtgagattgttttaatttaattagtcatctcaaatttaagttttagttatgccgttaagttaaatatttggggacaaaattttattatcattaattatcttactcgactcaactaactgtgatatagacaattcttaaacttgtaaaaggtttgattttatattaaaattgttctagaggactaggtttttagctagactcaatcttacaaccattaaccatataaaggtactcaaacgctagtataatatgtttcagtgagatatgaaaactgtgccatatcattagagaatcgtgactaaacctactttaaattgagacaaatactttctacctcaatctaataaatctcacataaacacatattatgaagataatctaatcatatattaagagataatattttctcaaaaattctatacactccacttattttatcttattatgctttatcgttcatatccagaataaaatatgaatcccaactgttgatccttaatgtagtaacataaatcctaaattcatttttcctttatatatatgtcgttattctactaaaatcttaattacttcaacattgta

SEQ ID NO: 1007 - DNA, 1400 bp, Glycine max
  Soy_ogl_890 Gm03:36004601..36006000 Cluster 3
aaaaactcagtcattcctccctctcttctcatttgatactcttcatcaatatctgtgtatgagaatttttaattaaaatccaagtgtagttggaatttttttttctttttgaagaaagagtatggttggaattaaaacttgtaatttaagtctattgtagtagtatttgttttaaattttttagtttagttgttttttttttttcaattgactcttttaatttcgacttttttttcctctgctggtttcatttttaccatttaacaaaagtgaattacgtgacattgaaactattaattaaatccttatcaataattaaattctccaactgttgttattttgagcatatagtgaattgcgttgagcaacttgtttgataaatgtagttatagaatgtttgattccaaattaatatattttttagttgttaaaatgaaaaataaatatttctaagttggtttggttttgtattttcaatttctattactcatgtaccacaattttacatattcttttctcacttctatttcctgaaaatttaattttttaaatttttttatgaaattctttttataaactaaaaaacaaaacacaattaaacacactctaatttttttaggatttatttcggaggagaaatacagattttttttttatgtaggatccaaaaaataaattcaatctaccccctccctagtaagagtaaaactgggggaaagtgctcctacttttaatttttgttttattttgaagaaataaaataatttcttacaacataaaaaaaattttaaaaaatgttaaggaaaacaaacaattgagaatttttttgagttaaatttatgttttttaattagtatatatttttatataatctatttaattccttaacatatgtgactagccaacatctgccaaatcaatttttcaggaactaattaatgtaaatttctgatgtaaaaagagttttttttttttatatactaatgtcatcgtatacaaacattaaacatgattcgtacttatctgtttcttaaatagtttttttataagtttatttaactaaaaattgtcaagtttatggaaaagggactaaaatactaataagttgaatttatatttagaaatgcacttggatttttattgagattaactttcatacattattagtgttaatatttttataattttatactataatcaattagaaaatattttgatatgagttttaaagtatcaatagtttatcaaacatgacaatctattattagatgatattacaaaaatatttgaattatcatcatattttaattaaattttatttaaattaaatgtgaaaaacttgttaatctctacataagtttaattttccttgtgagttgtgacaataattttgtccattg

SEQ ID NO: 1008 - DNA, 1219 bp, Glycine max
  Soy_ogl_5650 Gm17:12271601..12272819 Cluster 3
atttttttttaataagttttcaaaatatatctaaagagagtgtgaaaaataaaaatctggataaacatgatattttcattctcacacgcctcgtcaacatccaacgtaggtagcaagagaaagcattttcttacacaacctttaaaataatatgcactcggtttcagagactaggaacgagtaattaataggtatggttaaatatatataatcatacttgacttattaagattaaaatataaattaatgtagacgatttttttaagagtcgtgaggtcactaactaattaacttttaattttgacatttgtgcatgggtacgtggttgtatgatccaaatttcttatatatgttttcatacaaaagtgaatttaatagatggttccaattttttaaagataaacttctaaataaatatttataaaagaattagaaaataaaaattaaaattgattttctaatggacttatgcgccctatcttttggaatagtttggtgagagtgtttttgagttaaatatttattattgtaaaatagttttatattattatttaaattaatttaaaataattattttaaaatttaataaatttatcatagttatgattgaatgattagataaaaattgtatattgtcaatacataacattttttctcttttataaaagttgaatatataacttaagtttaacttaagaaaaaaaaacaaaattcattttacatgtatcttcttattctcttctaataaatatagatgaaccaatttatctaaacaagatcatatatacatgaaatactaatatttgtattttagtgttgcttattaaccataaataccttgaccagaatggttttgaacgttgaataggatcatttttcaactttaatctttaaggtgaccaacaccaattaaataaagtacagtgtgtatgttacacaaattcacatatgaaagtcccaaaaggtttgtagcagcaagttacttcattaattgaaaaatataccaaacaacaagtcttgccccaaaaaaagggttggacataaatttccattcaatttattttttattttgtagaagatgaaaatcccaattaccgtaagaataaaaatccaaatttccattatatttgatctcaaatataagaaaaaaatatgacatactaactaagaaaattaattaatcacatttaattacatcaattttaattaaaaaaaattc

SEQ ID NO: 1009 - DNA, 1300 bp, Glycine max
  Soy_ogl_5681 Gm17:13978101..13979400 Cluster 3
ctatattggtaggcattaaaacatacggtatttaattttaaatcaacctttaatagctttcttcacctgtaaaatatattatcagaggtgcagatgtcttgtgcatattttgaagaaaaataaatcctgagtttttaaatttctttgcgtttacgcttctatgttcgttgattttttagtgtgccgttcttgttaataatctgaattatccctttatgcttttgtttatgttttctattctagttttagtggttgagacttaattaatgtgtaaataaattagttatatattcataatttatttaaattcaactcgttaaatgtttgattaaatttatgaaaaaaatgttaaacatatattccacttctgaactgcatatggtaaaatggaagagatagaaagaaaaaaaaaataaaggatgaaagaaagtaataattgatgtgataaatgctatgatgagattaaaaaaatgtgagatagaaaaattgataagcaatgaaacagaaaataactaattttaaataagtttaaatttgaaatcaaatgaattatttaaatgagtcaagtatgaataagaagaataactcatgtatatattattttaacatacgtaattttatttatagagtttaattttcatatattattactatacaattttttacaatgtaaatccaataaaagccatcttaaaatgacttttaaagtacatgttataaaaagtaaaaaaacaatatcatacataaaaaaaattatgatttgatgatgattaatgtaaaaaaaatttaaattgttagtatattttaattaaattcttatttatttggagcattttaattttatgagtaaatagtacatgcatttttttgggacgctaaatagtgcatgtattgttagtggtaatagattttacatggccaactaatcaaaaagatgttatatatcatcactaatatgatctttaaaaaaaattgttgatttttaaaaaaatatcactaatatgatttttattagttgataatgtaaaattttttgtactatcgatgcatatattttaaattttttcaataagaattatattttaaatgaatgcttatccaccatcttaaaaaatgaaaaccaattataagtttcttactgtaaaaaaatatctttcttttatattctcttaagtaatctttattgacaccacttatattcttttctttttcctttttttaatataaaaatgtctacaaaatataaatttatattcttaaaaaataaattcaatataaaaataataaaaatccaattata

SEQ ID NO: 1010 - DNA, 1753 bp, Glycine max
  Soy_ogl_1589 Gm05:4532548..4534300 Cluster 3
aggtagcaagagaaagcattttcttacacctcctttaaaatattatgtactcggtttcaaagactaggagcgagtaataggttaattatatatataaaatcatatttaactgattcagattaaaatataaattatcgtacacgatttttttaatagtcgtgttgttactaactaaataacttttaattttgactgtttgtatgtggctgtgtgatccaaatttcttatatatgtatcttataaaagtgagtagtgaatttagtacacggttccaatttttaataaaaggaaataaaaattgaattaaattaaattttaatcaagttatgcaccctaattttttgagcagcttgatgagagtgtttttataaaagttgaaatatatattaatttttaatcatgaaaaaaaaatcattttagcgttttattttcttctaataaatatgttatgaaccaaatttatccaaacaagatcatatatacatgaaatactaacgtttgtaatatcatgctgcttattaacaataaatcccttgactggaatggttttaaacgttgaagagggtcgattcaattttaatttttgaggagaccaaggcaaattaaatatagtgtagtgggtatgttacgcaaattaattcacaatagctagctatatggaaattaaatcccaaaaggtttgtacgtaacagcaagttacttcattaattgaaaaatataccaaacaacaagtcttgccaatttattatgtagaagatgaaaatccaaattactgtatttgttaaccctttttttactactcaatcaaataacctaagcataccataccctaaaaattctttattttcagtataaaaacatgctaatgatattactctctttctaacaaaattaatgaattttttattcgtaaaaattgaaaacaatatcagaagaagatttataataacttccgcaatatcttcaactaattgagttaaacctatgataatttttttgatgtatttaacttctcatttaatatttaaaagtgaaacttattaacatttatgatttcaataaatttccactaattacaaggaaaatgttaattaaaaaaaagcattagcgataatgtcgctacattcctcaaaaaataatcgtgtgtaaataattatgatcgatacggtagaaaagtaataaaatgcgtagatgtctgtactaacaagattaggggatcataaataacttctgagttcttcaaattatatagttattttcctaagtttatcattttaattttattgattgattaaactttttagtactaaataattatataatgtggacaaaattcatataaaataattaatttggcataacaaacacaattaatatttatacttaaacttatgctttttaaatcttttaaacctataataagtcaaaattttactaaaaagactcaatacaagtcgatttttgtgatttcttgattgaatgttgtctatttttcttgttaaataatacaaatatagttgacttgtatataattaccaaaaaaatatattgttgacttgtatttgttaaacttaccgttacaatcgactagtactaaatcaatttcttgttggagagttaaaacaaagtttgacttttacttgttttagagttgacttgatagatatttttttgccaaacacaaactaccgacaaaaacaaataataggcaattaatgccagttggtcttttttttaaaggtaatgctagttg

SEQ ID NO: 1011 - DNA, 2088 bp, Glycine max
  Soy_ogl_4196 Gm13:22004601..22006688 Cluster 3
aataacaatgaagaaaatctaacaaagaaagaaaaacacaaaagataaaattgattctcatcatgatcaattgaacacctgatcagcaaccaaaaacaatgcaaactcctctttctgacaatcaaagtaccaaaataacaaaggagagaaaaaaatcacacgtacctgttatcccacaccggtcgtatccctgaaatatattcctcttaccaaaaagacagctgaaaattggagaccaacatatattaacctagaaacagtataaattcacaatgttaatttgagttcgattttgagggaaaagtaaagtacattgtggggataagatagggtttaacggaggcggaggaggaaagaggctgctactttttgttatcatttattctttatattattttatctaatgtcacttttttttattgttctatggccaacagttgttgggttgcgcagaaaagaagttgaagaataatatgtgcaaagaaaggaaaggaaatggcactacaataaaagaagaaaaaaaaaatattactcattactttttgttggacgacgatatataaaatatgtagttacataatttcaacatcaaataagtagtactatatataacttaatgataaaaagaaaatactatatataacttacctatttttatcttttttatttgtaacttttttccaaaataaaagagacataagaaattatcttattttcattattaattttttcccctatatataaaaaagataagagatacacactttctattaccagattggtgcattagtacagtgggatgtatattaccttgatgagaataaaaaaaattatgtggtaacaaaaaactatttgaatacaatttaggcagaacagttcatataaataaaaaatcattttatggtaaaaaaaatagaacaaatttatactaatatctcttgaaattttgtcaaataattatacaaaatattctttttttttttttacccttacaatgactcccttaatggaatataccgtgtaatgttttttaaacctttagggtatgcgtaacgtgaaaaggggtgtagtatactgttttttaaataattagaggaggtttgtgtaaagataaagaaaagtgttttacttaatttgacaaaataaggaagtgtatgtataatttattcaaaaaagtatgagtactcatagttttgtacttctttctattttactctctgaagaattattgtttaaaatgtttttgctcctaaatatttccttcttttaatttattcttctattttattataaaaaaactttatattcacttttatagttttttaatcaacaacagataatataaatttaaaacaagttacaacggatacctaaacccatatacatccattatagataccacattactttcatacgcatcatagatattcccctttatgttcatttcatctgaaccgttccttcaaaattttccattctaaacaaaccaaaaactatccactttgcactgttaactaatgtttccatctaagtggactgcacatgacatgggtgagaagaaaaaggttcagaaattttatttgtaaacaaaatcataataatttgattagctgttcgtgagcaaaactacatcactaaagttaatattatacgaacttccatttcaaaagtttttatgtatacaatttattgtttgtgagcaattatatggtaagaatatgtcgtatttcttttatatatttttcccaattatttatattccttttttcatgtttaatatattttcataaagtttttgtactaaacataaaattgtacgaaaaagtttaaaattcctttattgaaacaatcatatctgcaagcagaagaagagacaaatagataggccattttaaaacagagcttttgtaatatttattgttttgtttttgaaaatcagatctgtctttcaagagttataagacaatctttcccgtaggccaaacaaataaagtacacttatttttattcatcatcggtgcaatacatatgggtcatttaatttggacaaattaacaggtaagaccagtgtaaagataaatacttgaa

SEQ ID NO: 1012 - DNA, 1900 bp, Glycine max
  Soy_ogl_1292 Gm04:8097701..8099600 Cluster 3
caatgagaacgatattggctggaaaagacaatgacccaagatactatacatgcatgttaaaaaaatattgtacatattgaataactgagtaaagataatttgtgaaagagttatgtttatattctaatttaatgtttaattttaacattatttcaatgttgtatattgcatgagtagataaaataatgccacattatagtagataaatacatttaatatacatcgtcactctagtgaaattcttactgacttaaagtgttaagatatcttttccgtataaacacgtagtcatttcatgatatctcaactatattaaagaataattaaacttagaagatctcaaaccttagtccatttagagcacatcattgtcaaactgtcaacactcattaagagtttaataatcatatgtctacttcaaacacattacaatagtccttagagagataatctctaactatagctatattttttactttaaattcaacaaatagcattgtttctaacttaatggtatataattacttatttaatatcacaatcgtatgatgagagagataatattacgattgtatgtctcttgtcttaaaaaaaaaaatccacgatcgtaacattaaataagtaactacgtaccatatcaaggttgcttttattagaatatgtgctctgtaactttgatcccattgtttgaattgagctcatcttaattatattgtaatttccttatatattgtttaacttagatgttaagttcaattagttttttattttattttttataagacagttaaatctgataagatatttttcatgggcgactaatagatggtagaaactaaaaagacatgtccaattcaataaaggaggaagaaagtatgataaaaaatttatataaaaaaaactaaaatactgtatggtacttccacttttaattaaaaatgttgctgattattattgcttaattacgagtcacaactaaattgacacaactgtttggaaagaatcaagatgcatcgacggggagacccgaggacccaatctcagtccaagtgggagcttctgaatattaaaagcaaaccaatgtgttatagtaataataaattatttattaattacttacttagatactaaaattatagtggcatgggtggcatcttttacattttttttattgatcaagaatcaaagaattgggcttctcgtggagacacatgttctggacgcttgtagctggggacgaggcaatattagacagtgccattggttgcattatgatatgagtacgacgtataataacccagttgctacggaatacggactacggattattaatctttcttcttttgtcttcaacatcttcttcttcattggaggggttgtaaacttttactcaacaaaattaatcaatgtattagtttaatgaggtgctgaatctcaagcacttgcttcaatagctggaaatcatttgtttaagaacgacaaattctatttgtttcactcagttgacatgtttattaattaatttccggttttaattccacattccggaatttaattatattcgtagctgtgtaaccgcagcagcaaatattttaaacaaaatcagattgatatgagtggttatttatgtaagaattaatttgatttatatcaagatttgcaatactataaaattaatatattacatgtctcctgaaaatatacttctaagaagaatatttcgtcaattttggaaagcatacatttttgtttatgtcaagaatgagatttacacacatgcacagacggtgatatcccaacccatgatctattaatatgagtttgaaaaagttattaaataatatattcaatctgttttataaaacaaattaaattcatgcatgccatacctaaaaatttc

SEQ ID NO: 1013 - DNA, 1712 bp, Glycine max
  Soy_ogl_147 Gm01:43207889..43209600 Cluster 3
ctcagttagacaagtggcacattatatggggagcgactgcatggagtatctggggtaggttatttcgagaggaggaactgctgcaacaaatttcctttacggcgtggagttggtttaaagcatacatgcatgcatgaccaattttcatttctcttaggctcagtggacaatgaatactaggcaatggtttctcgaagcttgagctgtatgggctgatcaatgttttgacaaagtaatagggatagaggttttagatgaattgataatttggtgtgtaattgaaggctcttgagttctgtaactcctgttgtgagaggtaatgggagcacaggaaatatgtatataaaggcaagttgtgtgggcctacgggaagtatgattttttgtcgggatagaaattggaaggggatacatttgtaggtttgggttattcttgtttatgcatcacttgcagaaacacctataacctgacacttttatgtgtgtacaagttcttaatggattccaaacatccatgatgatatgaaaataagttgaattatttatccagaagattgtgaaagatgtttccctgaaaatattcttgttattgttttaactcataaagtgtgtgggttaattgtccccacaatatttttcttttacttgaatatattttcatatattttatttttgtccccataaaaatattggtttgttcccatgaaatgtttttatagaatagatataaaaattacaaaaaataaaaaagaataaattgctattaaatttaccattttatcttttttaaattttgacaccactgcatagtgaaaaaaaaattgaaataataaaatattttcaagtctttatagtacaagttaaacttggttttagtatttattattttatatcaatcaattaaatttgttactacttcttgaagttcaaggacgaataataatttataaaaatacaagaattttacaattttgttactatgacattatgtatattgtaaaaatttgtaatatttttctatgaaaatatgactcccccagtcttttcttataaaacgatttcaactaccgaaccttctttgaaaaaattagttaatttaatcgatcatctttctctttccacttttatttccaactaattggtacttctttttttcgatcctaaataacagatagaaatactttatctccttaatttctagcaattattattttgactaaaaattattaattaattaagaatattttagaaaaaaataattcaattaatgtaataaataattagaaaaggatattatctatatattttttcttaaaatgatattataaacaaaaatagaggaagtataaataatttgtttgtcaccattaaagaaaagtccggaatccatcaaaatatatttattaataaaaaaagagactcgagtggaatgaatgaaccaacttaattaacaccactacactatcaaaagaaaatcaattttcattctctatgttccaaagcttgttcccgaaaaaaaaaaaaaactatcattctccgccgctagacctcgtgttcagttatctcctctgatgcataacaataggaaaacaaaacatagttaatcttcataaaaattacataattttgtattttaatattaattatttattacggtttatatattttgccaataaaactattcttatttgatatgcggccatttattttttt

SEQ ID NO: 1014 - DNA, 2010 bp, Glycine max
  Soy_ogl_3099 Gm09:33007701..33009710 Cluster 3
ccatgtgtacaacaataactattaagatcaactttcataatttataaagtgagaactaccctttgctccagcattattttttcttaaaaaaataaaaacttttacaaattgggcaacgatgttcaatgatttaagggaagaaaacagtagatcttatggtcgcagaaacatgataaaagtggaactttatgggctttctcaaagcttcggatgattattataaaatattagattaaaatttcaaagggcaccaaaacactttttctcttttcttttctaaaagacaccgtctaattgtagatcttttgaatagaatatggccatcgttttcatccatagagtcgcagaaggcttctctagaaggaagatactcttccttttcgtagcacttacccgtccattaatatcaaactttagggatttggaatacataacgtgtaaaatatcaatcacactcagctggaattgttgaactaataattcttgcatgtcccacgcattgaccattatttatatatatcttctatcagtattttaatgttaattaatagtaataattaatacttagtgttttggactcggcctgtgtcaaggaccactcaattccaggcccacggaatagggtagaaacccaaatctgcaaacttaaccggacctacttatatattcagctggcatacccacctaattaaggatgtatttaatttagatgatgaaaataaaatatactttttttatttaaaataaaaatatacaaggtgtggattacataaaaaagtaaaacatttttacaaaataaaattaacttgcctatgatacatactccatgcattctaaatgggacataaatgtatatttaactattgtctataattttttttgaattttttcccaagaattattaagtttttcttacaaaataaattttttatgataatacataaaaaacagagcatttttttaattttccaataaatttaggaaaatacttatatattttttttaaaaaaatataacaaaatttgcagaaaaggttcacatgacaatacaaaattaataataaaaaaatctacattaaaaaactttacgtgctaaactccaccagtcacaatctactattcagttaccactccaaaatcttattagccaattaagctttagtaaaaggttacgtactccatgcattcttaatgtgacattaaatattatgaatgattgggaattttttcttataaatattgtcctgcaggctaatactaaaactaaaataaagaaaataaaataaaatttatatatatttatgatgtgtacgcagtaataaataaagatatacttctgaagctaccaaagtaaaagacaaattgcatgtaagccgtttcgaattcattttttcttgggagagttcccttcaactattcgtgtcagtatggaaaaaaaatttcagtttttattaagttgagttttacgggcccactgggccagaagcttctcaagctcaaggatttactttgggactaatgttggatctcaaggacctacaggtttagctaaatatctaatcctttctcttacaggagaattaatttttgaggaaaaaaatattcctttttaggatttgcgtgctcccatgctcctttagttatgttgataaaactatgaatagtttgtgaattccttcttcggattcatatatacaacaatcacatatgcatctagcacgctgcaccggcctatagtcaccgccaaaagtggtattatttcatatatatcaacctagctacaaattatatatatatgacaaaaattatagtgtattttagtcaacaaattaatgtatgaaaactcaaagatcataagacgaaattattggtactactagtgtttcatttcccaataaaagaatataattttaattaattatctattggtactactagtgtttcatttcccaataaaagaatataattttaattaattatcttaatcaagattcaagacattataagattg

SEQ ID NO: 1015 - DNA, 1841 bp, Glycine max
  Soy_ogl_5098 Gm15:39843360..39845200 Cluster 3
gttcctgaaatttgaggcactttttataaaaaaaaaaatattattttcactttctcaaattcacattactctgaaaagtgaatttgaagactaaaaggagcaaatgtttagtctcccaatatgaaattgaggctatgaacaacattttgccaaattaaaagattaaaaagagaaaacaaattaattgggaaccaaaatcatatgtatacaaatttaagagaataaaaataaaattaaatcttgttattattagtacgtaacatcatcatcattaagttagttagattcaaacaatattttatattctacatgttgggccatcatattcacattggacaattgattcttgctctccatgaaatacttccttaacctcttttaactttaatattttacaaaatcttgaaactatcatgcggtgcataattataattagattattttccagaacgatgaatccagagtacataaaaattggaggagcctttcaaaaatgcaaatccggaattttttttttttcataatacattaaaaaaattacaaaagaggcattccagaacaccttacaaataggtatagttctttcggaacacctattctacaatccaaattaaaattcatacttttagaatgcctaattcttaatatattaaacaataattacagaacatgtgatctgatataaataatgggaaatattttggaaatcacataaaaaaatttaaatgggatgcaggatgatttttgtaggcgtaaaaagaaaaggccttgtttattccgaattgtacgtttttcctagccagttgagccattatattaaagttaaaatcatacttttttaactttaatatctttacaaaatgtaaaactaccctgagcgcgcataattttgtatatgtatgaatttcgaaatataactttgtagcttcttccctttttgtcaaggacgctgaagcttcactcagttattttggtattatattcttttctttgtgtatttagatatagccgagtgctaataaatcactatacatgttgtatttactgtaaagccagtggcagagaataagaaaataaaagtaatatatttttctttctttctagcggacttagaccaccaatacttttaaagtgtagctaaaacaattactcactcatacaataacacaagggcaagtaaattgaattggcaaatcttaatcttgtcaggaaatagtgtttgtagaggaagaaaaatggaagagttcaacgatcaaaataaaaacaaaggaaaatgaagagcgttgtcagatataataaaggttccaatgagaagaaatgaaagaaggatggaacagatgaatatttgattgaatgaaaaaaaaaaaaaaattgtcccaacacccccgcacccgtcgctgcatttctaaatttactacaaccaacttggcaacaaaattctcaatataatgtgaacaagatatttatatatctaattgcatacacataatcaaaagttagtttgtatatgtcatgcatgtagctacttgataagatatgtttaaatttatgcgagagggcataggtttgatcccctaaaaaaaatgtcatgcttgtacacaactcatcatcatcttgcaagaagcatatataggacaagtgcagcaagacattctccaaagtcagcaagaccatgaattccttaagcagttcaatggttgcagttatgtttgcaatgtcatattgatcctttcacttggggtgattatgtcccaagctagggcatacccatcttcatccttagtttcaaaaatgtcgcaatctttccaatcaccttcacgtccactttatcacaaagaagg

SEQ ID NO: 1016 - DNA, 1200 bp, Glycine max
  Soy_ogl_5754 Gm17:38220701..38221900 Cluster 3
atttaactaaatgcatgcatatatgtataataaagtgtgttattattcaaatgattatatttttaattaatgataattttacattttttttctaaaatgaatcgtttactttgtaagaaccaaagtaaaataaatatcattttgaattgagtagttaataatgatttcctattactaaaatgaggttatatagatgacaataattatatttgttaaatatgtgattagatatttaaattttcatattcttatgaatgaaaaaatataatctccttaaatagatatttattattagtaaaaaaaaaattatctctgacttttggccgataatactcggaagttacccccattttttttttaaatatttatttctatagctgtctcttgcctccggtcttacttttcaaagaagaaagaagattaactacaaaaatgctaaattaaagttaatactttgtaaaagaaaaaaggttttaaaattttgatttttagtagattgccaaaattttctatatcgttcgatgaatttttcaaagggctagaattgagattaaggttttgttcttatcgagttatagatgagtaatctgactttctcttttgtctagtctcagtgtcatgatcttggatctccttcttctatgtgtgatcaaatacctgcaaaaagaaatttcgacgatgaagtcaatcaaatcaattaattaaaacctgcttaagtatctctttatggaataagtaaaacatacatctctttgtgtgtctgatgagtatattatagctttttgtgggacttacctcgtgggggagttatattgatcaattgttcccttattggtgtgtcgtgttgtagttgtgtggatcatgttagaccgcgtttgagtatgtatctcctttgtatgactatgcatcaagttttaaataaaccatccaactttaataaggtcacatacttttttagtgaacttagggtattttttagctgagaattaaggattactttttcaaagagttagatttatttaagagacttcttatcttaataggtatttttcatacactcaaagataaagttaaaacttttttatatttttttactacatttttaaaagataaagttatctattaattataacattattaattataacattaagtgtgtgaatcaattagtgtgagaatattttaacttaactaatgatt

SEQ ID NO: 1017 - DNA, 1241 bp, Glycine max
  Soy_ogl_6061 Gm18:182475..18507715 Cluster 3
tatcaaaagaagaaaagttatgtatgatatgataaacttctcttaactacattttaatgacaaaattagtattgacagatgaatggttgaaaaatatgaccaccatagaaacaaaaaaaatgttacaatgtaaaaatggaagtttttcatcggattttccattcttgcttgttccacacattaatctcttcccttaatttcaaaatcctctaatttcttatgaactcaactgttacacacaattacttgcactgaacataaacaattgttgttaacaatgactactttgcaacataaaatacatgacaaaatcatggttagtgtgtttgcaaatttggggggttacttttttctttatgtctatggaggaagagggaaaacttctctttagaggactatttttgcaactattagatttaaaggcgtaatttttttactatgacatctagtggaatatatgctttactaattttttgcaacatttttcaaattctaaacaatattaatgaagattctacttggaatataaaacaagatagtcatttagctaagttaatcccaaggactaaacttataatttggcataaagctccaatgactcaaacattgttttaaagctattgataaaacattcaaggatattcttcaattttctaacagggaagcattaaatctttcctttggagggaaagttgtagtttcagggggtaattttaggcaaatacttccggtcataagaaaagagacaaaacaagatgttgttcatgctaggctcctcttacctctttttgactttatttaaagttctaactttaacaaataaaaaaggattcaatctagatctttagattaagaagtttctcaattgaaataatttgtaggttgtaggactagaaactcatcaatagctgggtctaactcattagctcgaatcacatgaaccaataatcaaattttttaaatcctatatatttcaaaattttaatttattagtagattttagataaaatgattgcttaattttttaaaaaaaaggcaaaactaaacttattctattagctttgtaaggccacaaggtaagacaaaaaataattacaaccaaagtttacgtaaatgaaaactctcctaccctacatatataaaataatagacaacccaattacacacatatatgaatttttgttcaagaatgaaatcttattggaattgtccagttcaccctctggaaccatatcacatct

SEQ ID NO: 1018 - DNA, 1000 bp, Glycine max
  Soy_ogl_6385 Gm19:33079001..33080000 Cluster 3
ggggccgtaggtaaggggtgttagtggattctttcaagattgattcaaattgatgacttcagatttcaagctttaggcaccgcttagtttttttccgaagcaagtatagagcttttctaggcagttgcatgtttttgggctttcgcgctatgcaagaatgcaattgtacttatacttgcagaatgaattcagtatgcaaaatctcaattcatgtgtttgtcgcccaagacctatacatgtatcttcatttgtctaaagaaataaagtttgtttggataatctttttctgaagtaattcgagaaaaataaaatattaagaataaaaatatgatataagattagtttgttcaaaattacaaaaagttttttttaaagcatttttttaaaaaaattgatttttcataagcagataaaatttactttttaaaaaaagtaaaaacatacttttaatcaaaagtaatttaaataaacataaaaaattatttttaataagtttaatcaaactgacccacataagttaattttaagttatgtacaaactaatttatagaagtttttatgaataatttctgtaaaatgattaattttaatttatgtataagttaattttaatttatgaaaatactaattttattttttttcttccaaaagtattttaggagaaacttatgcatttctcaagatttcagtttgatgcttgattgatttatttaattttgatggttgaggcgatagtacgtagtgccatagttagatacaagatattttaaaaatatattcacgatcaaaattttgatcgcaacatcaaattctttgactttcgttgattttatttgaccctaaattctaatctcattgaccacatatgttaaaaaattctcgcaatatcaaaagagattttatcattttaaggaactgatgaaactggattttcctcatacatatatacaatacaaccccgacaaattaatcaaagcgcaacaatttatttgagtacgta

SEQ ID NO: 1019 - DNA, 1707 bp, Glycine max
  Soy_ogl_2764 Gm08:19180594..19182300 Cluster 3
aattatctataccttttattatattttaatgttgactaattagcaattcatagatgaatatgggagacaaagaatattttacattgcattaaaatttaacataacattttaaaatatatgatgacaaaataatattgataaagtaaaattaaaaacattttagtaatttagttaagagctgataacaaaaaatcaatttagatatattgatagagggtaatacaacttattaattatgatacattacaaatatcaaattaagtgttaattgttataaagttttagtaatttagggcatgcttcttaaaaagtgcctttttaaaaaacagatataattttattctttaaaaaagcctaaaaaaaatttaagcaaaaaaaaattaaacaaacaacccaaaaaaaataaaaaattgtttattatttttttgtaaaaaaaacattttttaaacaaatgaacccttaattaaaaactaataaaaatgtaatttaattaagaaatatattaataaaagacaatatgacttattaactatgacatattaggaatatgaagttatgacttataatttaaaagttgaatttgacaatataactctttaatttaattcagagtttgaaattttattatataattcatctgtttatacaacttttttttgaaacaatttaatcttttttgacacagttacacaaattactctgattttaaatttaaatttataattatataaaaaaaataatcacatttaattatcttttattactttttttttatgagtgggaaataagaaaaaggcacaagcagaaacccacaaaaaggaactaaatcctcagctagcagtatttgcctcaagtgagaaggacaagattctagcaaaaacaattccgcgtgagatgatgatccaatcttagactgaaagtgagcaccttggttgccctcacgatagatatgcttaaaggaaaggctctattggagttctttgaagctatatattgatcctttgaatcagtgctgcatataggggtgaaagccattctcataagtttctagcaactacccatatatgcttgatggcatgcatgaaattcagcgttaacgtttgttgtgtatccgcaataaccccattggtcgatgaactcccaatgatctcgtcctccacattaatttggatccaacacaatacctttcatactattctctatctcctcatgagttaaagggttgtatatataaattgttccatctccaaacatcattgactaagacacatccttctgcataagatcagtatccgagatgtggacatagttaagagatccacaatagggcctttgcttccttcaaaatagggtcataagataaagaaatttcacccttccccactctatacaccaagcctctccttagcacctctagtgattttaagattgaattccatgtaggagatgatcctgcaacgaatttgcatgcaagatggacttcttatgaataaataaattctatattcaagatatttgaattaattttagattttttttaataatattaaaaatattaaacttatcaacataatttttattcaattcaagaaaatttcccttcaaatttatgcatgcattgcactagcactgagcgggtaagaatgcaaatgctgatgagcaatgatttcacacaggaataactttttgttgttttttcttttttta

SEQ ID NO: 1020 - DNA, 1010 bp, Glycine max
  Soy_ogl_3058 Gm09:11925301..11926310 Cluster 3
aagcatttgtttgaatatcctatcaatattgaagttttattaattatataagtttttcttgtgcattacagtattatgtttcttatttattgtgttttgagattctagaaagagatctcaacaaataagaaattctctctacagagacatatgttttggttgtattatatgaaactatttaacctacgttcatggtacatttgttgttctatgccagcctatttgtcaaaaccttctattaattggacattttttaagcaagcccatattagtttgaaatgttacatttacctatcacgatgcaatttttttaatgaaacattttatgaaatagattgttatgatgtgggtagtgaacatgccctatcaatatgacattagttgatattcacccaatcatggtatatatgtttatttcaaaaccaatgattattatcattccacgtaaataatgaataatgtgtaagattacaagaacatggataaagtactcgggtgtaagaatttgctataaaaattgttaatgaaaacttataagtgaaaacttcaatttaattatttaatcaacaaaatttaaacaaataatttgctattttgaacttctactcttataaatgataagatatttttcttgcttctttaaacaagttttattaatcctatataaaattatacactatagagagattaagaataatattttttttctttctcatttatatcttcaaaaccaaaaccatcacgtgcatctatgaattatcttgctttactatcaataatatgattcaaaatgttcatttaagttcttccttaagagaaaattgtcttcttatatatagaatgtgtcttgaatgaattccttacatcttcccaaaactttttgttggaaaatataatggatcatgagtcaaatatataactttttcgtatactaaactgatgttagcttcattgtatcagtaaaaataatcggcaaaaatttatatttcctagtcttccatgtgtgtgtg

SEQ ID NO: 1021 - DNA, 1500 bp, Glycine max
  Soy_ogl_6020 Gm18:11853001..11854500 Cluster 3
atattttttcatctaccattagtgatttagtgtggtatgtggtgcacgttacagaatatttatttttgaagtgaatttctttcctcacaatatagtaaaatgaattcacttattccagtagtaaaatttggaaacttaatggccttaatattttttaaaaatagacaattcacgaattcaattgttaaataattatgcatgttgagcttgacattgaggacgctataattgaattgaattttcaacagttagtgaatcatgttcataataagtacttagataattcagaattcgcgttatcatcgatcaatgtcacaatttattttatatttcaccaaactttaaggtttctaaggaggctagcgaattcagttgcttatggtctaaccagagtagcaaattcttacgctggtcaccggatttttcatagtcctcggaattttattgcttaacaaattgctttggaaataatacaagtatgttgctataaaaaaataataattacgtatgttaaaatttagataaattaaatatttatgagtacgcagttagccaacatttacttttttttagaaatgtattgtatgttaagataaaaagttgattgataaaatatcaaataatttttaaattatatgaatttttatatattgaatctacttaatgtgacctccagctaatgcatggctacaaaaaatcattaaattaattaaactaaacgagacttaatcctcaaataagtgcacaataacaaaataacataatattttcttgtgtttataaaatattaacttttatattttacatttattttataacagttttatgttatattatattatatcgagtctcataacttataaaactcgtcatcaaatgtctctatctatatccatgtcctatcacatttacattttgtattgtatttttcaaaaatacactttcggaaaaggctagctcaaaccaccattcaacaagattgacaaagagttgtatcaagtgaataacatttctcataaaacaattttattaattatccgatgagtaattctaccattaaaaagaatgctatggcaaatgcaatacattcttttcaatataatttttgttattaattaattaaaatttactagaactatgatggatttcattcataattatgtgagtttaattcccttaatggtagattggtgagatttcaactttgtaataaagtagttcacgtgagtttaaaactggcaaaaattaaaattaaagagaaaataaattagtgtagagccatcatagctagagaagtggttaaaaaaaataaaaatataaaattaatatagataatacaccaaacaccatgtttaaaaaaaatgtgaataatcacatactctacatataaaactaaggagaatattaactattcatatttattcatggatagttaatattaactcttatgtatgcctaacatacttactctaaaataatacttctaagagaaggtttgga

SEQ ID NO: 1022 - DNA, 1091 bp, Glycine max
  Soy_ogl_6720 Gm20:31402501..31403591 Cluster 3
ctatctcattttctagaggatgaaaatgtaaatagtcaaatttatttttaacttgtgtagttgtcatgcatattttatatataaatatttatgttgtgtaatttattttaaaataaattgaataataaatgataacatataagagtaaattgaataaaaaatatgataacattttgagattattaaatttatgttattcattcaatgtaacaaaaacatattatttttaatgaaatgacttatctattctcaatataatatatatttatatgttcaaattgttgcaacatgtcacaactgggattgccatgcaaatactaaaatgatccaaaattatgtggaaaaccgacaacatatatttcttttaagagaacatttttgtaatagataggaggacatatgtcaatatattaatattcttgcaaagagaatgtattgataaaatctacatttatataacattgatttattgacaaagctcttgataatttgattccgaatttcactcatttatccctaaattttcttaacaatttattctgattaggtgaaacacttatcccaccaaaatgtcattgatatttgatgcatgcaaccatgaacaaatggacttttctaacttaacatgagaatggaacataatttttcaatttaaaaacaaaaatagttgcaagataataagataattttctgattgattggtacgtaacaacaactctgacggcttgaatcaaccaagcgggatatcacaacatatttctgtatttgttaaatttctaaggatgattagcatacgcaattttgtagtaagtagttgttagtaacatcatataactcttataattgcagagtcaaagaatttaaataataattagtcataccattattatatatatatatcacgctatagactaaagcatgttcttggtctatatgttttaaactaattgtgtacaatggcaagtaagtgacaaattgggtctctagctaatgtcatatatgggatgacagtacacaaattgcaataatttatttattcatcgttctgaaacatgtagtagtttttatagaagaaacatgtagtagttata

SEQ ID NO: 1023 - DNA, 1100 bp, Glycine max
  Soy_ogl_2808 Gm08:35388001..35389100 Cluster 3
gtgtaattataatgctgaccaaaattaattattacttctgataaaaattatttcatataaatatcattgttagaagaaaaaaaaattatggttaaggttaaaaatttgaaatgtcacaattatccttttaagtcaatattttttttgtcagcccttttaagtcaatactaagtgactctaatcttgacgataaatattattttcaacggatttaaattttcatccattcttgaatatcatattagaaaaaaaatataattttcatcatgtaaaaacttattttaactaactgcataattattttgttttcttatgtgaaaatcacgttagaaaaaccgtattaatatatcctaacgtgatattttactaataataaaaaaatcctatcgtgattttaataaaaatattatcattaaatatttaattagtacggtaaaaacattagatattaagatcatttattacatattaatctaagaaagttgtctgcactaaaaaaacaaactatgaaagctgttaaagacaggagtagtgatatgaaatttgagtaatctactagagatcatatatacatacaattcttcatttattttttgtttcgaattgtacgacacgggctttaaagtaggtgttttatgcacgtgtaatttttaacggtaaacaaaaattattaacagggtttgttatgaagcattcaagttttagctttgcttttttaaattcaagttactgtctaattttttggggtaatgtttcgatatttttttaattcaagtaactgtctaatctataggttccaatatttttgaattcaggttactgtctaattttttgcggtaatgttcaagggccttattcgtaattttccaagctattgtggtggcatgatcacccattattaacagtagttctgtagttgagctcgtgtatattacatgacaagaaatatcatgatgtacgagttcggtcactaacaaggaatcatggccaagaaaaaggtaatgtaaaacaacaatattacaaattacaaaaaaaaaaaaataacatggtattaatacaaaataaactatgttaaaaggagtgattaatcttaataaaaa

SEQ ID NO: 1024 - DNA, 1358 bp, Glycine max
  Soy_ogl_855 Gm03:5191401..5192758 Cluster 3
cgaaaataagaaggtgacatcttgtgtatagtcaacaagaagcatcaccctgatatactccttctctaaaatgggtatttagaatcggtataagggtggttacacatagggtgtcacttcttgtatgaaaaacattagatgtcattcagagtggcatctcttaaattctagttgacaaaaattactgctacatataaatagtcttctaaaacatctatactgataaatagttttgcaaaagtactcatttttggttttaaaaaaatcaggctataaataacaaaagggtgttttggggagaaaaaatgataaacggggtgtattattaaaatagagggatataaataacaaatagtccaataaaataaagcaatgccccaaattgattcagaatggacatagcccagtttaagtggctagactgaaacatctcagtagccagaggaaaagaaagcaaaagcgttgttggcaggcgagccaaaatgggacggtgtacttagtaaaattgagaatgtaaatagaaaaagacctttcactaatctagatggtgcttgacgggccgctctagcagttgagcccgttaacttagaaattacacggcaattgatttctatatttctcgaattacttcctgcactcctcaaattgcttccaaaatgctctctgaaaataatatgggaaagtgcagaaaaaaagcgccaaattacacataaaaagttactggaaaactagcactatgcccagcccaaaagaggacacaattttctttttgtaagtttaaacaaattcatcccatatcacaagaattgtgttatgttgaattagtatttttggggtatattgcttggcatagaaaattttgaaaaaggaaaataaaatttgaaaggtatttaggaaactttagtgaaaaaggagaaggagaagcatatttaataataacgagaggtatgtgtatcaatagtcaaactctaaacataataaaagaagattataaattggagtggagattcattcgttttaaatgggctcaaacaaccaagttcgttctaattgcactccatttcattggctcagaagcctttttttttatccttcactttcaaattcttattttgacttatcgttgaattggctcaattttaaaatgaaaaaggagtaagagaataaaaatagttattacttatatatagtttaatatactattaagctattggttaccttttttagagaccacctgtaagctaagtatataacttatgcagttgcatgttcaatatttaaatttaaggatttttttattacaaagcgatttttttcaaaattagcaaatgaggatatttttaaaaaatatttgtttg

SEQ ID NO: 1025 - DNA, 1200 bp, Glycine max
  Soy_ogl_6414 Gm19:38277301..38278500 Cluster 3
taaaagtccggaataactcaaatttattaagtatcatcataaatactattagaaatgtataagaatgcaaatactataaataaataaaaaggatgaagtgagatattaaggtcttttttagagagaggatgaggctttgacaatggaaatcttattggtggtctcactcttgacattatttttggtttattttttatgttatatccatatattacttgacaaactcagattgatattagcttgtgtaacacaggcacccaagagagtttacttgaaaatgactacattttgtaaattttgaagaaaaatttgacactgattgaagaaccacaaccatgtctaatctcaaccatggtcatggatgtcactaacaaccatgagaaatgaccatggccactaggagaaaagtaaagttttgaagaacaacaccaaattttcgatcaaactgtgcttatggtcagtcaaaatcagaaccaagcaatatccacgataacggatagtgaaccatgatcgtggatgtgtcagtattgcatggtacttatccagttgttataaatagtgagttttaggccctatatatgttattatattttgttcgatcttttgtgcattttggagtttttgaaaagagaaaaggttcatgatagagtatttagctaaagaggaccgtggagatcacagttgggacgaatttttggtctctttctattttatcatgtttacattctttattgtgttttctagttttgtcataatcacgagggactagttcctctagtccaacattgtgatgtagttatatccttgaattcctttttaattttaatggaattcttaatgttattctgttagttaagtttattttctattcttattactattttagaattaatcattctaaacattaattgactacctgtcaatgatcattcacgtgtaattaattaacttgagaaatatttgttttcatatgacttgtatgaataattattgatcatcctttatttgagaacttaatcctttgcactaatttggtagttctttgatcaattgggtattgaattagaacaaagagcattattagaccacatgaccaaaggctaataattgagttaagggataatggtaattgaaaattaatttgggtttcattagaattagaattaaaaaaaatggaatatttataaaatcacaatccta

SEQ ID NO: 1026 - DNA, 1512 bp, Glycine max
  Soy_ogl_153 Gm01:43512389..43513900 Cluster 3
cgactattattatatttttaagtttcaattgaatttttatgatttgatttttttagtgtataatagtagtttgaacctaaaattccatgcatattacctcaaacgctcaccattggactgatcctaatcgatcatttttatgatttgattatggtaaaactatttaatttcgatatatcaaattaaaattttagccacaaagtaaagacaaaaagtattactatataggtataaatttatttgatatatttccacatacaattttaatgtgaattttaaataagattcaacagcataaattatgtgtcactataacttatattacacttttagaaattgtgagaatagactcattaacatatgccaacatgtattatgtgccacttataacttataccaaaattatgaaaaataattttaatttatttaatataatataaaaatttaaaacaatcattaataatttaaaaaatcagaatcaaataattaaaataaatttctttattaaaatcataaataaaaattaaaatatctaatacaagaataatatttacaaacaaagtactcacacttgaatttattacagtcataacttgatttttttaagttttccgtcgcgaagttctgggaagggacatgtaaggtatctgaaatcaaatttatttaaaagtgtacttttgtgaaaacataaaacaaaaggacgtacgtaaattaatagagaagggagaggtataaacaacaattgccattggaccttgtatctttattgtgcaaaatcaaaatctaatccaaaatcattttttttatctcattgattttattttatttatcattactatctcatgatttaaatgtatagtaatggttaaataattataatcccacacacattaagattattttaaattttcacacacacacaaattaagattctaaacataccactatctgagttttctaagatttttagaggtgaaaatactattttactcctactttttcaattttgactagtttactagtatgtagctcattttaagtcttttttttttatttttaaatatgaccctaattaaaatatttaactaaattttaatattttaaatgtttacatacatctttagttcttgctatttggcagttttttgtttttcgtccttgtaaaatcatttttttatttcctattctggtaaatgatgtctattttattttttgtctttataacactttaaataatattttttcacggttcaaaatgctatctaaagtattttaaagactaaaaataaaataaacataatttgaaaggaataaaataaaaaataacttggacaaaaagtaaaaaaatattaaattataaatactaaaattgtatttaaacctattttaaaatatctttttttttatttaatgttggtgaaattagagatttacctttggtgttgaaaaatcacaagtgaacaattattatcaagtaataaaaatatcatattcacatgaactgagttttat

SEQ ID NO: 1027 - DNA, 1074 bp, Glycine max
  Soy_ogl_447 Gm02:8777351..8778424 Cluster 3
caacataaatacgtaattcaaattaatttagataaacattttaaatgaattacaataatttaaaactaattctacaaaattaatattactaaagtttaaaccaatcgaatatttaatatttgagtatttttatgtagaaaattcgactctttaattataaagatgtttttaaaatattttgattattaaatgaaatttgtgctaatgtaattgaaaagctttgtttggtggatacgatctcaagttagagatcacttttataggaatagagtagatcttcctaactgcaagtttatatagcaaatattgtttatcatgagttttggttattgtcattaattttatcatgtttatcatgagatcctatgtttgtttcttttctcttttttattatatgatattcggtgtgacaattgatggcggaagcaaggataccaacataattgagaaggatatcaacattaattgggatgtctactttcattaatttctgcatgttctgttttgctaaaaaaattatttttcctagtaaaattcttattaaattcatatattaataaagtttgttaaaattataaaaaagggaaaatattatactcattgtgaactcaaataaaatttaaaaagttcaaattttcgaagataagtcaacttaaactaattcaaccttatttaatattattatttgaaaatattcttaagttaatttaaatataagcattatctttgataaatatgactgggatggtttaaaaaatatataccataacttcgttccttaaaaaaagatagtttaaaaatatagttctttttcaatgaaataaaaaaaaatgaaattaactaacatccctatttcaaaaaaataaaaaatactaacattcttatcaatataaaattaaataattttatctatatttaagtttggaaggaatacattaataaattaaatttaaataatttaattaattctacagaattaatattagtaaactttaatgggttaaccaatcaccaacaagttgatgatcggtaattctgaatttaattctcttaagttttcgaattttgtaaatg

SEQ ID NO: 1028 - DNA, 1047 bp, Glycine max
  Soy_ogl_1307 Gm04:38297101..38298147 Cluster 3
tttttttctttcaaagtgttatagatataatatgaaggaaaatgttaataatactttatctcactctgttttttttactctatatgtaattgattaaaatctattgaatgaatgatttttaataagtttcaaccattcagtaccgaacaaattaaattgattaaaagcacatgactggatagaaagattttgattagctcatgggaggcagcaattatagcttattatcagtttttttttttctttcttctttgggcgagtggtgcaaaagggattttttaaggtggcttaatatagtgatggcacatgtcacacataccccacatgttaaaccgataaaaataaaaaatagcttaaataactttgttataatgaaaagtccatcaaatggccaaacacttatgactaattaattatagaaaaaatagattacatagatgtaaaatcttatattgtcattttcataatttattatatagtataaatttattaatttttataataattatttaaaaaattatattaataatgatttatgataatcacgcaagaatgatgttgggtgtttcttttcttctttttttatctctttgtatcgactctttttcgtgggatattgtcggcaccctatgttaaatatattttcttgtcgtttacaaaaaagtagtaatttataattaaataataatataaaaccaatcaatcaatctattttgtctgctcataaaataaaatcatctttaaataaaaatgttttctttattaaacttgataaatcgtacatatacaatttaattactttcgttataaaagaaattaattactttcatgaaaaatctatgaaaaaaaaattaatcagtacgttgtaaaccgaattgaattgattcacgtcagattatttaaaattacatatcaaatgatgtaattttaggtaaatatttagtttatatattaagatttgcgttgagaaagaaaagtgttaggaataactatgacacactttctttacataatttttttttacaaaatttttatgatattttttat

SEQ ID NO: 1029 - DNA, 1675 bp, Glycine max
  Soy_ogl_1906 Gm06:11576991..11578665 Cluster 4
ctacagaagagagaaaaaatatttaagacaataaataataattaataatattatgagtcaagtatgatatacaaatataaagtgtaatttatcctccaagagatttattagtgtgttattgtctgtgttctcttaaaggtaacacaaaagtaactcttctcctgttttgtaatttttgcatggaaagtatattttttttcttcaacatgattctaacgccatctcaaacatattatgtattggcaaagatttggacggttgacatggtgagacccgactcatcctaagacattaatcaatcttgcacttataaaaagcaaaagcttccgaagaaacattgaaaagtaaaacggtccttattagttttgacttttgagaacgatggatagaaaagcagcaaaagcttgacgagaaattgcattgctgtaaagcctgcaagcgtaaggattgaccaacgcacacaatcgctaaagctgtgagattctctcttccactttgattttggaagtagcaaatgttttttcattttaaagggcccttaacgccaccaatctcttgtcgtttactgcttgtttgttttatcaccatctcctttccattcacattcttccccattttgtccccctctcacataagacatttgttactttgttccttcaatagttatgtgaatcaaaccaaacaaacaaactcctattcatttcattcttagttgccctagattcattacttgtcattctcaactaatttcaaaatgatatggtctacacatgctttgcaattgagccagcatcaattttttagttataacttgtgagtaaactgcctaacattgcataataataatatataacatgttgtgacatgattgtttcataattttgtactttcggcatgtaattataaattcaatcattgatttatgcgtatggaaaaaatatttatctgataaaattaatttcttaaataaatctcgtcattttaaaaattagtgattggctttgggtcatgagatacttcattaaaaaacagactcaataagaacatgcatgccaaataattaaaaaaagaagtgaaattaaaagagggagagcattttgttagaactaactaaaaatccacataatgggtacctgctcccatggcaggagcaagactgaaacaaacttgatgaaagtatagaattgaattgggtgtcgtattgtgttggttgcagaatcaggcacataggagtcaagtgcaaaatgtattagtggcagagtacgagcatagtatatgttattgattatgtggcatgaatgcaaagaaagagatggtgttgttgttgactctgaatggaactcacagtcacgggcttcgatcttctgatcctccattgtctcttcacagttcacatccaagtaactaacattgtttacaccctgcccactgattccatcttcatcacacttttaccttttctttccccggcttcacactactatcttagagggtgtttttactatgagaaaagttttctctctctcgaaaatcaatggctagaaaattttgtttctcatgcttagtaacaattttaaaataataacattcatgtgaaataaatcaaataatattttttagaaatgtttttgtagtcagtttctcaccagaaaaaatttcatgagagataagaatc

SEQ ID NO: 1030 - DNA, 1413 bp, Glycine max
  Soy_ogl_3178 Gm09:38842401..38843813 Cluster 4
ataagcaattcaatgtttaaattgtaatggactttattaaaattgaatcacgattatagttattattggctgcttacttttttttatggacgtgttaatgatttaataattctcttgattttataataacttttttattcgtaagaatgaatgatagtgtaaatttttttttataataacttaccttctattcttgagttagacttcttgattttataatgattgaattatcttttgtgctccgttaaaaaaaccttttgcccacaaaataaattttttagatatatttaagtaaacttcatattcaagtttgtaaataaatcaaatagttttattgagtaaacgcttaatcaaattgtttatatacaattttggtcgaatacatatttcctcttgtcataatttatttatgatatataaaaattgaactcaatcaaagtatttctagctacttcaatatttcactgaataaaaggtcatttatttacctttgggtgttaggattgtcgttcgtacttcgtgtcacttttttttttcttttaacgaacggagaataaattattagtatgcatttacactaacaatataataaaatatatttatgatatattaagggagtcaaggatattgttataagttataaccctctcatacgtatttgtctttaatttttatgaattaaaaaatatttattatatgatttactgataatatatatcaactttttttatcaatatgattaaaatatttttttataatatttatagttatagctcaacttttttcttataaaaaaatgttatactaaccaagaccaagtatctgatcattatagtataagatttttaataatattttttcatttgtatcatattttagttcaatattcgactctttgattatttaattggataggaaaaaaataagaaaaaaattgaaatttattttttcataagctaaagaataagaaaaaagcagagctaattgatttgaaaaattgctcagcatgtactcaccaaacagaattaaaatttaaaaccaacaacagaaaaggttgaggcaacaactctcagcgaccatcaaaatcatgacaaaaaaactaaagctatatccaacttgaactcagaaaataatcttaagatctattatttataccaaatattgggtacataacttagctcttaattgaaactaagacttaactaattgcttctctgttaaccaacttctaatggcatcagtaacatctcccgtaacaacatatagcaagattggccagttcagatgcaaatcatttacagacgagtgattaacattgtatcctcctgtaatatttttctattaatcctccatgacccttattgaaaatgtattattatatatggaatgtatctaatattctctctctctctc

SEQ ID NO: 1031 - DNA, 2800 bp, Glycine max
  Soy_ogl_5595 Gm17:8980901..8983700 Cluster 4
aaaaaactatttcaagcgttaggacaagtttgtttgatgcaatagagtgacgttggataagcttggaaaatgatatacaaaaacacatacaaatatagtgaagaagcaaagcatatgcttcttgctaaattgccattgaagtttcactttcaattcaagaccatactatactctctttctaaaactcatgaaggtttaagaactttttggtacttgtggcattgtcttgccgtaagtgttaactgttttgcactttttcttttctttagctttctcgtctcttgtcgatcgaccaaaaaacaaagtttaaaaaagtttattgtttgtttatgtttatggaattatcttgccccacagtttagttttagagaaaggacaatatacttgagcttgaacaaaatggcgccgtgtaaatgtaaagcaggatcgaaaactaccaaaaatcatttctatttctcaaactttttacagttgatggaaaacttcattcttcttgtgccaccaaagttgcagaataatcgttgtttcagcgactatttgtttctttataaataatttttagatttaattatacttgttgttctcatgattttgatctcctaatttttaattacttgattttacttttcatatttctaattttgtaattttactctatccattaacttctaatatttgacaaagatgctaacatgattgcaaagttttggtgatatgaacgtattgatgtaaatgtagagtgctaaccttaatatattaatgtagaaattgagtactcatagaagtattgacttagatgtccatttttaactgttcaattttgttcctcactttaacttgacaagccttgtgttttttatataatgattttagttaataaccaattatttaaatgctaacttataaatatatttatacaccagtaaaaaaaagtttttaacattggtatttttcaaattttttctagattagttccggccacaatattaatgtataaaatggactttttacatggattctcgctacaatcaaactaaaaacgactttctattagatataataacaattgtggaatttttttaagtgtactaaacagacaacttacataatacataatatatatctgtcaacccaattttacaaccaatttaaacataattactagatttttttaaaaaagttaaattactagattattgaactaaacttcgagaaaccaattccctgcacacatacgctgtcatgacaatacgaattcacaagaaaaactactttcacagtctaaatttttttgtcacagaatgtaacttaaaagtttctattttaattttgaattttcatattttaatcattaataagttaaatgaaaagacgaaattaactagctataatttttttttctgtaaaagtattattcttcataaaaatgaaacaaagtagtatatatacccaaaaaaacagtgaggtatgaagttacaacggattcaaaagtttatacatctatgatattacatatccttctctttaatagtacacgttatatatatccatataaaaatgttttatactaataatttggtgttatatacattaattttttctagtataatatttgtgtaatgtaataacaattaaagtataagaaaaaaagttatgcactaaaattgtaaaaaaatttacataattatccaatcatgatcatcatgtatgataaatttaatttatttatttttaaataattatattaaaataattcacatggtaatttataattagatgtcaataaaaactattttacaatatataaacattaaactcttaaactattaacataaatatgtagatatcataaacaatccgatgcattaattgtattaaaagataatttcattattatcagtatattaaatgttaataaattatcttattattaatataaatttacaatgtatttattagtagttttttgtcttaagtatttattagtagtttcattttgattacaaaacaattatatcaataatttttttagaggattatatcaataaagataattttaatgattaatatcttttgattgataatattttttatcatatatataaataaatgtaacgaataattgaattatgcaaaagtggtaccaaaaaagtggatgtggaccatgcacagtttatagtttataccatagcagaagtaaaatcacttcattaacttaaataggactgctttgatttataacgaattaaaaaggttaaatcatacatcacaatttgagaaattgagaacgtatgggcgaaagaaagagggaaaaaatagatattataaataatgataaaaaaaataaagagtaaagtagttggcctacaaatataacatttcgatttaatttcaaatgttttttttttgtgactggtttgtaatgtttgtgtacacggttaagattaattccgaaaaaaagtgacacattaaaattgcaaatttttatttatatgcactcgatgataataaaaaaaataaagagaaaagtaaaatagaaaacaagttggcgtacaaatataatattccgatttaatttccaatgtttttttttgtgactgatttgtaatgtttgtgtacacggtttagattaattccaaaaaaaaaagtggcacattaaaattgaaaatttttatttatatgcacttcacaattaagtaatcaaaggaaaaaattacatgaaaaataggatttttttaatattgaaaagtatttttatattgagatatagagagagaaataaataacaattgcatattgt

SEQ ID NO: 1032 - DNA, 2201 bp, Glycine max
  Soy_ogl_6525 Gm19:42962201..42964401 Cluster 4
aacctaaaatcattaatatatattctttctcacttaacaatgcgagctagtagtcaaaagcatgatttttaattttatgagaatatcagaactacggactgcacatgtaagtttcttaattagtttaaaattaacggtctctcataagtttaaatattccattttgtaatttaagcaacccttccatgtggtcccgtgtttctccggagagtccactcatctctctagtgtatatcttctcatatgtgtgttcatggtcaaacaggtttcatatgatgttagttaaaattaataatgattcataagcatctaatccttcaaccatgttcttccttttctattggtaaacggctggtcatgttctaaagcatattcaattcctttctccctaaccagttgagacatgcataaaaaaataatagtagaaaaatactattgatgtttctttttagccctatataaaatatctttaccgttatgatggttacgttgttattagtaaatggttttatgttttataataatgataccatgccatagattatcccccctttcaattaaattaattattagaagcaaattaaatcaaatagaattttaatcagttatgcacttggtcaaattgtccaacaagttcgactatccatattttttttcccgcgggtgtgtatctttgttgctgtgggcagtgtataaaatttgcatggaattaacgtcgattatatataaaatttaacggcttagtgttaatcaaaatgatcactatacattcgatcacttagcttagtgagaaatgatctcttaaaaaaaaaaaagcttagtgagaaatgagaagtgaaaaaagagctgagaaactaaacaaatgtcataactgatctgataaaaaaggaaaaataaaaaataaagtaaggaaaaatgaaaatacaatacaagtatataagtatcattattattatataaactgccggtctatacatttatatatgcaaaccattaatcaaaaggaaaatacgatgagtctaaagtttgaccattgaactatacccaatgtttatgaaaaaaataaatatttgagcttctctcccaaaagtcacggtacatgtcaagtgtcatttttaattaattcaatgatgttttatttggactgaaaatagattataaaaaatgacttttttcttctttggttaagttctgtctctgtctctatagtttcaatcctagtggggaactaaaccagcagcgctacgaacactttcaacagaacgatacctaccctatacacttcttaagccccctatctttctaagaagaagcaacaagactgattttaaaatataagcatgctgggggatcgattaatgtgcatgttctctctatgaatagtggagtttgttgaaaagccttttctttgaatatattattggtagagattattactatacttaaatcatttttaataataatatctcaatttaaaagtcgacttgaactaaatatatacgactcttaaaatattgaatgcaattttgttttgggatattgaaatcatgacatttaagtaacttttacacttttgctgtaaagaaaaaagagagagtaacttttacacttaaattctgtctggataatataaatacttataaaaattaaaaattaaaaagaataaatttatcgcgtaagtcactacaaagaatcattgaattgatgactaaatttagtgggcgaaacagttcttcacattaacaccattaattgtaacaaaatttttagtgatgatttcttaaaaaaaattacatttttgtttggtcattaatattaatttttctagtagtgagttaaaatgaacttaacggacttaatttttatatgaatttccctatctaacattttaaggctgaggaatgtaagttaattttaacttatgagagcaatttaattcttttttatcttttaaatttttctcttgaaaatttatttatttttaacttgtagaaatcgtaaacaggtaaaaaaaagatttacaaaacccacgcacaacaaaaccttattttacttctattaattagtatatcaaattataaatcaaagtaaattgctagagagatgaattcttaaagaaagcataacaacttatatgcagagccatttatcatacatttgtgaaaaaaatactttaattaaaaaaaactagtatcttaacc

SEQ ID NO: 1033 - DNA, 1696 bp, Glycine max
  Soy_ogl_3502 Gm10:42783405..42785100 Cluster 4
gacaacagaaagattgagccgttgtgggcattttaatgggcctctattttgaatttacgcaagttacgggaaaaaacttaccttcagagaccaaatgaaaaaattagagcgaccacagtgggagtcgaacccacgaccttttgatccgaagtcaaacgcgctaatccactgcgctatgcggtccttatatgtctacggttgctatataatagtttttaacactatttaaggtaacttctaatttaattcattttatttagaatatctatatttgtttcattaagttcactaatgagattttttttcatacatattttttattcgttttttaagaatatcatcaaaagaggttctttatttgtaccatgaataaaaaatattagatattttaaaaaagtaaatgaataatctaaatgaaataaatcaatttacaactagctgttttttattcgttattttttcatattatttattccacaattttatgtctggatctaccattgaggctactaatatactttttgactaagaaaataattatgagttccaagtgcgtattaagttatgtatgtagtgcggtatagtttatttttcatcaaaaagttacttatttaaaccaaacataaaaattataaatggtttaatataaaatctgaatcaaattaaactaatttttacggattgattttgataaatttttgtgattttttttaatattattctattaaaacttgtatacttttttatattttaaatcaaatcatattaaaaattgctaatataatttttttttaaaaaaatcagactttttcaaaatatatgttagttatattatcctagtttttttttattattgaaatgaggaaatgaaaactatggtaggagatcaaatcccaactaggtggacatctgagtgcctaccggactcaaaacaaccctaaaatatattaaaaagatagcaaaagcaatacaaaattactaggagacttaggccaaacccatgatgaccaaagatatcaaaaacaggatcataaatgaaacctgaaagaaggaaggtcatatcattatgactatggccagacaaaacgaaggttggagaaagtccctccaacagaaacctgtgttatgcataccaaaggctgcaagactgtttgtgcacatattatcttctctaaaaacatgtgagacacgaaattaaactgcatgcatttgggaagctatgaacataaagtttctccatctgtttctgagttgtcaaggaacaagttccgctgacatagagtcgcactccagccaaagattgggccaacatttactccgagcaatttcaatattaatggctctcatggcagctaggatttccgcgtgaaaggaggaagagatgtcagatgacatgggagaccaaagtggtcttggaaggatgaatagagatatcaaaaaaattcagaatgttgtagtcagcaatggatgagcctgacttacccttggaaacattggcccataaggagattccagctgaatgagactaaccaccgtgatgtcacgacagttctatcattataatgttattatcgtcacatcaagtagttagtcacgctatatatatgtttaatcactttttattattatttgttgatccaaaatgatatttctatcaccatgttggggcatgaaattttattcttcttgtcttgtt

SEQ ID NO: 1034 - DNA, 1400 bp, Glycine max
  Soy_ogl_3510 Gm10:43076701..43078100 Cluster 4
gaactgcatcctccacactaaacattaaaaggtatctgaaacctgaaagcagggtcattagataacgtggaattagaagttaaaataaaaattaacattgcatcctatccaatttaagccacattgggaaaaggggggtaatggaagactagttttacaagtatagatatacaaaagctaattcaaagcatatcaaataaacaaaccaatttcatacctgcgggtaagaccacattttgacacacatcaaataaattatgatcccattcaatcataagtgatcattaaaatatagtcatcgatcttaattcatattacgtatcaacatatttgtcttttacatgttatacacctgaactagtttatgactattcaacaaacaaaacagacattaataacttaaaaatgatcattttcgacattgttccattttccatgttatagcagtcctagaataaggaagataaaaaataaccaaaatgacttaatggcaatactgtagctgttgttaaagtgaatcagtaccttataatctatataaccagatctatcttccttgctcactatctcaagacatgctgctgaacatgaaacttgttcagagaaccctgacaggaaaaaacacttcttgatactaaataatataacagaactgaatgcttgtaagcaaatatacattcctgacttggatcccattccaggggatagtaaaagttgcctgctctagcagctgaaagggaaaactggagaaatgcaaacaatgcaatgcaagttgagtgaattgcaaaatcaactaacaaataccaaataaaatacttttactcaaattcaaagcatcaatttcataagaaccgtataactaagtgctaactgctaactaattatatactgagcaaacaaaaaaacaatcaccaagactgagcacatcatctcctaaattattgaaaaataagaaatcagctttccctaattttcaaccaatagaatgtgtattcttaactaaatgtcaggccaagtgtcttgaattgttcatccactaattccagtggagataaaaaacatagccttattcattgagaaggcaacactgatacaatagaaagatcatatccacattcattcaataaatatgcatagtctgatgattgtaatataggacagtttatgatattaatatgatttcaaaactttttttttttcttcttttgactatttgattagttaactatgtttaattttccagatggcaagggcttcagtattattagaaatttacaatccaattagtaactaacaactttaattagatgcttcaaaataactagactattcctatttactacaagaacaagatctttgatttttttggttgggaatttacaagctgggtgatgatgcaa

SEQ ID NO: 1035 - DNA, 1900 bp, Glycine max
  Soy_ogl_5311 Gm16:5215501..5217400 Cluster 4
aacttcttagggattcccttcaaatctctgttttctcctaaattcctttattccatcaaacttagaggaaaagaaaaaccactatcttctttatatgccaaaatttggagcattcgatgtacgtatcgtagatttgtactgctcaaggaatccgtaatttctctgcttatggtaattgcaaaaaggttgacttgatgttggatttgtcttttaatatctaatattttatacacaaacaagattttcaatcgtaaacggttttttgaaacccatgctttgcttgaaaacattattttgttttggtataatgtgccaaactcatatagtctaggtcctaagcctataacatattttcaaacttttctcctagcatttaattttttaaaagatattatcattatcattaccatactatctaaaaattcacccttcacaaaatataaaaagagataaaataagttcatctaaagttgttagatattgaatttgaatattatctgatttcatacatttacaatttagtcatggacactaaattatgaagttattaataacaaactcatgtttgattttctactttaatttgtgcgaaggatatatataatgcatagttatggttgatccttatcaataatttcttccaataaaagaagaaaacgggtgaatttgtttaaatttaagaaagtaactttaaaataagaattatttatatatgtgttttttttaagaaatagataagatttgcttattaaaataagtaaaaaattgttttttaagtaaagataatttagacagacacactaaaaataataattattttattaaaataaatttaaaccaatctaccctaggaaaagaaaattctaaccaaggcctttatgcctatacctttaaaagactcgtgggtctgtgaattaaaagtggccaaataataatttagcatatggtattagactgccactaactcaatttccaccgcaatctttgggataaagagtttgtgaatagtaattgacatgtggagattaggttcaggttaggataaagaataaatgtatcgaattatttctaccaacttgcctagtccactagttgcatattatatttttataacgaaatgttgtgacccgatagaatctacaattcggcatgcccaacaaaggccacgtaatcaaattgatttgttatattattaattattatttgcctttcaattaattagaatatctgcaagttactcaaattgtaattaaggatagatagttatatattgtgtacaactcacttaaatagttaaatttcctatcgaacatttgatatatatgcctgcgatcacaatttgtatgcatttttaaccagtgacagatccaaaagactttttttagtggataaaaaataccctataatattttcataaacaaaaaataatattagcttttataaaatacataatttcatgataaaaaaaattaaaatatctatcattctacaaatttaaaaagataaaatgaataaaattggtattaatttagtttttcttttatcttttataattatgttctttcttttaaaaaaaaattattttgtgggagcaacacctatttttctatggaacaaaaatactaattatttaacatattcaacaagtaaaaaaaaaaaatatttagtggggacaattggcccattgatgtcaacctagatccgtccctgtctttaaccatatatcaatattatcaaccttgctccggttttatgaggattcccgttaagggaaaacaattgccaatttaacaattttgtaccatttttttttttatcaatgtaaatgagtattaactattaaatttgtccagagcgtcaaattaatatactataatacagaaacaaaatatatattttg

SEQ ID NO: 1036 - DNA, 2600 bp, Glycine max
  Soy_ogl_6753 Gm20:34697901..34700500 Cluster 4
gagaatatccaaacatcgtttctttgtagttatatcacacatattctctatattttataccgtgtggttttaacagatgtatgtatatataatcttccgttacaaaaattattatatcaacagatcactctatacatattgatttctttacatctctcaaaggcctttatttatttctccccctgtaatgatcctagtcagtctaatgtactcttcagactttaatgcctctcgggatcagagagagagagagaagggcattaatgtgctgtggatcttggtgatatatagggtcagaactacactaaaaaaagttgcatgttatgctgctaaatactgaaacggcatgagaaagacagtattgcagggccatatatcttacaaaagaaaaaaaaggagagaattttaatataaatgcatttgagtattgattaaaataaaaaaattataaataagtgttactgaaatgcactcatatcataatttatttatttattaatttcttaaagcctactgtatgtatataatattaattctttaataactattttctaagaaaagcttataaagaaactttattgaaataattccataacgggaaaagaaaagaaaaagaacggccgcaggaaaagttgatgaacatagactcagttgactcagtttattcaccaactgaccgtacataacataaatgagggaatgtttaaagatgctgaatggctttaggcgtaaattaattcgtgtcccggttcgtcttcttcttcgactacttcaaagatctttctctatgtttataaagaaggagaaagtacattctattttttagtagtttccaatgttcaagaacttgtgtggattaattaaaatcattgagttgcttgtaactcatccagcttgaaggggggctagagttgtttcttcagtttgcttaattctccattttcctttttaaaattaattttaccttatctttaaaatacctaaatataattcccttttactatatataagaccttcatttgattgtgattcggtaatgaatcgatgacacagatgatttcatcccaaagagagggttgatacatgatacttgctagcaatggtccgtgctctttgggtgatcaacgtgcattttttttttaaaaaaaaaaagtttgagcgaacaagtatagtagttagactaatttttataaaggagatggtatagtttgttatttgtttgtttgggatattactttcttgaggtgtagtttagcttggtttgaatggaatgcatttagatttggattgattaggtttctattttatttgagagcgtataccattctaaattcatttatgaatttactatttataacttgatagttgatattgtggatcgtgtagaaaattagaaaatttatgtataatttggaacatgcgataaatgccacaaccattaattatctagaaataatggttaatagttagtactgtatgactattgagactccacaagtcattaatattaattaatcgtgtcttaggaattaaatataactgatatatcaagggacgtctaaaaaaaaaaaagaagatatatcaagggactgggtatgtaagaaatatttacattaatttgtagaataaattttagataggtcagaattctaaataattgaaattagatccgtactgtctctaatgctgtatgcttactctctaatttgctcttgtgattttactatttttcaaaacaatataaataatttgataaaataataatagtataagtgctcttgctaaagtttgaatgttgaacaagttttttgtttttttgtttttacttgtggagtacttatttgtttttgtacgtgtatttaaccagttggatactggataggcatgcaatgcctaaaatgtgaaaaagtttgggattttcttaattatttttcgttgttatatctgaaacgatatagatgtaagtgccacaatttttattgttataaaatctcatgggacgttcctttcatatcgtggagcaatttcatcagcctccacagcaaacacaaatatcagagggcatggtatgaacttgtttgctgaatattaaattaatgtacagaaagtatactacagaacaatgtgtgcatcttgtaatattgcttccgatccaatgtatctgttaattagttaaaagttaaatcattttctagtaatatattgcgtttgatccaacgcatctgttattgaggtatgcctttgaattctgcttcattgagacaaaaaaatgcataatttttcttaaacccacgtaccctggattacacacaacaaaatatgcataccaaaaattacttaatcataatctatatgtttatattgtttcattacaaaaaaaaatgtcatttattaatagaataaaaattgtaaaacttataatatttctattagacaaaatatatgtcaattgagactaatccaataccaagctttaatatatgacaattcattttgtactgtaacagccactctgagttaaatatttgtgttatgaactctagtgaatatggcatgtattagaagataaacttaaataaaattattttgtatttgtttcg

SEQ ID NO: 1037 - DNA, 2600 bp, Glycine max
  Soy_ogl_6807 Gm20:37393701..37396300 Cluster 4
gttttcattttttttattttagctttctttactactatatatcagtcgttaaactccctattatggagattaaatgtaggtaaactgacgtacttgctttgattcatcatccatttttatgctactatgttagtgtttaacttctatgcctaatgctacagtaaaaaataattctatgcctaatgccttttaatttgttgttttatcacccgtaaattgttgtttgatatgatttgcggttggaaaattcttattgaatctagaactgaagttaatcacctagtagaccttgtatctaggaagagattttgggttattagcttgtatcttatcaattaatctatttaagaaatatgtcagggtttaattagtggatttaggcccttgttatctaaggaattaaggcttaattttgtgggttgattttaaaattgaaatttgaaagtataaattagataaatgttcttggtaatgcttgagattgaagtttagtgaaatttaatcccacatctttcatctaattggaaacctcccacccttttgcattttaagtgttttgataaaataaaaaaagagcttaagtgtttttatttatttctcatgttgtttttttgcttaattatacaattggttgcctcaattatttataaaagtttaattagatttttcaattcttaaatagtttaatcaggttatttaattattaaaatactataattatatatcattttcgtacaattgtaactgacgtcctcaagttgcaatttctggtggtttaaattttttaatagtgttggtttttaattattgctatatttattatgattctgcaacgtagaaatatggctgtatgtgttgtatagtttaattgtaatttttatctctaatttttaagaaatttgtaacttttatcctccgtcatgccattaataagcataagttgggataaaatttgaaaataaatgatggaggataaaatctgtaaatttatgaaaaattaaaaataaaatgcgcccaaattaatttatttgagataaaatttcccaaaaatgaaaaaaatgcactaagcctattattaaacaaatcatttttttgttgtaatattttcaaaatatttgattaaaaggataacttgtgtcataattactttgattacaattaatataattttaattaattcaagaataattaaaaagataacttgtttcataattaattactttgattacaattaaggaattaattatataattaagaaattctagttttttttaagtaaccattaagtttccttatttccaaatattaactcgtttagattgtctagatagggggggtgtttgattttccgctaaaactgtgtttaacagaatttttctactttcgaagacaagaaagtaaaagcaagttccttattaattagaatgaaagctagttacatgcgttatccaaataagttcatggtagatggttttttacacgctagtaattgttgcaaatcgtcgttgggttaatatcttacttacgcctttaaatacttgtcattgatggccttcttatgcacgtagaagactatttcaaccattgttggaaggtgactgtgactctggttttaaattttaataacgatggttaagcttcaaaattcagagttgcagaagaatgtaactaggactattttgtgttaataatcgtaacatatagagtaaaacttgcatgtttttcacacaaagactaaattgtgaagtaatacaacttattctcaaatactatcaactatacaaattaaatgattaactttcaactatgtcattatcatatatcatccatgttttccacgtcaaccacatatataagccacttcatcaacaaacttaaatcttggaccaatccttaactaaaatgtagatgtagggactacaaaattttcaatataagaattaacatttaaagttgtgccaatgtaaattaaatgatagttaaaccttacaaaaatgtgttcattgattagtcatcaaaaactatttatcgccgatgatttttcactattatcaacgaccatcagagacagaaattttttttagaaaatatttggattttgataaaatttaaattttgtaattttttttaaccgaaatatacttatatcatttcggtaataatcaactgctcaatgtaggaagtaacatggtcaaaagtatagactaagtaaagatggagtaccctaacaagcagtgacatccaagggaggcaaacaaattaaaattaaaaaaaaaactaaaattaaaatttataaaaaaatatatatttttgagttgatacatgcttaattgtttttctagtaatagatcatatatctagttttaaacccacaattaataattttaaatttatttatttattaaataattatttgttaaaagttaaatgtttaaataattatgtaaaaaaaattgatctcccctctaatacactcttagattcatccctgctatcaaacatatgagtaacatcattgatttgtttcctaacaaaataaatatcataggattaattgactccttgagtttttaaggccatcataaatggtgattttcttg

SEQ ID NO: 1038 - DNA, 2200 bp, Glycine max
  Soy_ogl_561 Gm02:15027001..15029200 Cluster 4
aaataaggaaaaggagtttttttatggtagaaaaaaaagcgtttttattggattcactttgatctctcaatcaacatatgtggcccactagtcaatgtacataaggaaatcaaatttgacacttttcaatgtaaggtaaaaagtaacaaaggaagaacaatacaagaaagccccgcccctcttgtctcccatcatctatggacagtgcttagacttctacggatctaatttgcatgctctataaacttgatgatatcggtggtctgattgtgtttttgccctaattcaagctaaatcataaataaatggcctaggcacaaggaattggcatcagcaagcatttgggtacttaaaaaagttccactcaaagggttcaaaacatgctgaaacacaagcccactttctcttgccaaaaataggcttactacctaaactagacatcaaattttcctgatagactcaaagcccttttatcttgtctgtttggtgctcttctgctgctagattctccgcaagtgagtactcatggggagagttgaattatgtggaccactcgcttttataaaagatgcacagaaacataactgaacatacagcactaattccatattcaactcgatcaggggactggtacaaactagtacagaaaatgaaattatatgctacgtgtcgaaagcccggggtggcttgtggagattttcatctggattattatcgttttcttccaactgtctttatgcagcaccttaacaaaataggaaagggatcgttttccgcagccaaccgaggctcccatcccatcatatccttcttaatatgaagaatgattgaacccacttgtagcatttatttttaaatggatggaaacattagcatgatacagtgcattattatcatgcatgaataaaacaagtaaatgttttaataagagatttcaacttcaagttctatgcagatgtattaaatatttagagagagagttttgtcttctatttgattcaaataaaattgtttcttttaaaaaaatacatgtagtttagacacaaaaagaacaagtaaatgcttaaatacagtgcatttgtaattttattatgtattcagtgagcattgtactgtgaaatagaacggtaattaagaaaacccgcatgaaattacgaggtgaggacaaattcaagtcagttacacactctagcttgtagaggacagataattttgaacccgaccggatgaactctttggatatgggggacgtcaatatgatcttgtagtttaactctttcaaactattatagatatcgcttgctatctttccacatcaacctgttgtctagttcttaaaattcttcgcatctatcattggggaattcactttcggtaatatattttgaccacataggtttactttcatgctctaatatacctatatattaaaggagaaaaaagaagaagaagcgtaattgaccgttgatctttaactatctacaacaatctcacaagtttgcagaaagctgtccttcaatgcagggtttttagcttggcaaattctggaccatgataatttttcattttacaaaataaattacctttcttaagctcctttttagaagcatgatatttttgttttagaaagagttcaattttgatacacttggctgaagatatgatttttaaagtaattattacaaaaacttatgatatttaacaatctattattgaataataatgtttttttaatatatgataccagaacgtgtcaaataaaaagagtatttatgagaacaaaagaaataaatttgtatcatacaattatatatgaatgactaaaattaaaaattaattcatatgattacttgaaaaagtggtttgactctcaaatcttaatctttcataatttgatctaataattatgattcattgttctcactatcataataaaagtcttcttactatgtgcaaggaacaccatttaagttgatattgaataaacataaattaaccaatccaactattggataattttatacatatcattttatataaattaaatatttactcgtttgttatctagtaataaacatttactaatattttaaatgatatataatatactatacatgaaaatatagtatgataaaaaaaatattaactttcaattctacggttagattaattaatttgatattctatataaagacattaa

SEQ ID NO: 1039 - DNA, 1632 bp, Glycine max
  Soy_ogl_3038 Gm09:7392501..7394132 Cluster 4
aggaaaaagaaaatgaaaagatactactgtcctttgacctcattctgataccagagtttgtcccaagtattatcaaagaaaccgagttatcgacctatggattaatgaacttagatcctaggttagttttccttttaactgggattaggtcaggtttaggcaatgaaagtatgaaacacagcctatcatgcaaattatcctatagggcatgataatgatatataagtaaattattaagaaagaaatattgacgagaatcaatttcaatacttttctgtcttgaatcttgttaattgagttaaataattaacttttttatataaaaaaattatcttatactctttactctaacaataatattcccaacaattagaatttgatctaaaattcgtatacttttttgacaaaaaaaaaatcatatatggtacactagtattgaatatttaaattcaatgaaaaatacgcaatgctgttgtgctgtcaatattataaaaaaaaaaaacatatagtactggctagcattaattttaagtaaattaagcattaaataatgtgactagtacttgcacatgaagtcacattccgtagaaatgcagtggttagccgtatgttttgtaatgaattgtgttgtcagtgtcacaaataaatcagaacgtgctaaaatttgaacatattcaatgaataaaggttataggaagagcatcgaacacgagaagttgcgttgccgttgcgttgggttcagagccacacgtcgttttctcgttggcctatgaaaccgcgttttgccttctccctccttttttatttttctacaataaaataaataaataaatatatattcgtgaacggtgacggtgcccactttcgcatattgggactattggcaattggcctatacttctgttatctctacctgacgccgttatacagagtacctcaccccgtgaaagtcgtcgaatggactcatcctttcttgtatttacccaaatacccatttcaaaatatcaattcattttttttttttgccgcgtgaaacacctcaagtcaaacatgtgtttaaatgaatgttgaataaattgattttataaaattaatatatgagtgatataatttatatttggatgttttattataagattaatttagaagtaatatttagtacaaaattttggatataatgtaaaagttactcaaagttaattaaaaaaattaaattttattttatcatgaaaccaaatatataaaaatatataaaaaaattaattttggattcaaaattaattcccacaacgccaaacaaaaaacacacgaaatagtagtatatcagtacatcctaaatattttgtaggctaaaatacaggaatagttctttatcttatcttttggttttaaattgttcttgtaacttttaaaagttataaaataatctttttatttaacttataacaaattagtcatttcaaaaattgatcattttttttattttttattacaattttgaatattttgttgattgatttaggacataaaacttgttttattagattcacctatatgaaaattataggaatcaactaatatgtgaaaaaaataacaaatatattgaaaatagcatgaaaagtgagtctcata

SEQ ID NO: 1040 - DNA, 2153 bp, Glycine max
  Soy_ogl_4361 Gm13:302171..30242653 Cluster 4
aactctaataaacattttgacatatatcatacaactcatatacaaatatatttattagacttcaccatcaacaaaaccctaacacataactcattagttatatattaataaaaaaaaaaaaccttatcacaacatacttatacaacatagatgaagaacatgaatcaaaacatacatggcagaattagaaaaacatactaggggtgaagtagaaggaatcaatacaattataggtaggaaaaaacttgtaatgggttgcactaaaccttggatttgcctacgatatgctaaacatgactttggatccttcttcttttttccctacctctctatgcctttcctgccactctcctccttcacatttcctaatttaagtgaaagttaggtgagtgtgacttaacatttacataacataaccacttattgagctcccaacaacccgtctccttttttatatttagtctctctcataaatttctcacccatgggttactctattgggcccaaatttagttaacacccaataaaagtacttctatatccgttagcatcaatctattatttaattcaacattccattgttttaggttaagagatcaacccatttgttagaccttaatagccatttataagcccttccttgtctaagcttttttctctacaaggtggagtatagttatttaattttctagttacatttttttgggggatgtacactaattggtgatgtgtgggatgggggtgggtgacaggtggtcttttattatcttaattcaatattgggctctaattacccctccatttaaccttgtagcccatctcctaaatagatgcaagaaaaacttttttccccaataatcccactattttgttcattctatataatataaaatttaagataaattgtatagcattttatattttacctattcatttaattatttgcagaatataaaattcatgtttgagatttgatgcataaaataaaaatacaatgactgaaacataattagattaaattaatgtgtaacatataattaaatgataaatattttatagttatattaattataattttaactttgaacattaaaatgattttatgaaatataagaatcagaaacaagaatgttttaatatatagttaaatttcaaacaattcataatagtttttccaaaatattatttaatgatagaaattaagagataaaatattatatattaatatattaatatagacttaatttttataatttttaattttcaaataaattagtataggtgaatgttgaaagaataagtttccgatatggaaagttttttatattaaaaatttaataaatataaaatccaaatattaatttatttagacacaatgtatttgtcctagagactttagttatattctctttggattttgaattttttaaacgtttaattcgccagatcttcagcacatgtcatctaattaatttgataagtctttggttacttaaatacaattttataaggcagaagtaactgattctatattgagaagtaatctttcatgattagtttttatatacatattttgttcatcttgtgctttttcagtcatggataggaattttgaacacaaacacgatccgagtctggtgcactcggtggaggacaacggagtatattatcttctacaaagggagggaagcaactgggatacgaatttaaaatgggaagacattacttctctgggaaaacaacaaagattgggaatggtatgaaaatataatgtcttgaaattttagacagaattttttaaatttcttaaatttttttgttacatacagcatgccccttacaaagtcttcaattccttttcagagaaattgttgcttgtttttcattgttaatcttgtttcatactctaacaaaaataatgcagtagtgcaactagtgtggatcttgaagaacacctatacgggcttgcaaaagatatgggaatcacggttgttagttcctcacaagtaagctgattatatatgtatattggaaaaaaatactgtcatggtaaaatttagtgaattaagagtacttcactaattgtttgttttgatcttgattgcctcatttccttccctagtactgtaaacttatttaattttctttagtgt

SEQ ID NO: 1041 - DNA, 2317 bp, Glycine max
  Soy_ogl_1718 Gm05:37906184..37908500 Cluster 4
aaataaaaaataaagttatttctaatatgtcttttattgaaactttatattatgaataaaaaatagttattgaaaataaaattataattaaaataaaaatactttaggaatgataacattaaataagataaaattagttatatttacttatattttaagtttaacatataatatcacttttttgcttatatgtaaatccataggaagtactataataaatattttagaatatgagaaatatatttttttaacactattttgaatatactttcctttaaaaaattacaagtcttagacccctttaaatgatccttataattttgtaatgttaaaaaaataagaaaaaatatattaaaaagagtatgttatactctactccttctatattcatatataagcaaaaataattaattttgcattaattaagaaaagtatttaatatcatttaattttattaatttcaagtaaaaaataaaattatttctaaaatgttatttattacaatttgctatcatgaataaaaaaaatcattgaaaattgaaataaaattaaataaaagatattttagaaatgataacattaaataatacaaagttaattaaagtttattatatttaaatccaataaacaatatcacttttctcttatatatgaattccaaggaagtatcttttaagtatgtgatgatagattcaattcttgatatgtgcatagaaaaaaatataataaaaaatatcaacttcttaaatgaaatgatattaattttttacttttgaccgaaatatacatgttcacaagaaaaaaaccgtgttataaaaaatatgttcctatcattcttcaaataaatttcacattttaagaaataatttaattatccatttattctttatatttatacattcttttcattttagtttttacatctaaacattacttatttcaatccctatatattacattttaaaatatttttattaaaataatgtgagatgacattttaaaatcttaggagagtacattgttacgtgttttctacaaaaagaaatttacttttttattagtgtctttacattgatttttttttacaaatgctaattagttaatgtaattgttaagaaagtagaagaaaaaatatttattggaatataaaaaattaatttccttataatttctaaacgcattttatattattttcaataaataaatttaatttttttaactagttttctttgagttactaatgagcaagatttttttattttatttttaacctgtgtagtattaccttaaacaattaagaaatgttcggtgttattgttctcaatctgtgcaacgtcgtcacacgttttcaccacatgcgattgtcagtatcatgtgtcatctctcaatttttcatgttcttcctattcattacccaatcatttgcttgcatttattatcttcacctatcgttcacttttttcttcttctctcattcttggtctcttgaattcttcccttcatttgttgagtccagactaagttgatactaaaaggtttatatattgtcttgaaattaaacaaaaaaactattttaaactactaactatgattaaaatatattagttctgatcttatgtataagtaatatgatttttttgtgttaattataagtaataatgattaatttttaaacttatagttaaatattttttatattcttaatttattactaattttatttattaggcacctattcatttgactatgaacattaacattaaatcaaataatcacttataaaatttaaatttacggatacttttgaaataaaattttaatttatgaaatattaaatctaaccatcactttgcttgatcttgataatttttactatattgcttatatataatataaaaggtaatattaaattaatctaaatcatacattttgtatttatctttcataaaaagttaaagattaatctctcaacctattaaattttaggatattactaacatgtaccattagttaaaaaaaactaaaagaaaaaaaatatttatcatataaatcatagaagaatataaaaaaatcatgaataacacaattttttatctcccaataaaaatatttatactttaaatttcttattcaatgcccactagttaacatttacctaaattttatttgagaaacaaacttttttttaataaatattttttcatacacaaaaatttagaaatcaaatctctaataactacatgattcaggagtaagattatttatctataatattatcacactgtatttgtaatgtaaattttctattaaaacacgc

SEQ ID NO: 1042 - DNA, 1719 bp, Glycine max
  Soy_ogl_3042 Gm09:7540582..7542300 Cluster 4
caaattttcaaaaaacaaatcaaacaacttgctattttcaagaataacattatataatttcttttagggtcatataaattagtgtttttttacagtatataaataagtgttctaaagatattagttaagcaactaataaatataaatattttagttaaaaacatgatgaaattaattgaattgaaaatcattattagagtatattggtaacattttttcataaaaactgttgtcttttaattttttagcctatatgttaagaatattagttaagattttttcttattcaacgcatacatacccttttcccctcaatccctgctaaatatatatcatcaatttttttataaaaaaatatagaagagagaaaaaggtaaaaaaaaaatgttaatatatagtaattaaatgtctaagtaaagtaaacttattttttaataagaactgccattgttttttaattatatacgtctgcgtcataaacagagaaaaatagagttgatgtttgaagtttattgatggagccactaaggtcaccatccaggtgattcaaccatatcttcaagtgaagactaagtgctttgtattatccacttaggaaagaatagacacaatgttttctcttggtgggtccaatttcagtaggcaccattagaaaggtggggttcaatcaatcaacttccattccctcgctccaacaacttgaagatgaagactagatttggatgtgataaatcttagggaagtaatttgtgtggacgtgctttttttgtgagaagggttttgcaatgtgacaccctacccgtctattataaagcagttgaatggaccacccccccttttttctcgtatatatacgtgcttctgtacaagagtttcaaaagtgaaaatgcataatcaagatttttgaattaagggtggttctttggaagtttatgacttcaatttttcaccgatgtccaaacctaaccaatacattaaaagcaagaggggaagttagggagacacacacacacacacaaaagatgtgttgcatttggggtaatgaagcttgatgtaatgtattggtgttagaaagtgggtttgtgtatatagtaagggatcacagtgagggtggctcataagtcctttatgagagccctacctttattttcttattgttcatccatgttatgcttgcttgtgcttatgaaaaatatacgtattttgtaaccaacttaaccgatggaaccctaaccgggccttactccatacaactaaagcaaattcaattaaaactacaaacccttgaacatgttgaattatgaaaaattgaggcttctgttcaacccctaaatacgattaaaaatgctaagataagtgagttaaaacatgatttaatgaaatagttaagtactataatgatataggaatttatccccaaagtttgaggacatttgagtccaaacaaaaaagttatgatacttttaagtatgaatgctttttttttttttttctttccgttggaaagcccccaaatagacataaaatcaaaagtaacaaattagaacttctaacaaaatacgcattggaatgtgtgtctgtccacgtaaaagaaagatcaaatacaccctaaaaaaccatgtaggtaccccctgtgggtttagcaattttggacttagagaattaatagattaatgttagcatctgaatcttgagtgacagatgactaatttcgtaata

SEQ ID NO: 1043 - DNA, 1344 bp, Glycine max
  Soy_ogl_3496 Gm10:42596301..42597644 Cluster 4
aaatatgaaaaaaaatattactttattagaagctcaacgcaaaaaaaaattattaaaataatcaaaaattgattattttattaggaataaaagaatatatttaagtctattatatataataaaaaaacttattttcttatgttttgttaaaaataatgaacagataataattacttcaaattaaaaatattgtcattttttcctttttttttttatagatccttttctttttaaacccgtacaactaaatttgggtaacattgtttgcagtaagatgattaagatgattaaggttacacgattttaagaatgccttataaatttcaactgattagattaataatataaatttaagagtcatagtgatactatatcttattcatacaaacaggattgcctttcattagaaaataactctactctaaaaaaaggaaaagtgggaactagaatgcaaacaaacatataaaataaaatcaaatatgaataagaaaggaggtacattttttttaaaattaattactcgagattcttttaaagcaaaatgggcactaagctgaggccaattgtttgccataatcctaattaggttcattggaagatctaggaccctaagtaggagaataatttatttaaaaaataaaattaattattattatcataaaagaagtaaaaaaaaatccaggacaagaaattaaaaaatataaaattagaaagagcaaaatatacatatttaagatattatatgtatttttttttaaagtgacacccctcattcaagtttggatctgccattgaggttggcaccacaaccagcaaggccaaaataacaaaagcaattagtcaagattttgataaattggtttatatgcctttttctagaatatttttttaataatgagtctatatatataaaaaaagaagtttatatgctttttttttctttagtgggtgagtaattttatatttttcacgtttcatccaatttgacttttttttaattgtgtagcatcattctttccattacaacaatgagttagcaaagggtcaattccgatagacaaagtccaatgtgcgatttaattccgttggaacatgaacacatgcattttgagaagaaccgtagacatagtcataatctaagcatcttaaactttgaacatgatacacaatatctgtactagttaataacccgaataaattttatttattctgctgatcattactgacaatgtgactaataatttttgttagttttgaaacatgatttattgtttttccattgaaaattggcatctgattgttagaagattgtggggaaggctttattaagtgggcactacatct

SEQ ID NO: 1044 - DNA, 1690 bp, Glycine max
  Soy_ogl_4170 Gm13:20428011..204130 Cluster 4
ttttttgaaataaatacttattttaataaaataagtaatttttcattttctttagtgtgtttgactaaattgttcgtacttaaaaaaaataatttaatttctatttatttcttaaaaattacttattttaagtttaaacaaattcaccctataaatgagttagtttaagtttaagtttttttaacaaaccaagctcaagcttttatttaggcttgataaaataattaaatgaatcaaatttgagtaattaattttttttacaagtcaagtttaagctttaagaacttgattcgtttaagctcttgtatgacagtatgacacattatgatcataattttttaatatagaaaattaatgtatttatataatactaacaattaacattttttcattagtatatgactttttttttgttttaattcgaaataaatgactcggtttgaacttgggtggtttagaaaaacaaagcggggattcttacaagttgaaaagcttaacatgagaaatcagcagttgatgaaagttttgtcagccaaattaagaagctacagctagtatactagctagtactgaagaaagcaacgctagctaaagctaggtcctcaaattaaagattgaatgttggggtttcgcatgtatcggaatcaagttcatcagaagaacaaattaaatggtggacttgcaagggacggttagagaagaaagttctcaagttgatgtattgattcggttattaatttggaattcttagaaggggttcagaacgtaaacttgatttccatgggtgcaaataaccatattacaggagggacaaccattaatcaattagccttcaggctgaggattattgaggttcgtaccccaaaacaacagttcatgaagcacctaatcgcaagtaatatttgctttgtgtatagggttacttaagcatccctgcatgatccattaaacacactgatatttagacattccctctaaataactttactcttgtcctgagttagtaaatttttaatataatttcttggtactgagagtctaaataactatactgtaactgcattgtccagttttatttttaaaatgatactgctattatattataaattaattgatttattcttttcatcttactaagcaaaaatatatataaaagatgagaacaggctaggtatcacataaccagatatagatattgtaataaatcaacatccctttttttcttcagggttccctacccatggagaaaaaatagctaggcacgcccaataattctaagactaataaaaatgtgacaaaaggtaaatgaaatgctttgcagggcagtgattgggacgagggtgcctaccaagaactggcgtaatacagtgccaagtggagcaataacaatagtccacgtcagcagtccatctctaatatatatgtcccatggcagtagcaatacttgatgagattaacggtgatgaaatattggtgtaaaacattttaaaataattttataaaaattaataaacttattatatataataatttgtaattaaataacattataaaattattttattctattacattcatacataactaatttttttcatacttcattgtcaagaagttcaaaccaatataaaagacaaatagactgtttttgaaagttcctcatgtccggtatatcatttttgagaacaag

SEQ ID NO: 1045 - DNA, 2499 bp, Glycine max
  Soy_ogl_6309 Gm19:716102..718600 Cluster 4
taggagaaaataaatcaagtattttacaatgatatttgacattatagagattcaaaggataatgcggtacattagaattcaaggcatcgcttcttaatatggtatgaacatataaatacataaatcgatttcatttaaagcgacaatggattagtgactgtggaaggctcaccattagaggacacggcatgaaagaattgtggctcgaaaggattgcaaatatgaatattatcatgagccattgctatgatttccttgtaaaattgaagattgttggtggttgtgaagctctaacgaactttccgctacatttgtttcaaaaactccattcgcttgaactcaaggggattcgtaatctacaaatgatttcaatggagcacactcataatcatctcaaaggatcttgaaaatagtgagtgccctcaatttgaatcatttcccagagaaggattatctactggagaaagattaatcacattaaaaataggagaattttaggaagaagatgaaccacaagttccaaattatacatgcaccaattctcatgtttacctctcttcatgataaggtgccaattctccgcaatatctcagcagcttttgaaataccatcttgtttgttgcaaatatttcactctctagttagcatttaattcattagcaaacaacagcaaaacaactaacacacgtaaatcgacaagtgtttcttcgtgaatcaattttttaaatattttgttttatattcaagaatttctattatcaatattcaacaattccaaccaaatgtgtttctaatttttaggacacaaggaaaacagagaaggaagtgaagtgcaaaagttctggcatgtggcatcctttctgtaaggagtactctgtcattgggagttgtagtggcatcatcttcctttagcttgttggtaaatttgttttcttttccaacctcctgcttttttccttcttacttcatacttcttacattatgttatggaagtttctgaaaagaggataaagaactcaaacttcataaacattataatcacaccaacccaaaaaatattaatatgcaggttacaagggaagacaaaattatctatctgaatggagcaaatgatgttgacatgcttcaagaggttgatattggagttggcattagcagtgctgaatcgatgccaggtatagggatacatttgattatacctatctgggctgtgcttttacctgtccttaaaaagatttatgttcttccaattcataataaatgaagagaatttttaatttaactagggaagtattttgtagagcttaccgaatttttttttttttttttgcttattctaataagtttcgttatcaaatttgtggcacaagatgttatggaataataacttattgaacaagtacataattaagttgtttaactaaacgcgtacccttcatctaccatgtccactcactaatattctctactcttttgtgttgtttaacatgtggtcttaatatgtaaacaagcaggacttggtagattatgttacattatggagaaattgcatcatacataatcgacccagttgtcaaacccatatatgcttgcagcacaggttactattgtaatgttatccacagaatataattgttagaagtgctatgctactccatctttttcatcaattgttcatcttttattttcttcttttcttagatatataaaacctgatatcagatattaaatcctttaatttctgccattaggctgatatttgttgggatataaaccataaaaccttatccttaagaaacaatgttcacaattaaccaaacaatatctgatgtgtaaaaccatgcatccatcaattttagtgttcaccctcaaatgcatccaattttagttgcctcaatattctgaaatgaagactgaaatatttcaaaaaaaaatttcctttctcttattttttaacctttggtgtgttgatttgttctttctgctgaaaattgattcaataattttctgtttgcattttaagagtactacaggtttgggaacgcaataaattgcatcatgcctgttgaggtaaaatttaggtctcttcatccacacaaaaataaaaaaataaatgcactgataacttgtttcattttttatgcaggttgatttttttttcaataaaaattaaaaagagtccattttgatttaccctatttcggtttgaggcatatgcctctttctccggtcaagctgcttacaatgattggtacatgtcattttacaatgtcttcttcactttacttccaataattactgtaggcacttttgattaggatgtttctgccaaactttgcctgaaggtactaaattgtcatttctttaaaaaaattctgttattaaagaatatttcctctgtaggacctttatatacactactagaacaacaacaacaaaaatatacactactagaaaaatcaaaattagtgacgagaagttttaagacagaatatattc

SEQ ID NO: 1046 - DNA, 1321 bp, Glycine max
  Soy_ogl_3041 Gm09:7536232..7537552 Cluster 4
ctttaatggatatttttatgacattgatcaggcggtagtcaatttttgcataataatatttgaccgcgcaattttgacttatgagtattgagaatttgagattataattcgcacacttaccacgagcgtgaatattcgatctagtttatgaaagacaagcaaataatcacattccattcgtaattaatagattatagatttcaccatatattctcttgggaccgaattcagttgaatttatatattacttgctggttgaaggacaaattgtaaaaatccagtctaattattatatagagcactcaaaagatatgagaatattattgataaaggcaaagatataatgtatataaataatattaaggttctttcactaaaattgttacatgataactttaatttttaaattctcttatttattttttcattaatttttattagcttttaccaattttatctgtacatttcttgattttttttcatattaagaaattcattagtttaccaacgaggattgagtttaataaatgggagctatagctagtttctcaaaatattgcatgtaaacaaaagttcgtattttcactaagaaatatatctatagtagtgtctgggcaatccgtcaaacaagattgtgtcactaaagaaggatattctgggagataaaaaacaaaaaaggaattcattaattttaaattaagtaaaaaaatcttataaaatatttaaataaaaaataaaactaaaaagtaaccacaatccacacttcctagtcaatatataaaaatttaaaactaatgtcatgacatatatttatgttttttatttaaaatatctcatatacttttcttagccaatatataaaaattaatctcctgtcatttttcaattactagtatatttttagatgaaatttgatatgagagatttaattttaacgaaagaaaagttacaatgtatgactaaacgttcataaataaaattaggcgaacagattcatataagactgaagtatcatgataaaaagattaatgattaaagctaatactttatataaatattatatattaccataaagtgagtctaaatattctatatcaacatggactattgtaaccttggtacttctggcaattatataattatgcatgacaaaaaaatatatactcctagatatttgcggataaaatttgttataggtatggtacttctggtaattagtattttttaagatacctgctacctgtcaaattatcaaaggaaagaaccacaatttcataaatctaattttgattttgttttacccttatgctcacgctcaccc

SEQ ID NO: 1047 - DNA, 1900 bp, Glycine max
  Soy_ogl_3172 Gm09:386251..38657100 Cluster 4
caaaatgtaaatttatattttttacattttggattgagctttctgcaaggttaaaatgatgcaggaagcacatcggaggtgaaggaagcaattgcctgagtttggaagttgagattcgtgatctagcccatctacaataacagtttggaccttgacttgttttattttggcaattgctatttccacttgccaattttgctaatgcactccccttttaaatttgtttacccaaactaccctctaaccggaaaatagattctggaatttctctacactccctcttttttcggagtctaatttcccgaagccaattctattaaataggggattaatctgataatagtatcaaattagtgtatggaatgagtgcatgcagtggcggggtttgaaaacgggtctgtcataaaatgatgtgcagtgtgtggatagaagcaaattcaacctattaaaataccccgaacaggattgcaccaagatatcgatctctcttttgagaaaagacacaacacgtaacatcatggaccaagtccaattctgaaatttcttgtctgacctgatataaacaggatatggagagaatcacattccactagcatcattcttcattaccactgtttctgccttccaactgttcgataaaactcccagcccaactgatccttctgtttttattaaagccatacaaatcccacctatctccataggccaccacatattccctggaagtgcctgatacaaggtcaacaaaacatatctgtctaccctccaaggcccaagcctcccaagcaagacatatttaaaaagccaagcagtttacaagatttattaacctcgctgaaagtggatagattatttagagtatcgaaagtcagaatgttgggtgcaattagttggcgacaaggacattatttcacaattggcgtaaagcttgttggtactgaaagagagataaaaggatagctttttgatagatacgaatttttgtattaggtggagaaacatgtatgattcatgttgcttgaatctttttctattgtggtttcttgaactgacacgtcttgtgcttttttggattttttttttttgataaagattttgcttatccaaaaaaatattccttaaaggggggagtgtaaatacattttagagtctattttccagtacgaggatattttgggtaaacaaatttaaaagggagtgccttataaaaaaggaggagtagaaagaacaattgcctctatttttaaacttcaacttactcgttaagtttggacctcaaagacaagtttaacttattgcccggtgcttcttttcttgagtattagaggtctttgttatagccttttttggttttgttttgggccttcgaagatttctttgccaatctctattcctttatttttttggactttgggtcttcccttggacagactttgacagttgatataaaattagatgttagacttaaataattttttattgttgtaatataggattgctatcattttggttttctttattttttctctcttttgatccttataaaatatttgcatttgattttggtcccttgcattactactatttcagttcctatacaattgaaaactttttattatataaatctcttttatattaaaaaaaaattcattttagttccccttatatatagaaggattttcattttagtttcacttctatagggagatttccattttagcccttacataatactgtaagaaacattaaacttgttttcaaattttattaatcatatcacttaataaaaattatgaaattgataactaaaatgaaaaacaaataattaatagggatcaaaatgaagaaattttaagaggacagaatgaaaaccatatattatatagaaactaaaaaacta

SEQ ID NO: 1048 - DNA, 1382 bp, Glycine max
  Soy_ogl_6527 Gm19:43010456..43011837 Cluster 4
tgattgaagtactaattttggccagaagaaactattacaagtatttattaaaatttgtgatgtaaatggaccgatatatttaactttaaaaaaaaaaggcaatttaaagaaagtgttcaaaaaatgtttttaaaaagcagatcgtaagattttttattttcttctataaacataaaaaataccttgaaaaaaattagacaaatatatcagaaaagccaaaagttacttatttcatacaaaaaataattttttaagtaaacttaaacaaatggacctaatatctcataatttaagggttaactttgttaaattcttattctgtgaaaaaaatcaaatataattatcattcaagactctctcaaatttaattggcaaggacaacttattttgaaagaaaatattatcaaatttgatctacttaataattttttatagacaatgaattatgttaacttaaatgttaaatagaatttttttagagagtaaattaagtctataaaacttatacaatttaaaaatctagttgtttttgacacataacataatttttaaaataaaagtaaatgtcgaatatcaaattatatatttatattaatctaagtttgatatacataatcattaaaaaaacatttcagaattaattcagtggctaaatttaataaattcatattttataaaaatagttcagtagaataatataagtattcaagatttagtcatgaacaaaaaatattataacataagctactatattataagaatttatagaatatattaaattgttttttctaaatcggcccttaatacttaataaaaaaagtgcttattatataaagatttgtgcataaattttttatatattgtgaaaaaaaattaagaaaaattgtttttatataaattataaaatatattcataatagagaacttattaatgtaaacttaaaacaacttctaaatatgttataaataattatcacaactactttttttgaagaaaaaatatcttaaacacttgcataagtatttgtagtctcctaaaaaaagtacttatttatagtagtacatcataagataaatttaaatatgttttaaatttagagacccaccttgatcttccattcttatgaaattaactcaacatacttatatagcaaataaaaggttgaagtcaaccatcgttagtcaatagacttgcccagtcgtgtgatgtgctggtggtggtgaggacttgatatgatatttttatttttatttttgcttcgtaggacttgatatggtattggtatagggtgagacgaaggtggattttgtcatttttaagttaattttaagaaaatgagacttcgtttagtagaattggtattttcgtgacagcaataatc

SEQ ID NO: 1049 - DNA, 1281 bp, Glycine max
  Soy_ogl_1901 Gm06:10892620..10893900 Cluster 4
tttttaatcttttttaattctttttgtctatatatataaggattaaaaatgattaaaaataatacaaggattaaaatgattaaaaataatatacataaggattaaaagagataatttttaagtttagatactaaaagataaaatatgtataatcataagaacaaaatacgtaattaaaccttctaagcatatgaactaaaagataaaataggtataaatataaatattaaatgaggaattaaatcttattaagttaaaatgacaacttgtaattactaactagaataagcgaaggaggctgaaaaatgagacaccggatttttttcatattaataattctaaaatattttataaaaatgttaatcaatgctcttaacaattaattatgaaaataagattaatttttttataaaaaaaatagtgatattttttacgtatttttttcatagagtttaatggatattatttaactaatatacaatacacttttaacaagaaataatattaaatactactatatttatttattatttaatagatttttgtttttatgataattagtaaaaaaaaaaaattcatgttgttgtcaacatcaacaaaaatattgttctgacacgactatacgcgcccacattacattgtgcattaacgaataaataattagtttcataaataaagtataacaacacaaagttgaaaaatataatgttggttactttagagtataacaacacaaagtatcaattatattaaggtcaatgttaaccgatattttagaagtattgatgaaaagaacaaatcaccaatataattcccgaaattgtaatgatcaattaaattggtttttaatattaataaaatagtaaactagttttcaaattaaattattaatcaatttagtatctgaaattgcaaaattatcaaccaatttaatttctgaaattaaaatggtagatcaaattggtctccattttaaaaaaatagcaatataatcctcaaaattataaatcattaatcaaattagttattttgttaatagttggtgttttctaacatcttttaaaaggtttaattaacatgttaaatgtttgagtgttagtcaatcaagcacaggtgtgattgtcacctcacatggaagaaaacaaccaaaaaattaataaaagaataatatttttttttcctttctttggctgttgttattcctttgtccattagttttgcactattttttttttcaatcattaagagaatcttgtcacaacaccccttaaaatcaagttg

SEQ ID NO: 1050 - DNA, 1315 bp, Glycine max
  Soy_ogl_2415 Gm07:38239886..38241200 Cluster 4
gatgcggacagtgcattgttgaatattgatttattccagaagttgccgcccttccgaattgcaattggcattgtgaaaaacttaaaactgatcgatcagtcatcatatgttacaaattattattcttcaaagtggtgaaccacgataaccccaccctagctagctgtcggaaacatattattttaacaattaataacatttataaatatcatcggcatggaaagagaaatgaattgagttttttttccttaaaaaacagcacggagagagagagaaataactgaaattaaaaaaatagtctcttttttttttacagaaaataaaaatatttgaaaagctaaggtaatctctaactcagtttttctattttattttcttaatttttttagacatgttaagttagttttactttttttattattgttattgttatatactcttatgtatttttacagtttaagtaattttatttgtaatttagtcaaattaagaaaaaaaggtagatcccataaatcatattatattcttacgtttcattaacattaacttttattaagtcataattattttaattatggaacaacaaattataaaaaaaatcatttctactttattttatgtgcactaaagatatatatctttcaacagatcagtggtggagttagatgggatggcaaaatatataaattactactattaaataatagactttttctatattcttttattttcaaattttacatgttggacactaattacttatgaaatcataattctaataatcattaaatatgatatgacaattttatatgcaaagttggttaagaaaaactaaattaaacttcaacatttataaatgtctaaacccaagttttgcatatttaatcgggtaatgtgaagattaattttgattggactgacatcaacccaactaaaaaataaaataagaaaaaaagttaattactacaacacaagctaaaagatttaatccataaaattgctgtgtgaagtaaaataatatatattgtggcactcatttaagtttttcacttaacagaaatttatttatattatttattgcatcataattttttgttttgtctataaaagacatacatagtggaagatttaataaataagattgtaaaattgaatcaattttattaagtattttatcttgtcataaattttgattaaaaaattatatttttatataaagaaattatatataaagtattgaaaataaaataaattggggatagtttcgccatagctccatttggacatcaggtagctaagcccctgcaactgatgt

SEQ ID NO: 1051 - DNA, 1300 bp, Glycine max
  Soy_ogl_5310 Gm16:5212201..5213500 Cluster 4
gaggaagaaaacagatggataaagagtgatagaaaaacaatagacgtggtgtttcccacacaacttatttaggatatcaaccctagacagtgatgttcagaaactagcaatgtttccttatttttccttatttttttctcaaacattatcggttttgattcgtgtatagccaattccgtattggtacatcaatgatttggtgtgacggcaaaatcttttttccccccaaagaaaagcatgctttttactgtgttttctcaatggtaagtactatcttttcgtgtgaattttgtcaaaatagttttacgttggacacttatgattcagtttaataaataaatttgattgaagataaattgctttgtatcaatgaaaacggacaaaatgaaaccgtgttcaggtttgattttgactttttaagttggttttctctttttaaaagtttaaattgctgtggaagtttattaaaaagtctgagtgtggatttgaaagggtgtcggtaacataaattttgtttaaaattaattttgaagtgattttattattataaaattaaattatgagtaaaatttaatataaaattttgaatttaatccaaattgattctggactcaagattaattttaattttttttaatataaagttaaatatataaaaatatatttaaaattaattttaaatttatgattaattatccaacgtcaaattaaacactcggccttataagttaaggaattttttttctaaatatttcagtttgctaatatattttctcaatatatttgttgtttctttcttttgttatggaagtgttaatcgtatcttgccaatttatttttcttgatcttgaatttatttttcaaatagtttgcatcaggttatataggctagtaatttatttttcgcaagtgattagttcattgcttttgttgattttgtgttattttataagagagaaatattagtaatatattttttaacatattctttaaagtactttgtttattattagttgaaattattagaaattatacatttaatttaattttttcacactatttactcattaaaaattatttttgatgtaaaatcaataaacttacaatatataatgatttataattttggtgtgattgttatcatgatatttaatataaaatattcatcatcttgactgatgattatttttgttaaagaatctaattagatttcttctttcaataatttttttttcatccacttgaattagactggtttccaaagttatattaaaattttgatctaatgtaataaaaaata

SEQ ID NO: 1052 - DNA, 1564 bp, Glycine max
  Soy_ogl_5764 Gm17:38686401..38687964 Cluster 4
ggataaaaaatgtttatttatgagtacatggccaaccatcacttggactactttgcttttggttcgagcctttatgattcattctaaacatctattataatctttctatttatagtttaggaaattaagaagactgcaactgccatgttaaatgtatgtatttgactagatgaaaccaaaaggaaggttctatagattggcgtaagcgtttcaacgtaacataactagtggcattgctagctagaggacttttgtatcttcatcaagagtctaggctaaggattattgagagatctaaaaactagcaatatttcactagacgcaaatatggatcccaaagtatcatactttggcttggctcgatcatttttgggagatcaagttgaggcaaacacaaataggaagctgaactgtttgttgaagtattaggaaacaatgcatgttctctgaaatcatgcgatgcatacaagtagcattattatgcacgtgcaacaatgaccagaagatatgtcttcagtgtttttaaattttaatgttgaattatgataaattattgtcaaagccaaaagttcctggcttaaacactgaaatagatgttacatccgaaggaaattctctcgttagcaaatcccatattgtgctcagttaatgaggttaatttccatcacaatgttagatgcatgataggaaatggagacaagaaaatgttaaggattcaacttccaattcaggatatatgataatttatttgatcataacataataaatatataaaggttcttgtacaagttcctactttgtttcatgtatcccaagagttctatatatgaagacaagaattgttcattgcatgtgcaatagaatgtgtttgtaaaacttctccagttcttgacatgataaaatttagacaccctttttttttataagaaaactacaaaataactattagttattgaaaattatttcattatttttaaatcttgcaactcctatttctattttatttctttcatactatagactattttaatcttcctacaatttcacatctttttcaaagatttattatattatttatttactttttaataatataatatattaaaaatggtaatatactctaactatatagaatcaaatagttttattaaaatcgatatgtgaatcatggcattgccacattagattttaaaaatgctcatatttctccaaatcggatcaacaaaataattttctattttcatttaattctgaatatttaaaccttttatataatttctttagtatatattctttaactaatcaataatcaaatttaggacaaaattaaataagtatttctcaaataatgaaataatatttttataatgattaataaactaattattaatacactacttgtgctatcaactacaacttaattctatagcttgtttcgtcacaataatatattaccatattatttatcaatatcgaaattcatttttatcatcacttcaccattagtaaatcaaattatgaaaacctcccaaaaaacatttaatcaatttaaatcgtgtattta

SEQ ID NO: 1053 - DNA, 1200 bp, Glycine max
  Soy_ogl_6751 Gm20:34613201..34614400 Cluster 4
agaggtaggtgtatttggcaaggaatattggtctaacaataacgactgaaccagcgacgaggaaagccaatagaactccctaatgaaaatggaaaacccagcattggtcattaaaatgcatcgatgggctaaatttaaaattgtctttataagcagaatggtaagtcaagttgattccaaatccaaaatgctacgtgacaaaatatcagactgcgaatcactgacaacttttattaaaacctctccttcgccgcataatacgtggcgctttcctacatcgatttctctgcgaattctcagtttcttcctctagtccctctcataagcacccaatttaccagaatacgagaaccctttgttctcttctttgggttttgcaacataccaccaacacataaatcaaaagctaaccctataaatggaacaaaaattaatcaattcccttgaattcatccaaatcacactttttttattttctatgttggccttttcaataatgcgtgggtgtcttgaggcacttttgctagaatgagacacaaacctgattataattataaagaaaaaggaagcaagtcttctaaagatacattagtttccaaatactaaagtccaactaattacatttaactattttgaaacaaacacttacgtggcatctttgaaggggtatataatactacttctgccttttttttataggaaagtttgataaatttgtcttaatcttttatataaatttcttttcaaaagtgtttgtgatattgttactttcttatataaaagagaagtgatatatgcacatttcaatattttagacactccattgaaatccttcaaattgtctctatctttcttttttgttacattaaatatttataacttttttctatatgtgtatattgagtgtccaagaaatattttcctatataaaaatactggtcttaattagagatacattaactaattacatattgtacgttaacaaatttaatactattaattaaattaatctaatttgctacttttatgtagtgattaaatatcattctctccctctcactcacaacttatataaaaaatgttaattaacttacataatgttaataaaactttttttgatacactcttttaaatttaagtcatataatcatatatattatatatggatagttaacattaaaagctaataatcgtgtgatc

SEQ ID NO: 1054 - DNA, 1404 bp, Glycine max
  Soy_ogl_2684 Gm08:62055..63458 Cluster 4
attataagtaatacttttataaaattttacgatgattgagaaaattgattgaaattatttaattttattaatttcaagtaaaatttaaaattatttctaaaatattattcattaaaaatttgatatcataaataaaataaaattcttaaaaataaaattagaattaaataaaagatattttaggatatatatcaactttttagttatatatgagtttagagaaatagtatttaagatttgaatttgatatatcattgattaaattgaaataattttatttcagttaatctatacacttgataattaactcatttctttagatatataaaaattgtataactttttaacttatattttctcttttccttttaaaaatatataaaatatataatataattcatatagtacgtattacattttgaaatcttttaacatataacgtatttaaaagatgtaatgattatttaaaaaaattatggatccttcttttgacagaataataataataattatggatttttttttttacagtatggatcctactatccctaaatcagagatattcaaatgataatatggaccgtatattcgtcaccatttctcaaatagtcaaatctcaacaacccactacttcttcttttgttttaaacttattatagtccctagacaatgcaacttcagcgcaaagaaaaagctagcccatcatcaacattaaaactcaggattttacttcaaagatttattttaatacaacataactatagaaatttttatattattatcaaaaatatatattattagattaataaaaataattcactatcaggttatttaagaaaccttgtttcttaattgatgtgttaacatatcattaaataataagtttaaaaacttcatactgtaacaatgcgtagttatatcattaaacttagttagcatcaataaaaaatgtttgttttcacagttagcatcaataaaaatctttttaatgtactaacacagtaatacgtatgtagttatatcattaaacttaccaacatttacacgctgatatagcaagatgtaaaaagtaacctcgtgtcataaagttatggttttctttatatcaagcatttcacctgatttttggtttggcttcactttctgtgtttctgattgtcaccgttcgttgaactttacaatagttgcatcgtgcgtgatttctccggccgatacagaataggtgtaaaactataaattttatgagtttaattttaatagtattttactacaagtgaaaagtatttattaattatttatttccgctaatacgtttgataaacttgactatcatagtctgtttaaggtttgtaaaataattttatatggaaaaaaatcttaaattattgtttcattcacgccaca

SEQ ID NO: 1055 - DNA, 1290 bp, Glycine max
  Soy_ogl_5289 Gm16:4361501..4362790 Cluster 4
aaattttcgtatgtcagcatagcttttgtcaacagaaattaaattattaatataaatgtaatgagtttaaaaaataaatgttatacccggataaccattaaaaaaattaatggtagttataatttttaaaataattaatttaaactttataaacttacatacataataatttataactgaataacaatataaaaaatcttttcatttttcggtgcacgcaccatttatttaaattgtaattattttttatttaaattgtaattattttttgtgtaaatgtttatgagattaaacgaattagataatatagtaaacatatattcaaaatttctaatactgattcagtaatcatgtttaaaagacacacatgaataattatgtgtttacaaattattttttcaatttttcatttaattaacctatgatcactaaatatatggatcaaataacataaaattattttagttagatataataaaacatgtttaactccaacatgtcaacctatgtaagaagctcaaatgggtttggttagattgaaaagttcaacccaccaatccacacagcccactaattttaaagtttttgcgttcaaattttatgaataaaaaaaattaattgaacattttagtaaagatgatcagtcagttttttaataaatattaattattaacaaaattaataaataatctatatcaatcaatgtcatcatgataaataaaatgctcaaaggaaaagatatctatctttaaaaaaaactaccactcgatgcacatcatcagttgtgtgttgaaattgtataattaagttatgtattctactttttgacattaaaagttttctggtagttctaatttatttcgtaaaattatttatttatagtaatttttaattttatttttcattaggtttatactagaaatggctaaagtgaaagttattaagatcagagaataacaaaaaaaaattcaaaagaaaatttcatctatacaatttcaaggagtaattaatgtgaaattttagttgtatacgtacatactaatttattgccgaggaattatctgggaagtatctgatctctcgatagcatgacccttgttcaattagattaagaggttcttatttcttctgttaatctaaaataagctttattaaggcctaaattttcaccgattgtacttcttagttagagtcttagagatttcacttttaattaataaatgcatctcagccttatcggattaggagactacacattagtcattgatactactcatatattccaatgtg

SEQ ID NO: 1056 - DNA, 1100 bp, Glycine max
  Soy_ogl_3495 Gm10:42591701..42592800 Cluster 4
atagtaaaataaaatcatatagggcaatatataaaaaacgaggttaggtatatatgctagcaagattaatttggctagcccttcacaggtcaacaatgtgatgtatgattgtatgtcatatttcagtcaaagaagtaatcacgtccaaaacatttgcttggaggatcagacaagaaatcacgataagaccaactatattgttgtggcttgttattcgattcatggaaatttcaatgtacctgtaccttaaatcaacttcgagaattatttttatctcgtctttcgtaattctaaagtgctgccattaaattgatttttttgttgtctactttgtcttcttcatattctttctcatacaactttctgaatttgagtctaatttaattttaaaaattatctcataaaataaaagttatctcatttatatattttatcttatcattatttttacctcatgagaaatttgggttttcccaataaaaatcaaatatataaatttcattatgagagcaatcgccaccactctgttgtttaagttatactttataagattctatgcaaaaatatgaagcacagatatgggtccttgacactgccattttccaatgaaagacacgggcatgtccatgttcatttaaatttatttattaagtttaattagcagcgtatagattaaaaagagaaaactgtataataggtagtctcaaaaattattttatggcttatttatcgtctaattaagttactttaaatatcctcccaattatagattaattaataatcctgaaaatgttgtactattggaaaattaagtttaatttttattgtggtcattgtaaaaaaagtattttacaagtgaaataggttaaatttaacgaatgtgcttttttggcaagccctaaaattaaattagaatggaaagaagctttgatgatggatatatatgtgtcccccctatgcattaatgtgttatgcataggtgggtctcatataggatgcaacaaaacaaaacaaaacatatattactcaaaaaatccaactaattaacttgactcaagttatggtgggacactcttacaagaactagaccagggacacta

SEQ ID NO: 1057 - DNA, 1616 bp, Glycine max
  Soy_ogl_213 Gm01:48896501..48898116 Cluster 4
tataatttgcagtggcatattgggtttggaaagatttctacacatggcttggtttaattcttcccttgaatgtgaaacattaagttcatacatgctaggactggtaaagggaagaaggtaaaatatgtctggaaagtcttgtaactctattttggtctctatatatggttgttattcagaaaaagtattatgttaaaatatcagcaggtaataaaccctataccttttagaatcgattaattcaggtcttagtcatagctattagcttaagatacagaaaacctcttttttcttttgtggactggtgctttatctggcgtataattgatgtactaattagttagaagtgggcaagaccagtctcttgacgtgtaaatagaatattatagagtacacttcttatactccttttaatatatattttgcttatagattacttcttatgtctccacaaacttagagtcctgaatttgcagataaattaaaatctcgattaatttaagcttaattaaagtgatatatagatatagtcatttccaccaaaatttatccaagaattaatcacgagccatttacataaaaaaaaatctcttcgatccaataattaatcataggctctttgtttaaaaacccaacatttacttaaatagcatgcacaccgaattgtttttcttatttagttgagtaaatatctaatgaacaagaagttaagattcgaagcaatatatatcacaaattaataaaactccagtttatacctgatataaatttgcacaatctctagcttaaaaatgataaaggataattcacatctatattgcgcatatgtgtaattaatttcactttcattctccttcataactaggaaatatatagagagagggaacagaaattagtgttgtccaatttagcacactacgcaatatatagctctccttcatatcagatttaacacactttaatttgcagcaccaagatctattgtttctagattttaacactcatccttgcagagactctcttatatattacaaaatttaaactctagcttcacagaatagtagagcatgtagaataacttggacctctactacaaatactagataatatcaatctactattttgtgtcgatgtatcttttatttatagttcctacaagttgattgatgattatcttgtaaaaccctgtgtttgatataatatgaaattatataataaggtaattcaaaaaaatgttataatatattttaaatacaaattattagagtatgcataattgtggacagatccattcaggagaatgtgaggtaactatttccactaaatttttaattctttttaatataatatatatatatatgtaattataaatagttttgtagtataaaatgtactaaatgattaatttataataaaaatattgttctcattaatttattcctaatctcattttcttaatgaacattcataatattatcttttttctctctcttttgaatgtgtatttcacatattatcatctaacttatgaaaatttgtctcttagcaatttcaaatatttttatttgtttgcttgaaattcttaatagtatatttctttcaagttatcttttatc

SEQ ID NO: 1058 - DNA, 1638 bp, Glycine max
  Soy_ogl_1950 Gm06:147251..14756838 Cluster 4
aaggttatggtgtaacaatggttacttgcagtcagttgcattgatcgcagtaagatacgtgctagactttttgcttttgccaagaaatgaggcttttcgtgctatgagtattgatgtttatgacaaggtcgatgcagagagtgaaaatatcttgttcaatctcacggacataaattcagtaaattattgatttaatctttgaaattgaacttgtattaataagttaaactgctctttaaaattaaaataataaaatgagttttatagggtctggttaataaaatgacttctgaaattgtaaatccttgattaagttagttcattaatgtctgttttattttaaaaaataaaaatagagaggataaaaagaaaaaaaaagatatttgagcggtctaaaaaatagagaggaaaaattgaaacccttaaaacatctactgaagagcaattggctcactagagtaggagattgctaaaaaaatcatcaattcctcttccatctcacatgcatgatattttcttattatcttataaatgcttgtagaaaaatttatcgatacaaaacctatcattgcaaataaatttaccaataactgtacttcataaattagaagttatataaatctttctaactaattaatgaataacttatacagtggacatttcttttaattgattttttttgaagtactgtttcaaaaatatttttaagaaataagattgatcaatatcataactaattatgctttaatcttttatataaatataaactagcatgatatgatatgattactaaataatcttatctcttaagtctatcattaaggatttgatcctgatacaatatatatattgagaaagaggtcaatcttttataatgttcgatcaggtatttaattataagatttatattataaagatacgtaaaaaatatcgtttaaaaaattgttgctttcgttttgtaattaggttataagagattagtctcttatcaaattgatattctgaaaaattcaaaagctagaaagttaacaaatacattctacaaagtactcaaatagagttttaaaaaattatataattaatcatctcaacgcgataatgtttaatgccagttattttacaattgattttaaacggacagctgttgaatatcaaagtccctttttcacttagactgagtgtgactatatagaacacatccccacattcaacaatacagagaaataaattgagttgacttatggtttgaagttaattaggttaagggttcaactatagctcctaaccagtaacctcatgggtccattaatttctttgaaacaatattatagcttagggtgggaatagtctattttttctgtgtgagaaagaaaccactccggaatcgaaaatagcccgctcatgatcatgtcgcacgtgaaacccattacgaagaaacaaagaatctggtcttatatcccttaactcgggcctcctgggccatgctcttcgttttcttccaaactactaagactacatatatacaatgtaccaaaaacgagactacatatgtataagacttaagcccatacttgtgaaattcggtttcgttattaactcaattgagataatggattaatgagtcaatgatttgatttg

SEQ ID NO: 1059 - DNA, 1800 bp, Glycine max
  Soy_ogl_2280 Gm07:8154301..8156100 Cluster 4
atcttttgttagcgaatcgtattggtaggttagaaataagtaaaagggtattaatcaactaaagttaattaatttgctaaggaatgaattcatattttagaaagaggtggatttaatttacactgccgatgtgagaatctcattaatgagttataaatgtaatcactctttttaagtcttgaggtctgttttgatactattaaacgatataacttaactaaacttttttttttatataaaaaaagtaaaagggtagtattatatgagtgagtgacaaacaggtcactcaaggtaaaaaataaaagagtatcattaaagcatttttaaacaaacaggtcactcaaggtaaaaagtctactaagtactaacccattctcctaacttggataaaggtccacatataaatttaagactttaatattttttttagtctttataatataggattttcattattatcctctaaaagtttgtccattttggtttttatttttaattttagtagttgatccattatttctattaagtgatggtatgactaataaaattggaaaacaagtttaatgtttcttacataataaggactaaaatggaaatctttgtacatcagtgaaaccaaaatgaaaatctttttatataaggggaaccaaaatgaaaatcttttaatataaaagatatttatatggtaaaaagttttcaattttataggaattgaaatagtagtaatgcggactaaaatcaaataaaaatatttaacaaggatcagaagataaaagaaaatcaaaatgaaagcaaacctgtattacaacaattaaaaagttatttaagtctaaagtctaatttgatatcaactattcctgtcaaaataaaaattgatacccactatcaaactcaaactctgtccccattaccaaaaacaaaaactcaaagttggtccaagggagttatagacccagtccaaaaacatatttaaggaatggagattggccgaaaatcttcaaaggcccaaaagaaaaagttaagccgaataaaaaaaaaggctaaaaaatgaaaacaagctggagacctctaggactcaagaaaataggcacacaccggacaaaaggttaaacttgtcattgaggtccaaacttgaagagtaagaacaagtttaaaattaaaacaaggtccaaactgttattgtaaatgggcagatcacgaatcacaacttccaaactcaattgatcacaaatgacatttggcactgtccttaagggcatgaggaggagtgttggaaaataagtgttacattggtatgttgaaaacaagttaaaagacataaattaataagaataccgtaaattcaaagtgccaagatagctagttttggataagaggtcacttgagttaaaagtctggtaacccactttcccacactcttggaaaaggacccaaacacaaattataatctgggtgatctttgttatttccatgttcgtattcccaagtgacccttacaattgaacggatacttgttcttgtgacgcttatacaaaccaagtagagaaaataaatgaacgagaaaaagaagtaaaaaaaaaaaaggaacaattaaaaggaatctcttgtggacatcgatcctatacaaacatttggtttagactagtaaatgctctacaactcgtagcaggttgtcagtgggccagaagaaggtaatcaaagggaccaggtgcttcaaatggcatttgtttttagtagttgtaatcaatctctataatataagagtattaattaagtagaataattatagttcaattaaca

SEQ ID NO: 1060 - DNA, 1500 bp, Glycine max
  Soy_ogl_5619 Gm17:9762901..9764400 Cluster 4
taagcgcttatttaataatctcttattacatgagagcttaggccataaaatatatttaaaagagcaacattatatcctcttagtgtgtctgtatttatcttcctacaaatttcaacatattaattgaaggaatattaaatgaaaaattaaatgtatttaatatctaaaaaaaaaatgtaacaggtactctatttagtaattagaaaaatgttaatgggcacgagaaatcaatgcttggggtcttctccaagctatcctggacacgagaaatcaatgcaacaaaagtcgtcttccaaccagactgcaagagtgcaaggtccttgttgatagtctacactctaatcaatatgatttctctgaatctcacattctagttgatagatgtagagcgatgttgaatgtaatttcagactcattgataagttttactaggagacaaacaaatcaagtatatcattctcttataaaggcttctcagtttttactttgtttatcaatttgattatgttctaaattgtatctttcatcttatttttattgaaatgaaatagtcctatttgtctccaatttttttttaaatggtatttatagaaaaagacctagaaataaaagaaaaactttaattagcctaatattttcaattttaatgacgaatgcccaactttcggaaattttaatgttccttacatgagcttctgtttaatacatggtaaaagatgttataaatgggtccattaaactgaagcgacacggtccaactcagaaagcaaacaaaaatgtgaggcccatgaaataaagcacctcgtaatcgcatgaacagcttcagatatttgtcaattgttttctgcactccccaaattatttcctgcacttcctatattgattcttgaagcaatatggaaagtgcagaaaaaaacaccccaaatatttaattgtatgtggccgaaacttcacattagtctacactctacagggcgcaagcaaagatgtaccatgttggtcccgaaattttgttcagtcaataagtatgcttttcttttttttaagcaagttgtttgtatgtacgatatttttctcttaattttagaaataaataattaaaaataaaagagtactaaataaagaaatataacttagatactgtaggactacccaaaattaatttactggctagtctcacttcattactaaggctgaacctttgttcttatgataactacattagatcgagatcctttttcagacccatattttaatttaatggtgtaatggttcaaatttcccttccatttctgaaatcattgtagctcgaaatcattgaagtctaattttctagagtaattctaccatgcaccattcccaaattggtgcatttatgcatctagttttgtttttttcccttatattttgggtgtcctgggttttaaaatggtttttggtgccaaatcaatctgtaggtgcatatgcatgcacactatttttaaggtgcatgttagaaag

SEQ ID NO: 1061 - DNA, 1974 bp, Glycine max
  Soy_ogl_3834 Gm11:10689927..10691900 Cluster 4
aatgttctttttgcaagatatataagtaagaaagctaaaaagttgaaaaccaaatccttaaaagaaggaaaacaaaaaagaagaacaagggtagctgcagaaacatatccaaccattatccaaagcacagaaaaaacaggagaaggaacttagatgtaaccagataaagaggttcaaagcttgaaagaatgcaacgggtcgaaaagggtggtggtgctgctgcgaagaagatgcgtggtcagatagattactcgaattaagctggcagtactgggtttggcgcatgcagataacgcaaacaccaagttaatatgttggacgtatgcgccataaatgtccctctgctgcctcctactacattagtatacggtcaacgaaaatatatagaccccataggggaggtgaagtgaggtgagtgagtgctcatgcatgctattcattattcaattctcaattcaattcctgcacaattcactgccttttgcgctgactatattgttgtagtagtatgtgctcactgttacctctctgactatattcactttttcactaatgatggagtatgtataacaaaggtattgaacacattcaaccatacatatctaaaggggtttgacttaatgaaagcgtgttagttccataagacttgagagtgtgtatagggatatactccataaagaaatccctagcttaattcttgcgaaaaacattgtcttagataagaagtttatccatatcgctttaatttccggaactttgaaattctccctccttagtttttatccagcaaaaaatatatatattcaactatgaataaaattaaatactacaactgactactatcatctcattttatttaaaaaaaaaaatatttatattttatgctagagacactgagtaagattattaaaagaaaaaaaattctttcttcaattatttttgctcaagtcagatattatgaacaaagaaacacttaaacttgaatactcttaattactaagttgaatcaatctgcctcagttgatctactgctccatagttactgttataagtttggttaaaaaaaatagaaaattattttaatatataagagtgatgataacaaatattatcaacaaaattataattgatgtgttttattcattctttagaataactatatattaaaaatggcgtgtatgttttgcatttaattaatattctcttcttgtatataattaattactagtttaaaagttatattatagtattatttgttaatgatagttttgttcgggtagagaaaattataaaatttacttttgaagtgagttatttagatataattatgcaattatttacaaattttagtttgaaaaaaaaggttgtgcaagtagtacagtattttgtttgttccggtacgtcgtgatctgcagagaaagagaaaggaagatgagtagtacagaaatgtcgccacgtctgactggcatgcagcgtggcctcgtgaaatgaggaaggcagaagcgggggtagtgaagagaattgaagcaccaatatcccttcgccgtgttctgctgcttttggccacggaattcgatgcagattggtgaaaccatgcatgctacctcacctgtgatcgatgtgaatgccaattcaatttcaagatacacaaacaataatgtacttattcaagataccatgcattgctcaatcctaagaaagattgggtccaaccgtccaagagttagatgacaaattcattattttcataaatttatcttttaaaatgatttggatcattatttaatgatttctaatgtgattataaatttacatatgttaagctaatcacaaattttaaatgatttatatatgacgtaatatatttgaacatatatatacatatatattttataacagtaaatagtgataaaaaattgtcttatgaaactaataataagtctaacatttgtcttattttgattattcatgtgt

SEQ ID NO: 1062 - DNA, 1341 bp, Glycine max
  Soy_ogl_1025 Gm03:41743060..41744400 Cluster 4
gataaccatcttagtatattaaccaccatccctcttataaacaacaataggtagtagtatatgatctatgagaagaaaaagaaaatactttctgagtaaaaaaaaaggcagtttatgtaacaaatattaattgagacaccttatgcaacggttgctacacttcggttgaggcacaaaaaaaatacaatattatatataaattttatctaaaatttgctttctgcattttatgtaacaaatattaatcatgattcatcataaaaaaattatttttgttatttatttggtaagtttacttaaaaactattgtagtaattattattagtttaatgggaaaaaagaaattacattgaagtggatctataaaataaatagaagagaggtaattattatttccaaaaaattgtataattgattaactaattaaagttggtagttggttgaaagtgaatcattcatgaaatttaacatggacagagttgtataggttaaaaaaattgtaaacataaatcactccatgattgagtatagacattagaccattttcacatttaaagagtttgagatccaatttttttttcaggtacacataggaaatgggaattaagatggtgtctgatttttatttgagcatggttcagatggggattttaatctttttgggcatgaagcgcattaatataaggccatgatttttccactcctttttatcatcaccctcaatttttaatttttttttcctattctatccttctctccatcccctccccttcctccaactctcctacactccttcgtcttcaccttttcatccctttcaaacaccgtttcactttcttatctttcattgtcttttttatgagttttcacaccttcattccttcttcttcggttctctttgttattattttttcacatgttgatgatttttaaaaaatagtttcattatatgtaaagatacacaatgaaaacttatttctattgttaaattttttatttaaataaataaataaatatggtgaggagtgagaagatcaaagagggtgtgtgaatatcatagaccttattataatgttctgtagagagctagggccatgttcaggccaagagattaattaatgatttactgaatactatttatatatcttaggtttttttattatcgaaaaggaaaattaaagtagtttttatatttgttataattaaattattttcattagatatcttagaaaaattattaaaataactaaaagcaattcatgaacacatcgcaaactattttagtaaattttctcatttactcaaacaccaagataaatttaaataaattttctcaaatag

SEQ ID NO: 1063 - DNA, 1400 bp, Glycine max
  Soy_ogl_711 Gm02:47255101..47256500 Cluster 4
ccatcccttctggatgtgtttgttgtgataaatgctctatcaccttagaaagattaataaaaaaattatataaatatatttaatgtctattcctttcttctattaattaatgcgctgccgacatgagtcgggatgaggataactgggcacttggagttgagagttgagactaagacacagaaatacaaaagggggaggaaccctcgatttgcagtattactttctcttctgctctgcaatcaatgtgttgggaagactttttaattgtgttcttacctcgcgtaatcggagtatataaattaagagtctgcacgttttgaatgtgaagtttgttttgatcaattccgtcaaagttcagaaaattcatcaaataagagtgtaacactaattatatttccagtaatacatgcattaacaagtgataaaacacattgtactactgtaattttgtttaaacattgggtggtgcgttaagacagttagtcctttctttggcaactgatgaatttaggcgtcttacgtcaattaattaatcccatacagtatttgatttaaacttatactattatgtatgaaatgtaggactaaatttagtaaagtaacttttaacttattttgattttcctttataaaaaacttattttggttttttgcacttaaaataatactagtacgtactaaagatttatgtacttttcaattacctaaatgcatcttgggatttaatttttatgctttttttttagtttgaaaaaattcagaataaatattttagaattaaatgtttggtagtaatataataaaggttaatttaaggaagaacgttaaagagaaatgaatgttatccgtgcttttaattgttacaatataaagtcacatttctgttgatttcatttcaacagtcactaacacataatctacaaatagtatttctatataaaaaaaaagattgtgtttttttaaaatgagaagtataaattggatttttatatgattagccacagatcaatgttcctattgaaattagttaacttccacaaatattaatttaatcataaaaattaaaaagtcctaaattttattcttattgtcgtttctgtgaacatgataataataataataaaatacactaattaaataatagtactacgtagtatttcattttcagatccatttatatgtacggaagttaaaaccaccattaaccacctttcaaagaacaatatttaatcttatcagcactttaaattaaatcaactatcttataataagctttatgcttttcaactttagattgtgagttttaaaaaatagaaaaataaaatcatcaacacgaaaaaaaaaagatattttacaatatgttatgcattctgtaaaaaaaaaacatggtatgcaaatta

SEQ ID NO: 1064 - DNA, 1100 bp, Glycine max
  Soy_ogl_3049 Gm09:8664101..86290 Cluster 4
aaacacagagcatttactatttgtaatcccctaattgctatttttaaattttttattaccatttataccattttatattaaaaaaatccaaaccctatttttttaccctccattaatgcttaactaaaaaaagccaacaaaaatgcattaacaagctcaagtaagaacacaagatgtgtcctgcctaagctgcaagcctgcaacatgtacctacaagtaaccaaagtcttgagcggaaatgcataacaatcttgacaaaactacaatatgattagtagtatactaactatgagtaacagcatactaatcccgtaacatacaaaatagattgaaaaattcaaccaaaatctaccctacaatcataaagagacatctttgaaaatcaccactccaattaaaaggttcattggtagatgagggattggtgactaggtggtcaaccggacatgtcttgcacgcataatagcaaataaaaattaaacaataatgctgtaaaaaaatagattttttttacagaaacatcatttaatgttaatgcagtatgcataaaatatacttcctctctctttttataagaccaatatataatattcctaatattaatatttttagactagaaatatttttcattgaaagaagaaaattaatgtattgaaaaatcattagaagagagaaaaatattaataacaaggatagttttaaaaaagttataaatttaagataaatttattactatcaattaacacactttttttaatcttgatgaatttggtaattagatattagtaaaatatataaattaataattaaggataaaatattatttgtgtaacatgtatgacatccaatatcaaatatgtttagagttaataatttactgcaaaaaaaagagttaataatttaatggctaaaatacagctgagtaaatttacttttgaaattttttatttttgtgcaacctaaagtgctggctaaacaagggcttctttgggcaacattatcttttacatttgaacagtaacatctcatttttcagcagatctattacttacatgatcctgttctattgaaatcaagggtatctaatttttgtaccattt

SEQ ID NO: 1065 - DNA, 2000 bp, Glycine max
  Soy_ogl_4360 Gm13:30201101..30203100 Cluster 4
tccattgttttaaattaaacacaggttcaaacatatatgcatttagtcctacgattaattaaataatgagcaagattaaatttaaataaaataatgtagctagtgtatatcgttcgtatatgatttagtgattaacttttcttaatgaactctgacattgttattaaacatgcctctatatatatctgtggatctagttagtttaattatgtgtaagtgttaaacttatttcactaaataattaaattaaaaatttgttaatacttatcaatgtaatcaacttcaattaaatggatattatatgtactttgtaaaatacgaatataaatagtattagttaaagatcatatatttaaaatgttcaatttatcttttattatcacctaatttaatgtttaattttattaatagtttttttttagtaaagttaattttattaacagtaataataaatagcatgaataatctcaacacaaaaaaccaaatttagagaaaaaaggatacaaatgaacacttattcaggaggtggagtgagcagagaaaagttttttcttttcttaacaaaattctaatgtgctatttgtatcaatctgcgcaatatatttcgtaccttttaccatttctcttttattaagtttattttcttaatgaaataaattattaagcgaaataagtttttcaacacttactcttttatatgtattattccaggtagttctgtgtccattacattatttcattgcaaagaaaagatatttatcagttctttgtcctctatttaattgccaagaaaagacatttaacgatgcagttcacctttcattttagaatctttacatagtcaatcttaattaataaattaaattaatgatacgaaatttggcatcccactttaaagtgtgaaccttgggaggctcatttattagagtaaacacactcatgcatccttaggtacaaaaacggtgttaaacgctacttatctctgaacacactcccaactacccttaatgctccctaactaaatctaaaatctcgtagtatagcatattctcaaaaattaatgaaggacaatcacttaatgcacttgtttatatatataaaagtaataataatttaatgcacagttcaacccaggctaggtattataaataatgcaagtatggggcaagagtaattcaagctttcagaaattttcccttttcagctttcattggctttggaaaaaatcctttgaatttttcttcttcattgtgttcttttagacggggttttgttaactcttcatttacaaccttcccatctgtgttcactttattccctacataagaaaagcaaaaaaatatataagttaagcacaaattaataatatatttgtaataattaccaaaaagaattacatgttagtgacaaaaagaattaccatataattcttccaggatgagtgaaagatgctcatccaaatattttaaaacaagggtgctacctacatcaagaacatcaagctcactaaacttaccagcttaatggactttacattattatctactggagaaagtatgggcaatccataaatttggacaacaaggccagcatgcacttctagcaaaaaaaagttataaaccatttagtcaaattagtgcagactaatctcatgctagagtcaataaaagtaccttcaagatttcctcaaattccaatatttcattccgctgatagtctgctatcaaggttttgttgaatagagattccaatgtgtattcttcaaaatctttttttacctcagacttgtgtccagcaagcttgttaacaaagtcaccaggaaccctcatgccatatctttgattacgagtggtttttatttgcattttagagaatattatgctaaaaaatagatatttaaacatgttttctatttattttttcagttagttcgtgtgagataatctgcaacactttttggttcaagagtaatattgttggcagagaagatataagtagga

SEQ ID NO: 1066 - DNA, 1300 bp, Glycine max
  Soy_ogl_5941 Gm18:5389301..5390600 Cluster 4
ttagattggcctgattgttatgtttgtgatttttaaatagcagaaacagcaagtgcaaatgtaagacccagacaagagggtttaagaaacataccactatactcaaacaaatctgccaatttttctttagtttctatttctgagaattttttcagtgaaatgatccaactgtggtagtttgtaggacagctttttggggaataaagccggtaatgcatctaacatgtctttctacaattcaagttttgctgcaatcaccttagatgaaatgcttatcatacactaatctcatataatcatatttaagaggagatcatgacaaataagccaccccttctagaagcaatcataattttcaggaaaagttttacaatttctatgcaaaatcatctttcaatgttttcacctgcttatggtgtatacatatttacagacacgcagaatctaaacaatgttaagttcaagtttcaactgcttaatgtccactgtataagctcagatgatatatcaaaaagcattatcaagagcaatatttgtccgattctatgtaagctaaatgtttacggacctagtttaccagcaatcattacaagttccataaaagtgaatgtatttgttaaagctgttactaagcactagtttggtcggtcattagccaagaattcatcgttacaatttaacatacaagtttggataaacttttacatgagcactggtaggagaaaaaataagaataaataaatattttttttttacaagttaaaactttcatttgatattgtacttatatcctatatattattttctgtatttacatactgtgttaattttatcaattattgttaaaaatacaaatttgtataatatataaatgatttatgtgaatggacttacatataagcgaagtcaggggatagaatcatagttgcacattcacttgccaaatatgtatagggtaagaactcttgtatactgttgagttttagtgaacattgactcaaattatttgggcacatcgccatttttgttttgctctcctacaaacaaccgttggacttaagcttgaagaacagatgccgaaacttcattatcttctcgtggcaaatcaactcaagtaatcaaggacaacttttgggtcaccatcctcaaccagttatggatgatcttgttgaacgatttctagttttgtaaatggagtttctaaaaggagataggatgaaatatgtaaaagaaaaaaatgcaaaacaaataggtgttggtaaagaaaaaaaaatataaaagaggctgcgataaagaaaaa

SEQ ID NO: 1067 - DNA, 1227 bp, Glycine max
  Soy_ogl_985 Gm03:39851724..39852950 Cluster 4
ttttacagattcatattacacaccacgtaaaacataataaattttttaaaagaataatcttatctaatagacccaataattttttaaaacatgaataaataaaagaaaaagaactaatgtgttattaactactgattgattgtaatatgaactcattgatcttttgccatttgtgtgtttaatcatgtgataaaataacaaaaaaagaattaatgaaaaaactcaaatgaatgtaaaaaaaaaaaaactttgaacttttctccctgcaagtacgacaccgaaaactttgaatttttctccctatttgaacgcctttatcacctcctcttccatttctgtctcttgtaatgaataattcacaccaaaactcaatgaacataccattgttaagtatgatcctataaaaaaccaacaacaaactcaattaccgataaaagcacatgtttaaatagaataagaataatataatattagaaattattattctctattcaacttctaaaacgtgcatattagaatatagaaaattacctaattatatgaattaagagtgtattaaatgtattttatgaattaaaactgttaatttttattattgattaaaactgctaattaatatatcattaatgtaaataactaatttctctattaatgtgaaattactcttctttaaaataaaaatattttatttactttttttcccatacaattattaatttaactcccatttatgagacaaaataatatttacaaaaatgtccccaactcactttcttttatatattatatatataaagatatgtaaaaaaaatctcatccttctccttttatatatatagatgctaacttctcattttcagacacaatttttgaatatacttttttatctattaaagtctattaaaatagtatatttttatgaatcttattttttatttaacttttttttttaattttataaatttaaataaatttttacacgttagaaaaaatgtgtaatgttttcatatactagtaatcacaacggaaaataacgcttcatttcatcaacggataaaagttttgtagaaattgatttcctttgtatacacttatggtttaattatatttttggttttgaaaattaagggtgcatttaattttagtctcttaaatttaaaaacaaatattttggtcttttaaatttaaaaagttacaattttcatccctcaaagtttattttgggtt

SEQ ID NO: 1068 - DNA, 1949 bp, Glycine max
  Soy_ogl_1721 Gm05:37934101..37936049 Cluster 4
tctaatccaattttttaaacaatggcacagtaaaataaaaactgaaaaaaaaatattgatggaagttaattaagtactacttttggctaatttgactttgcatacatatttcattatctatgtactacacttcagaagaaaaaaaaactcatgtagtagcttctttcaaataaccattaaagtcggctcaatggtcaaaagttagagtagcatgtatgaaattatagatttaaatctcagtagtgtgactattataaaaaacatttttcaaagaataatacttatatctggttcgcttcattaatttgatttttcagtgagagttataaatatctttatcgtatcctaaactatttaagaaacaaaaaattggataaaaatataaaaagaaaatgttaacaatgtactcctttctctcattttacgtgtcactagctagcttttggaatatttctttatcttaaattatatgtcagtattaagaaattattattaatatatatggaacaatatcctttttagtcaaatgaaataaataaatgtaagaaatacagttacaattgtacaatgtaataaaatcatttatggaataaatgtatttaatccaaatgaattaaatattttattatgagaatcaatataaataatcatttttgtaagggagcattgatgacaaattaaatgatgagatggtggaaagactcaccagtacactatttatttatgattaaaaattattaaaaatataaaactccttaatgataaagatggtctaagttgatcaatgctactattaaattagagccaaaaaaaataataatttacgcgttttttcgaagcaatttaggcgtgtatttacttctaatatttttataagattgctttatatgtctttaattggtttatgacatcgttgacatttaaaccaatttgaccagaattgcgatgacagcacagttgatcgttgcagccgagtgtagaaatctaaaataaacagaaaaaatcctaaaagtaaaatatacaacaagccattttaaatatgtgaaaattataaattttgatcgaaaattaatgcaactttatggaaagtaataattattaatttaaaatgaacagaagaccagacccttgacaacccgcgtgtttttatatatataaaaaataataagttaaaaaaaatgataacacttttaatccttttctaaaagaacctttttggttgaagagaagaaattataattcaagaaagaaatttttataaaaataacttggatgtcacaattttttttctctattttaattcaaatatttctttttacttttctttattttttttctctttcacgtttatatgaaatttatatgaaagtatgaataaaagaaaaacaaggactagaaatgaaagtaaatttggagagaatagcaaaaagatgttgaaagacataaaaagtggtgtcaaatagtatatgttattttgagaaaaaaaaaaattccccaaatcgcaccccggcccccgtttatattctttcttccctctctctcttaccccacaaatctcagtctctcacttacccaatgggtagaactccttactgtgacaaagagcaaataagcaaaaaaggaccttggtccaaagaggaagatgaattcctcatcaactagatcaaccttcatggcgaaggcaattggaaatccattcccaaagcagcaggtattggagttttagattttacaattatacttttttattgttctttgatcagaattaaaatttcattttgatgacttatgttgtaaattaaagtttacatagatcagtgtagattactatgataaaacttcaattctgatggaaaaagttccaataacatttatgaaagtgcatccaggttttgtcttgaattctctcactagctaggtgaattttgaatgcaccttttcatgcacaa

SEQ ID NO: 1069 - DNA, 2163 bp, Glycine max
  Soy_ogl_3541 Gm10:45124238..45126400 Cluster 4
atgagcaataaaacacttaaatttacacatatttttattaataaatatccgtgttctgacttagacatattatattgttagtctttcttcttatattgtgaattttattctggatactcaccggttcaaggtttcaaattgcaattaatatcactacataaatagataaaggctaatgagatatataatcatgatcaacagggtgaaagcaagagatttggatttgggatgatggtgaagaagaaaacgcacgacttcgatgattgtactacgagcattaaaagtactgaaaaattattaaacaacataaaaaaaaaacaaatatgcattattatcactattttgcactagtttataagaatggatctagtgcgggaaatgatgctgcattttggcatagtaactaagttaaacaccgttcgatctctatttgatgattcagaatgagccacgtcatattaaaattgagaatgtacttatgcaaataaattagttgcaagctattagatgaatatcaaaggtgcacaagtgagatgaataaatcaaaatcactgaatcgaattgcaccaaattgaaatcctcttgtttagctgtattcatgtgtcagcataattgcaaagggccaagaagatgtgcctttagttcattaaagaaaaaacaaaatgctcataatatcatctgagttaccgacacagaaaggttaacacgagatcgatttcacattttaggcatgcaccatcatgaatcatgatcatgggattgatcggacggccaccatttgatcatgtggaattatcaaaatgtgtgagtcattactcagtactcaccaggtgcatacgccacgtcacgtatatagaatccataagcaaaagtcaaagtagcttcacatcatggtcttgcttattctgatctctagtgtatgctctcttcgaaggttcccgagtctgaagagtcaccaacactgcaaaacaaaaccccaaaaatactgaaagccaaaatcaacagtgatagatacggaatagtaacatatgtcattagtttgagaaaaattaattaataaatgttaaccaatttcttatgaattacactcatatcatacaaaaatgtgaatttgaatttcattacttatatgaaaactttctcgacagatgatttataattactcgatgaatcttgaggcatatcttaatttgaagagtttctaaaacttatctaaattttttccttttaaaattagattcaattttttgaagtatatgattggaatttggaaaagaatatgttctattgaaaattgttagttagatttttaaataaagattagttatggacagcaaatagtaaaaatagtaatacttgccactaataagatgatacctaaaaaaaaatgaaatttgcggaacccctcgtatgtgatgaaagcatggcattgttgaatcggtgatgtggaccacattttctgtatgagcgtaaggtctctctcatacttacctcattgcaaagaatccaaagaattttcctattaagattcaatgtgctttattggccttgacacctccaaattcaatgcatggctacttttatacaacttgcttcaattcctccttaatcaccgtagttactcaattttataaatagacactcgtatgtgagcattacattaatataaatttatgtcatatgtgtccctatgccgtatgtgtgcattaaattaatacgaatttattgatatggcagtaataacagggacaaaatcctagtcaccagatctgtagttttgcacatatgaagttaatcatattgtgctagacaaagatgtgtatagttacagattgcaaaagtcaagagacacaaagtaattttgttttaaaccaaattctatgtatgcacgctattgattattgacattataggcaagacaatttacatcaggtatatgcttttgaagatgccatgcaaaggaaagataaaatttctgagttcagaactatgctttttgcacatggagactataagggggatttgtctagatgctgaacttttccatttcacccttatccctgtccctggacctttgagtgcaatcatgtgcatgttgttatgtactgcagtgaataatgatcctattattgtaagaaaaaaatgtgttttcagtatttgtat

SEQ ID NO: 1070 - DNA, 1200 bp, Glycine max
  Soy_ogl_6419 Gm19:38416201..38417400 Cluster 4
agatttataatcataaatataagggcttggtaagatctccaccatgatgcttagaaatatgaggtatcatgtagttgtgcttttaccacctatatgcccaacaatgactttaattaggttcttctaacaataatggtttttgaagaatcagataccataatgaaagactagaggtaatatattctttttaataatgtattattctatatcaactattgacaatataacaataagttgtgtacgtatataaatatagggcaacgataatagtataaaaaagaaaataacaagaaactttactatgattatttagttttttttatcttattattataggtgtgaagtactaattttattgataattaatctttattaaaaaatctaattaactattaatattaaattattatttttatttatgagacttaaatttaaaatcttgttcaacagacccaacttttacatagttgtttggtttaatctcatgagttaagagaatgcattagtgggaagattggagattgtgtttccacaatttaattaaatgtcttttttatgctatatataattgaagaaactattaaataaaatataacttagagtaaaaaagtaaaaaaaaaaaaagagaatgcaagaatttagaaagagaatgaaaattgtgtattctttctaaaaaagagtagtcttttttataaatacaaaaaataattaaaaaagttacaaaagataaatacaaataagaaaacattataaaatataatgaaagatatcaacagtttcaaataaattattcatatgtaagccttactaggaaaaactacgtgccataaaaacctaatggaggaaaaaagtagatcattcttcaatatgtaagccttaagattttgttcttaaaaatgtctcaaaaggttaaggaacaacgttttaccctactggtttagatgagtgtggcatcttggtttgtccagctgcatttctgaatccccattatgaggaaattattggtccataatatgaccaattgatgccttttaaaccgtttgtaaggtatgatgatgggggtgatgacccttcggattagtttcggtgagtcgtccgttaggactccaatttaataagtgttggtccaattatttggagagagttttagggaaaaaataaaaacatcaaatccataatgtttctagctaccaggcaaag

SEQ ID NO: 1071 - DNA, 1800 bp, Glycine max
  Soy_ogl_5759 Gm17:38393644..38395443 Cluster 4
agtacatggctaaagctaacaggattgaataattctaagatcaaaacacatgcaaagcttcacaataatttgcaaatacaaacaatgtatatcataaacgaataacaaaaataatccctaaaggaagataatttgagtattcttggtggaagaaaattccctggaaacaaatctcattcattagtactagaaaatgaaaatttaaaatgaaaagaaaagggagaaaaagaaaatgacgaagagaatctattcattctaaaataaggaaattcttgcttgggaagcatgtccgaaattttccaatctaatattgtgtgactaactaagtcacatttaattttatattgttttttgtgatttgtggaatgcagaagtacaacgttggatgccatgacgtgggaatgaggatagggtcttcatattctgctgaagcttatccgcaataacaaaacttaagtgggccccacattcaccattttatggctcctctcgccattccataccataccatcatggcatcatcatcatctttctctaattcttgctgcttccaaccctccttccctttaatcatgttggatccactcccactagaaaatactaatttaatataaaaaattatccataaatattaattattagtttgttaaatttttttagaagaaggaatctaataaaatataattatcatcttcatctttattaggggaaaagagatatttcatgtctttttatttttattttttaaaaataaaagttgaatacagttaattgaaaatgagaataaaaaaactaataatataaaaatagtagagagtcaataatgaattaatggtgttaagattaattttataaatttgttattctcttttatttatttattaatttttcttgattggtttataagttaaaacaacttatgtatataattataatgaaatggagagagtaacatcttttctcctttgaagtgtatttaagattttttttctaagaaaagtgatcttaataaaatgtaattagaatgtaaaaaaatagattgttatttaattataaattattatatataataaattatttaacctttgtagtaattgctttaaaatttatgcatagaaaatgtacatgataaatgttcgctttagattataaaaattcatatttttaacatatactacctccaaaaaagcatataccattacataaaattaaactcattttaatgttatgtaagtttaaaaacatttttttcactttgatgatttttacgtttttttttaaggatcagtctcatagaaatacttacttatcaggaaggaagaaaaaagtttgaaaacattttatgttttatgtaatcatatattatcattttattagagtaatattgaggcaatgatgaagaaagttaattttttctgttaagacgactgtatatagttatgtttattacaaattttaccagcctaaaaaaacaacaaattgtaccaataaaaaacattatcacaatgtccttgttcacgttgtagtctagttttaagaggatcatattaaattacaaatgtctttttcatttttttatctaatatttttttgtgatgaaaggaaggagttagaagaatgtgataggaacgtgggcagaggaaacaaacacactttcaagtttcaacttatcgcattacaatattacacgtcatttctaacgcgtgttggtggtaatgaccttttgttggtcgttcacctgcatccctgtttcaatttcaacccttcaacctttcaagtttgaatatatatttggttaaa

SEQ ID NO: 1072 - DNA, 2173 bp, Glycine max
  Soy_ogl_6761 Gm20:34906984..34909156 Cluster 4
atgcaaggttagggaagactactattcttagcaaaaatttatagtaaaatttacatatgacctatcgataattaggcatgacaaaattttccctcactccctcgataaaaaaaagccactttcactttatatatctccatatacataatgcgaatttaacaacaaaactgcaaagttgaattgtgaaaaaatattacccgacttaaaattaactttaggcttaattacgactttgattctctaagtatgatattgtataattttaatcccttagatttcaaatgacataattagagtttgatgaactaaaattacacaattatgatactagagtgataaaaaaatgcaattaaggcttaactatatgtatatatcgtttgtgcttgaggaatcaccttataaatgcttgtatatatattttacagttttcactaattgaaagtttttttaaaagggggaaagatattattaatatcagaaacaacagactaatcacaaggagtgccaggccattccaagtgaagtacaaaaaccaaacagagacgcgcattacaaatttcaaaatacaaaaccaatctaatcaagtgaacaaaagtatcctaagttattagctcaaagaatcataaggactaattgaaaagttgtagagaaaacttgaaatgaaagtatatcacatatgagttttatatggaatttaccaaaaagaagtgtttcacattctttgagttcttgatagcatagatgctatttgtgttcatgatttatgtgatacagtaaactaagattgagaagtcagatattatatcctttttactctcttttttccgcattaaaataaatttctcagccgtgattaatctactttttcccaaccatgcatatgccaaatggaagcaaaaggtctaacaaaaattattacacctaatgctttcggattcaaaaagcaagactttaatgcattattactctagcggatttgcggtaaacaacttgcgtattctatcatgtcaagcgcatatatagcactgtatgtatataattataatctataattctgcatccggttcaatcaagctagatatttaaattacagtttttttcttcttgagatatatttttattatattttttacaatttatttctcttttaccacattattcatcatcttatcttataaccccctctaagtcaaattgattgacgttttaacatgaaaaaaaaattcattttgattgacactgtcaattttgaatgaaatattaatttttttaatttcagttatgacctcaaacaactatcgtattcgaatatttaataatgcatgcatttataaaaattaagaaaaaaggagaggatattttagtaaaattatttcactaattaaggtatttaattatttatttttttaatttgtgtgaaattgaaaaccttaaatgtcaaatatgatatagaaagagtatttttctttctcttctctttttacctttctcttgattatagaaaaaaaaaatgttgcaagtattttgtaccaaccaaagttgaatctagtaactgctatctagcaaattatgattcgaattcatgttgagaaatatacttatatatatttagtatcttatagtaattgaaacataaattatatttaaaagagcatatatgtagtaggggagttgaatttcacttaaaattataagcaactacctggctccaaacaaatactcataatgcaataacatggggaagccaatacatatccaagtttgggggtggatgaaaaagaaagggaaaaaaaatcatgtcttagtcagcttccaactcctacaatgtccctttacatcatagttgtgaaatatatccttgttgaccaatagtgcaaagctatggtacgtaaagacagactttcgaagggtttgcgaaagtcactatctactataacaaacaatccttgttttcgtttagattgggtatgatgtctagcacactgagtgtaatggataacctattctctcttaacttgtccatcaagctcacgccaattagaatgaagagaaatgacttccctgttaataaccaattaaaatttcatggtcccaagctacatgcatgcttggggagggctaatttatttgaaaaatggtgaaagtacattccatttttgggatgtataaatgg

SEQ ID NO: 1073 - DNA, 1500 bp, Glycine max
  Soy_ogl_938 Gm03:37708701..37710200 Cluster 4
tcctgaagtgaacacaagttttgaaccttacaacttccaagacaatactttgaatcagataccacatgagaacttgaacttcagcctttctgatagttttcagaaccctagttctgaaccaaacaacaacggttcacaaggtgagaccagtggatgtcaaattgacttggacatgagagattatctcaacagatcttatatagaagaaaatgattttgcttctgattttggcatgtttggagcaatgaatggggatagacaaggcctctagtacgtactgctagtaactacaggcttagtttacagaataagaaccggttagttttcatttgtcattcagagcagatgcaactttagctcaaacaatgtggtttgaataagcgaatatgatttagaattagtcttgagtcaagtttcttaaaaactcagatttctgttacctatgattgagacttttgatagacgaatccagatggttaattttatcttaccttaataaatttggaatgtgaacattgttgttttcgtgagactagtctcatgaactcaggttcaatttggaaaggtctaaataagacatggtgaaacgaattaagaagttctgaattgattaattaactgcatcttttcacctgattaggaacgtaattgcttctcgttcatttagacattggcaactaaattttggtaaatcttcgaatggattcaaaggtatatgaattcgtgcctaactattgtagtgaagttataattttatatatcatagatatataattatatcgagttagtttattaaaaatatagttgttaacattttccgatcagaaaaaaaagtaagatctaaaataaattttcattgagattttttttttaattttaaatgagagtaataaattgaatatttttattaacatgtgaaattttttgtttttttttcctttataaaaactaataagtaccaaataatttggtttgttgatagatctaaaacttgaggagcttatgcttaagtttggctacctataataagggcatattagataaagcaaaaatttatgatacaaatgttagtaatactatctttggctgaaatttataaaaaaattataattttttttgtgtttcataatttatttaatgattctttcttactttaataatttttaataaattttaatcaataataaaatgtatgttaaaaaaatgtattagaaagtacaattaacacttttcactaactaattcatacgaaatgtgaatggaataaggctcaagattcattagccaatatgactttctatcaaaatgaaatatattgggatgagaatattcctcaccaactagcttctgttatttcttcttattttactacatatttcagttaaataaagcccaattcatttctaaaaaaaatctcaaatattttaataatattattattcttgataatgtaatgtacaattaattatgcttggtaaaataaacatattatttattcta

SEQ ID NO: 1074 - DNA, 1600 bp, Glycine max
  Soy_ogl_1575 Gm05:3422701..3424300 Cluster 4
agccactttgttcaaatgggaaacataatgcatcatattcattcaatcttaattaatttatcacaatggaaaacatagaaaagaacaatgtgcaagactcacaactactttgatctcctccattttcacattaggcaatcctaaaaggcagtggttaacacgcaacttcacctccccaatcatgtgcagcctatggcgaagaagtaagtcataattacggtggatgcttccactgaccatagttcaactgcctgaagaaaatacaaatatatcatcaaatataacttactagtcaatgcatcaaatatagacacaaacagaataaataatgaaacaagaaagggaactttaaatgcatcttcaaaattgtcatatggcacaggctcacattttggatacgcttccaaagctacatcctcactatatgcccctggaagctcctgtattggccaattgactagttagcaaaggcgacaatgttatgaatttgaaaagaaactattaagctatcattcatcacatagaggctctgcaattaaccaagttacataatcgtgataaaagggtagaattaaatagcaaaaggaattacatcacttagaggatactgctaacaaaaaaaaaaacataaattgcacctattatattatgaatatcattttgtatctgcatgcatacacatgcgtacgctaacacgggtgcatgtttcatactttagtgtgtattaattagaataaaacatcaatttaatttactataagaagcaatagcaatatgaaaattaattatttttcatgatttttttaaatgaaatacaaaatggaaaaaaaaaaactacgtgtacagtaaaataatgaaagaggaaaacaaagaaaagaagaaagcgaaaaaagataaacaatataaacaatgacatgagatgaggaagaaacaagatcgtagggagcaatacttgtacaaaaaattaatatcgatcgatagcaataattaaaaactaatgtaaagtgcagtgcaaaagtgagctaacgtgaactttatatactattcgcatttattggtaacaagtatgtataaaaaaattactagatacaaagtgaattgaaatagcaagatatgtttcatgcatatacaacataaaattaatgatgaagagaaagaagaaaaaaacagtgaaaacgagatctttttttattgcttcctacacgtattggcgtgttactgatggtatttagcactgtatccgccaattgtagaattgcggtatcaacagggaaaggaggcagaagattttttatcctttttttctgttattttttttcaatcgtcaaatattaattgttgatattagtaatttttgttagaagacttccacctttctcatcatttcttttcttgtttatcaccaaattaatcttatattttttctgttttttatccgtccaggtccagttccccgtgaaagtgaggtattctcttagaaattactaacttatattttttttcttttcttttgactggttcactccacaaatccttacttttaggcacaattaaccaacaaatattcctatgttctttccacaagtgatcgctgtagggt

SEQ ID NO: 1075 - DNA, 1377 bp, Glycine max
  Soy_ogl_2296 Gm07:8624901..8626277 Cluster 4
tttaaggtaacatttctgataaccactaatattatatatttttaaaagttagcagagttaaatactggaaaaatgtgagagaaagagaggggtgcctatctatcaatatttgtgaagttaattttaagaaaaatctacttggacttgattgattaaacttttcagcaagttctacaattctagccgtgttttaatttcaaaatcacagattaaatactttttttatatatatatctgtgattatcatgataaaaaaactacaagaaaaatattagatagtatgtttagtaaaactcaaaacatgtgtattgatcacttgaaaatcaagagctatcaatacaaacttctacgcttaaaacgtgaatttgattcaaaactgacactttaatgggtcatggctgcctatcatgtaagcatctcggacaatctgagctcccctctggacatcatggtgaaggaatgtcgatagcagcagcaccgagtccggcttaaaaaaaatactctttgagaatgaagggattagaatcatcaatgaccgccatcatcatgagataaaaaaagaaataaatttaataagaagaaagaagtacggaagcaaaaacttctaatatcatatcaaaaatgaaagaaatgaatgatagtttttaaattcatttatcaaagtattacaaaggtgatttatttatataaatatagagaataactaacttttagtaactcttagtaactaatttcaataacttttagtaacataattaagtaattatttacctaaattctaataactaacttcaacgtggcttaatcgtgataaagagttaaatacagtaaaaaaagaaaaagtgagacaaagagagggacatccatatgtcagataattttgagaaattaattttctgaaaattttacttagagttaactgattatactgaaaataaaaactaaattaattaatacaaataaaataaagaaaggacaaagttaaacttgacaataacatgactttggttctaatctgacaaaatcaaacaccatctgaattttgttttgggcactaaacgtgaaagttatctttttcaattttcattggaagttatcttctataattactattttattttactggtcttctaaaattacttaaaacaattaaaagagattagtttttgagcctaagcaaaatacctttagtacatgtaaatataatttctgaatatacaattttccaaatcacgtaaataaaattaactcaagtttaaagttataaaccaaaagtaaatattttttttttctttttcattccattttatttttctttaaagaacgccaaataatgttttaattagttagattccaatggcgttggattaattattt

SEQ ID NO: 1076 - DNA, 1751 bp, Glycine max
  Soy_ogl_4684 Gm14:5494550..5496300 Cluster 4
ttagaaatactcatatttaactacctataatgagtcttcacatttcatgtcgggatgctattgtaagcaattaccaagttagttagtattcatctcacatataccttagggtcaaccaccttaaccgataaataccaaacatctttttttccagtaggtatatattcttaaacattttcatattattatcttgtcaattttttattgacttgcaaatattaatttgataaaaaaatattaactgaaaaaatttgaattctcaatttctttttttctttttaatttcattcttctctaaccactagacaaatcttataagtatgtgaaaatagtttcttaacttaatgtcaaacttgcaagtatactaccacccacctcgtttgtttgtgtggactagctccctctcaagaatcaccaattagaaagtgagcctaatctgcccggtccaggtagcatcaaaatcgaaaaacttaattagaaagaaaacaaacgaatataatgtaaaatattccattttaataataagccaaaatttgtgtggaaaatgatttggagtacgtatatatccacgcaactagggtcaagattttcatgtgggcagttcttagagatggtttaaacactaactacaagcagattgtttgcaagttgggcaatgaccctacgcgtcttgtatgcatggctcttgtagcgagtagagactctagttcatattcttagattgtacgcacgtggtgtgtgggacagaatccttcatcgtaagctaatcaatgaattttaatcctatgacttaattacatctgtggatggagttcaatttagctacaacttttagcatgcactagcagaaatatacgattttcttacaaatttttcctattgattttcctccaagagactggaataaagccagcgtggaggaattttcagggtcttgatatattggtgcttgaatcatgggttctgtcaggaacattggttttgccttagctatgatagcggatttttgtgctttcaagatgcatgatataagtaaatgaagatagtggaaaagagtttgagttaggagttattatgctctatttgttaatctcatttaattaaaatgccacgggtatactcatgcttgtttcaggatgctagctatatattgctgattactgtaagaaaattggaacctcaaattttcgcatacttattgtgaggataatggtgcgtatatatttatccaatcattagcctccgattaatttatatatacatattaacaccgtgtgggtccatttttttatcataaaaaatatttaaagttgggttttagttcttcatataacgtgagaggtaaaaattagacttaattattataagaatatatcaaaatataaatttaaactatcattttattaaaaattattacatatgataaaattattgattttttatattattttaaaagtcatattagtttaaggcgtgcagataaaaaataccttgttgttggaagagatcaaatcaatcaatttcaattatttttatgtcttaagagattagtttcatgttttagcggcatgaggatatcttatttttagaaaaaaaaaacaaaaaaaaattattactagtattaaaaaattacactaatgtaggaaaattaagctcttattaaaattctatagtgaaattatttgattatttaattattaaaatttaactaataattttgtatttcgaaaattagaaaataaaataaaaat

SEQ ID NO: 1077 - DNA, 1842 bp, Glycine max
  Soy_ogl_5627 Gm17:47359..49200 Cluster 4
tctagaagtattaaatgtcaaatatttcttctttatatttttttataattttaagaattaaaataagcgccactaagtaatatcataaactaaagaaaataattattatataattaaaaaaattaaataatatttttttatagaattgaagaattaaataaccacacgtcactttaaaagctaatttaacaattaaccggacgtactttggcgtgcctagtttttcttcttccatttacaaggcggcgtgcactagttgttagtcttcaccgtcgtactcgtagcatataattgttgctatgaatgccattcaattcaagcgtgttcgtataatagtaacaaccaatagcaatgatccctttcatagtgtttgttttcctaacactcttgttcacctcgtcactggtaaacacctgagaaagcgtgctgcagaaaagacaagccaagaaaactacccttcaccagcttggtacattgtcccatcgaacccttcaacagctttcgaataagcatgggccactcatgttcttgcagctgggggttcaatacccaccttggtagtttcctctactgagatggccagagagattttcaaaaaccgtgactcggttttttctggcaggccttcgttacacgctgcgaaccgtttaggatataacggttcaaccgtgagttttgcaccgtacggtgagtactggagggaaatgaggaagatcatgattctggagctgttgagtccgaaaagggttcaatcgtttcaagctgtgagacttgaagaggtcaaacttctgcttcagtcatctgtatatatttatacagctaagattaaaaataataattaaatattgtctgatgtaatagagagagaaaaacatcgtaaagagatgttataagaatgtttgtaaattacgagaggggttccaggggatgccagatacatgctaattcaactatagcaactaaatatttcatgatcctttttgtcatctgtattgcgtccttaacttgctgtatatatggaaccacgatagaaaaataactcccttattagttactttaatattcatccaaccacatataattttaattttaataactaactttttacttagatgtatgttgtgtgtatgtgtatttgagcagttaccttcatataattgaaccaccgcacaacagatatatttatttataacatacggttatttccttaaaaagtaaaaaaaaaattataagagatcaatcaattaatcaatcatattacacactttccttacactatatttgtttgagtgtaaaatatagaagaaattggagcagagaaaaataggagataaatatcagatttctacatactatttgaatataatgaacctagaatcctgaatcttttatgttgtgaacaatgacaacaacaacatttaaacctagaatcgtgtacaaactgtccaaacattttaccaattaacaaagctttttctcactgtcacacatgcatacttctccattgaatagacttagaatttgtgctgctaataaatcaatcacttagtgtaatttgattactttgttaaagaaaaaaaaaggaaagaaatattaaaaagaaatggtggtatatgcataaaaataattacacgcaagagaatgcggaattgcatgaaaatgctgctagcataagccataatggataattttaaccattaaaaagtaattctaaaaagatttatcatttaaaaaatgatttaaagaaaaacaaatggaattacttcgtaaaaaaaacataactgcttttttaaaataaaaaaaaaacactttatataagcatataaaaaagcaaaaattacg

SEQ ID NO: 1078 - DNA, 1985 bp, Glycine max
  Soy_ogl_6754 Gm20:34701316..34703300 Cluster 4
gaacataaccttaatttttaacaatatcttaaatcttaacatgaaattaaacaatggatttaattactacaaaaaattgaactaattatatttcacaaaacttggtataaaaattagtaaaatatttttctttttctttactttttgagaatggatatttaattaggtggccaactaattgaaggagaggaactaattgatataagaagaactttctgtttgggttttgtcatgctgaaaaacaattgaaggagaggaactaattaaaagagagcgacacgcggcgtatgttgtaagagtggaaggttgggccaggcgtagatagatagaggagagcacagtgtgaagacactttccattgatgcaaatgctgcagcaggcaataatatatggtagcagagtttcaatggtcgatgcatgcatacatgtacgtaccttgcaaatttgtaatgggtggaccatattggtatcgaaccaacttacccaaaacagaaaaaggagaaccatgaagtccctacgcatgatccttttccccttgcttatatcacggagtttcactacatgaacacactcactcctcacaggactgtcttcagttgtcggaagccaagataaaaacatatatgcacactcaagcatgcaataagagaaactcaaatgattcaacctctatactctggggcctgcccctgcacttttcacggatgatcgtcaacagtcagaagcgtagttgtctgtctggtatggtctggtccaaacattgtactgcattttacctcactatgccaagttttggaagtgttggtctcattacacccacgttgcccaactcaaacctagcaatatctagcacaaccgcgtgaattaattgatggagacttgtttcagtataattagagattttaagaatcatgaatataccactgtattaaatagacagtggaagattatttgattttcacctacaaggatcttgtcggcggtcttgaacacaattatctcctgcaaaaagatacacgtgttccacaccaaaaacctaacaatctaggatggttgtatcatctactcacgtggtgtaaaattaatacccacacacaatcttatttatttcttttatactcaccagtactctataaatcattcagaattagagtgcatgtggttgttgttatttactgcgtacataggtaggttttttcaataaattaatttcatgagattagggtttaattctcgttttctcttgtcaataatttagtgtcaattaatatattaggttatgcaaatctatgtagtagtactgatccgtatttctattcacgcctcttcaatatgtttatgtctatgttttctttttttgtatcgcatggtaaatatttttaagaaactgatgagtgtgcatttgagaattgctatactttttatctttttgggtttaattgtggcttaaatattttatgaagattcttgtatttattgttatgatttgtatagcaattgtatcattcttggacggatggatgaatgataacttaaaaaaaaacttaaatatagttttagtgttaaatttgggataagttgtttggttttggtcctttaaataaaatttgtttttttagtctctcaaacttatttttagcctccaaagtgaagtttggtgactaaaaataatattttataaattttagaaactacaaaaacagttttttaattggaggggggaccaataaataaattctatatcaccattttttgttaacactgatgcctgaaagtttaatttgggaatcaccgtatgtgatgacactcaatcaaggcgagcctaaattgagagctagaaatggtaaaaataatcgagtaatttatcgcgtagtttgtccatattgaaataaatgaattgtaagctactaaaacaaattaattaatagcatgaaatttgaatagtttgcatattttaattaagtttaagtttcaccaacaaggtt

SEQ ID NO: 1079 - DNA, 1700 bp, Glycine max
  Soy_ogl_77 Gm01:3290001..3291700 Cluster 4
gactactaccagtaaaatggcttatggaagtatgcttgaagtttgaattaagcaaagttatacattaatccgtggataggaaaaaaaaagggtccttaagtattcttttttgggaaatactatccagtattcttaggatattgattaataaattaaaaaaggagaaaatttttaattgagatgagtaaaattgtattattcttaactttttttatgcttttctcatgttttcataataaatactttttttaatttcttaaacaattctctaaagacactagttaacaatatttgttttgataaatgctaactagtatccctggttaatttgctaaaaaagaatcctgtaggactttcttttttttaagaactaaatgacccaaacctactgcaatgtctaataatacactcagatgtatactataataatggcttagaactacacttgaaagctcgatagaaaaaaaataaaataaagaactacacttgaaagtgataaataatcaatgatatattcagataggatattttagaacaattgcaatccaaaaaaatggaaggaaaaaacataatagttggtaccataataataggaaatgcaacaaaataaaaattaaaataactacaaaggacatgaaagagccaaagattacatctggtccaacaacttctagggttgctctttttctgcagcaaataatactcaatactccatacttatattttctcaccttctgtaaaataaaaaattaaaattaagaaagaagactttcttacctgttatgttgctgcaaacaaatatacaatgtacaataagtattagctattatacagattggttgaaagaatcaacctcttatcttctatcaaaggtgcacacgtgttcggattcttcattctcgttttaaggatgatatcaaaaagtgcaaagatagatacgagttcacaaggtacagtactgatccttgttatcttcgtgaatttaaaaaccttagagatgatcttaatattcttcttgctctagaggaattcttttggaaacaaagggctaaaaggtgactggataagagatggagaagctaataccaaaattttccatgccaatgcaaattccggaaagaaaaggagttttatttctaagctctttaatgaaaatggtgttgctatttctaatcagcaggatatttgtcttctagcaaagaaatacttagaaaccttgtatgctcacagtgatgtaaatattgaagtcgaaaaatgggagttcaaggaagctgtctttcatgtgcattctgataaatcaccgtgttcggatggatttaatcctgctttctacaaaagattttgaaacttacttggtgatgatattttccagaatatagtagccaggctgaatcaaggtttttaccctccaaacttgaatggtacaaatattgttttgattcctaaaattgattacccaacttctatgaaggatttgaggcctatatcattgtgtaatgttctgtacaaaaatgtctctaaagtgctaaccaacagacttagatatgtgcttccgaagtgcatttcaagggagcaatctacttttgtagaagacccttctattcttgataatgtgttggttgtcatagagaccatttatcacatgaaattaaaatgtgggctaaggagggtgaaattgctttgaaaattgatataagcaa

SEQ ID NO: 1080 - DNA, 1564 bp, Glycine max
  Soy_ogl_1736 Gm05:38677137..38678700 Cluster 4
tcctcctttttaaatttgatgagttggtttggttggttgatttagtggctatatcaatgcaattagatttgaaatagtagagcttggattggtacccatagaaaaggaatgaatatcttgtgaggaaatacggtcaagattgcatggggaccatttttatttttttttacccttctctgaagttgatatatacgttctccccccttaaaaagtaaattaatgaattttattttaacatgaaaggcacaacaaggactcaactcaacagtgaagatggtacccttgctttggtttgttgtcctctagtaaaattggcctatctatctataatatctagttttggtgccactcaaagtgtgtaaattgtggtgttgtcggccatgtggtatgctaataaaatagggcaatgttgagcactttccgaaacagaaagtctttatttgatgggtgttaataaataaaaatgatgatgatcatgccctggtgcccatacctatgctgcatcatccaccaatggcatggggcaggtgcctgtgagtttcttccctccgtgaaaagggcattgcccttgcatttccatgcattatgccctcctaatgggttgcctctgttgtggtcccctaagcttcgtgtccctttcagctcactaaggatcgatacaatgaccatattgccttatacgtgccatcatatttatttgcatctcttgccacattaatcttaatcattacatttaaagaaaataaacggcaattgtataagaaataattcttaattatcgcaacttgatttctcatctttttaacttacgcacaactttgtttagttttgtatttatttatcttaaatttctaaatttaagattaggtattatatcttgtattttatgaaataattaatacatgtgtaaaatgatattaatttgtataaaataataaagagaaaatgtacaatatttacataaaataatattataaaatatattaacaatcaatgttatgtataataagtatattgacaaccgattagtataaatcagatagtaatatatattgaacttatgaagagaaattgagtttgatactctaacaatacatctttgaagaggaatcaaatcaagtataactaaagttttaaattgaaattgaagattaatattatactcaagtttaaaatgaaacttatgaaataccttagaactttatttgataacatttgttaacttttataataactaaattataaatcccacgtagaattatttctaattgattgacttaaaaaatattccaactactcattgtaacattatacgtcttctcctttatcaatctatataatttaatcaacgtcatatcacacctttgttatattttcgttaattattaaaatatgagataaaaaacttaattttaacaattgaaaacttatgtgaaccaaatgcaatgctgatgattaaaataggatgattaaaaatatataaaaattaaaatatagagaacaaaaattaatgtaaactaaaaagtaaaaactccgtttagcatgctaacatttatttttgttg

SEQ ID NO: 1081 - DNA, 2414 bp, Glycine max
  Soy_ogl_1927 Gm06:13751801..13754214 Cluster 4
atttttattaaactcatcttaaaacccttgtattatcttttaatagatgtcttgacctagctaaattcttcaccagacaatatcttccttctagatcaactgattaagcctcgtcttttattaacaaaataagtaaaataactttaaaaaccaaattcatctaaacttcttttcaccaaagaaaatcaatagtgctgtcacaatctgatgtcacgtaaatccacatctatttgtcatttgatttaaaataaattacttgagtctagtgataagcttgtttgcccggatgattattaagccgacaactgtgtatggaatacaccaatatatatcattgcctaatctggtccaattataaaagcatgattaaaaagtgtcaacacgaattttagagtgaatatgtagtcttataattaatcggctattagaaagctagcttgcttgagagagggattaactaacatgactgcatgtctaatcctaaaatgtaaatatacaaaacccctttaaatggtaatgataagttaccaagtaagtgcacgcttatgatcacgccacgcatatatagaccaagtaatcttcctagaagctaatgattgagttttggaagtatgattatttcgatctttttctgtttgtaatatatataataatataggcattttgctttctaatcagtcaaataaataatgcttattgggatattgatccagcattaaggatctaaagctataactaaattgtcgggatacatatatggtttgtcgggtacgtacgccttatatccatccagttacgcatatcgatttgctcaagtttgtatatgtagctttgacactgacaccacaactttcccccaaccaataaaaaacagtgattaaaacttaacagtgtttaggttcatgattaacatcaattatacattagaaaagagggtgtggctggccgtagaggacatcaaccactcattcaatttgccagaaacatggcaaagaccacagaaaacatctcagggatgtgtctccggctgcttcaacttggacttggattagctaaaaaacaacaaagacctataaagacagatggagattcgtctgtaaacccatttattctcaatattctttgtttcagcgcacttattagcagataagtagtaacacctcatttatatacatttatactaataaataacaaaaattagagatgtgtcaaaattttaatttatttaacaatatattcaaattagaaataactaatatacacacaatactaaaagttttttatactattgtgcaataaaaaaatttatactccattgtataataattattttaaaaatcacattataatattttttattgattgatgatataaaaaattttactttaatcttttcaaattaagtaaaacacttttttttttaatactacgttatcctttacgtgagacaatcatattacagtataataagaataccatgagagatatctctttctcccatatgattatttagcatagctataaaccagaactcaaatttaagactactaattaaattggagtaattttgcctaaaatcatctgggtattgaacggtaaattaaatacatcaaattcacacaagaatttcaattttttgtagggagtaaaaaacaaggaagttttttagaaagagatagggaaagtccaaataatgataatattaaaatagtttccttggtgtctgtgttgttggcgaatggataaggacatgagattatccaatacctattaggttctttatgagtcccatacagagaagagagtcttattttggaggaggggagggaccattggagagtgagaggggggattggggacggtgcagagcacagtaggagccaatgaggggtggaggcccacattgggcccagcaggaaacctggcctcatggcatggccccttaggtcattgaattgccttgtcccttttgtctaagagaacaagagaagaaggtgacattgatttaattgggaggtatccatacctctttgcaccttggacatggtctgtcccaacaatgcaattgcaagtttagtccatgtatatatcaatatatgtctaaccaaccacttattactttatgttatatatctcttttccttcttcctcttaaactctccttgtccctgcttttttttattatttaattactacccaccaccaccacccatctcttctccataaaataatactataaggtttagaacaattaattatattgtttaagaaaaaataaaaatattcgaaaagttttaagttaaagtgatactaggtttgttttttaactacttaaatatctggatcaaccatattgaaataatagaggagaaaatattatttgtgaacttttcatcttaaaaaaaattaaatgc

SEQ ID NO: 1082 - DNA, 2002 bp, Glycine max
  Soy_ogl_2625 Gm08:12000101..12002102 Cluster 4
ctctttttttctcttgcttaatagaaatctagctagtatatttttttttcgggatacaagatagagattttgaattgtgagtgaagattagtgggtggtttaaagagcaagaatgagatggcgaccacgaagaagaaaaaggtgacaaacggagataaaaaataagtcacggaaaaagtgatgttttcaataaagaatacacattcattttaagaatgagatgcgataacgaaatgtatgtaaaaactataaaaaaaaatcacatttattacaaaattatatataaaaaaatagatttttatcacatgttttcaaccaagaatacaaataggtactctctacaaatcaacatctacgttattgattcaaataaaattaagttaaaattctttaagaaatatctcatttaaattttgtaaattaaaaaaacataattagcaagaaagacatgtctctacataatgtgcttgaaaaaaaattatattttttttattaattttcttttaaaaaaagaaacatcacacttttattgttattttttttcaagattagagaagagaaccgtagcaaaaagaaaaaatacattgtctctagctttagtttgttgtgtctcccttaatataagggaaagcgatggaacattggagaggcagaaaagattgcagaaaacttgtataaaaaactggccataagtgtatgtatgtgggttcatgtgacattgacgtatgaagaacattgcatggggatatcaacggaaccatgattggagattactattcacaaaacgtcatgattctcttgtcagtgttaaaatatatattgttctatttattttttgtgcggctatgctctttaagttaaggtaatggcgtgagaaaatgaacgatggatgagtttctctttcaatggcttgtctttaccctatttcaagtctcaacatcatcagaagcttcaaggaaattaaatttcgtgctagcttgcttgaaaggtactatacgttgatggagaaacaaaaaacaaagaaaattgtcctcattataattagtaattacctaaggtaatgtaagtctgtcctattgaaatagtgcaccaatgttttggtttctaattgttcaagacttctgttcaactataacacatacaaatgattatttacttggtcaaggacaaagtgattatttaggtgttgtttgtttattgtttataaaaacagttttctgttttttaaaatttgtttgtcctcttaacacattatttgaaagtatttgttcttttgagtacaattttgttttctaagaatttgtcctcttatactagaacaaagcattaaaagaaaattagaagaaaatgactagaaaacattcatcaattgtttatatttattagttttaaaatacttgttttggtttcaaaacataatatattttatatcaaaaattgataattaagtagtattgaattgttttttatttaagtttttgaaacaaatataagaagaaaatcaaataggatcttatttttcgggtctgtgaaatgcctagttttacacgagagtaaacacctaattacacatcatttctaaagaatatataagaatataaaaatattgatcattttagtttatttcagatacaacgtgtctaatatttaaagattaatataaggtcatttatgatttctgaaacctaatgtaatttttttgaaattattacacgctaagatgtcctatatatgtatgatacatatcccataccagtatcccagtttcaaagttttactccacgagtgagcacgatgttatttgtataaactattcattgacaattattaatatttataaaagaatttgaatgatcatctttatcttcaggggaatttctcatcgaaaccaagatttttcaattcacaatgcttaagatattcttatttaagaaatttgaggcaagtttcggttggaccatatgttagtaagagtgagtttctttgatgaacttaaaaacaa

SEQ ID NO: 1083 - DNA, 2021 bp, Glycine max
  Soy_ogl_4410 Gm13:32413580..32415600 Cluster 4
ctaaaagtcatcccgaacgaagccaaaaataagtgtataatgacgttttccttttcaaatttcctttttgggaatacttcatttacgtttcaagcaattcgcattcttgcattattattgtatgaacttttcttataaaccgacacaaatagggcttgtctgggggtaaattactttagagatacttttatgaaaagaaaacacgaacaaaaaaaataaagtcgattttttcataaactaaaattaatttatggataagttaacttgtaaaatttttatcatactaatttttctaaaagatgatttctaatgtatacataagttaatttaacttataaaaaaattatttatttttttcttattatcctctcttaaaaatatttatgaagaagtttatttattcatgcacaatgcggtttgttgtcccaatgttttctgaaggctttaatttcaaaaattttataatgaaactgaaataaaagatattatttattattgatcccctcacggacattgtatttctttttatctcttatcatttagttttttcggggattctattattctgtggagacttcaattgcattatggactgcataaatgtatgtctaagtggtgacccaaaattgaaagccgctgacatgtgacagccagctcttcattttcttagtgcactcattcacaataataataacagaagatggcctcagcgttacagaaatcaaattgcataatttgcatacctatgttatgtcttgtgatggtaccatcaggatataccatgcaattttgcttgatttcctccttataaatatttattatgaaaagttgtttatttgatattagtaacttactaacatttcacccaaaaaaaaaaaaagagtaacatactaactttattttgttttctttttgttgactttgcctatttattgtttgggtaaaatattattaagtatgacctttttattatttaaaaatcattttgaagataattcaagaagttggttaagaggaacacggcaggatctcatatgatgacaagttgcaagtttaagtctccacttgtctttttgagtaaagtaaatataagtacattcttttggcttaaaagttatttttaccttaaacaggaacgtcgtcttcttctcttaaaatactttaaagttaaaatttaaacatcaactagtttagaatgagatgaaaaaagagatttaggcatataccttatttttaaaaactacattggtttttccttttaaaaaaattaaaacaaaactactttcctgtttttcatacaaaaataacaataataaactttttaataattgaagatatttttcactcaaaaaaataaaataaagagcttttctctaaatgtctttaactcgatttttttttatgaagagatgaaaaactaaataaaaaaaaagggtactgaacacacttccttaattaccatgtacgcccaactatatgtaactcccatttatttcagttgattggacttggcaaggaaaattgtcgagtaggtacaatttgttctattcgtggattgaggctcatcactcataaccatgcctaccttataagcaatacatgttaagcacagcgttgacaggtcgttctatagcaagcaatagttagatattgcctatggaaatggggaaaacaccaaccacgttcttcaccttagtacacacacatgcggtcaattaaatttgattatatttttatcctttggtgtgttgttgttactttgctgttttaggtctacctaaatttttgtgtgggcttcagcaatttggtcttgctttggcagtgttaagagtttaatgacggcatacgagtttattaatgatcgtgtagccatttttgttattgaagttgtaggggttattagtgaacggattgcattaaacatcacagttatggaaatttaactaccgtcatgccccatgtgtgaattaattgaattttgaaggttttcttaatatttaattacttggtcttcatcaaca

SEQ ID NO: 1084 - DNA, 1374 bp, Glycine max
  Soy_ogl_5313 Gm16:5237161..5238534 Cluster 4
caaaaggggaagagaattagttgattaggtaatctctttgcaaaactaaataaataaataaaaccatgctatgttaaaaacaataatttccaagctttctcaaaggttatgaaactcttgaggaagaaaacaatcaatacagtcaaatgatcctctcaatgtgatggaaaaatatacatcacatatatgttatatcatagtggggggctaacgttcccttacacatctcttgctattattcgatgaactagattacctagctttgggttacttttaaaaatcatgaatagaaacctatagaagttcttcttcaatgattttttagcgtgtttcaaaagggagaataagcgtactctttttttctttaaaattttattaaccctaagtacattggttaaaaaaactaataaataaaaagtgtttcattaatgattacaataaaaatacattaaatattacactttaatttatatattcttatttataattttacttaaataaataaattttattttgaatgtctaatatatattttttcgttgttttgagtcatcatatataatgttgaaaaaaaatcaatttataagataacacataattaattaactaataataataattcaaaacaaaaatttaatatatccaaactcaaaacaataaaaaaaatatttataaaacccaaaacaaaattcaattattaggtaggttacacatatttaaaagccttataatttcttaattaatatccttgtagtatcaatcagtattcttcttaattattgaatctaaaattttagcttgtgtgctttgatgttgaatgatcaattcctcatcagtttgtgtgtgataataataatggtaggtgtggctactagatgtgtgttggtgattgcattgcgggtcacatgtgtctcccaccatgcagacaagggagctgaggcccctctttcaaaactagtagctgttgaaatttcatgcccattatcacaagagttcaaattttgaatgggaaaagatcttcctttttccgctgggttttctatcttttgctttgatctcttcctttttcattttttaatttttattcttttcatttttattatgagactcacttccatatgggataagcttgaatctaagtttgtcttaatcactttagtcatgattgatgattaattatcatcttccgtcgtttataagaattaaaattttggtataggaagcattggaaggaaaaatcttatataggaatgttatatccaccgtgtaggggaatatttttttttatatcttaaaaatcataaaaacaataatttttaattagtaaatagtataaaacttgtgttatcattaaactcatataataaaaaaatg

SEQ ID NO: 1085 - DNA, 3163 bp, Glycine max
  Soy_ogl_5897 Gm18:2410507..2413669 Cluster 4
atatgtcttgcaaacatatatactattattatttaatattagtacttattatacaagtaaataggagaattaataagttgatattataggaagatttaagttttttttaaagagaaatgctgtagcttgtctttaagttttaagttcgaattttcatgaatacaattgtgttttagaagaagaattttatatatggaacttgatctaaactaattacatgtccaatatattgttcacatgttggtttaaacttaagcaaatttcacacttgaatcatattttaatatactttattaatttttcaaaaaaaattaattgcaattttgttaattagacttaataataaagtaatttcaatatgacactctatactaatttattctatcttactatacatttatgtcaaatttaatatgaaaaattttaattttgaaaaagaaattattgacaatgaaaataattataattaagtattattaataatatcatataaacatattaaaaaagaattattatttttacttcactttagtatttttaatagaacattaatttcttttgttactatttcttcgtgtacttttgatttaggaaaaaaagaaagaaagtcaagaccactattaaattagatcaatggtcactaaaacttcaatttgtttcaagatcaataatattttttatgtattctcttttaaatttttaactattgggattcaaataattaagtacaatgtaatttcaaatttcaaaatttcttcaaataagtagtgaataaaagaaaataatttgacttgatatgtgtactaaataatcaaaactaaaataattaatttactccctctgccccaaaactcaagcattgttagaataaatacttttaaaaaaaacacacaagcgtccgggtgtttaataataaaaaagtaaaattaaagtgggttgtcatgttagtcacctaagttaagtctctaattgtgtttgaataaaatacttaaataaactttttttttctttcaaatttcagtgactaaaaaaattaattttaaaaatttagatgaccaaaataaaatttaaccaaaatttaagagattaaatacatatttaaatctaaatagtatttagaaaatactataattatcctttgtcaaacattaaaaacatgtgcatagcttaggtcaacactattcaataataatgaaacaaatgggtaggtctagtctggcccaacgagccaaaatgtgaaaagcaagtatgtcaacttgaatttcttacatactgctttttcttggctcaacctggccaatggctaagttaaattgactcattttttaatcttaattaaagtaattttttaaaaatataataccaagcctaataagctcatttgttttttagcttctaatttgatagttttgccaggtccaatgcatcaatagactgaccagtcgagccaagccaattttgatggttctagaaacataaaataaaatgaattaaatttaattataaattaatgttaacctttttttctaaaggtaaccttaattgtcattatctaatcaagttgagacaaatgccaattaattaatgaaactcattatgtgtttgatatatatcttctttttacttacaatggtagtagtagggtttaaatcaaaaactttatataaactatcaaacctctctttctagctactttagctagtccgatcttaattatattagtgagtatgtgattgaattaagcattgattttattttattcttaaaaagcgaatttcttagtagtattttaaaaaggttaaatacatcaaagatttataaaattttacctttttttcctttaccatctgcttccatatctcatgcttacatgatcattcacaacacaaaaatttccacatagaaaaaagctataaattaaaggagctatatccaacctccctcaaaccaataggatatgtgcattgcatgtgagtactacacatgtaatcaatttccatcgaaggaaataagaatcatgtaccaagaatgagagaaggtgtatagtgctggcatacgagaagaaaacagtagtctccaaaagctagattttccatgcgcaaagacttctcatagtcgtcataagtgatcttatgcttccattaatcttcagttgacggctccagattatgatagatggtgctagatcttgtccacactaatgagcaagaaatgactactgaccaatgaccacattgaattgggtcagaaaaaacattatgatgttttgatagaccctaccactatatgaacattttataatgctctatgcgatctcacgtacacacacgcacacacacaaatttaggacgatactgtctcatgtgatttgaaagtggaagagttttagttcatctgcgtgacctctgagggagaatacattatgtatatgtgtctgttatttgaaggacacaaatgtttgttccaccatgcctttgtgaatagtgagcaatcgagtggtacacatttcgctttcaaacatgcacccctatttcattgctgcctcttaattttcttttgttctcctcgtgtgtccatctcccactaacatacaattttcgctcagtgccaacttccattcacatttcaatctttttctttgtatgtgttccactttgagggttcaattaggattgggggtatgacaaagttttatggtacgtacctatcacttccgagtgaggtaacagacgatgttttttccattatatttaaaaagaggacatcaacaaatagcacaaatgacatctagaattgggaattggctttcaattatcactgatttgaatttcagtttccaccttcctctttttctgtaccagcttctgatagtgaacctcccttgtaaataaaaatacatcaatagatgaaagcaatttaaaattaatctggcttcatcaattctttatatggcttacattattgcgatttaacaagacctcaataaatagttgctgtaatgcatttgtcttcccatctgtctcagatggtaaaaagaaaatgataattaattgtgtatcatgaaataatagtaccaatttgacatgacaggtttaaaaattttagtgcctctgtattacaaaacgtgaccatatataagtcccgtttgggtttggtcttaatt

SEQ ID NO: 1086 - DNA, 1707 bp, Glycine max
  Soy_ogl_5928 Gm18:4853494..48250 Cluster 4
attttggaaatctttcaatactagtctcttcaaaggttgattacgcagtgaagatttctaactgtggaatatatcaacttatggctacatttttttggataaaaaatagtgttaagtaccactacttttagaaagagattcataaatatttttcgtctgacgcaaataatatataaaatattcgacacatatggcattgcttagcgcactagaaatcaatattccattatttgctatcaaagaaaaaagaaaaaaaaaaactgtgaaaacaaaccgtggcgtaaataaaaagatatgaaagtgacgtaaacgattgtggtaattgctgaaatggcttgattaataacaatagatataataaacgcaacaactaatgatagctgattaccatagtcaatatagagatgactgtgttagtaagatattttcaaacgatttgatcttctggagatcatattaaataagacaaattaagatatttatcagaaagatgaaaacatcattaaaggtagttgtttgaatttcacgtgcaaataatcacacaaatatagttacatttactttcaatgaattaattaataaagtgatgagtataagttaaacagataaggcatatgtaacttcatgaatttgtatatataaaagggaaggctctatctagattgaggatcccatgccatgatttcttgtaaatcctaattcacacttaaatagtagtttgtacaagcttcaacaagaaaaaaaaaaaagtgttcttacaagaaatctattttaaattcactgaccgtttatcttttttttaagaattttgattattaattaaactctctcaatgcgatatacttattaacgtttggtatggtgtgattattctaaaagacaacttttttattataatattattttttgaaaaacaaactgattatattaaaacacaagaattatgtgaaacgaagcaccagatgtgcctaaccccatacccccaaaattacaagaaaagcacactgtctcaacaccagcaatatactgaggcagtactaattaaagacggagctataatagattatttggtttcatgatttttattttttattatcaacttctacaaaagaaaatactccttttccttccaaataatgaatggtactatttcattatatgcttgcctgattttgatgtatcagatgtgacattcttaataaaaatcaaattaaactgatttttaactttaagatcgagtgaaatgaaatcaatatgatggattgagagagattcgcttaacttattacacccttagcttgatgtaaaacaacgtcgatcagttgctatcattaaatcttaagaaaacatcgcttttgtgccatgcaatggacagctctatctttggtaactaagagctttccacgttacctttggactaaaattgaggaaatggattcatctctctctttctgacgtctccatctttccatgtgttatttaaacatgtaatgataatttttgcaacattttttatgttgcgacaatttatgtttctaagagtaaagacacataatgtacgagctgctaaaataatatcgtttcgcagatacagctattgtttttattctcagagtattctctcctcccattttatagataaaagattatagctaaatcaaattcagcaaaaaaaaaaaaagctaaataatatcataatgcatgctg

SEQ ID NO: 1087 - DNA, 2100 bp, Glycine max
  Soy_ogl_4559 Gm13:38831801..38833900 Cluster 4
gttacccagcttttcgagcagtctgataatctcttcctattctttagtatagtttcctctttttatgttaggcctgaaataattcagccacctagtccttctacgtgaaattctaaaactcttacaatcttttttttatcaacaaatattagttgctagaattattaatttttgttagtacaaggatttgtaatctcaacctcttccttctttcttcacctctaaatcaactttatatcacttaaaactttgaacttaacattatacatatccatcctaaactcctaagatatggttataaatctttttgacttatatattattgaatttatccatgttaactaaaatagattttttacccacactcacacttcaaaataattaactaacttaattttcacatcttacaagtatatataggatatgttgtttgatttatacctgcaaatcttgggagttggcgccaattccaagagccataacgagaggcataagctattaactttctatcttcctctggagtccaagagttcacttttgtcacaggaagaaagggttctcatctctgttgttgttggcaatgtacttaattccgttcgtgtgtgtaagagagacaataagaaacagatgatgtgacgatgttgtttcactctattaatgccggaccagaatcatcgaaacctttacttattatttatactagatgcgttcccattggcaaaacgtgtttcatgccccgtagaatttcaataaactaaataattattcctcccaaatctgcgtcgatctcagcaatcatatcttaataaccgagctttgtgacaagaaaatgaccaatttggaactataaagacttgaggatgaaattgtaaattgaaggagtttagccaaaatataatacacgtatccaatttatacacgtattcatattatttaactccagacaatttaaaaaggggtattcataattctaatgttttttttacaacagatttctaatgttttctaatatttatcaatggctttgaccatcaattaataatgatattataatcaatagatttgtaatgtttagtaccaaattgttgtaatgtttagtacctaaaaaaaatctttattccggtaaaaaaaacttatatctttattaatgtatttttttggtacatatatctttattaatgccttgggagatataaaattagtttgtggttaaaaagagaaaaaaaaatcacagattccatcctttttgctaataaaaaaataataaattaataattaatatttatcagtaaaaaaatctttatcaatgtctaacaacaatcacaatgaccaaaattaaacaactccataaattttaaataaacatatttccaaactcattttgtattagattgaaaataaaagcagaaaataaggaaactaattaaacgggccttagaaactcaaatttggatttctagttcatatgatatccaaaccgatctgaactggaaacattatggttattttctctaatatattaattttttaaactgaggttatttgatgtttataattaaattttaaatagtaaatattaaaaaatgggtgtaataattaacagagtggtttattaacaacttgggaaattcgagtcccgagagtagtagtgtattgttttggttagttttcattgttaattaataacatttaattacatcaattttattaaaaaatactaattttttaactaaataacgcacatgcttttctttttcaacaaaaatggtatgggtgactcttagtaagttcctttattttgccacaatctgatatatttgaatttacagaaatggtatcattctaagtcatatatttagattttagagtaataacctattaaatttagatatgttggttatagcttatcccatataagaaaattcataggaaacaaaaaaaaaatgcaggaaagtacgtaaaagcacaaatccacgaacaacataatttcaaaagaaaattcatcacaattaaatgtaaatttgaagaaatatctatagaaacatctgaaaaaaaactgcttatgaatttttctgcaattttttttccataaaagtacat

SEQ ID NO: 1088 - DNA, 1800 bp, Glycine max
  Soy_ogl_5309 Gm16:5147501..5149300 Cluster 4
gttaaaaaaacaatgtttgaatttattgaaagagtagaaataaaatagattgaattaaaataaaacaaatttttcatttcttcttaattaaaaataaagacaaattatagtatatgatgaaatatactccattggtatttacatcctcatattttactaatttaattaaacagtgtaataccattattccatcctcttttatcatttccaagaatctgaaccaaagcgaggcgtgaaatttgcctatcaacaaccctaactcacataaattaatcttccaaaaacttccgaaacccttaaaccaagaagaagaccaaagttagttacaagtacacagataaaccatcaacaggaagaagttcaccaccgagaaaaaattgagtcttaatttcaacatgattttatgcacattaacatactaattaatgctactttcttcaactcatctcccttgtgcagattttagtcatctagctaaagacgtcaaatactagaagcatagcatgtcaaaagagacatcatccaactccacaatcacatcttaattccccgtagctatttagctacagaaggatcaatctatgaaggtatcaaccagggatgctctttacatgcatgatcgagttggagagttttgctgctgccaaattgtcaaagaaaatgggtggaaaattaagaagaaaaaagtgaaagtgagtataacatttttacagaactttgttcggttctgacttctgatcatgctgtttcgttcttaaaattatttgatcacataaatgcagcatatggggcgtcattaatgaggcttcagaactagaagaagttcaggatcaatccagcagataagtcatcagtttcacataaaagccacattgacaacaatacagtaggtacacacttctctttccaatggaaaaagtataagaacacgtcttatatgatgtaaaacaacacaatggattggggtggactgaatgtcgatcaaatcagtgcactgaacaaggaaaatgtgtgtattttattttccatattgttgcctacaatcattagggagaattgtgtacatatatggatatggatccagccattcatcacattatgtggaagcacaagggctggctaaagagacaagtatataaatttattgtagaggatcgatgggacccaaccattcactacatgagggtgtttgagatatatactaagctaccataaattcagctgcaatggattcgatcagtgcttcctgttctgttcctttgacgaattatgattcattttcttttttctataagaatcgaacatatatactagaactcaatcaacttacgcactttatttaactgagttagatccatcatttatcattcattttatttacagtttgttgactgactttatctaaatagttttgtgagataatgcagtaagattgtcgcgtatattaaagaaatggttgacagttggaaactgtctctaaacggtaggttgcataattgtgttgaaaatctttatcgtctagtaaaaaattaaaatagtatatacacaaattgaaaataatcttaactttataagttgatcgattttggtagaattaaatttggttcaacttagattctaagatgtgtagttaggatcaaactcaaaattctaagagtttataatcaaaagctgaacttttgatttgtttaagtttaagttcggattcatttgaaaaatatccgaggagggatttgtaaacaatgtaaatatagaagaaagggaagaagaaaagtgcaaaaggagataaagaggtgcaaa

SEQ ID NO: 1089 - DNA, 1311 bp, Glycine max
  Soy_ogl_1390 Gm04:44269401..44270711 Cluster 4
tggagtataacaaaacatatttaaagatagataatgaaaccaataatttttggaatggagctgaggaaggatcttatctcaaataatttatatatttaaaattgaaattaacggtgtgtgttctcaaacttctgataaattttcagactcactaaacacttgtggaagtatttgtaaatgattcactaatattgtccaataggatttaaatctccgattaatttacttaaaacagttcctttttatcatttttatcaactatatgaattatacattgactctaaatgtagcatacaaaaccgttaatctttaattagttatcttatcctatacaatgaaaatcaattcttgagttaaaaacacgaactttgtctgttaaaaaaacacgaattttgtattatttaatataactttaaattctttttgacagcattaaactttaatttttttaaaattctctaaataacactattaattacgtttaaaattatcttttatagtattttttggtcaattgtgattcaggatcacttgactacacttgaggggcatgctttctatgttatgattccaatatgccaacagacaaatctctccttaagagccttttttcttttatgagtcacatcgaggttctaatctgtaacctcgatctgcattctatcttaaatctcctaccactagatctactctaatagtttatgaacatgtgtttaaaggatataattaaaagttaaaatgcacaacctgtctattgatctatagccaataaataagacgctcataattgccttaagtatgctagctattttcctagctattattatgttggaatacatattaatttgaacgtgaaagcctgtaaaaagtaacagcactacgccactactcttcagccaaggaatacaagaaggcaaagtttagaatcactaatttcaaatatgaattatttgtattctcaaatcaatataatttttaaaaaaataaagagtagtctgataagttattatcttaaaatcatataaataatagtttttaattagttgacaatgtagacaatgtagttttttatacatgtaaattaaattcatttttaaaatgcatcatttcctcttaatttattctgcatttcaatttaaattaattgtgctaatttatcatataaattagaatattatttttctttatattactatttctttcaaaacaataagaatgatcagaggcaatttttgatcggaccttgcttttcatcatggtcaagcgcaattgatcaattgagtcatcaatgggatgctcatctataacttt

SEQ ID NO: 1090 - DNA, 1100 bp, Glycine max
  Soy_ogl_2267 Gm07:7938401..7939500 Cluster 4
aaaactttatgagccatctttccaccgtttagtccaccctacacttgacaaggtaaaaagaagttatatcgtgcatgtaatgaaattcatttcttattggattaactatgttttttaatttcaaaactttttcaagttttcacttttaatcgttgataaaaaaattgactggtgttacacacttttttctagcatatcaagactagttaatttttttattagggactaaaagtgaaaacaagaaaaacttcataaacttcataaactaaaaagaaatcggttttaattctcatacattcttaatttagtctctatgcatgtaggcattcttaatttgacacaaattaattatatgtttaactttattaatataattatatctttaataaagatgacataagaatgacaggggcagtattagtgagttgcctgctccacataatggaaataaaaaaaaaaggttgtttagacttttgtcctgtctaaacgatggaaggatctttgcaaacgtctcacattgatttctagttatctatatgataaaaagtgtcagcaggctaaaagttttgagaaatttaagtctagtcgagatcactcctattccttacttaatcttacgaatgagagttggattgaggctgaagccctggataaaaattgtgatttctactccaaatcttaattcttttacttacatgggttttgttggttaccaactcttctccacgtgcaatctttaatttctttccttggagaagtaaaaattgggatgggaaaagtttaattatcataggatggctgcaagtgcttgccgacctaaagatattgacaattggtttgggtgtcattcaaatagtactacttgtaagttgtaacttactttagtatattttcacctctttatatttttaatgttcataacatgtctgcattcatgtgtcaaaaattttgcctgtacttatagtcttgtatttcaaaatattcattttaaaatgtctccaattcactataattgtgtatgatatcttaaatttcatttcgatgagagctcatcctttgcgctttgttagattggagtccttgatagtggacaagccttt

SEQ ID NO: 1091 - DNA, 1400 bp, Glycine max
  Soy_ogl_1549 Gm05:2362701..2364100 Cluster 4
ccttcaccaaatacatatctcaaattgaaaattgatttttttaagaatcttaaagatctatactattttaaaaaaaataatcattttttactttctttccctaacagccttgaccgtggaggcaacacaaatgaagaggataaggaagtagaaaccactcgaacacacaacagatcgtaaacaacaacaactgatccaaaaaaaacaacaaaaatacacaaggtctaacagcatgcaaagggatccgagattgaacacagagattgtcgatttgtgcaatttttgttagatgggtgaccctagaggcaatatctaccattccttgttgaagatctaggagatccttgttggaaagaagaggggtagaggagattattttaatcagtttagaaaattaagaaaacattaattatcttttctcaataatatcctcatttataattatttcattgaaacactattctactaataatatcttatagtactacataattatcattgcccaataaaaatacctactgtcacatacataactataaggatactccccaaaaaaactataatgatattcagataatcatattattctctttacatttagtgaaatttgatgctgaacttctcagaattttaatattattttggaagatcggactgtatacaatcaaaatattgaggattaattttgttattggccgatatctctgctgagcatctcttccttttttctcttaaggttctaatcatgttccacaggtttacttcatttatcaatgccaaacactgaattaaggtttaatcagagacaaaaatgcatcttaataaatattttaattattaatatatattctatttcttaagattagtttttataattaaaatttagataattaattacttatatttattttaaactaaaatataaagaaaattttaaatggtaaaatccattgtaggacaaaaaaataccaagatttaaaaaaaaaattatcactagagttaaaaatgaaactaatttaaattttatataacattgcagaatttattaaaaaaaaaattaagatatgttctgactattcttttacctctttgactccgtgacttaattttgttttgctgcttgtctgactaacaatgatgtgatgtccttttggattcaaatcaaagaacgaacttatcatgacatgttggagtagaataaggtggtagatatccatcaaatcaattaattttgcactgtgttttatgtaatctaccaatatgtcatggatttgtttagcgatcagtgtaattccggcgccttgaaaatgaacgttttgacaagatacatatatatggcaacgtttgggaaatggttataataaaatagaattaaataagataaaattatacccaaaaaa

SEQ ID NO: 1092 - DNA, 1800 bp, Glycine max
  Soy_ogl_3141 Gm09:36820501..36822300 Cluster 4
gccaccacattggtacatcgcatttctttaaataaattcattacttcatgatgctataactccgaacattggtatttagtactaacttactatgctaaaactcaaactcaaatgtgcaaaggctaaagaattaacagaaggaaagctttgaggtatccacctttcatacataaagaatgaacaaactactcgctcgcatacatcaaatggcatcccattttttataatttgaacgaatagatatggatatggttaaaaatagagactgccatttgatgtatgggagtgtaggaaatattagtaatttataaaagtattaccatgaatgttcactctttaattattgatgtttatgattaatgtacacaaattaaggagtatttaatatgtataagatattaatgtatttagtctaaaattcttttacttaatataagatgtaattgtaatttgttgtttgttgaagtactttttaaatatatacttcatcatttctaataaagattaaatctagttattttaaagagatatataggaagaaaaaaattaagactttagtccttaatttggggttatccctttttttcctaaaatttaaaaatatttttttaagtccctaacataataaattaatattgtataatagtttttagtaatttgtgacaattttaaaatataaattcaagcggttaagaaataaaaattaatttatgataactaaaaaatatcacaaagtatcaatttaatttgtcaaagacaaacaaaaattccaaaatttagagacataaataattttaaattttagaaactaaaaaaatcacacatgaaatttaggactaaagaagtaattaagtaatgggactcaaaatttataaaacataaataggtttgaagtcaaggaagaccggaacgatgcgtactataagggttgcaaagcaaacaggacaattatttttctgtaaaaaataaattctttggacatcatgcatgtctttttcaactcttcttttgcggattatttctcaacaactcaactgctttgttagatgacgggttctagtgtgcgaagaaggaattgagtttcgtaggtgcgaaatctagataggtcatctaatttaacaggtctaatttaacaggtcctaaaattaatgattaagataagtaaaagaacatagattaaatttaaaacaaaatttattttttaaactttttttctttctccctttcttgttgtcccttcacctcaccaactcctatagcttcatcgttggcatccttcacctcaccaactcttatagcttcatcgttggcatcctccacattcaacatcgatgtctttttagatctttagaatatttgtttggatgaaaataatatttttttaactagaggtatgaaaagagtcattacctcttcacatttgtactttaccatatcattctcacacaagtgctttgattgggagcgaaggcttcgaagtgcacgtgatgacgacaaaatgacattgtgctcactagatctggttgttctaacgccacaattctcatacctacctccctattgtcaagctggttgttccacaaaagtcaaaccctcatatagaaatcctttttcagaaaactctaatgctcagcaacatctcacacacgagaagaatcgatgtcgatacaaatgtcgctgtgatgttcaatatttttcgtagacgggaatatgagacatggagcaagaaacaaaagaagacgatctacgtcgatgcattcacgtttgtatctaacgtatcacattacacaatgtttttat

SEQ ID NO: 1093 - DNA, 1191 bp, Glycine max
  Soy_ogl_4916 Gm15:8408913..8410103 Cluster 4
aagccaatagcttttaagctggcctatcaaaatatgctgtttgagacagcttatgaaaaataagttatgtaccaaacaaatttattttggtttaagtaatttataagtcaatcaaaaaagagtttataagtttttcaaagtttttaccaaatataatcatatatgacttttttaagaataaaatatacacaggaataattattttattattgcttaataaatataagataaattttctcttatatttttaagactaaaaaaattatccatgaaacaaacattactaaattatcttcttaaatatgttttaatatttgtaacttatatcttttgagtgactaacacacacggacatatatagagagagagagagagctctactttaagcaatcaagcacatttaggcaccatttttgttaaacgccacatagttatcaaaacctatttgaaaacagcaataataaagtctatctaaaatatttattgagaatatcagttataatttttataagattaagatataactttgatctcctaataatttagtcaaaactatcgaacatatttattgagaatatcgattatcagtcaaaattgtatgtctattttctcatttgacatattttaaatattattattcactcgtataagcgagttttgagctttcttgtgaagtctcactgcaacaaaatgagcaactgctagcagaaataactacacgagagatgttaattatatgatatctcgaaagtgatattgtaccaaactataaatgagaataatttttggaaatggtaacgctaccatgaaacgttgaaactgccaacgtcgttgatgcatctctgggtcgatgggtaaccatatcatctgtgtctcacactcgcctgcttgtgcatatttaatagctaccagattttttatttatttaatttgaacttagagaacttaagcaactagtcaccacaccttttgttgtgttgaaaaagaagttaggtgaattagatactcgaatttataaaaacttaaagcaatttttggcttgtaagtcaaaaagaaactattagtagaaaaatttctacatagctaggcccgtaaaacttgactctaaataccacttcccctccgtcagatttgcatcttactacaattacagtaatcccattcgagagttatgaacattggtgagacaat

SEQ ID NO: 1094 - DNA, 1566 bp, Glycine max
  Soy_ogl_4667 Gm14:5104235..5105800 Cluster 4
atatttaatcattttaagaaattaaaataaaattcttcttccaaaaatatatctgtaaagagtactttttacacaatgttaaaattaatggtcaagccttttgactatttacatacacttcaaaagttattataatatactattcaaataaaataatttttaaaatactattctcaaatacaaaatattattatttttacctcgattcatatttaagaccaattcaatcaaaatttaacatacaattcacaaatcactctaaagacattttagcaatttttttgttaccttaacttcttaatttacctgagtcttttcttcttttaccatcaatttgactgatttaaagtaattaaaaataaaaaaatcgctataaaatttatgatgccaaaatacacaaatatataagatttttaaaaaataattctaaagatatttaacaaattccctacccctacttaaatactacaaattaagtgcacccccacccattccatttcgttgtgattttttttttattgtttctttaattagccaactctgttcataaacaaaagatcagacataatcatcgtacatttgactcataactgtacattattagtgcttattactagcattccttattgctttctgctgtcacactgccaaagaggccccaagatacagtgacatggtcaaaaactcagaaaatatccctattctggtgtttgttactacttcactgacatgcaataataagttgataacatcaaggtcccatgctacttcggcggaaacaccattacgcatgctcagctcgtgattcctgaacatggcaagctaattcacgaataatgtgtttagattatatttatgataaaaaaataataataacttgtatttttatggtgaagataacacaataaaaagagtcgcttttatattttcatggtattgtcatattttgaaaactacaattaattcttcatgttatctaaacactctagaatacgccgcaagtaggtgtctggaatctggaataatctagtgcacgtttatgttttcgttccacacccttttttcagtttatgggcgaaacgtgcttgcttggttccctaattaaaattctctgttttccaaaatataagggtttgttggaataaaagttggacagatatttttataaattttaatgtatcaaataaaaaaggaaaaaaaaaggttttttagaagtaaaaacatattgtaattgctcacgactcaggagtattgaagtattttttttttctttagtagagttctgtcaatttcggttgtgtttctcctactccaaaatcttttgtagtttacttggcaggaacactccgacactaaaagttagtgatatactctatatgatagttattaagatgtaataatgaagatgtacagtgtaacattacattgagaatctaattttttatatacaattaatacttgtgaatcataggatctatgcaccttaccttttttgattaagaaaattttaatccgatattatctaataataacattaagatgatgattagattagaataatactaa

SEQ ID NO: 1095 - DNA, 2000 bp, Glycine max
  Soy_ogl_5628 Gm17:10326501..10328500 Cluster 4
ggttgggaagaaaaaagctgtcaagcttttctttttgtcgaaggttaatgagttggtgtataattgaatcaattgatgttttatatatgtatgtatgctattaggtggaacatgcaattaaagctcgagtaaggaaaaacttatgtgcagttttttgtgtctccattatcaggatacccactcaattagaaagtgacaaatatatatatttactgttccttctcaggcatgtgccaatttataaaaattttaagttgtctgcatgtttcttcctccccttaaaataaaaagtaaaagtgagattggagatccatgctagctttcactcacctctataatttgaccatggaacgcaaccatcgtgtcgtgttggatcttgatcggcacaaagagaaacaacaatcatatatatgaagaattaagaaaacatgaaagagaagggaatattcattcaataaaaggaaggttaagaaaaattatgaagagattattatatattttgggaagagtaaaacagcacatcaagacttctagatctagccactagccagtttgaatatagacaaacggatgttcaaatgatgaataataggtgttttcttaagagcagcatgccctcagtcctgatcagatgatagaaccttatcaatttttttagcgtttaacgcctgtatttcagcattaagcggaatagttaattaaaattttctaacaaacgtgggtgtgagaagcggcatttaggagcttgacaacatgcatatgaatgattagggttttaattaattagaatcttttaccaaaaagaaagagacttccacaatttggagaagcaaagaactaaagactagaagaacataagatcatagagtttaattggaagcattcttaatgctctgcggttatcctgataaaaaaattaaaatttgattaaaaaaatgctctgcggttcttgagaaaggatccaagtcatctaacaacacatatgcttgttactctcttattttctttatttcccatgtttaccacgtgtaactattttttaggttaaggtttgatgaatctctatgtatactaaattcttttatctaatgcaagtttagttttataagattaacttgatgattgaaggaagaaaaatattgtagatttaaatctcttttactaaaaaaaattaacaacaaatatttttgtccatgaaaaaatgcaagtctaattcttggtttttgtgtgcatttctctatgttctagatatttgtttaattaaatcttaagtttgcgcaataaagaaattaggcatacatatataggatagaatttatttacgatagtattatttgaattttaataatatatgaatattttattattaaatttatttaaatattatttaaaatgttcgataactttacgtgttaatatttttaactatataaacatgatccaattgtttgcatttttactctgctttcaccataaattacccctctggatcttacatgaacatgtaacgaatatccgacatggatgacatcaaagtttaaaatactatacttctttgattatatgttgtttgttcgggtcatcatcttctctaatccttctacatcgtctgtgtcagcctgccccacgcacataggcatagccttcaacttcaacaaatgaaaaagcaaaatgacgactagagaaatagttcgagcggtaacctggcttttcattggagcgaatcgggatcaaattcctcatcccttgtttaattgtagttagggtgcatgtgtttgattttctttttggtttttagtttttaaaaattaagtgtaaagaaataagacatggaaatgtagagaagaatcaaacacataatgtgtttacattacgtatgattcatgtgtagttaacctcacataatttgttcacattttttttcttctttttgataaagacgcatacatacacaatttgttcacaaacttctaatttcttaaagcaataaacattaattt

SEQ ID NO: 1096 - DNA, 1800 bp, Glycine max
  Soy_ogl_3367 Gm10:4738301..4740100 Cluster 4
caccccaaaattttcccacgtgcagaaagttgaaatcagctgaattggtaggtggtcaaagcctcttttatgtgcatagattcagttgcccaattctttcgttgaatggagaaattactccatagaatgacatgtgaatacacataagacaataaaataaatttggaaaatatcttaattaccatttttcaaatatggaatattatatatcttgttatatatatcaaaaggttcaatgcttataatcctattaattaatgaataattctaaatatttatgtaatattctttcattttaatttctgaataccaattaagtaaattattaaatatttttatttaagggtttgtctaactaaccccaactaaaatcccattctatgtggtccaataaaattacacccatttgtttagatttttttatgcacaaaaatttatataattttattggttcacatagaatgagttatttaatctcatttacttagctacatttagatcacccctttatttaatattttctttatagatagtatattacttatccgtatattatacagctgaatcagttgaaaaattaaacttagtcataaaaaatactaaaattgatagttttacgtgttaattctctcatattataaatacaagtcttaattattgaatataattaatgaatgtacatactctccttctcaaatactcatcatgtcaaatcaattttatctttttaattagctattttctcaaacaaaactttgacttttcttaattccattaattaatgtttgaatttgttcaattgatattaaatataatgaaaattgaaaatcatcaatgaaggaaatcttttacagtatgaattaaatcgattttccacattcagtacaaaaaaatcaattttccaaaactaaaagtttaatgcatatattttatattttaattaaaaaaattggtagctgtttttaagaaatactttacctgcatttaaaagtatccgtgcaattcacacaatacaatacgtactcattagcaacaaattaaactcagttttgttgagagctattatacatcactataaaatgaaccaaagtaatcgtatcatacaataacttgtaacgatgtaaagactagcgggttggttctctttcaatttcatgaaagctgaagtaacatggtggtgattgatagtctaaaaattcaaaaacaagacagacattttttttgtcagctaaaaattgtaatttatcctctgcatgcttgcaaacaaaaagagtgtgtaacaagaattcatcaacacttctacaaaaagggcagagaaattcacaaccactgatttccacattccttcttttcaagctatctccagaaggtaagtaggtaaccttatttctaaggagcctccaatccaaaagaagagtaattctctgacatttgtttcctgtactgccactattgaatgttgcacctcccattctattctaaaaagttcatttcaaaatgaatatccgaaagcaatgaaaggtgcataatttaaataaggtggtgtaagattgaaatgcctaattctccctacataggcccaacttgtccaaaggaccaaaatttatccaaattttaaccacagttaacttaaaagactattattgccttatccacttttgctttttactaagtacactctccatccctttttctaaaatcaaattacccatcccaagatacccacacattaccacagtgaccaagtataaatatttataaatgaatattatcacatcctaataattaaaattgtactaa

SEQ ID NO: 1097 - DNA, 1800 bp, Glycine max
  Soy_ogl_1466 Gm04:47332101..47333900 Cluster 4
attttcacaaacaagccattcgataaataattatttgttttgttcaaatatttaagcaaatcaaaccattgcctcaaatacaatattttttgcacgtttatctaattgtaaatctgttggtaattgaaaaaccaacattctaaattcaaatattgtatgaataacgtttctttttctacaagttgagcacttgagcatggctatataaaatcagtaatcacatcaaataattacgtgtttttagtaaaattctcataatatccaagctcaacaaagtatgacaagttggacatatagtgattagatgtggcatgttggctgaaatttttggcatctttcaaagcacaaatgggtttttctggcgtgtagtgtggccttccctctcatgaatgtgtccatgttcatgatgtgcctctcattcacggttcacttagcttatgaacacagaacaagagactttggactatcgctcgagtcattttcttcttcatctccttgccctgcatcattatagcaaagacaatttgtgctgtcaatgatcattattattttagttttacttaaaccatctacattcatatcatatgtgatcttcgttttcaaatttcaatttagttcttcgtggaaagaaattgaacaaacctattattcttaatgttgtagttaattgaaattaattgaaacacacaaacaataaacctattactactgtactaattgaatcgtaactcgggtagtgatttaaactattaatcatgtcatagagctactaatgactttaagcaagctcacaatccacctcacttaacacccttttaaatccacaattattatgtggattagtctcaatcgtttatccacttccttctctcttcttattatccctgcaataaaccgtgaatagaaaacccttcacgtacacgtcccagtgtccaatgacggatccacgtgttgttgcacccactaacattataccatttgtaaataaaactagtatcctaatcaggcattgccacgatattcatgtctttcaaattttatttatttcttctatcaaacatcacggacgtttcttactaaaatcgaatactcaaattaaatagatttttttttacacgtgaacaaaataaattttataccatcatgtgaatcttttatatttatcttaatctcaaattaatatttttaaattatattttatcttagtttttaaaattgcaacatataattgtttgtcactaatctcggctagaaagtcaaatgttaaacatgcaatgcaatgtcttaacaccatattatttaagaaaacaatagtatatttattgtttattatataaaatcataagaaatagttagcattttttcttgtcgagtaattaaaagtatttaatagagtatattaaaatatatttttactaaccttgtaagaaattcagaaatatttgtaagactctaaaaataattacaaaaaagtgcaaataagtaaaagctaatatttcttataaattgacctatacatatcaatgatggatccacgtgttgtactatgggtaattgcacccactaacattataccattagtaaatataatgtgtatgtatttttttttcttcaagaaagaaatcgtactaagatatcaactcacatacattatttaattaactgacttagacttttttattataaaatatgtatgtaaattataaattatttatataatatgaaatgtagtggaaaaaatattttataattaagtattgtgcttgtaaatttatttctagtttcattattcttactcaa

SEQ ID NO: 1098 - DNA, 1100 bp, Glycine max
  Soy_ogl_3045 Gm09:7754501..7755600 Cluster 4
aaaatcatcttctgctaattagaaattgaatcctttatttcatccaacaattacttaccgtaccttttaattttatagcgaagaaaaccaaaatatccgacactttaattaaattgatatagtaataaattaacttctaaacgagaaattaaacagggaagtagaattgttaatatccttgatagatagggagaagattaaataagatggcatctcatacaattctctcatttttttacctacatagcaggcacctatgaatatgaaaaatattgatcttagttaatcaatgttcaattttggcaaataattttagactaacttttttttttcattgttgtttactgcatgaaacatcataactagaaaagaggctaaacattacaaaataggcatagttgtactttcacatggtactgaaaatgtactgagacataaaaaaaaatgaaggatggttcctttcttgagcttcacttcggcatttaggtggaacctacaaatcagtgggtaaatgacaaattgttgcttgaagtggacaatttatatatgcgatactcattggatagaatcgtcatgggaaacatgattctaagtgacaactacagaaaatctaacaatattaatgtaagtctatatatgaaggcatcacatcaatttatttttaaccaactaacttcgtaatcaagcaaattacaagcccatgcaagtggttctctttattcattcactctagctatctatgaatgtaacgagactctgattacgagaaaagcctgaaatctaagccacttattaaatttgtggaaaattttggttacttgtgtcatctcatgacacaagaaaataattggttctattttgttgctttgacatgaataaatgctccgatttcatccattttattttcaacggttttgattaagaatttactcaataaataaaaagtggcggttaggattgagaaatcatcaaataatataattataaaaaattacaataagaatatattaatgatattaaatattacatttttcaatatttttcttttatttcttatacgttacccgtcccaaatccatttttttttgtcaaatctctct

SEQ ID NO: 1099 - DNA, 1398 bp, Glycine max
  Soy_ogl_3233 Gm09:40477601..40478998 Cluster 4
aaataatttaaaagttcagaagtaaaaaattaaatagaagcttaataaaattaatttaaaatattttacaatatgtaaaactagaatttgaatttgaattgaggaagttttgagaagacaaattcatcgatgtaatttataaatattttgagtagaaaatgattattcatttattttaggtagaaaaaaaataacaaggagattaaaccggctaagttttttaaaaatagaaaggattaattaattaaaagaccttgaaaaaacaaaatttcacataatcaaaacaaaagggaaaaaaaatgtatgcagtcttgtatttatttctcattttaaaatttcaagataggagtaccgattagtattttctgaaatatatcctcgttaattagaaaaaagagaaaaaatagtatatgaaatataaaataataaatgaaaagataaaggacttattatattctaaataattttaatataaatgagaaataattatttttcttaattttttagcaatattcttcttctcagaaaaagaagaagcaatatttttaaatgaatgatagaaaattgagaaagtaatcattaatcagcacttattggtttaagtggttaaaagtttcatttcctttaaatcatgtctcgaaagccttttatctgaaaaaaaaaaaagttttgccttttaggtaagtctgtttaattcaacaaatattaaatagcatttaaagtaacatttatacaccgagaatttaagacaaaaaaagaaaaaaatattgagggtctgaaaaaacattttccttcttttagaatgagcctttcatatatgcttatgctatgctaaccaatgcgtcctttaattaccacaggaaggaagcacctagcttacagctatatttattgaatatgaaggaataaagggtccctataaaagtctaaaacacacagtgattgatcctcactgtgtttcttttaaattattggttaagtttggacaggtataatacagagatgtttaacatcgaggattatactattactctaaatcccaaatacccacctcatttttgtcaccaaagacaatcctacattgagaccaacaaaatattccaaagtaatttcccatgggaaaatgacatctaatctttgcttcaaacaaagataaaatggaccaaatgacagtgttaataatgaagtcctctgagacttgagagtacaacactttaatttttccaagtcaaacaaagtgaatccaaaatctcacaaacttctatctatccgagagcatattataatatttgaataattaatctagtctcatagatgagttagtagtggttaatattattaaattgtcttcctagggttcccgacaacattagaagcactgtaagaatatatagtaat

SEQ ID NO: 1100 - DNA, 1500 bp, Glycine max
  Soy_ogl_2613 Gm08:57601..59100 Cluster 4
attcttgattttgagactgcaaaaatcttgttagtatacctaacaacattaataccatgatatctcttcaaactttagatttatggggttgttcgaaacttaggaatctgcgactagggcaagcttcaattctttatcccatcgggaatctttggtttttcttgacatgagcttttgcaatctaattgaagtacctgatgctattgaaaacttgagtttagaaagactgaacctgcagggaaacaactttgatttaatacctaagtcgatcaaggagcaacattgtctatcgtatttgaactagtctaattgccatgacctcatagttttgcctgaccttccatcagatagggctacatcatggtggggaaggtattttaaaacggtatctggatctcgtgatcataggtaaggcttatatatctttttgattgtcccgagttggctcatatgttatccgaacatcagaattatcaaatgtcctcgtccaagatgttgaacttgaatggctagtgaaattaattgaggttcgcactctacaacattggatgaaatatttgcctaatctatcatgcattgggagtgtctttagagattaattgtaaaatttagttttaattaataataagattatttcttattcagtaaagcttttcttataacagattattgttataactaattataatgaaatttcataggatcttaataattaattataaaaaaaattttaaaaaaaagatatttattgtgaaaatgatgtgagatcataaaaaaagttacaaatcttaataaaaatattttttttacttaataaatatcctaaagactctaactatcatttgttaatttcatgttgtgattttccttgtggtgatagcaaccctatttttttcggtgtggctttgacattgttgttgcttgaggtttggaagatttacttccacggtggataaataaaagatttaaaggggattcaattataaggataaagaaatttgatatagatgacaattggattggctttgtcttttgtgttatatttgacatgccacttaatttggagtgggatttatatctctaggcaacactttcattttgtgaaaacagaagcacacatcacatttaaagcccaaccaggtattaaaaccatcaagtaggggatgtgcagtatattctggcaagatatattgacgttgattatgtcagaaaaagcaacaacagctttgtgtctaaaatccagcttccttacaattggttgctgacagaggaagatgaagttgagaatattaatacaaaaacaaaagaaaataatctctcatatgcggggctttaaatacgctagctagtcaagcatatttttcggacccaaggtaatcatcttttctaaagttaattattgattaaaaaattttatttactaataataatcattaaaactaaaattgcaatgcattctaaaaggtaataatattttctaaagttaattattgataaata

SEQ ID NO: 1101 - DNA, 1580 bp, Glycine max
  Soy_ogl_2672 Gm08:14135301..14136880 Cluster 4
cttcatactatttaactttatgtattttttttacccatgtattactttatcagtctcgaggctaattcacaaatatacttttgacatttctcttcaagataagatacactacccaacaattgaaatatagaaacaaacaatagtattatcttaaagtatacaattatcaattcttaatgatagatacaaactcataaaagtcccctgttaagaaaaataagagcttgaacgaatgctttgatatgaggtagtaccacacttttaaattcttattcattgacatttataattcagatattttcttttatctattggagatgaagtttattggtcttcagaggtgtcaggtggttaacgtttgaacttaacagcattgcttctgaattctgatcttcttgcaaaaaatgttttgatatctcactgtgctactaaaattttttttcctgtaacttttttcgacagaaatagaatatggattcaagaacgtgctcatatacttttggaaagcactttcttagaacatatttattgcgattcaaacacaaccatttaaatagcttagacttcaatttgacgctgaaaggttactagctagttttttcttctttaattctttgagatgtcttcatataaatcaatcactaaatttatatcttttttagtatatttaattgaggaatataacaatatactctttgacgtattttttttaatacacactttatttttaagttttaactaaaatttattaaaaaaatttaaaatcacaagagatttattaaatgataaatgagacgaatcaaaatttatagttttcaatcattttcaactaatattaaatttattttaaaaaattgtattagaacatgttaatatttctcatttaatttttacctttctagtaatcaacactaacacttatttgtcaaaaaaaaaaaaaaatcaacactaacactaatcaactttaaagttattcaagcacatttatactccaccacagcatattcttaccttttttttgtttcaatcagacggaggatgattgcggcgttcaattacaagtatttagaaattagaatatagtgaaaattacaaaatgtctttgattacatgtcaatcatatgcagctttgcacacgtgacacattatgctcatcatcaaagtctggcatattagtatagatatatataccttaataaaatcgatcatctagcattgcttatgtatgtatgtctaccctacgagaccaaaaatatatgttcaatgtaattagcttatgttacatgcatcttctccattctccatgtttctgtgcattgttttggaacccaaacaggcacctatgacctaccttctcctcagatatgttaatctattatatactagtattcttcaagcttgttctgttgttcccacgtcactcattttttttatattctcatagtttggtacactgaagcacatattctcacatagcgtgacacatggttcttaaacaataatttagagagagggtttcctgcaaggaattttggacgacttataggaccacaccatcactgttgccacacccccttctt

SEQ ID NO: 1102 - DNA, 1100 bp, Glycine max
  Soy_ogl_5857 Gm18:1063001..1064100 Cluster 4
tatagttagaatgtcttaactcgtgtggagtatcttaagttagcaagttttgcgagaaattctgagacaggatctatggccactctggtgcttcaatacacatccgtcctgattttattgaaataaaaacaaaacagggtctagaccaagtattgtaatgtaatttgtggatattactaaccatttcagatcctcgatctgtgaggatctgaatgaactaggcgagcattgtatatgaaggcaaaatatattgatgaaacggacaaaaatctcactctttgactaaatataaacaacaaatacctgcgttccccatttttaacaacaaaatgttgggatagtcatacctcaacgttctatatctattgccattttatcgaccttcaaaatataactagagaaaatagcactatgtttctagtattcaaatcgaaagcatgccattcaatattggaacatatttgcttgctgaacataattattaagtaattttcagctgagtattatgtatttgctacggcgaaaaaaaaaaaggaaggaaagaaatattgatttgtagaaataaatatttaaatatttctttcaattcaaattttaaacttttgttttctatccttttttatcactttctgtctttctcttcaccgtaccaaatgggccgtaaggcagtgtacaaaattttgcaatagtatatccagtatatttcttcatgtcttaggttaatttattctcatgatgagaggtggagaaattatactctcgtgaaaatgtaactttcctaagaataaaatatatttagaaatatctttcttgaccttttgataaatttgtgaatagatattgttgaaaaaagtatcactaactttcttcttgaaaataataattgagagtgtaataaagaaattgatgagacatttattttatattcacgtatgtattaaaaaggtcgcataaagatatttctaaatatttcttattcttggagaagtattttttcatgtcttaggtaaatttattctcattataagaggtggggaaattatattctcatgagaatacgagaagttatttctttatcacatttgtaacttcaattttta

SEQ ID NO: 1103 - DNA, 2282 bp, Glycine max
  Soy_ogl_557 Gm02:14981919..14984200 Cluster 4
gatgttataagaatcattctgtcttttatgttttgttgaaagtaagtaatgtatcctcgcagttcaaagttacaagattaattttactagaaagtaaagtgcaaattatatttcttttcttaaattattaatcacttgtgtcgcaccttagaaataaagtcatttcgtcttattccattccaaacatttcccaccaaaccaagcattgacacaatatgactcctgctttactttttaaaactattgattaagaatgtgcctttctcctaactctattcttgaagaatctataggaaaactacgaatattttatgttttagaattgcaccaaaccaagcgcatcgacgctgctttaatatttaatattttatgaaaagtggataaaggtaataacatttgattcaatgtattttttatttcatcctctttttaaaaaagaagagaagttgaagtaaatataattttaaagcttataaaaaaatatagaggttttgatgacgcaaaaagggttttaagaaaatattgcctcaatttttttttggaattattattctcctcataatgtaaaagcatcttttgaattaaaaaatattaagattgataattaaacaactttagtttcatatttaacgacattattttaaaattttattagattttaaaataatatttaagattaaaaaaaagcataggcaagtactatttcatattatatcttccttttttttcaacatgctctcataaatacgaaagagacacgaaatagttaaaccccattaatttccatttgaaaaaagtaagccccattaataactattaaataaggtcacttattttacattttttcccctttgttagatagtacaagcggctaaaaaaaaatctaaattcatgctctctgaaattacattatcaacgggacaaattataagtgtaaatgtctaatattgtaaatatttttagtgatattatttaattaaaattaaaaaaattcctgataattcacgttatgcacaaattaacaaaataaaaatttaattgtaattaataaaccaaaaatttaattagcatatatcaatcagttcacccaacaaaaattgatcacataaaattaatctatattataattataatcataacataataattatttttattattcaacactatcataattttcacagacagtacttaatatacaaaaccaaatcaacgagaatgtagctccacaattttacgattttgtccttctcaaaagaatgaaagatagaatttgataaacgctaagtataataaaacaatgatttgggcatgcgtgtaaacaacttcaaattacatagacccactttggcttgaccgatgagtacaataatgaagcatacaaggaattttttcaggctaatgaagagttaaaggcattgtattagactaatatcgtatcaaccaagttagatagtagcttgtggagaaagagataagatatcctcaacagtttacttagggagaaagttgaatacaattttgaactaatttgactgtttcattacatacacaagttcgttttatttttagtttccaaatcatcatgacaactcgcaaccaaaacgcagggttttgtagtataatgtgtggtacaagtagcaagtagttagtttaaaatctttaaacatcactttgattgcgtacaaacatgcaaaaataaaaaaaagaaagaaaaacttgtacttttcagttggattagactcctctatagtgcagcatgcaccgcaccttagaggataaagtgcatttatcttaaccatttattatattaatgcttcaaatctttttaattagtttaaaatttagttttaataaaataaaaatataccatcaaataagaataaaaaatatccctcacttcacattcgtcatttacattccttctggataattgatttacagatgtgatcttcaacagataaggatcaataagagttgaagtgagtgtcttctccaatttgtatttgcgatccacaaacacaatcagggtaagaaggattacaccacgttacagttgccattccaaattatctgaaacaccacacacacaatccctaatttatacacacaccattgtataatatatatttattttattatcattaattaattttttcttaattatatcaatgttgatatatgggttcatcgatatgtaggtgaccattgaaggtgttcaacttgatattcctaagaatgctctagaagacgtaggtaatgaagatgaagccaggataatt

SEQ ID NO: 1104 - DNA, 1541 bp, Glycine max
  Soy_ogl_2619 Gm08:11892660..11894200 Cluster 4
tggaaggaaaacaaagttaataatggataggttagcttatttttcataagttttaagtaacttatcaaaataaataagctaaataatttatataaaataagtttatatatcaaataaattattttttcatcaaagaacttataaactagtcaaaaagaacttatcaaacatattagaaaatacttaaatttattgtctcccttcgtatttaatgagtccttattatgattttatttgttataatcaattttaacaagtgatggagattttgttttgaataaaactagttggtacaaaaaccttttatctgatcatataattggactaaatttcctagaaacgactaaattgtagttggcaatgtttgccaagaactaactagtttcctatgcaactcctaaaaccactcaagtacttctaacaggaaatgtgagttttgcgtgtaagagacacataatataaacctcttaactatttttattttttttatgaattccttaactattcttctaacgatgcacgttagaatgacaccatttgcccagtaaatatgtcacttccactatgtttatactttatatatatcatctctcacttcctctctctatatatatcctctttttctttagttgttactttgttgggtattaacttcgccacttcggcataaattttttcacaactaccaataatgttcccaaagtattatgtattagcagttagagcagaataattaatattgctcaagtaaacattattttaatcaatagttttgcagattaaattagtaaaatacaatttaaagcttttttatgtcggccctttggtcccatttttaaaatttaaaattagaatagctttattttaaaaatactaataattttcacactctatttaggctttttgtagttctcgacataacactgcgtttaggctggagacaacttttgcttgataactaaataaagttattgatatataaaacaacatagagaaaagtatcaaattgatgaattattaaagttgaacactgttgtcgtacaatattattaaaaaaatgctacatatacatcaggtaccatctcaatggtaatatgtggctcaaaaaagcaaacattttcatcataatttcgcccaaaattttaattaaatatatttcattagtttctctttatcatatatatttcattaatttgaaaacgacttataaataataaatggataggatttaataaacatctatttgcatgtgcgtatatttttgttaccaaaaaaatgtgcgctcatttttaataatggttaaactagttttttttagacagcggttaaattaaaattttattctctatgtatttggtaactatatttttttttatttagtctcaatacaagaaatcatttttacatgagttcttgccatttacaattgtcataactctgagaatcacttatcttatatgattaatcaattttgacgagactataataacggtatttggacaaatatttcaatctagatttttaatactcgtatgtgatgc

SEQ ID NO: 1105 - DNA, 1775 bp, Glycine max
  Soy_ogl_6258 Gm18:58774026..58775800 Cluster 4
tatttggaagggtaacctaaaaagtaaaaaatgtcaataaataaatgaaatcgctgagaaaatcaatattaacattttttagaaataatataaaaatgtaattaaaaataataaaataatattataatagtaggaaataaaaactcagagaattgtagaattaaatatcctgaacaacaataaattttgcaactttacttgaaaattattgtttaatatatataatatatgcatatatatactaattaatttataaatttaacaataaatatttaaagaatttaattcagcctttatcggtaattatactatgtatacttaataatttaggggatactaactaactaataactatcgaaataaaaatgaaaattattcatattaccgtataacggtgtctttccagtggagcacagcaaaaatgaatgtaggtcggagatcagtgaataagcaaagggagtatttttatgttgatggcacagtactaataataattaatgctattcaggataatgaagtatttatttatttatatttgaatactgcacttgccaatatatggtagtcctcgcttatttctatttatatttacacaggaatttgttaatagaatttttacttaatttgaaaaaaattcttaattagttctcttaagaaactaacttgcctaaaaagttctctaaactaacttacgctctcacataatatattatgaggtaccttgtgaaaacgtaggatatgggatatattaatttaacagtaatgctatttcttacgaaagcgttcctttcacgaatcccacaaataagttatgtggggttaatttcttttttttttttttaaataaatattaattaaaataaaagataaatcttggcacaaatacacgttcgtgcagtttttacgacagccctttcatacaaacaagcatttccttaatttaaatctcatcatgtaattgtatattgaatttagaggtggtaaaatgagttaggctaattggatcggtccgaatcggtttaatgaaatataagacttgaatttaaattttttaggtcaaattaatggagacttttagttcgattcaaatataattcaatataggttaaaccaaccaaattttattagaagcccacaaaaacaagtttttacaagatttgaatttcattttttagggtcagagcaaatttgattttttttttggctggatccattataatatctaacccataacaggtcaatccatgttgggatatatacttgttttgtcacctataatataatattgatagataatattaaatgaaatataagacttataacttaaattttttaatccaaattaaatggagacttttaactcaacccaaacatattcaatgcaagttaaacttgcaaaatttcgttagaagctaaaaaagaacttttacaaggtttgaatttcatttttaagcttagaataaatttggattttttttgtcttgtatcaggtcaacccacattgggacatgtaacccgttttatcacctataatattgatagacaatattaaatgaaatataagacttgaatttaaattttttagtccaaattaaatgtagacttttagttcgatctaaacataattcaatgcatattaagtctgtaaaattttgttagaatcccacaaaaagagcttttagagggtttgaatttcattttttagcccagaataaatttagatttttttggtaggatccattataatccataaatccttttaggtcaactcatac

SEQ ID NO: 1106 - DNA, 1900 bp, Glycine max
  Soy_ogl_70 Gm01:13501..2972400 Cluster 4
tggtgagagaaatgagaaaatgaaaagcttcagacacaggaatgggggcacagttcttgactgaagttgtttcggaagagtatggggatctatgttttattatatagttaacttcttacctacataacaatcacagtaatataattgacaaacgtgagatttaatttctaggtttctattgaggtaaaaaaaatttaacccaatggatcacatatgacttgacttttcatttatggcatgagagaaattgaagtgatagaccaaataggtcagacactgagctaaagaaatgttgagtcaaaatctatcaaatctatccaacttgatattttttctataaaatacatataaattaatgcaaaaaagaaaatgaaccaatttttcctgatttcacagactacactggacaacaaatcagtgatcatattaaaattaggtcgagttgggtcatttttatgcttttaactattggttgggtcagatgatttattttgataacttcacgaacttttatgtatgaaaaatataagttaaaaatatcaatatcttaaataaattttatttttttaaaaaaataatttttaggtccaaactaaaggataccataaataaataataattaaaaaatagtaaacttcaacatgaattgaactgaggatttggggcggtggaatatagctataatttattaatgttggtgccaaattccaaagaacgaggatccccattttaataagttatcatggacaatggagaatcctaatctgattgcaaatagctcacttgtcttcagcatgaaactttttcgaagtgcttggcagatatttgctcacattcttatggctttgatcctccattttcccccagcactgaataatatgtgtattgaccaatatttatatactatttttatattccttgattaattagtgtgtgtgtgtgtttgtttttacttttcacaacacgcaaaccgatgtttcattcacagccaaattttctttactatttagatgcaatggaacgcttaatgacaaagataaacaaattttctttagtttattcatattagtatgtaataaaagatttacatacaaaaatagtataatgttttatttaaacaaatgtattggtaggattatttcattaatttgtgcagtttttttgtctgacaagtgcaattttttttaggtaatttagtgcgaaaatacaggtatcgtgctagtacatacgaaaagagaaggatgggcagcttttatttctgcagcgtcctagtgcacgtgcatagtttccctttcatcgcccaccaatttttcaaccttctttgtttttttatggataaattgataacggaagttgctatttttttctcatatggatttttctccctaactcttgcttattttgaccactcaaattaaatataaatgccgcatgcttttggtacttaaattgaatacaagtgccactgttatcaatgtgatcatactttaaatttaaaaaaaaaaaaaaaaaaactttcacactcccttttttacattatctttatatcttctgtttcgtgacaaaaaaaaaaggacgaggaggagaaacttaagttaatttctgtcttcactatttttctattaaaaaaaaggcatgggatgagtagcattgagatagggtgttaaaatattaactctctttgttaatataagtgtatgtattcacacaatgtggtccaaagtccgcaatcccgattgtttaacggctcaacgatgtgttcaattgctgatttttgtcttctatttccacaaaagagaaatcttttgactttggtcccttttggataacctattttacatatgatttgctcttactttctactctcttttagtttattcacctttgttgtattcccttt

SEQ ID NO: 1107 - DNA, 1972 bp, Glycine max
  Soy_ogl_2665 Gm08:13628201..13630172 Cluster 4
cagaaacttgtttattgatcatcaataagttttctgaaaattatggtttttaatttaagtaaaatccaaaaaagtgtgttaaaaaaaaatttgttattaaataatgattaaaaaattgcataataaaattataacaaaagatatcttcattgttaaattgcataataaaaacttgtttattgatcattaataagttttctgtaaattatgagtttttgatataagtaaaatctaaaaatgtgtgttaaatttttattattattaaataatgattaaaaatttgcataaaaattataataagagatgtcttcgttgttaaataaataatctattttttatgaaaataaaataaagttataaaagtacagaaattgataaataaattatgaaaataaattattagaactaagagacatcaactttctgtttattagtttaatatgatatgataaattgacattttaaaatttaaattaagattttttaaggtaaaattaagattattaaatcttattgattgtatttgaaatttaatagactaaatttgggtgtcttgaaaaaatatatttattaacttttaatatagtgcattatgatttaaaatttaattttaattcaaatttaaactaggattaactaaatttatgtagtgatgttagtgaagaatgaaaaataaaaatatattaaatgtttaatgaacatgctacgtgatttcataaaaaaaggtaaattttaaaagtatttttatttttaaaactaaatatttaaatttacaatgtatatgtatagatgaaagtttaaagccacactttaaaggggacaataatctacactttacaggataatatatcttccttgtcaaaaaaaggataatatattttcacctactcgatcgacgtgttatatgaatttactctattatttttttataggcatattagactattagtgcactctataaactatttgtcaagacaagagtatgtatgtttttttatataaaatcatgttgcaaatagcgttattctaaatatttttataaacatgttgaaaaatagcgaatgatgtaaggatcatagcgtctgaaacttaatttgtgaaaacatgcattgattggaattcagaaactcacataatgacagatatgaggttgttgatatagtctttatcatgatgtaagttgatgaattccattaattgctgattcatgcgatgttttcccagtcaccaaaatgcatattacccgttcattgaaacttaggtcctacaaatacttcgtccttaattaattaaatttatttaaataaaatattcgtgcaatacagctaaatatataacttttggatggggtgctactagtgtgtttattctgacattatatagcatatatgattaaaaataataataaatgtaaagttattcttattatgatacgattctcgcgaacaataaaaaaaaaacaatggttattacatcacctcttaatagcatgttaatatattttattaacccaatggataattaatttcggcaccttcaaaattcacaaaacacatatataatatctaaaaatgttttcgtgtcattttcaacacaatgacatttagatttctatatttttttttgttaaatcaatgcaatagaaattataggatggacatataacactgaatcacgttattctattaaagacacaccagtgctatgtgttagaactcattaacgccagtctagtgatgaaaattgagataatttcatgaaaatttaggtttaattttcatttttgttattatacacacacaaaaatgctatatgctagaaaaatgaagttgtttacccttgcaatttaaaaaaagtaataacaaagacaatgaaaggatgttattataatcaaaaaccaatgtttagaatttactaagtagtgctatatatgctagtgcacaccattatcaaaaaccaatgaacgaaagag

SEQ ID NO: 1108 - DNA, 1500 bp, Glycine max
  Soy_ogl_3048 Gm09:8520001..8521500 Cluster 4
tgttgtcttttcaattttttttcttccaaaaagccctcactcaagacttcaaatcttctatttaccaaccttctaataaagcctattcatttttcttgattctacaagggtaacgaatattaataaaataaaatgctctaaatgtgtgatgctattgttttcttttgattaaatgtaattggtggtttgatggtcattttagccttttatgttcatgagcacacctatatacgtttagattccttcataaagcttccaaccgtgaaactattccaaacacgctatacaatggtttgaaaatggactcattcctttaaataatgtctctagctagttcaaatcttgtttatgtatacaaaaaaaacatatataattgataagaaataaaagtggttaatcaagttttttcttttgacagatatttatcattaataacatgtgaatacctcacacccataatacaataacagaaaaagtatatacatttacactttctcttttacccgtccttagataaaaacaaaaaatagtgcaaaaatttgaaaaatgaaaagtgagtgtaacttaaaaagaataaaaaaaatgttatagttttatttgctaataaaaaaaattaagatgaacaagtatgagaagatccattcaagctcaagagaaataattttaaatattatttcaaataattaatcaattgtacgtaatgcataaataaataatctatcgggccccaattcttactaatagaattagagaagcctgattatttttctactcattaatttttttgacttaaatatgttccatcaaattttagagtttgtctttcttagtctccaaatttaaatattcttaattattttgttcctcaattttttttttaaaaaatattcttcttagtctcttctatttgatttttaaaagtttagatacataatttgtgataaaattttactagcaagaagggactgaaaacaatattttacaattttaatttgaagaactaaaaaaagacaaatctcatatttgaaggattaaaaatatattatttttaaacatttaatttatttgtttataacaattaattggatgacatatcttggaaagaaaggagtcaccatcgatttacaaaattcttattcagcctatatcgaaggacaaaattgaaaaaaggcctttatgtgtttgtatgtctttctatctgagaaacagggagagcattaatgaagtcgaaagagacctgctttaaagatccggcgatgccccaacaacataaacgcgtttacagcttgctttcgtgctattgctaagttgtaaggatggcaacattttttttctgtagaaaaatagtaatgcaaatcatttatagtggataatatgaattcaaacatgtactagctagtatttacgattatttatctaaaataaatttaacaagattttttaatacaggaaacaaagtaaaattctcgggttttttattccccaattataatactaaat

SEQ ID NO: 1109 - DNA, 1332 bp, Glycine max
  Soy_ogl_552 Gm02:14763969..14765300 Cluster 4
atatgactatctaaacctttgtcaattttattggtaagcaagttgatattttggagaattaagtgattgtatatcaattttttaaaattggtagtcaatccttttatttttatatttacaatattaacaattaaattacatgattttgatatatgtgtaacaatattcataaatatattagtctaatatcagtaattgtcaaaaataatttactttccgatgcttttaaattgcttttcaatttcacatgtgaatgaagttattgaaaataacattcttaatgaaaataagttcttttaattacataatcaatttttttttcatattctatttattctttaagggtttccttcattgtcttcaagtaattacatcaaaatttcattttcataactttatcaaattttatattgacaacatgtgactagggtttaagattttatttatgataaagaagtatcactttaacgtgaaaacaatacaattgtaattaagacagtatgagattgaaagctgagtagtaaaaattagtataaaaaaaagaagacatattgtagaaaaaatagagaaatattaaacagtgaaacggaaacatgttgaaaagagtgtttttaaattctagaaacaaagaatttgcgtgacgaataactagttgaaccaatttaattagttatgataatagatcttattttattaattaaattataattgtacttggcttatcttaaatactatcttttatatttatttttaaacaattcatttacatcaagattgtaatatatgatttctaaaaaaaaaaagattgtaatatgattgactctgcattatattctcgaagtaaatttaccaaacagtttgattttcttttttatctctaaagtctaaacttgttttcgaattaatacttaccaaatatgttttattcttttttttttcttaaatagggatcttctttcttattatttagtgggtttcattatcaaactaatgtgagccacataaaagatttaaaccagtgagagagaatactaatgaaaaagagtattaaatgtgtgtcactaattattcttttagctagaatagttttaaaaaataaaagatcgaaacataatcaaacaggcctatactataagtttcgaagactaataaatcaagtttgaagtaatagatataaaaagacctcgacctatagatctgtgagactatctacttctaattgtgatgacttctgtgtgtcttctgcaaagggcgagaactatgatcacccgagacattttggttttcttttctttgttttcaatgagatcttggacacatgcaatgcacggg

SEQ ID NO: 1110 - DNA, 1375 bp, Glycine max
  Soy_ogl_648 Gm02:44599126..44600500 Cluster 4
atttgaatattaagttttacacttttacctaacatgtcatacattgacattattgagtaaatttaaaaatatgtagttgcataaaatagaagttcatcaattaatgcgatgatgcatcattaaatataaaagctatcatttatatttaacctttaatttgatgacgaggtattttaacttaaatatgtaacaattgtgcaatcatttcatgtattcattttttttattcaattttctggaatgttttcagcagtgggtgacataaagtgggggatgcgataacgatgtatttttataaacaacaatagtgttagtagtactacatcttacttcatcatcaacaagaaaataattgtgatttctttgagtcgtcactgcattgagatataataaatgctcatcaccattcttaaatatattgattaaagaattaaaataaattattgagatgtccatgacttgctttacattttttaataatttttatgataaatatttttttcatgtagtttcttaattaatgtcttaagacacccattaacaaaatctttgacatgtatgcttaactagtaaacaaaataacttccttcgtatgcataattaataaacacaaaaactgaagaagaacattgctttcgtgggagtgagtaagcgccaacggaatcacgttggccatgaaaacgaaagcataagaagatgcttcaataaaatagctagcgtgcggcgacacgatgaagttgcgtgattaagtgtaacaataccgctatataataaatgtttggaaaatgactcttgaagtattgaataatgtgtggtttttggttcaagttcaacttcatgtttcggttgcaagggattcaagactacacaatggatgggacaatcaataagcctttagtcttaagttgtattagacttgatcatttttaaaaagttttatgttaggatcgattcttatagaaaaaagaagaagagattactaaatatgattagttagattttcttataaatggaaaaaaaaatacgaatcataagtaaaagtaacggatatttcattcatatgataataaaataaaaaatttgaaaagaagacaatggatgggacaagcccagttatatttcagctgaagcttggtttcttgcgcgtgatattattggatttttaggctacataaaggaaatgagattggaccattctataaaattcgtgatttgggtacaagagtaaaatgaaaatgaccattacccatcgatctacgtcagcttagtttgctttttctctattttgttcttttagacccaaacagaatgttcgttgttaattccaattgggtcattggaccaccctctagtcctctttttaaaaatcaaccct

SEQ ID NO: 1111 - DNA, 1763 bp, Glycine max
  Soy_ogl_1305 Gm04:38233520..38235282 Cluster 4
tttcttaaataaatttaggttctcacttgtaattatatttaaccaattttaatcacatacaaaatttttggggtgttacaaaaaataacttgaccatttttcaaacttactgaacaacacactaaaattaatttttcctacaaatatatatttatgttactccataataataatataaataaaccaaatactaataaggtttgtaatagttagacgtgtttctgcttgaaagcaataattaacataaaattaaacataataacacgagcagactttttccagagttcaaactccctacttagatttgggttattttaagttaatatatctagccgtcactccacaaagttagtctttaacaaaatagtgagctaatatagcctttaacaaattaatcaacattgaaagcattgatcttataatatcaaagaaaaatataataaggtgaagataatatcaaagagaataaaaaggtgtctacgagataccgaaatgttgaaatctgggccgttagcttctaattaatctgatgagtatggactaactaatccagaggcaagaaacaagcttgaattgatggtgacactaggagcagtaggtgtgaatatccacatgtttcaccaaattttaggttaacaaatatatgaaaatatatatagaaagaaagggcgggagagtttatatcaaaataaaaaaaatgtgcaagagagtgttttaatcttttatattttaagatccattagtgataaaaaaaaatataacaaagataaaaaaagaattaacacccgagataaaaaaaatttaacacccatctaatgataaaaaagatttaacacttatctaaaataaaaaaaaaagatttgacacccatctaaaataaaataaaaaatatttaacacccatctaataataaaaaaggataaaatatgtttggagtctataaaatttgaaaagtattatcttgatcctcattcgtattagttcaatccttataaaaataaaatattttttatggtcctcattagtaattccgttagactatttctttacgtaactaacatacttaattactttttttttatatctttccaatcacactcaaaagacaccagaattcattgttattttatcttttcccttgatctggttagaaagtgtgagaaaatagttaggaagtgaggggaaaaaatacaattttaatcactacaaattgtttaatttattagtaatcaaattatatatgtaaggttgttatcaacatcaaattatgtatgatgaaaataccatcaaggaccataaaaatattttgttttgataaaaattaaattaatacgaaaagttttgcaagaatcaaaataatactttttaaattttagaggaactttaaacatattttatcttaaaaaaaaaagattttccacccatccaatgataaaaaaagatttaacacccatttaatgattaaagaaaagattgagatgtctagcttaacttagcttgtgaaatggaatcttaaggagattaattaatcactagttcaatctaaaatctggaaaaaagaatgtgtcacgacatcactatagagaaggtgaaattttgtgattcatacagttaaattagcattgagaaattaaacattttaatacacttaatttatgcatgcattaaaataaatttaaaaattagataaaattaacattataaattattcaaaatatataacttgtattaattgataaatcaagtaaataagcaaggttttt

SEQ ID NO: 1112 - DNA, 1200 bp, Glycine max
  Soy_ogl_2685 Gm08:14566501..14567700 Cluster 4
ttataccatatccgcgtatccttaagcctctagatctattaaagagtattaaatatacttttaaattatcttgcattaaaaataattatacttttatatctttaatgcatactctaaaaatactcatctacatgcattatcatagaagttatagaaaggtatgtaaaataatcttatttaaatgacaaaaaatagttaatatactatatttaacattaattatactttattgtcgctattaattatttatgtttaacactatatgatatatataatacttttttaatcaaaagaaagaacaaaagctgttacatttttattgtaaagcaataatttccaacgtaaagttataagttataaatgtttgtgaataacattattcaactcatatacggtttgtattgctcgatcaacaatgaatttatgaagtccggagataaaaaaataaaataaaataggttggatggttaaagaattaggaaagggtaaaagatctcaattttgtttcctttgttataaaaaataataaactaacaactaacctttgataaaaaaaaaaaaattatcaaacctaagtttgcttaaaatttacttaatgtcctcttgtaatttgactggatggctaaagaaagtgttgagagaggttactaattttgtaatttgtagtcctagacactggcccaatcgaattttccaacaaaatagaagaattttttaaacaaaataccattttgggtgggtctcaaaacaatttttctatcatggatgattttgatcacttaggatttgggtggtgccaaacaaaaaaaatactttcgcgctaacttttgtcctcttgtgggaaatgtcactttgaaggttttcatcttctcaggtggacctgttagacaaacactgtggattatctcatgtgttttgttgtccaagataacaaaacatgagacgtcattttgttctttgacatcatgcataagtgaattttttattaaaaaattattttttaatatatttaccgttagatataataattgtctaaatttttgtagggtgaaagaatcatagctttggttaattttttagttggatatttttttatataatttttttcactaccaacttttactatttttcgataatttgttgtatttccatgttttttaatatatttaaaattagatatttaaatatctaaaaagaaaa

SEQ ID NO: 1113 - DNA, 1300 bp, Glycine max
  Soy_ogl_3018 Gm09:5711801..5713100 Cluster 4
acaagaccgaaaaatgtaatacagctttgaaattgtgaacatcatcaattgttgtgcaagtgtttagagtttatgtgttttaatcaagtaatttaagttcaaatttttattaattgttaagtataaaataaattatattaaaagaaaaaaattaatcgttatttttttatgagaatttgtttatatcaatataatgatcagaaaaataaatcatgaaaatttctggctgagtatgggtgggggtgtcatcagcaagctaaagacctataggtcctaggaatataggatagccttaatagggacatgtgaaagatcgcagattcaacactcttcccattattccatgtatatatatacttagtatcaaatatcaatgcctacaccatgcaaccagagccaccacaataacacactctaaaaggaaagtgccaacttagatggaatggcttttccttttgcttggcaacatgccaataaagatgaactataaggaagtcatttgaatttgataatctgtaccttgcttgattttgtggcataatggagccaacctagctaggatgttaattaaagtaaggaacaaagtacatagataaaaaatagaggataattaagtcgatattatattgtattacttttgaagtcatcattttttttttaaattgtggatatataacatatgcatgtggttgtgatcgatcaagaatttgaacttccattccttttgatggctgcgagtaattaatctacgaggtggtacatgtaaaatgctgtgacaccgagtttatatggggtatattatggtaaagtaattacatactccatccatcaggtctcaaatataaaaaaataataattatgacatattaactaaaaaatactccatcaggtctcaaatataattttttttatgacatattaactaaaaaattagtgaactcatttaatttcatcaattttaattaaaaaatattgttttaacttatcctatattaaaacttaatatcaaagtcattgatattggaatctcaattaaatataagatattttaaaaataataatattgaataaaataaaattagttgaatttcttttatatatatttgagataaaagaaaataatatataagatatacttactggtctggtttgagagagtagtatttataaaagtaattggagaggacctttattattaacaagctaagcgatattttataaactgagggaggtttgtgtaagttgaaaaaaggaaaaaatattaatatagtttcattaaaattaaactagtataattaaa

SEQ ID NO: 1114 - DNA, 1472 bp, Glycine max
  Soy_ogl_3037 Gm09:7171742..7173213 Cluster 4
cacattgttagaaattttgctgattaattaattatcaatctgctcctcaaattaatagttttaaatgaattaatttagtttttaatttttttaaaaaaattaagaacttgagatcaaattgaaccatttaaaataatttagagaccaaattaatttgtttttaaaattttgagaattaaatttaacatttaaaaaaaatggggttaaattaatttattttcataaatttgagaattaaaatgaatattttaaagatttagaaattaaattgaatcgtttaaaataacatggtgagcatattgataattatatcaagctttttcccaaaaagtgtgtatgcctattgaactcttgtaactaaattctctattaaaaaattgatatttaataaattgacgattcatcctagatacagtagtaacttccaagaaattttggaagaaacagttttaaatatgtcccatgctatgcggctattttccagccaaaagttagggaatattaaacttcactctctcttctcgagcattggtttacaattttctataatgaacacaagtatgaactttgtttgcttcaggcttggttttcatttttttatgaacctgagcatatatatattcattaagttcagataggtcgttgaagattatgcacatctttagcttatctcacagctggtagattttctctgttgctacgctaacttgcaccatggtatcaatctaaactcgagcttttattaattaattatttgcaagcgattgaactgcaagttgttttgcacagtcattattctctcaaaatcttgaccagagtttggccaaactgttatatgtggggattattccttcaagtcttctactcgatgacttgtgctcaattactcaaatagagagtttataataactcaaatatattatttaactaactgaaataaactcttttaaccttaactaaaaacaagggtacaataggaatgagttagatatatggtagtgccacaaattaatgttgccaaagatatgttaatagcttctatattctgaagcagtgaggaaggttgcacaagactatgccagcggtacataaatcctagtattacataaatggagcaaaaagtttgatgagcacatgcatgcgtgtgacaaaatattgatttttgttgctttcataggctcttccataaatcataacattatgggttgttgataagatgatagtaatacccaaattaattagtcgtgccgttgtgtttaagaaatactactggatatgcccttttataagaatcttctgaaaagtttatatcaataattgttataagctctcaaagaaatacttattataagtctctttacaaattgtatattgcatgaatgatcatatatatatatatatatacaccagatgtagtgttccatgcatatgcccgaacaggaaaaaaaaaacttgtatctaaaaaaagggaa

SEQ ID NO: 1115 - DNA, 2200 bp, Glycine max
  Soy_ogl_518 Gm02:12715101..12717300 Cluster 4
tatatttaagcttttgtaatgtttgattaaatattatttaagtcaatttaatcatctaattattctcataaatgttttgtgatgattaatttatttgttgtcttataaatgccacgaatcatatttaaagggtaatgatcaaaccgtttaatcttgcaataaaaacactcaatattattttttccagcttaacaaatagattttaaaattttaatcttttaatattttatttttttacaattcatcttttagtgttttcaaaaatcagttcaaagaaaattatttcatacgatacaagagtgtgcaattgtatgggtattgaatgaaaaagttgtggtgtagtatgggtattgaatgaaaaagttgtggtgtagtgtacgatgatatgattgagtgagagaaaatattggcaaaagatgatgaaggaaaggagaatgagatgttgagacaatttgttagagtgggtgtgggtgagataagaaaaaggtaaagagtgaattctgttttgaggtgagtggtggtattatgtgctgaaaaaaaaatgacgtgaatacattaagacatgaaattgaggtttattagaattaatatattattagtatgatgaaatgatgtaaaatgtgtgtgaatgaacgtgaaagatggtaatgaaattttttgataaatcaccaagttatttaatatagttataatttgataaatcttttgaattattataatttggttgatatgcttagttcaattaggttggtgaaaaagattttgacattagagtcaaggtttagtatgattttaacgtatgatatacatttaaataaatagattttattgtattcttacattataataataaaataaaattattgtattaaaaataatagtataaaaaatatatcattgacaaagaaaagttattttgttaataaagatatatcaacgaaatttacctaaatttttttattagtattaatagtaaaatatttaatatctttctaattaaaatttctaaaaaaatatttccaaattataattattttttttgagaaaattaagcatagatataattagaattataacaactatcaaaataattttatcatagaattaaataataatatttaataaaatttaatagaatgctatggaattatagatgactacttaataatattattgtgtctatttttttaaaaaattaaacacattaggtatgcgtgtttccaaatttttaataataaaattggtctacctagatatattatttttaatcatgtatttcttatctaatttttcaatatttattaacatattggttctttatttatgtaaccttcaatattgatttgtgatttcaaattaataaagaaatgtaacataaaattgaaacttaaacttttttgttattgtaaacatattacaacaaaagttttcattttgttaaatttcaaaatataattcatcacatattccgcatataaaatatgaattaattatacattatgttgtcaatattattcaccatgttttacacgtataattgcaataaaataaatttaattaagctaacttaattcatcaatactttatttacatcatgtattagttatactttatttacttaattcatcaatttcactatactaaatcattttttatttatatttatttgattaggtattttgggcatgtgataaataattaaagaattacggatttatttcaaacaatttacaattattcaggaaaaaaagactatgcttattttatgatgagacacctcttgaaatgttttaattagaaattataatatgtttatttacgatacaagcttttgtaataccaatacatgttttcttacctttaatatattgacttatttttgaaatgttttacttatcaaatgtcaaaagaaataattcaataaaaaatgatttgaattgtttatttaaatattatttaatataaaattattttatacatatacaaataagattactcaccgggtaccatgcacaagtaaaaaaatagttgtataactaatatgatattttttttactgacttatagggacttaacaaccaacaaaaaaaaaaaaacacagaaaacacacctatacccttcctattttgatttctccgccagcaaaactaggagcttgcacgtaaaaaatcaaaacccctgaggcaacccaaaagcatgt

SEQ ID NO: 1116 - DNA, 1703 bp, Glycine max
  Soy_ogl_551 Gm02:14761198..14762900 Cluster 4
ttgtaatatttatgtgtgaacgtaaataataagtgtcaaagagtataaacttttgtataatctattattttttatgtaacatgtttatatttcttctcatttttaattaatttttgttgtgtgtgactttcctaaaataaaaaaataataatgtatcaaaacagttattagattagattaagaagtaagaaccattactttaatatcaaaaaatcacttataaattaattaaaagatcgaaaataatagtatttttttaattttaaaatagtaaaaataaaaaataaacaaattaatttcaaaagcttgaaagccaccgtccactatactatgggctatcatcatcatcactacgaatgctacttcagtgtgaaagcactatatgtggcgttagatggatcaaaacaataaaccttttcagttgtggctgttaactgagtagtacagttatggctctcaacttgaaccagatttcctgttttagaaattagtcagcaagctaattaagatgataatatttgagcattcacatattacaaagtacaaacattttattaatatttttatatctttttctatcatattaaattatcaattaaattaataaataactcatctttcatctctttttctctctcttgagatgtaaatacctgagaagtataaaaaaaatatttttcaactaaattaatataaatcgaacttagatctcttcagtacaaatataaaccattaattacagtacaagagcatgactaatttgggtttacaccaagatataatcgataatcttttcctctaaatttgaatttaagacatttttttcaaatctttattgactttaaatttataagaaaataagttatgtatatgtaaaacaactttatatgatcctttaatcaaccattatcatatatgatgaatttattaattttgataataaatttttcaaaattataccaaaaagaatttatgaatatttgttggttatttttccctcaaacatgcttaagagagttttaatgagattcggtgtattaatacttatataatcacatcttaattgattgaccgtactaataatgcatagacattaaactttaaatttaatttatttttacaaaaataacaaaaagacatattgatcctaattgtggaactagaaattattatgagatacggaaaatatattaaaggggaaaatgtctcattatgataattaggtggggtcaataaatcagcatggttagagatggcagaattacagctgatgccctctttagaagatccaaataagacgtttctaattgtgtatgggattggacggttggaccatttttcaactcaaatcatttgtggtgcgtggatttgtactgatatcgatcacatccctttcgattttttccagtcacaggtggtggtggtggtgggttatagtttagtacaatgtgacaagtgacaataaactaggaacgtaactgaaattggttcagaacgaaaggcctcaagaattagtaaagaatttgaagaaagcgtgatggtgtgttctaaagcgtatcatacctttcaatagtgtctcttgtttctttacaaccacaaaaaagaaatagaaaattatatatttaaagcaacaaagggaatgacgagatatggatggaacaatgcaggttataaagttgtatatatgtacgcacacatatctg

SEQ ID NO: 1117 - DNA, 1981 bp, Glycine max
  Soy_ogl_875 Gm03:34606020..34608000 Cluster 4
agattaagatattaaattagtattctatctccattcatcaaataaaaaaaaagtttaatatgcactgtaaaataattttatattattatctaatcataaataattgtttaaattattttaaaataattatcttaaaagttaacaaatttatattacatggtaagtgcgaatgataagtgcaaaagaatgattgtgtaaaaaaatttatatttttagtgtataatttttttcataaaaaaatgaaaaatcatgtttgacttgtgatttttttatttttatgcaaataaagtaattatttacagattgggattggggctaatttcaaagttttgtttggatgttatgttaaaaaaaacacaggaacaacaccacatatagttgttaacttgttttaaattaaaacatttttttgaaatatttaatttatatgaaagaatccacagattctaagaccacatattagtttattcatatgattgatcagttgtttagtactgtagtaactagtaaccatccaataaaagaaatgtaaaacaatgctttccacataacttgtgtactatgtatttaatatattattgtggtttaaattttgcgtacattttatgtcaacttatttaatatctgatttttatcctttgccctaaacctactagtctaggaatatatttcaagtttaatatatttttaatttattttagtttcgtactataaattaacatatttcattcaaaattcaaatactatttaaatacagtaaaagttaatttgtgctaatgtacatatatataacttttagaaaccaaactagtttttcaaaaacgtgtcaaataattcagatcgtcttttacaaaggattgttgatgtatttgacgccttgtagctctttttaaataaagctacgcaaccaaaactcttccattctttctatcttgcttttctttttctttttaatattttggctggaaagacataccaataagatttttttatcagctaaatcaaaattgcattaaaaaaaggcatatcccaataagattaaatgcatcatatagtaatcatgcctttaccaattagtttataaattaatctatcaaacatgatgttgtgctgatataaattagtacccagaaggatccagatcgaataaatttttgctctaagcgtcactttttgcatcatgattaatcataagaaattcaacttattttcattctgtatatatacacacgtttgaaaccaaagaaggagacagcatcatctaagcaaagaaagaatatatgaagatagtgtaaattagcagatccaaaggccattgtttcctattagaatcattcaaaaccactaaatggaaagtgctaaatgacctcactatgagaaaagagtgagagaaagaactatataataaaataattgaaggtagagtagtgagaaaaaagaagggaaaggaaagacacctcactactatcgtgtactatttctctattgtcacactatacaatataaataattgaacacgacatgttttgctattggccaattatattttatacatgcatgtcaccatcggttaaggattcaaagtacaatgattataatttccagctttattaacttcatcacatataaattctgcatacacaaacaacaatgctaatcaacatactttattagcttccatattacataaaatatgaaagattgccacccaaattagaaataaacttgaaattcctgaaagcgacaaaaactgaaggaaaatgatgatgtctatgtggagtcaggctatcggtaagaattattacgatttttctcttgtgattatgacgaatatttaaagatgaaactaagcaattataacattgttgattatatgataactgtcttatacccaatatataaatttttaatattcgaactatttaaaaagaagcttatatattgagcacactatttaaaaagcaagtaaacagtatggcta

SEQ ID NO: 1118 - DNA, 1700 bp, Glycine max
  Soy_ogl_3067 Gm09:20456301..20458000 Cluster 4
tttctctgttgtacaaagaccgtagaatttagcaaatctagctagatcaataaagtttttgtttggtcaatattatagatgacacaagaatgaataacaatgtagttcattaatgtaatattcactcaaatataacgattcctttttattttgtacaaaatttaagatcaatatactaagtatttttaatgctgttttccaattaatattagctagtagataagattgtaatgatacatttgtttcacagactatttagttatttttagaaatacaatataaaaaacctattccacatatgttacaaggcataaaaaaattaatcctgaatatattttatttttagaaaagtcataatattacgttttatcaatatttaatttcgataaaagggacatggaaaaattattttcatgagatataccttttcatgagtaaaattcatatatgttttcttagtaatcactatctcattactctcttattattcttttatgatatatacttaattttttttcaattccgaaaattttgttggtgcccaattaatgttcccacattttgattaattatctatttcattaccacattaaacaataatttttcatgtccccttcaatgttcctctttcaatagataatttttgtttttctttcaattatcataattgtctaacgcatgaaaacatgacaacaagtgtagtaaaagtttttgtaataaaaatattttagtaattataatatatattttcaagaaaaaataattcaactaaacacatgttttaattattcttaagaatataaaaaataattccaaccaattttaatagttaactaaacacatctttaaataatacctaaggatttcatgttatattcttacatttttttttctaaaactaaaaaatatattcgtaatatgtttggacattagtaaagcaaaaaaccacaacccaattaatgataataaacgtgaaagctacaaaacaaactttctagaaaaacgtaattattcacgtcagatatgtgtaatcaaacacatgattagtcagagacaaaaaacccaactaagcttcaaatttctttgaattttcttgaggaccttaatttccgagaaagtttcatgaattaattaataatttgtacaagtatgcttttcacctggtaaaagtccatgcatttgtttggtgcctgtggaaaactttggtgattccatctctttcaaatgcttgtcttggaataactagaacctttcaaggatattgaaggcgatggagttgatgaggctgatcttttctttaatttccaagacagctaatgagtatttcattattttttttcagtggttaatttgtatgtatacaatgtatttaattcatgctcgtagagcagaacaaaatccaagttaatttaatcgtctagttaggaagctcaactatcgatctcaaaatctcgaagagataatatctgactccgtcgattgatatcttggatgtattcactcaaacggatcacatagctagtacatgttagttttgtaggcttgcttggattgctttcaattatataataaccttctaatcttattttgtatcatccaagcttcctatcctatatggattaagttttgtgtcgtggcatgtgtttttgaggtgcaagagaagttgtatccgtgaattgcatgcactatataggttatag

SEQ ID NO: 1119 - DNA, 2207 bp, Glycine max
  Soy_ogl_5138 Gm15:437190..439396 Cluster 4
tacttatcacaattgtcaatagttatttttcttttaattttaattaaattattatttaactattaacataacaaccatgtccttttgtaaacatttttatatatcagttttcatattatgtaacaactatatgataatgtaaaaatgtttttgcatatgacattaccactccttttagcagtatttatttattcaaaacttaatatgaaaatctttttcaacgagaaatccctaataatcaataaacgataagcatttttctttgtggaatcttgttccaataggaatttgatgagttgatcacttgatgatctgcttatgcatgttgcttttatttttgttgaataatttttgtaactttaataaataatttgataaactaatgaatttttccatgtttcatactatggttaaccaacacgtggagtagatgcaaagaagaattgatttagttagccggatcattgatttttttttcctggtttaaagtcaagaaataattaaatatcattaactggatcattcaatgaatgtatatgattccaacatgaacatagaagacgactaactaattgtcaataatatcactaaatcatttaataaaatttttaacttgaacaataagaattaatttacatgtaatcaattcaacaatagtaaagatgcaaaatttagatttctccttactcaaaatattttttttaatagtatgtgtttaatttcagtttcaacttttagtgtatagttttatcaggtattttttccattaattcttatttataagatttaaggttcaaataatgatttgtcttacaatctattcccacttatgttatgagtgtttatcttcttcccaaaccattgtgtgatgagatttaacatatgttaaattattattggtagggaacaaatgggagggaataaagaaggctgtcttgggacaaaattgctatcagtaaggagaatggagggctgaatttttgaaaccttagagcctttaacttggttgtgcttgggaaacaagggtgaaaatttttctctataaccccaatgatttggtgtctagatttctcaaagctaaacactttcctaagggggattttatgggtttgactttgggtcataaacctagtttttatttcgcgaaacatttggagttcctgggatttgcttaacatatatgggtttgaggtggagaataggggatggtgaaggtattaatatgtggcagcagcctagggttagaagtgagaataacagttttatattggtccatgtcctcaccgagtgtatctatacaaacagtgaaagattttattatacaaggaatgacagaatgggacactaatttgatccatgcattagtcatccttacatggcagagagcatcagtcatatatatgtacattcctggaaagtggaaacataagaaataatagacgaatttggaagttggacaataaagggttgtattcggtgaagacttcatagaacttgcttgtggagttggttgctcaaagttcgaattataaggaagagggtgactggaaccagttatggagattgaggattcctcctaacttccgagttttcacgtggaaagcatgcggatactgtcttcctagttgacataggttacaatctagaggtttccttgtcctataaactgtgtgttatgtgataatgaaatagaaaatagttggcacagtttttttacatgtcctacaagtgttatcatttggaaacaaagtggtatgtggagtggcattgaggcaactatgacaagtgctgatggtttcaaaaggttagtcttcatgttgctgagttctcttaatgaaggaaaaattgagttattattgatgaaataaagaatgtcatcatatcctttgttttaatttctatcaaatttgctagaagacgagctaataaagtagcccgtagcttagctagaaatgcaaacaccttccctcatgattatactttcaatgatgtacctcaatgtatttatccttttattgaaatggaaaagatatgattttcttcctataaaaaaaaagactcaagtttaagatgatgcatgtttctttttataagacccaatataatgtttttagtattagttattttagactagaatattcctaattaaaagaaaagaaagaatatattgggctattgacaaacaattactagaagagagaaaaaag

SEQ ID NO: 1120 - DNA, 1000 bp, Glycine max
  Soy_ogl_5340 Gm16:7651501..7652500 Cluster 4
aaagatgctaaatatagaatatatcttagttccttaaaaaaaaaatgggcccacaatttaacagatgaaacatctgcacccatacccacaatcttttcccttgctcacaaaaactttgtcgaaagaataattaattaatgtcttccaatgttttttgttgacaaaataatatattggaaagtaaccaagccaaggaagcaacagaaggtcacctgtacgaaccacgtacacctctattggcatttggtttattggtcatcagcataaataaatatgaaaaaccatgcaaaagaatgctatgtgcatgaactcgtggtgttgtaccgtttagacccagaatgatgtcgcttgataaacaaattatgtagtgtcgaacccaataggcacacacatgaatcattgcacgtgcttttatagaaaactaaaacaaagaaattaattcaaaatttacatacaactcactaacacttcttatggttaaaaataaaactcacttcttttatatatgagaagaaagtttaggatgagaataaattttgttttgatgtttaataccggctgtggaaactccgtaggtccacttttccaatcatgtacatctttttgaataaatctgatgtatccttctttgacctagacatgaggatcttataaaagtagacttatctgagtactttccatttgttattatttatataaatattcttattgtcgtctataattaatggattgtccaataacctgtccttttttacccatttgtttgatatttttcttgtctatttttctgtcaatttaaatggcttattatcaacattttttgtctatctgtatggtttttttttcactatttttaatttttctcatctatttacgtatttttctttgttcatctaaatgaattttctcttccatttccctacttatttgcatgttttttcttctcaatatttgaatgatttttcccacacatgtaaattgatttttctgactagttagt

SEQ ID NO: 1121 - DNA, 2100 bp, Glycine max
  Soy_ogl_6666 Gm20:1104901..1107000 Cluster 4
cttaactatttgttgatcctacttaaatatgttatgattgtggttgatataagttgggaactatatttgcaaaaagatagtagaattattgattgaaaggaagctgcttgatgatgctttgaactatatggacctgagtgcttgaggcaacttaagaaatgactttcatttgctttgaaaaataaatgtttgattggtcattagactgactgtcgtggttcagaaccacataatatgctatacatgcgtctgatgtaatatagaaaatttaatttcctaattcctcaatattaatgaaagtaattaatttagttgattgtaataaatttattttaaatttttatatatttattttaaattatcattatcattaatattttttctcttttttactgttttaataaaaaaaaaattctttttttaatgaaaggtatttctaatttaaaaataattaatataaaaaatattaaagattgaatcttataaaaaaaataattaccaatttaaacttaaatcttataaatagaaacagataaagtaatatttttttcttctaggctcgactattcaagtaacctcttcaagtatgtacagtagtattatgatatttcaaggtcatgctacatatatttttttagctttctaaaatcatttattatgatgatttaatcatttacttatttccttctcttctcttaacttagcaacatagaattttgaggattagataacagcatcttttagggattattttggatttatcgttcttgtttctgatttatagttagcagtttgtagaaatgctgtcccatgcttacaggcttgttctgatgtgtgcatagatgcttaaataacactgtctcctctctaattttaaaagttgcccttaatttcctccaatgagagatgactatgagctaaacttcaatccattttagtataatcggatccaagagaaaccacattaggctaatgatatctcgtatatagaattctaaaagctgaattgttagttatgaatacaatgttaaaactctagaagctaattagaacacgatcaacgtggcagctttaagtcgttcatgctatcaatgattttccttctattttgccttcacattcccacacccaccacctaagtatatgcaaattgccaacattgggggcagaaatatggagattaataacagtttaaagagaatagagaggtagatatctatatgaatctgttctatgttcagttcaacagtcaacacctcttctggtgggagaaatttctgtctgtccccttaacaaattctgttgatttctgaagcacaacattcttgaaattaatgacttcttgaacttaagagaaagacctctgcattctaaccccattcaagctactccatcatttcattgagggagaacctcttccttggacttggttctagccgttgctttgggagcactatgagaccttcatgtatttttgatctgtaagaattgaagacaggtaccaggagagtttataacaacttatgagaccataatcttgccttaaaagaatgagtatcagccatgtaatttgggaaattcccatattgccttaggaacaagttatcagtgcacacactattcgcctattcggtgttttaagcacaactgaaccacaattacatgaatttgtgaagcgtggagtgctttgtgcagtagagaacctaaagttttctcctcttggttcaagagaaaaccacattaggctagctgatatctcatatgtagaattcgttgtttctttgaacagcaaatttctactttttaatatagtaatttgagaaatttaaacataacaaatgaaactggcaaggatagaattatttatgaacttacctagatattggctactttaccttatgtattaatgcaaactgactgactgtcacctttttttgtttttttgtcatttgaactaatcagtatttatgtcctgatattttgattccaaatgaacatacctttttaactttaaaatgtgggaaaactcagttctctccaacttgagatcataatatactcaattcatgtatgatgttatgaatatttctgtttttatat

SEQ ID NO: 1122 - DNA, 1299 bp, Glycine max
  Soy_ogl_3142 Gm09:36897913..36899211 Cluster 4
ttattaggttgacttcttttaataaaataataaaataactatgcccattaactttctgagaatgtttttaaaaatatcattactttctaaatatagagaatttgaaattttcatttactatataaaaaagttgagatatactgtgaattcttccattgtttggttcaaccttagttgcctaataatggaaatataaataatgagttcaaacattagcaatataattcaatatattaacatttgacatattgataatgcttaccgattttcaatattaataacttgtttattcgtattgtatatgaatttaattagtatacaataacaagataatttttttatattatcatctaataataaattgtcatatatgataaaattattaactttttctaataattaatttaatttcaaagttatatctaagaccatttataatttattaattgtgtaattgtttctatattgacagtagtcagtagatgaatattgaacgaatattaaactcgttatattaatttattagtataaacacgtgttgttcatattaatagtttatattttgttagacaacgtataggttaattcaactctaaactattaacatatgataattcttgttctaattatagtagtatatctaatatgaatgtaaaacgtagcaacagggaaagtgagagaagtatgtgccttacttttttttttcttttacgttgactgggaatatgagataaaaattattcagaagtactaatgacaaaataagtgtctcctattttaatagacagtataaaaacaattcttttttaatgcttttgaaaattaaggcaaatatttaattatgattaccttaattaattctccatgaatattaccttctgtcgttgtcacatttccttgaaaagagaagtatcattatcttatgcctacttaattagacgtcagagtggatcaattagtgcatgtgcattgattaattattaaatcaagttttcaacgagaggaaaaaaaagtgtgttcaacgatcgaaaaagcttttgctccttgaatatatataatgataatgaaaatcctttcattgaattttttaaacttactaacgtaagtttaatttttttttatggtgtgtataaaagatactttgatataagaaataaaattcactttaataatctctccaccttaaacgttagtttcataaatattaattataaaaatatcttacttatatatatacagtgccgaatctacactatagtgagatatatacttgcatttccttattttttaaaattcacc

SEQ ID NO: 1123 - DNA, 1686 bp, Glycine max
  Soy_ogl_6436 Gm19:38768515..38770200 Cluster 4
agtgtttggtcaaaatttaaaacattaatgaagcaataaattatttttttaatttaataagtagttaagttattatttaaattttttgtgtcttaatcattcggtttactaggaaaataaattccaattacttccgagtttgactataaggtaattaaaatttgactaaaaaatatttttgtgaattacttggttaagtcattatttagaattaatttaataatatgttgttttaaatttaataacatatataattagacagattaatgggatcgatcataaaatctttattcgcaataaattgttgtgattatgattatattgaacatattttggattgaaacgttatacacttatacaaataccttgactacattttctttgatttttctaattaaatatttgactattttattttaaaaaaataatgacatacttttgttaaattctgaaagaaaaaaactattagtctccatgtttaaactaaaccaaaggtaatttttgcattcgtctcactgttaattttcttttttcctcctacattttgccaataccaatctaaggaaagttctgggaaatgcgtttcttttttttctctcattgtattacttttccaatttcttggataccaatcgaagtctagaaatatctagttcttcattctcccaaaagcaggttgtgacgtttggaataaattttaatcaaactgttccctctaaaaaaataaaaaggtgattaaaggaagaaaaaagagtggtgaaagcagcagcagcaaattggtcccctgcacgagcgtgcactggctttgattgcaaaatatcaaatgaaatccaaagtttgtctcacccctcacacggttcgtttccacgcatgtttggacaccttcatgcacctgtctctacttgtacggcttgatatcacacccttgccaatacaagtccatgtttctcttctttaggataaatatccttttgtcattttaatttgttaatttttattaaaaatatcagttagtcatttatattttttatcttttttttcatcaaagattaggttaatcttatatctttatatgataaatactgattaaccacttgtatttgcatctttcaatcattcatacattttgccaatcatttcctatcataattcgtaaccatttttttttttttgagaaatgttttcattctaaatttcatttttctttcttctctctccttgtcttttccatttaaaaacacagggttattctatttttttgaatatttttctcctttgggagatttgaagactctaaaaggtgagttaccgtctctcgtcctgattttcttcatatacaagaatcagaatttgaacccttagaggcttaggcttagacgcttgtcatgctcaaatgcttgtgtttttaaattataattattagataattatattttttatattttgattatgttcatctgtgttgctcatgctacgccttcatcagtggaaaacaacaagcaacaacggtgtgagcattctctagcaatagtgaaagacattaaccacggtgtgagcattcatggttcagagaagagaaaagaaaaaaatggataaaactaaaagtgaatttacttaaatgagaaaaatcagattacatgagtacaaatgtggcttatataaccaatcatatatgatattaatatt

SEQ ID NO: 1124 - DNA, 1300 bp, Glycine max
  Soy_ogl_492 Gm02:11451801..11453100 Cluster 4
ttaatttgagatttagtgatatttaaatttttttactctatccaaaaaatatgttatatatgtaagaattaaatctaaattcttacaataaatttaacatatattatcaactgaatcagatttattgagtttcatgcttgaatgcaaagcacggaaatatttattataggaaatgatacgatacatgaattcacatattgttacttgcgccatttaaattgagaaaatggtgctcttccaaatgtatgcttattgctgcatcaacagacagttctttttttcttttaatatttaaacctaagccaagttcataataattaccactagaagcattttgtaagtgacttcacttctccaatcatgccattaactgagctccaagtttgagaaagagcaaaaaacttgtttgcattaccctattgagtccattgacttaaatgaatcattgaccttaacaagaatgtgaatgactggaggggtggactcataaaattgatcacccctgcaacaatttttgtgaagcagtatttttctacctttttaacagaaggtcttggtaaaggtaggtccaattctgcatggtgttgatgaactaagttttaaactcattgcaatagtttaaatatcttttttgtttttgtagtttagtatttttttattttcattgttgtaaatttttttcttgaatatttttttcatcgttaaagtgctttaaataatgattttttaactattcaaagtacttttttattatttaaagtgttatttaaaattatttaagaatgaaaaataaaacacacatttgtaagaactaaaaaaatattacagaaataaaaagaaaaaatactgaaaacatatttaaatcatatttaaatagagagacattgacaaattaaccggaaaagaaaatagagacactgacaataggatttggttttggttacagattcggtgttggctttttgtggcatttggacataagttcttagagatagacaatgacaaaaatattgaactgtcctttatatttacggcgttccagctggttaacaaattatttttaaaagtaaaatatgtaattttacttgtgatgaaaagattaatagttaatattatatagtcataaattatgaatgtattgaaattttaattatttattttttcatcaatagctaagattatttattttatctttactcacattagctaatagagaagttaaatataatttaatagttttgaatataaaaaaaatacaatgcttaatgaaggagaaccacacgatttattctcttattaa

SEQ ID NO: 1125 - DNA, 1356 bp, Glycine max
  Soy_ogl_5196 Gm15:50514645..50516000 Cluster 4
gaaaatgtcatgaaaattcttatataggaagactaaattcacatttttttaaaatttgaaggtgaaatttattaatataaaaatataagaatcttaagctcatttaacaaaaaaaaaaaaaatagcaactataaaacacaatttccccctctaaatgactcgggttctagcacttctctttatttttcttttccttaacgtggccaacacatccaaccttcaactagttgcaaacctgaaattaagaattccaacatgtgttttgcttcgtgtatgatttttattgttccaaatataataaaactactattctgataaatgattcatgtttatttggtagtttgctcaatcactcattttttatggccgttaggtatatatcataaaattaaaaaaaaagaacattattttaatcattccccatatactatattaatctatttctattaactatctatcaattggaatgtgcaatccctaaagcagataatgtattgtagcttatccagcacggctaaatgggctccttgcatttctcatcaatctaaattttcttgtacattgtatataccccacaattgcactcttaatgtagaatagggcctcaattggagtatgtactaagatcttaatttctctttttaaaaaataatcttaatttcaccaaatgctgttttttttaatgaattattgagttgttataaactcttttaataaaacattttcatatataaaattaagaatcaaattttgatcaatatatttaagaagggacacaattatttattatttgagtcggattctattaataaaaaaccaatccttaaaaaaagcataatctgttaaacttaattgataaattaattagaaacaggtagtgtgataatgaaatttttttacgcttgtactatacaagttcaaactaaatctttacacaaattattccctttctcccactataaactagattattttatacagacaaaaaaaaaattaataaatagagggaagataataacaattttataaaacatcaatgttatatattacaaaaagtggttgcagcaaaacgaaaacaatatgaatccatttgttgtaatttcattggccaaatattaaactaaaataaaataaaaactaaaacattgctagaaatcagaagtggtggtatcatttatctgcttcgtactacacaaattcgcggtaacaagcatttccttttacaaaattaacccatcatcatttatcattttttgttttggagctcaaatcattaacatcataaggatataagtgaaaaaaacaattaatgttacattgaaaaattaaaatgacaattttttttaacaatttttt

SEQ ID NO: 1126 - DNA, 1044 bp, Glycine max
  Soy_ogl_6424 Gm19:38480901..38481944 Cluster 4
cacttcaattatcaacttctcatttaaaatctggtaagtttgaaaattatttctaaaacatgtattttaaaaataaaaaatatataagagatatttttgtatcttctattttctttaaggactttgttcaagtactcaatggataaacttgtaaaatatagagatatgtacaagagacaaacaatttttaagaaaaataaaaactatttttaaaaacagttaacaaacaaatcctaaacttcttaaaaaaaaaaaaaaagaaatcctaaccttaacgcatgctcttgtgttgaagagctctttagcatagaggtttatattataaattaactagcaaactatcctaaaagttaaagttttcaaatgaaaatataaataacaattttatattgcatctccagcatttagtaagtaacatattatggttagtatcaattttttaatgtgataatgtaaaccaatcaaatacagcatacacataatttatcaaatgatctaacccattattgactttgcccagacaaacagacatgattaatgcggggtcttccattaaattgatgtgctacttaaatgtcataaaaagggtacgttgtgcatcttaatacaaaaaggttaagttttgttaaaaaaaaatgccgactaaactgattagtgattgatatcaatgcaaaacattttggttattaataatgtgcacccttataaactatatgaaaaatgacatttagggtacacgttcaaactacctaaactcaaatcaaacattacaagcaaaggcacagaactcttactcaaaaaccctccttgcttctcgaataacctccttagacctgtgcagtagaagaccacttactgtcgttaatatatctgtaacctgaaagagacaaagttccatggagaatttaagagatgggagattcagcataaacaaatgcttcagttagctcttataaaataaagggcgcacttatgatataaagtgtaatcataagcggttaattaaaaaaaaataacaattgagattgtgataaaattaatata

SEQ ID NO: 1127 - DNA, 1400 bp, Glycine max
  Soy_ogl_3352 Gm10:3709801..3711200 Cluster 4
aatccaattactgactatatatatatagtctacatatggtatttttttttatcaattattatttatacacagaagattgttgatacaaattgattcgacacttcaattccttaataaagatttatggtttaattctcgacttggatatgtaatgacaactaaatcactttatccaacaaatagacttgatgcgatgggagaaaacttacacctatagttataaaaaaaagaagctattatctacacagtatgaagcatcttacaattgtctggttaataatcggcaatgttgtgtaagaaatattttaaaaaggaatgccgtttatgaagtaatgaaaatgaaatggtaagtgataactctcttttttagaaaatgaaaaataaatatatccataatgtaaaagaaaaaattcaaattaaaataataaagagtagcctctgtatgtgtgtgtcgtggcatattaatggctaagcaatgctacactaattttgactaagatgattccgtctcataatgcttggcaagataaaaatctaacccgagaatttatcacctatattttaataccaatcatatttaataagattatgttctctcatataccggagaaaatccaaacacatgccagaaaatattccaaagaaaagtcggtgtagttttgtctttgcagcatcatattgtttcatatataattaaattataataacctccgtatattatcgaccatatattattagacatcgtttgaattcactagcttatttttaaaaaagcactggtcaacatgtgataagagtcactagttgcaacaagtctcccgttttgctttggcctattcgaattcaaatttgaagtgtatcatactttgcctttgtaatttgatactattgatcaattcacttttgatataggataaagggtagagcttagtttgaggaaattatgggactaaattgatgaaaactaactggcttatataaatttgttttttttcttcttaggttcacatttattattaattaaaataataaaaggaaaaaaaggaagaaaaaaaattagaaattatgaaaattaaaacaaaattaatatcttgtttagaattaagttagaagtactctttaactacatccattaaattacattaagttttttttttcttttaagagaaaaagggttagactagatattatattatggaaataattaattacttaaaatgtaaaaaaaaacaaaagaaatgaaagtatgcaatattgaagattaaatcaaatgtgtaaattttgtaaaacttgaaaactaaaatcgcagaaaaatttagaaaaaacaaaatcacataaaacttaaaggaaatcaaaattaaaatttagtctaaaactaaaaaatgattttaattttaaaa

SEQ ID NO: 1128 - DNA, 1389 bp, Glycine max
  Soy_ogl_6526 Gm19:42975412..42976800 Cluster 4
gctttttttttcgttttttccccgtactatatattggtggaaagataagcactggtgtccggggtctgtctgtctttttttttaattgaatttattgtatatataattaatatgtttatctttaatttttataaatataacttatgtgagaagtttagaactgaaataaaatagttatttgtgataacagttaaaggataatttttttaaaagtgaagacctaatataagaaaaaaatatgtcaagaatttgaatgagagaatttggaattataaatataatagttgaaggataaaattgaaaacataatgtataaaccgaaaagacatatagcctttattgttgttatagaaagaaaatggaaaaaaaaaacttatattcttatgataataaacaaataaaaaatagaggttaatggattaatttatactattagtataaatttatctaaagaaaactatcggtataaatttatttacactgttcataagttaaaaatcaattttggtatgaaggtgcaattttttttacactcaatgtatatcctttcctaaaaaaataaaaataaaaaacatttatttcagaaaatctgatcctattttcagaaacgcgcatgcgcagtttgttactagttttgaaaagaatactcctaggtattaataattcttgggaatgttttaatattttttatcatgtttttaaacatttttattcccaagaggggtggaaaagtaatattttcatgggaatatgagaatttttttatctaatacatatgatttttttatttaaaatttaaaaattatttctgagaatattaaactgtaattaaatattttgtttaaaatacccaaaaatgatattgatatttccatgttatatttatagtaatgtaaaaagattccgtggtataaaatgggtaagcattacattaaagtagttagctttggatttgtttgacgacgtggtataaaatgggtaagcatttcattaattttaataccaatctcattcgtaatggtttccatgacaaaaatcccatccaatcatattttaatgccaatcatatttactaagattttgttttctcatctcacatatccaaacacatgccagaaaatattccgttcgaggaaaagtcgttataatttgtcactacaacaaacaatgcaagtttttagtttgtcacgggataaaagaacaagaaagaatattttgagaaaacgaagatcttctaaaatctttttaaggttcttattatgacctcatagatttattcagattttcttcttaatttgttcttttggtttttatagtttacttatcatcataacgattatggtgctctgccatgtgacactattgctcgccaccataatatattgtact

SEQ ID NO: 1129 - DNA, 1601 bp, Glycine max
  Soy_ogl_3255 Gm09:42848894..42850494 Cluster 4
cacacacacacgcgcatgagacagaaatcaaacttataatatatttttaagtgatagaaattatctatagtcatgtctcactatgatggcatcatttttcatttttagttatcgtgtgaaaactatcttctcttagcttcgtgcttgatttgttgacatctcatttgcctaactgaatttattgtcggtgatctaattcgattaattatcttattagacaaaaaagtaaaacatgaaattcacggcttggtcttggctcaaagggtataggaagtgatgcagctagcaaaccttatataatgtctattttaagttttgtgcaatgtgaatttattttaaataccttctcaaaaaaatttcttactattaaatttaattatgagaatcagcacatatattttttttttttcaaaattttaatccgtgcaatgatctacatactacaatgcaaatgtggggtttccttcttcaaatgtcgttcctatcactagagtacacatatggttaggctatcttttatcggtgtgattaatgtgaatttatctcaaagataaagttattcttttcaaaaactcctttaatactatataataaaatttggaaatttctttagctggctggccacgcgagtaaggtgagacagatgacatataattcgactcagccaaaggtgtgtgggccacttgatgaacaaaatatgtagaataggtttcaacttgatattcatgcataattccaacacataaatcaggatcaataattagcaaagacatgtgcaatccacatgcaactaatcatagaagatagaactctggtcgtaattgtctccataaattatagcatgctcacacaagaagaagtttcacatactagtatacgattgtggatcattcaattcattcattttaaaacgagtcattgttacgacggaattcaggttcacacttaacaaaaataattgtctacttatgtattttataaatttaaatatttaaagctataaaacataaacatatatacatattataaaacagtgaatactttatacatgaatagtatttatcatctaataacaacttattatatattttatcaaaaaaaaaacttaccatataagataaatttgttaacttttttacattagttatcattattttcaattgatagtgattttttttacactgacaattaatgcatgtatataattaaactcatcataaaatgcaatttaaaattgttacgctagattttttttgttttattttgatttcctagttatttgaaaacaacttgatgatgacaaaattatggaagattgatatttttcatttctattcaacaacatgcaaatagttttatgattttgaataagtgattgttgattttttttctctctctcgaatagaaaaaatggattgatggtggaatgttttttatatttattgaatatggaataaatcctcattaatttgaaggaccgcctgacagacaattataaattactttttataatgacaaacaaatctcttttttcaacttttggaaatatggtagtgtttggtctaattttacgttttccttttaaaagtaaaagttcattc

SEQ ID NO: 1130 - DNA, 1303 bp, Glycine max
  Soy_ogl_5089 Gm15:29653298..29654600 Cluster 4
caaaacaattgaaaacatatgtaaactacaagaacccgtgagtaactagaataataaaaactaaaatcacaaactataattataaatttgagaatccagataaaagtctggagtacacatgtcattcaatgttagcttctcaaacgttcggatatcacattcaaattaatgtcaataaatcagtcaattaactaattaatatattaggcaaaacaaatcaatcataataaatattggtgtataacgaataattttggagaataaatcatgtattctaattttcttcctaaatttagatgctcaaaatataaaaaaaaatctttaattgctttttggaaaacaattttataaaggattttatacgttctgcatatgaatttatatatatccactatcatgcaatcttttagtcttaattactttgtgcattgaccgagaaattaaggggactgaaattagcaaattttcaaacattacgaaggatttctttatatatttttttctgttaaaataaaaaaaaattcttaattaattgcttttggagaaggattttataaaaaaaataagtataagagagcattggatttagaaatctataattataaatttgagaatctaaatacaagtctagcggacacatattcaatggttacttttctggcatgtcacaagtcgtcatatagtgtttcgtgattgattgatttagttacaaatcacatttatgtgtataaaatttaattcaaattaatgttaataaatcaggcaattaactaattaatatattaggaaaaacaaatcaatcataataaatattggtgtataatgaataattttggagaacaaaatcatgtattctaattttcttcctaaatttagatgctcataataaaaaaaatctttaattgcttttggagaacgattttataaaggattttatatgttttgtatatgaatttatatttgttcactatcatgcaatctgttaatcttgattgctttatgcactgaccgagaaattaaggggactgaaattagcaaattaattttctaacattatgaaggatttctttatacattttttattgtcttttaaaataaaaaatttcttaattgcttttggagaaggattttatataaaagatctgtataagggatcgagcattggatttagcaatcagaaaaagagagcgttgaatttactcaatttagttaaaatttctttcatttttgcaaccttttcccaaaaaattaaagtttagtgtctatttataaaaggagtaaattttagggaagctcaatacta

SEQ ID NO: 1131 - DNA, 1100 bp, Glycine max
  Soy_ogl_6259 Gm18:58807201..58808300 Cluster 4
tcatccaaataaattaatgcagttttttgtgtttctgctttggaaacgcggctagatcataaggcgtttagttctttggagttaactttaaatttattaaaaattgagttgatttaacttgacttcatttatatagtttaaccaccactattaaatagttagtctatgcttaatcaataatcatgtgattatgtctttatgtacgcaaacataaaagtgccatgacccatgatgggcatccactagtatccagtgttaagccgttgcatattcttttcatcatcgcaatcataccctgcctttagataatgtatgaatttgattctgtcgccagataggaaaaagtttagacatttattaaagagcttacagtgtgaatagtaaataagttataaaattaagtttagacatttattaaagagcttctgacttgtttggttagaattaagtttgcatttttctttatcgcatcttgaagtagcgggattagcttcatataaactttttttttttggttgtggattttaacatatgtaattatattaataagttataaaatttcactcatatataacaagcacaatataatattatctttgctgttttatataagaaacaagtgagagtatctcttttttcctacttataaaaaatatagactcactcctaaatgtattcttaagaatataatagcatttctgatcttaagtacttcggaggaaagaaaacatgtttggataaacagcttaacaagtctttaattaagttacttttaatgttaaacaaaaagttgttcaaataacaaaattctgttactgtactgctataggtttatttcttttcagtaaattacattttcatctcttaagaaatatgaatattatatttttctctctttattaaaatatatgtttccctccccttatatatttaaatatatgccactttagtctattttttaattttttcacaaaattctatttatatccataaaaaaatattaccaaacatataaaaacaaattacattaacacactcatgagatttattcaaattacgcgtgatactcttgtttatttaacatttacaccaacaccctt

SEQ ID NO: 1132 - DNA, 1600 bp, Glycine max
  Soy_ogl_1925 Gm06:13631001..13632600 Cluster 4
tataactttgacaaaatgattcagtccatggtgggtgcaaaaaatgagtacgtgggggaccaacacgtaccatgtcgatttggttgggtttgtgaagataagatttccacgcgggaaaacaagagaggcaataaattacgtataaaattggcaagtaatttgatcatatgtggaatgcgatgtcgcatgggttttgagactgtcttgcaaggtggggtacgtaaacggacgaaccgcaacgccaacgcaaacgcaaacgatagcgagagccagagtgagtaagaagaagaagaaaaaaaaagaaacttgagttggtattactattattattattatttgatatcatggtaattaaaaccataaactctcctgtgctattttaaggtatatatacttacaaagtttcaattatttaaatagagtattatttgtttgtttatgatgagatgatattttagtttagcgtgtgaaataataatattagtatttgtgcggggacaaagattccttccctccgtttgttgctttggaccatacacactgacacacacctgctattagacaaaagagatgggtcccactcactttcctcttcttttctctctgctccaactttcgccctacacgtacccttgctcccttctatttctctcctttttctcatcctctctctcgtatcgcaatcacgactcgcttatatatgccttattattttgtttttcgtacatcaagctcataatttaatttgaaatttgttatgatttcttaaagaaagaaagaaaaaatcaatactttcttcttctttcgtattgcattttacttcctcattgtatccgttgttgtggtagtgaaaaatattttaattgaaatagatctttatattgtttctagtttagatttatttaaaacgtgaaaagattattaatgattggttttaaattatttatttcattaaaaaaatatgatttaagtgttggcaatattaaattatattttttagaattttatttattaaaaatcattatattatgcataattctaaataagggtaaaaaaaattattcaatcaagccagtgaataaaaaaaaatctttaatatgtttttttttcaatttattttttattttcgactaacatttattgatttttagtgtgaaagtcaataagtattagggtgacgatattccgtgaactagttgctatgtattttttttccttttcgtaatttaaactacacttgataaaattaatcaataacaagtatctaaaacttataaaatacaagaattaaacaaaatgagaattgaaatgatgttttattcattccacaaaaatagttttacacttatttatatcattgttaattttttttgaaaaaaaaaatatcattgttaatgttagaaggccagcttattggatgtttataaagctcaaagtaaatctaagcgtttagtgggcttcaatcatgtgtaacctgagttgcataggttagttattaagcctatttaaacgaatgtcttgtctccaaacatatttgtaattaatatttgaggctgtgattctatgaagatacattactcatatttgcgatgaggatcta

SEQ ID NO: 1133 - DNA, 1100 bp, Glycine max
  Soy_ogl_564 Gm02:15206701..15207800 Cluster 4
gggaaagcttaaatcgaaaattctcaaactttattgcctcaaaactttaacaaagtgaataagagacagcaagtctctttacaagaaagaatcccctcttaattgggttaaaatgatagaaaagtcatttacaatttttagaatataggttaaaatatgttttttttttcttttactaaaattcattttaatttgttatgttttgaaatatttagtttggtccttatctctaaaatttgatttaatgttgtgcttttgaaatagtgattatttttctttaattttatttttggagcacattttaaataatttcttacaaatttaagatgtaaaatttgttctattagatttgtttgcataaaaattatgaaccaggacaacattaactcaaattttagcgttaaagaattaaaataattttttaaaagataaattatcaaaacaaattttaataaaaagatgaaagagaaaaattgaatgtcagcgtaaaatctaggataaaatatatttttgatgtttgttctattttataaatttaagtttagtccctatactttcaaattggttgtttggtcatcaaactttgaaaaataggaaaatttaatctttcatctttaacacaaatggttaattttttatggactaaatatatttatatgttttcaaagtctgagaacgaaaataatctatttaaaaaatgcaggaattgaaataaaatttatctaaaagtacgagaactaaaaacatactttattctaagataaatattaactaacatccttaggatattaactaaagcacttttgattgaaagacaaaaattacattattcataatctttttaatattttcttataactcttacattaaatatttttcttttttaattgcttgggagacctaggaaaacatttattctaaaatcttaaatctataagcctagccaagctgatatagaagtggctccatttaatggctggctcaagaaaacagcatgagtgcatgcggttgggtagccacaaacaaaagacacaggcgaggctagaaagtctacaaccaccaccacggcacacagcacacatacaacagtgtctaatgcg

SEQ ID NO: 1134 - DNA, 1800 bp, Glycine max
  Soy_ogl_3051 Gm09:9459301..9461100 Cluster 4
taactatgtaatacgctgttaacaaggaaagtgtaagtctttaactagtgtaaaattgccatacaaaaatttgtgtacatcatatatcagcgtcgttaccatctaaaaaagtatgaagttaaatcttcaaaattaaatacaagttcgataaaaaaatacatatggacttgctctgtatatatgcaacaatcttgaggaccacatgttctctaaatgaaaaagacatgcaactcagtacaaatgtattaggtgatcatcactctatatgctataataaaaataaaaaataaaaagtcgactaaaaaaatataaataaaatgtaatagcaggaataattaagtattgtttagtatatatctatatatgaatttgaggcacgcctgactattggcaaagttagtgaaaaatgttgtgtttatgtcatccatttccgtcatgctgacacaagtagcgggggctaccttctaaggataatgacaagaatctctcttctaatatgggcttaatatataatgcaaacacaaaatgcaagtcatacaacctggttatcttttactttgtttctatactacagatgtatcctcatacaaagtatgtaaaacttcagactatattgaatgtcaatgcaagatgcctgtgtttgatacctaggtagcagacaccccatattctggccttaaatccccatccaaaaacatgcaagaatctcaaatgcacaactaaattaagaatcaagactcaagacaactcttttcttatagattaccagtttagccattcatcacacaaatctaagaatataaagtggttttgaattatgatacaaaatacacgcattattttaaacccatgcaaattaaaccttggcaatggcatcaaatacataatgatttggatacaacttaaagtgacataaccccattgttactgaaggaaggccacaccagtagcatgtttattcaagaagaaaaaaagggaaaggtgcgttataaagtagagaaatgagttagaggtaccattggcagattattgatctaacatcagaggaattgagaggtcaagaattatgttcaaaggaggtcatgtatacaaaggttgttacaagcaagagggtgataaataatagagttagggttattggaaggtacaactattttctttggattctggctattaacttgggggaaaaaattgcaaagtagttatcctggttatcttttactttgtttctatactacatcaaatgtctaagggaaattttagtcataaccattttcccatggagagcagttaatcaagaacatggataggtctacaatctgtccctatacctaggggcagaacgataatctttaaatgtgggagtattaatatagaagggaaaaaaacagacaaccattttggggagccaccagtccctatctaggtacaccctagctatacccaggcatccaagactctaatgcgccaaattataaaccaataaagttagacacttacaaaataaacacttatataatttcctatcctcataaccttacaataaccaaaaagtaccggaatatgaaagctattatgcaaaaagcatacatgaggacatatctcacaagttatgtctcttttctcatcacaccaatgctggacacactttcgtaaacccactaatataattatattaagcgcatgcttggttttcagttgggacccccctcaaaaagtaaaactaaaaaagcttcaattttgccttgaaagttagtttgcaaaatgaaactcattcaaactcaagtttgcaaactttaa

SEQ ID NO: 1135 - DNA, 1500 bp, Glycine max
  Soy_ogl_3376 Gm10:5327801..5329300 Cluster 4
atatatttgtgatcaattgtaatgctgatatttggatggaacccgatcgacaaaataaactccacgtttcttggactttgaagaagcttggagcaccacttttgggggaaaacttccatgtggctgtaatattcagtctttaatttaagctttcaattttcgtaataactttccattccagcattcatattcttgattggtgaagtatgtaaaaacaagtttggaatctttaatatttattgaagtttggagttttcttgttttaggttggctgtgaattgtgatcgacactgatcgtagtgttttttttttcggatgagacactccatatatgcatggttttggaaaaggaaactaaggcaactgatatagggtagagttgctcgtattataaaactgtagactggggaggcctttttactaagatggtatgtatatataatttctaagttaatttcatggtataagttaattttctgaaatttgattttggttttgtaaaaataatttctaacagattatcgctcataaaaaaacgtggcattttttaatcataaaaaagtataaatacaaaaattcgagtccattttatattatgtaggtaattttgtaaagaaaaatatactagtttaatgattttttttaaaaagataccattttaataaaaacagcaggccggagaaattctcaacttattgaaagagaacatgtaataaaggtgtgattcataatagagtttgtgaatttgacaggacaactattaaaaaaaaaacaatgaaaagagacgaaaagggattttaggaaccattttgtcattttattcattttaggaaccaatttaatcgctcgtcacaatttcaaagactgcgttgattaatgatgtacaattttaaggaacatttggaattttattaattttaacgattaatttaatataattaatcattacaatttcagagaataaattgctaataattcacctttactatatttataactttattctctttatagatagatgtatttatcttttggatgtgaaatggttatttcattattcaaagaatattttttgtaatatctatgtaaattgtttctatttagaagagaagaagaagtaggataggtaaactcgcaggtctcaaatggtggatgtgatcacgtgggtgggctggctcagtcagtatatcgtccactttggcgacagcaataatttcatctaagaactaataataaatcctaaaaaaaatactgagatgtggtcataatataaaataaagaagaaatataaggctatattaaaaacaactaagaaactcacttacaccataaccataatcgttttatttggtgcgaacctgttccctccagggtgtccccaaggtaaccaagtttatttaaggaattcatcattttcaataaatgttttctacatatatgtgtcgtggatgaaactcataattacatgttctacatattaaaaagataaacttatttatt

SEQ ID NO: 1136 - DNA, 1900 bp, Glycine max
  Soy_ogl_3868 Gm11:17360401..17362300 Cluster 4
cccccttccccctctttctctctcttactatataagaatttttgttaaaacttaaacttatattatttttgttcctacattaaagattatgattgtttcctaatttattatgtgagaaattaattgtatttgtaatatatgattatgattggttcaacaaaatttcctaataaaaaaagttaaacacaacttttttaattaaacaagttatttctccagaaatcatcaaaatcttatattaaagtgtgaatcttatggattaaagttaatattattatataaattatgattaaaccattatgcggataaatttattcttttgtaaaaactaatgacacttaataatgtttgaactttggagcaaaagagtattttgatgcaaatactaaaataggtggtggctcccaaaaggggtggtgatgattgtaaaacagtaacggaggcacatactttttttcataatacaagaggcactgaagaaggtgaaggaggcaataagtgaataacaggtcacgtgatcggaattagtgggataattatggtgtatttttcttgagtatgaatgcgttgtggcctccacactagggagagtcctctttggcaaaaatgtcctaagtcagaagaagagcatagtgtgttttttttatatagtaataaaagcactagggttcattatcgtggtggagttaagtgggggacataacttttttctaatctccgaaattggtgaatagtggctttgacaaattggagccaccgaatccacaatgaagatggccaacgtaaatgatgaaagaggcttggggaggaaaaagtttgttcctatttattatttttcccccacccaactaaattgaacgcaccttatcatcattgacatccatgcatttaatggggcatcatattttggtacaagcatcatacagtcagttactaaggactcggttacatgtatttttcaagagaaccattctacctctattcctttgcctttaagggtatttttttttaacttttatacacaaattaaaaatacaacaaaataagattttaaatttcttatcgacttatcgtatatatttttatttctactctataataagtgcatactctgatactagttgtaaatatgtaaattatttaaattaagtaaaaagtaaaaatatgtaacaatgggtagaaatataataaatataatctgaaactttaaaaacgacaaataaataaaaaattaaaaaaaattaaaacttaaaaaaaaacagagggtaataattgtttttttacttaagattccataaattgatgttttaaatttttattagatgttgaaaaataataatttataaatcataacaataaaacgatcttaaaatatttctttaaaagttaatccaaatacatcttaaaaacattaaaaactttgtctataaatccaaataaatccaaatgcatcttaaaaacattaaaagctttgtctatatacatccaagactaaactccatggatatatatattcagtcttggatgtataagaattcaagttttgaaaagtcttcaacttgaatttgtttgtctcaagtagaaaatacttattctttatataaaagaaaaacttatccaattttgttaaaaattaagaaactttaaattaaatgtggaacactcaaacaccgtgagcatgtgaatgagtgacgaaggaacattttatatttgaggtagcaagtctagcacaattgcacaactgatgtgggacttattgtcaatgtgatggagccataaaatgaatattatgtaaaaaatatttaaatgtatatttataagatatatttaaaaacaaataatgtcataaaatgaatattatgttatttttaatattgcttacaatatattgtattaaaat

SEQ ID NO: 1137 - DNA, 1300 bp, Glycine max
  Soy_ogl_558 Gm02:14985601..14986900 Cluster 4
tcttttcattggttttcttttttagcatttttttccccactctaccaacatgggttaatgaagttacacgattttgtgttattaattaaaatttcaagttacgatatactttatattcatcgtgattcacggtaagtaacttctctttttaacattttttccattatattatccatcttattcacattttttgttttttttatttatttcataatcatataatttttttgtacaattacatcataaaaacaatatctcttctcttctgtgaacgtagattcattgtaagatttctggcattgatgtattattattcgtagaagagagcttttcatcaccttggcttaaagtactatatatagatactgtactataacaactatatgtctgggtatcaatcgatgttatgtcagggcatgcctgattgtgggaagcaaaggccattgaatctccagagttctgacttctgagtaggtaaatcgtaaatccattcatagccaaacaagtctctctccacatattatgctgtcgttcaagggtaaattcttggtaccatagtaataaggagtatttatatgataacaagtgtctacattggttcagaaattaaaagagattttttttttatttgagatacacaaaattatgtttttttttatattttagataataaatattttttttaattctttaactaatatttcaaggagactggttatcaagatcttatttatatttatgtaattattattatttttatttggttggtaccttcttatttttaattaaaaaaagagagttaaaaaccatgtaaaagtacgagtaacatgtattgcaagaatattgaaaaaatctaaagctggtgagccattataatttataggagaaaatttaatgtcaagggtgcagacacagcttttaacgtgaataataaccaaaacctaccttgctttgacagtttgctcatacaaaattaattaggccgggccctctgtggcgggtctagaggattcatgctttgcattgaataagataagatttttaacacctaaagtggaactaaagggtaagatttttttactgttatctcagccacgttgcaacgaaattcacgtccaattttataaatacgtttctggctgcggcgaatgtaaggtgagaaaattataccccttctcatattatttgatgcatgtgtagtgaggcattaaccattatgctataaagtaaaaactaattgagagatcggtgcattccgaacttagacttttaaaaatatatatttatttatattaatttt

SEQ ID NO: 1138 - DNA, 1100 bp, Glycine max
  Soy_ogl_4660 Gm14:4930401..4931500 Cluster 4
acagatagagatatagctatttcatttacaagtagaggtgcaattctcctggttgatatatttagaaattaatggtggttttaacttccacaatataaatggaactgaaaatgaaatactacggagtattattttcacagaaacggcaataagaatagaatttaagacttttatgcatactatctatattcctctcactgctagatcaaattatagtgggttataacaattgaacttaagactttatgtttttttaaaattaatttgtttgaataaatattattaatttatgtgtcagtgactattgaaatgaaatcaaaagaaattaatgtgactttatacatcgtaagcaccaataacattcatttttccctccttaaattaatcttttactattaccaaacattaacttgattcgaaaatatttattctgaattttcaaactaaaaatacaaaaaaaaaaaaatcaatcccaagatgcaaaagtacataaatcattaataatattttaagtataaaaaatcgaaataagtttaaagttactttactaaatgtagtcctaaatttcatacataatactagtataaatttcaatcaaataccgtatgacattaattaattgacgacgcctaaattcatcggttgctaaaaaaaaggactggttgtcttaacgcaccacccaatgtttaaacaaaattgtagtaatattacaaaatattttatcatttgttcgtgtattagtggaaatatattactagtgttacactgttatttgatgaattttcttaactttgacgcaattgatcaaaccaaacttcacattcaaaacgtgccgattctttaattttagacaaatattaaaaacaatagttaaaaactaatttttttttatcgatatatgtaaagttatgttgatataattttttgggtcttattaactaaaaaaagtatttattatgtaaattacatgtaaacataaaaaaattatgaattcctcttctttttttattggtcagctcctcttttacttatctaggttaattccccattgctttggaatgaatttcttttcttaaccaagtgtcatcaattatttaacg

SEQ ID NO: 1139 - DNA, 1139 bp, Glycine max
  Soy_ogl_71 Gm01:3032801..3033939 Cluster 4
tctttagatctctctttaattccccttgtgcaatgagattattcatcttctcactaagtgagagaaaacgagttattgagtcgtcatcagaagcttctcttaggatctccatctcttttatgcaattatcaatttggcttttgtaggcattatggatttgatatccccattggtccatttttagcaacaattatcaaacttggagatgacatcgttgttgttgggattcatccatctttcttcaactaaggaattgagacttggttcaaggagccatgcatttttgaacctaaatctcctcttcgaaaaaaaagtcttttacatgaagtcaaacttgaggagtataggagaatgatcagatttggaggagatgaggtttgtgagtttgaaatttggaaataagtcaagccattcacatgtagtctagttattcttcagaagccaattgggatgatcatggattccaattttatcatccaaggacataaggtcattaaaatctccaaagacacaccacgagagaggtaaaagtgtgaatctttatcacttagttctaaaagtaataaaatttaaaaaggatgtaatttacctttcacttaagttcaaaatttaataaatggtgtgatttaattgaaaaatttaatgttttatttaatctcaactttaaaatagaaatattgtatcaataaatttactaaaagattaagatttcatgtctctgtagaattatgattatattaatctcttatttatgaaataaatattaaagaaagaactaaatacattttatatattcaagatattaaatatatttatttttatttaatacctattttatagtgttagttaagaaagtaaaattattttaaactttattatggtatatttttagtttttattcataataattcttctacatatggaatataaaagaaataataattttggcattcagagtaaaaaaggtgttttataatattatcatctcacaataatcctctttataaagttagtattttcgtttgtgcttatatattagttttttttttttgtaagggatacaattaataaaaaaacattattgccttacccgtcctgtttcctttttctctgtatcttttttagggtacatagtgatg

SEQ ID NO: 1140 - DNA, 1065 bp, Glycine max
  Soy_ogl_6421 Gm19:38452964..38454028 Cluster 4
gttagatatttaacacttttgtatcatatatttatagatacattaaaaacaatgtctttaaattacacggttaattgtttttttatgagaaaatatcaagttatcgaagagtatttagtttttgaataatttgtatatattaaatattattaatccaattattgaatactttgatgttaagttaaccgtcatacccatcagattttaaacaaatcaaaatttgtaattgtatatttttacagtcaatatttaatacatttataaaatatgttacacattaaattaattttatttgatgaagtataaatatgttttaaaattttataaaacttgtaaacttaatccattcaataaaattttaaagtttaataattgaattaatgaaatttaatatttataaagtgttattaaaaggagagtcattttataaataattactcctagaataatttgttctctccttattttaagcatattaaaatcgtgtatataaatttattttaattttcaattatcattaatctaaaaaattataccattaatttattatatgtaattttaaaatgaattttgaaaataattattaaaaattaatcattattaattacataatagtttataactgaattataatgggaaaaattatactctcacacatatttcaattgaattcataattaattatatttcaattttttaattaagattttaggggtagaacaatagaagctgaaatgctttgggagagatgtagaaatggatgggtggtggcctagggttggacgtgttgttatttggaagtgaaagaaagcaattaggagagcatgtttggtggcgtcgaaccaatgtcacgttgcacacagattttcttggagaagcgtgaggactgaggcgtcttactttgtgtgtaaatcgcacattagcatacttagcaattcatcactctaataaaatattcctaacccatagtattttattattagttaactttattagaaattataaaattatgagatagtcattaaaaattttataattttcaaccaattaaatagaatgtgttaa

SEQ ID NO: 1141 - DNA, 1100 bp, Glycine max
  Soy_ogl_4022 Gm12:7965301..7966400 Cluster 4
actcgaaaccttaacaaattaatttaaactcaactttgactcagacttgtttaaatgtttattataccttaaatacaaaaattgtttattttttataaaaacttgttaatttattaaataaatgaaaaatgaaagcggataattcatgctgaaggcaaatttatccttctccatatgatcatgggcaaatggaatatttacatgcatactttaatggcatgaagggcactttgtctagtgtaaagctatcatattcctaaagacattaatgctcttgaattgaatgacatgtttaggtgagtactcaaaacatgagggtacacattctttctccttatggaaaagccccttttattaaatatactacaatattcacatttcatgactcaattccttttgcttagctcacttcctatgtcatgtcaaatgccaattattgacagcagatcaggatagtgtctccctccatttcgcgcctgtgcatgccattctacacaagcttcattcgttaaacaataaggtatgaaaaacaatatatatatctacaaatttcaacacacttaatagatgagataaatagtgggttttttaagtatattgagaaagatcagattcactgtaccatacatgtgaaaaagactttattgtgagaaataaaattcattttaataatctatgacttgaaaatagtctcataacttttgagtatgagaacattttattttcaaatgaatatatacatatagaagaagagatcaaattattcaaaaaatagttattttaaagttactcttcattcttagtattttttttttaagatctaatgttataataattaattattcaatcattagatctttaaaaaatgaatgatgaaaatgaggggtaactttttttaaaaaaattttaaaagaattaccttgaagaattctatcactcatctctctttatattatatatatatgtgtgtgtaaaaaaaaaaaaaatgatcgtacccgtgagtgatagaattatgtgctttgtttgagactgtgatcatcacaaacagaaattagcacttattagagcagaaatgttgactttatttttgtcaaaaaaaa

SEQ ID NO: 1142 - DNA, 1296 bp, Glycine max
  Soy_ogl_3254 Gm09:42834205..42835500 Cluster 4
tatttaaaactttatacattcaatataatatattagtattatatttattaaactcaataaataaattttatttaataaacataataaataagaatatataagaaaaccatctatttatttatatatttatatagatattacatgagtaatattaattaccttaaaatttgtgtttaattctattttaataatacagaaagacaggtgctgcgcggtgttcgtctatccacaatataatataaatactacattaataagattaattaaatactatctttttatatatataaacaaatagtaatattttgagaaaaaaaattatactttaatgtctaagttttttttttaaattacatacgacatcacttttttttattcctacactaatccataatatttgaaaacattacattgcgctactttaaatattacactaatcccacttgatatgttaaaaatattacactgcgtccctataagaggtgttgttataaatgttaaacaaacattaacattttgtgtaatttgaataaatctcatgagtgttactataacttgcttttatatttttatggaaataaaaaaactttatgaaaaaaattaaaaatcgactaaagtaacatatatttaaatatataggggatataatttactcaacataaataaaccatagtagtaaagtagcagaattttgttatttgtacaactttttatttaacattaaaataacttaattaaagacttgttaagttgtttacccaaaaatgttttctttcctctgaagtacttaagaatagaaattcttaataatgcatttagaagtgagtctatatttttcataagcgggacaaaacaaatatttctcacttgtttcttatataaagcaccgaaatataatattctattgtgcttgttatatatgagtgaaatttcatatcttagtaatatatcagcaagtttgtaggagattttttacgagagcacttgtggggataaaaaaaaaaatcaaattaatataattttatgtgagttaacttttaaaaaaacattctgatttaatttcttcgtaaatgtataaggaaattcgaataagtaggaaatcaaattttataccaattaaaacattcacgttagaacatagaagttgggaaaattaagaacatgagcattatatctcagacaggcagtgttatcttttactgacaggtttctaacagcttctttcctaaagagatcaaactgagtctattagaagctatacgatactgatacttaaactaagttccattattaagt

SEQ ID NO: 1143 - DNA, 1800 bp, Glycine max
  Soy_ogl_297 Gm01:52758801..52760600 Cluster 4
attaaaagtaaagaaagggaagaagaggtagtagatttaaatttttactaacattctaataaaaattaatatttattaactttttaaataattattttaaaataatttaaatagtgatttgtaattaaatcacaattataattgttttacaatgtgaatacgcatgtgttaaactctctctctgtataaaagaaatcataccaacatcctttgagatttattaaaaaaaataatcaatacttgtacatatattaatctctttaattgtttgaaaacttttcactgacacctcttatacattacattagcactccttatttatttaaaacatattacatactgtgtatataagagaggttactgacttattgtaaacgaaaaaaagaaggaggtttatgtgtaatttaaaaacaaagttgagagtgttaatataattataattatagaaattagaaacacaaaacaaacatattattggaataagaaatatatttaggtaaaaaatatcattttttgctataaatatagatttgtaaataatatgtataaaaagttgaaaaatatatattaaaaataaacttaaaaaatagtagtagtattcaattttggtaaataaaaaagaatatatattgtcttgtcctaatatgaatattatatcgtatcttaatattatttgatttactttaaacataaagcagtataacatatataatacttcgatattatttaatatgcattaaatatttgatagtataataatttgttatgcttatataccctcttatatcttatcatattattttatcatttcttaatgagtcttaaatcaaataagtaaaagtactggttggaagattatgtagaaaggttaagaatcatttatttactcttgcatggaattcttggatctccaccccctcccacaggtgtcttttggaaatgattttaaaatcttcatattaaacagaaatttaagattctcaaactcagatttcttaaaaacttaaaaaaaaaaaaattccagccaaaccctccttaagattttgatacagaaattaagaaatacaattaaaatttcagatttcacaaaatattttataatttcctaatatatattttatctttcatattgattatagaaatattttataatttcctaattaaggatgtaataaaaaaatattttaaaatcgacaataaaatgagagggagtgataaatataactttccaatccatgcgtgtcatacactacattattaatcccacttagaaaacataacataaattggcttagaaaaataaaaattaatactgctccacgattcaattatactgaatggactgaaacgaatgaggactcttcatttcagtggtccaccccaaaaatatatgttgaaaaaacggtcctaaaaataggtagcgaattatttatgagattgtcagtgtatagaacggggatcgtcggtgatgtgttataatttatgaagcgatgtgttagcagtacgttagtacactgccttccgtttctgatgatgataattgcagtcacaacaagtattgtgccttcccgttttttatgttgataatggccagcgtgcagagagagataggcaaatcaaataagacttgagagattggggaaggaggtagtgcctttctctccctttcacattcattctttattttccatctctttcttcaaatctattcataacctaaaaaaaaaaatatcaacttctccttcgttggatatataagattaatctaataaaatgaaaaaaatgagaaagatttatttc

SEQ ID NO: 1144 - DNA, 1900 bp, Glycine max
  Soy_ogl_3484 Gm10:40812801..40814700 Cluster 4
ttttttgttttttgtgtgtttgaaacggaagataaaggacaatatttataagataattacgaaaaacataaaaatggtaacaaaataattgagataattagattgttttaaataaaaacagaaaaaagtaattgaggtaattagaataaaacagaaagaaaataaaaagaattttcaaaatagacacagaaaaatctaaaacattaaatacatcattttaaattcaaatattttgaaatactcaaaaaaaaaaaaacacacatatgtactcatgtgatatcagaatctctttaaatcgacatacttctccccattcccgttcactatatattacttagtccccacaaatataatttatccttttctacaaaagcaaatataagagagtgggcgagatcactctttttggacatattaactaagaaaatgattcgtgtaatcttcttttctaaagcatggtgatttttttgttagccattacttgattcggtatcccctttgattctagtaaagattataaagcacgtaatgggtcttgttccctccgttgaaaaaaaaaacaggtaaataagcatttttgtcttaaatatgtttcaagttcccataaatttggaatatgccttattcaatctctcaaattataattatttacattttttagtctattgaatttttgaaatatttcttttaatctcttttggtaaacaaaatcatcacaatttgttcattcagacagacagaaagcagtcaagctaaaggaactgaagatatattttataaattttaaggactaaatattaaaatttttgtttgaagaaaaaaatattattcctacaaattttagggactaaagattgtaacatttatttggttcggtaaaactaaatatccgtaatcattcctacaattcgtgtaaaaaattaaactaataaaaaaatactttaaaagaaatctaagacatctatttagcacatatgaacatctcaaaaaagaaattatgcaatactttaaaataatgttaaaatctcaataattaatgtaataaaactaatattagttatgatatatgactagacatagttactcgttatctttttatagcacaattcatgtcgtctaatataaaaatcaagtgatatacaggtgtagctagacataacaatgtttagatcaacaagcacgtaagaaaaatataagactcttcaactcgtaccttttatcaacttaaccattacacaaattgttttcagtttacgtatacacccttcggtaaataaaaataatatattgaaaatataaaataaaaaaagagaaaaggaaaaaaaataactaaagattcaatcatcatttactttgacccaatttaatatagaactcaaaatatatgttttactatatttaatttttttttgttttttttaaggaaggaaattaattcatatcatattttatgagattctgaatacacttaggaatgtcaacaaaaagctggcggctagcatataattgtgtctccccccccccagctaaagagtgagcaacacatttagtttgcttcctagtaaaataaaacatatgtctatgtttgtaaaaaaagagagagcctatctttacacaacctaagtatgactcttaattcttattgagttgtacatctaacattaaaattatcaaccacagttttacaatctgattaaattatcacgaacccaccctatagcctctaaaagggccatagtttcgcttcaactggctacaaaaggccttaaaaaatgcttgtctttgcaaggataaactgacccaaatcatcccgtaagtataaaccaataccaaaacatctttgattagcaaataaggtagcatctaaattgcacttaatcacaccaaaaggaggtttctt

SEQ ID NO: 1145 - DNA, 1716 bp, Glycine max
  Soy_ogl_4230 Gm13:23660701..23662416 Cluster 4
atcgcccacacacaaagcaaataaggaatatgggaggccccaatagatcagtctacgttgagagcaggttttttttccttctttgatgtcctatccaatttaaacatctaaacataatcttcttatcaaattcaatattattgtaaaatgtaatactttcatatttataatctaagtctaaccatgaataattattatgcaggaatcaaacacaagatttctgcctcgacactattagattttgttagttgaactagtccttattgattaatcaagcgcttttaattaacaatatatcaaactatacctttttctttttaataatcatattcaaggattttgacctttcggttagatcatcaggtctcggccttaggtattccacaagccttttggtaagtaatgagattaatcctttgtttaaaatattatcatatttaaatttttttgtctcaaattgaacttaagtcttaattcataagtttaacgcatattgtcaactgaatcataatcagcatgtatattaaatttcatatagatgataacttattatatcaaaaaataagctcataatatatagtaattatatatactaattaaactgaaaagcaagtgaaaaaaaatcaagaaattcagaatattcattcaataacttaaagattagtacaagtttgtgaaaacatatgtataatcggaccaagcctattgtatggacaatcaagtgagaagagggtgcagcaaagggaacacgtactaacagtcattctttgaatgggaacggttggtgaagattccacatactcctatatgtttggttctggaataaatgtctaataattaaaaaaaaaaaaaaaaacttacaaacacataaacacacacgagatcatgtgtttgtgtttggagattcacaccccgcacccctttttaatttttaattgattcggagctagctgaatcagcatgcagcttttataatatatgcttttgttcatggcctatatagtacttattcccagttatattagattgatatttgaatagtgctagtttttggactgttatgccatggttccgcactttgcgctgcatacatgaaaataaacttatgcaacaaactagtgatgaaaaagagattagacagtgatttgctgctgggttcaattttggaaagaaaaaaaaaagtttttgcgaaaaaagatgcttcgattttaccaatgaacaatgttttgtttcgtcctatacaaaaatcagagtcaaaatgtgcacagccgaaaaaagtaaaagctaattcaaaacattcagtctcgatgaattatgatgaagctagcaaaacagttgaagtggtcagatttcaaagaaagcatgctttaatgtccttgctctctcaactggtagatttatattcttaattattatgctgaaaactgttgtgaaaggttggtaaaaactatctatctgcaaaatgttgttaggtatattgaaagtagaagaaaaagaattaacacatgtaaattggaaactttcaaagatattattggtttaatttgagtaaaatagtggcggttaaaacgataagattttataaattttcatgtttggtttaaaattttagtatatagttctatttgatcatcttaaatatatagtaataaattaaatttgttttattaagtttaagttttgatatactaatgtaaaattttgtttacagtcaag

SEQ ID NO: 1146 - DNA, 1438 bp, Glycine max
  Soy_ogl_910 Gm03:36601163..36602600 Cluster 4
taacaatatagttgtattatatttaataatattttatctatttcttctttttgtttaagaacattggcaacttggcaaaactaaactcaaaatccatagttaagttagatagagcctgctagatgaactatgtctttaaatgtttaaaaattatttattatttttttataacagtaaaatcatctattttagtatgatatattagattgttagcataaatttgtaatatatatactaaaattttaatttttattagataaatatcatatcaattaataatgaagctattctaacaccaactgttttttttatcagccaagaaaaataattatattaacacttaggtacaaggggtacctaaaccataatacaaaaacatctgttaatatactaagagaatcggttaacacttcacatacacacccaagagaacaacctactagtggttatttatactatatttacttgttatgtagacatcataagtataccatatataaccaccccaacagttaatatgtgaaacttaatttttttcttgtaaaaaaggcttatagagtttattgatcatgtcagatgagtaaattaaaagacattgagaatactttatcgttttacaggatgcgcgtattaattaagtttgattttcgctaatatatagtgagcaaaatcagcaactatattgtttttagctgattgatttttggagaatgatgcgcatatattcaactctctgcaggccaaaaaagagatatggatatacgaatcattttttttatccaattagtcaaagatactagcaaatagcaaatcatcatgcatgatcaattgcagtaggatccaagagacgacatgcatgcataccgggataccaccttgattgaattctacatgcatggtcgatcaaaagatatgcatgcatttgaaaacaatattaatgaattcttcgtcaaagcatatttttcctttggcttgtatatgctaaaagttaaagttgattcatggatgataataatatggtttaacccccttgttgcaattggctatacctttttggaccaaaaaccttccaccgtaatcacacacgaaatagtttcactttttttcgtcaatacaaggaagtaattaaccttttttatttgttcttaaattctgtaaatgaatgaatgaaattacaaaaatttgaaagttaaattacttagtcaaagttgaacagtgtaaaatgcatcattgggttgatcttctatgtaataagtagccaaatagggatctgcttcctaattaaacactgatagtgcagaaaacatgtcattattaatttaatagggagaagaacaaataagataaaagaatggtgggagaagatttgcattttctgataaagaaaaaaccctttataattaaattgttatatgtggatgtctcactttcaaagtgg

SEQ ID NO: 1147 - DNA, 1926 bp, Glycine max
  Soy_ogl_195 Gm01:48191475..48193400 Cluster 4
cgttatataacatgaaaaattcattcacacaacaagaaaaagttagaatagaatcgaaaatttaatgttgtccatggcatcaatgatggatatcactttagcattgatttggcctacacaagttggaaccaatctttcaaatgccactttctactttagagaagaaaagggatagagtatggataatttaccatatatacaatatatgtctttgtatccacatttgaaaaaaaaaatatatatatttgtatgagagtaataactttaatccctatctttttcacctattcgatagctatatattcatatccatacttactatctatacttcatttaagtataaaattaattaataatccaaacaaaagatacaacatcaatggcataattataatatatataatattttaattcttcaaaatcaactaattcctaaatttgaacatcatctgctagtattcacatgtgaagattaatattttaaaatttaaatatttttcatataaaaaattaaacaggcatagcatagttttttttcaaatttgaacaagctaagatgtataaattaaaacttacttagaataaaaaatatttcattattaatgataaatatcctaatattaaataagaaaaagatgtcttgggaaggataattagactaatataccctcgatcttcatatttataagtatggcttctgtctatgtttcttcattatatctctccttttcgtttatttgaatatgtgttttttattagtgtgcttgcctttcatttaaacactagcctcatgagatgcacctccatcactccttcacgagataatattctttctctcttttataatttttcaaaatctctgtctcttgtaaatggtgtttgagaataatgatgcagaatattttctactttaagttgtgattataattgataaagaaatccttattgatcacaccaattctgaaactattatttaaaaattaaaaaaaaaactctttacgtcgacttatttcacattattatttaaaaattaaaaaaaaaaaactccttacgtcaacttatttcacatttttttaaccagtttagaagatcgaaagtaaacaaaataaaaaaaaatattgtcctagtgtctatgagatcatgtttctcaaaattaagtttttttttttttttttgtaaagtgaaaattaagtttgttacatgaaaaactagtagtggcatcgaatattctactactacatctggcatatttaagaactatagaactgttagttcaggatcatatatttacttattcaaatttattctatttcttctttaaaaaaatatcgtgtaagtttaaataacagagtagaaagaagttgaaaataataaataaataattatatatcgtcacataattttagatgcaaatacatgttagctacgtcccccctgccccccaaatcgtcgaaaaagagatgcattttcttcactgaacgataaatctgcaactccattttctactgttagttggagtattggtgatcgaagaagctacctaaagatctctgtacaattgtagctatacctaccccatttctctagaaaaagattcaacttgtcaatttgtcatgtagatttggacaatatacaatgcataacttatcgcatcggaaacaaaaacttctagaagtatatctaattctccatctcatatgatcaatttcaattaaagatgcaggtacacgtacaggcgcgctagtgtttaaatataacctgcttttgtaagggtacatcgtttaattaaactttctaaatttttccaatgtgattttgaatatatatacaattagtatacttcatttcttgattatcttagtgggaaccagaaaggaaaaaagaaatttccctaaaaaaatcaacaagaatacgtgttagagtatt

SEQ ID NO: 1148 - DNA, 1701 bp, Glycine max
  Soy_ogl_929 Gm03:37491901..37493601 Cluster 4
ggaagtgtttttaagatattagttaaaaaaatcatatataaaaaaatactgttaactatagtagaatattagaattgtattaaaaattataccaaaaagtttgtttgctgatttaaaaaaattattaattttttttatttgttaccttttttttttcttttctgtaaataatgtatgttaatttatagttgaaattcataagactaatacatgaaagaagtagagcattaatcaagagaaaacttctctttttattggtattgttggatcagtataactagaaatcaaactttgttgtatgtctaaagagttcatactattaacctctttttaacatttttcttaaaatattttcgatcatccaaaatgctgaagatctaaagttatgccatttctgacagatatgttcagatatcattacaataagaaaacaattaaaaattgagatattttgcatttgctccaccaatcactagtacagccacgcttgttcgggtaattgcatttaagtgtccaattgactatcagcaaaacctataataaaaggcatatactcgattcacttgttcacaatattcttttgcaaaagtagttattttcttaaaaataatcaatttcaaacatggatttcacaagtactcaacaaccttaaaacattttcgctaaattaaagtagtaataaagttaaagaaccgtacactcctaattaaaagaggaggatagacgtaacataagtttgattagaataatggcattagtaaagtaaatttatatgtatgaatgtatcgttgaagcaatgggatggctttagaccaaatattttttattataaaagattagttattctaatccaatgcaagattccttgaatacatgtcgagtgcaacttttccttatggtattttttttagcaaatttaattcttttaaagtgatattttgatatatttgtagtttgttatgcaaacgtatataatatcaataattataaaatgtctaattcaattgactaaaaaaagtaactaagttattttaaactctaagatacatattttttatttttacaaataaaaaaatataatatcaatagttgattaactaaaattatttactttgcattcttaaatgaattgtttagagtaagattcaatatgtaactttgaacattgattgatcatgggtattaaatttttttcttaagccttctaagttttctaaagataaatttgttacatatataaaaaagattgattaacagaaactcaaagaatacttttaactcatctagaagaattaagtgtgtctttgaatgagataatttttaaatctcaatgtactttgaagtgaagcctagtgttacaaaagatttatgttcaacagaagccaacagaaattcaaatacaacttcaattactctcaagtaatcttgatcgtttataaaataataaactgatgatatttttacatatttatgatttagtatgtgcaagtaatacttacgattgattttgtcatcaacaattgagtcacccactttatcttttgtttggttcaattaaaagtggagagtgaatttaaattttaatggaaagatgggaagaaaaggacaaaaaggagagaaatttttattagatattttgtttggttaataggataagagtggaggaaaataattattttcttatttggtttgcaagggaag

SEQ ID NO: 1149 - DNA, 1457 bp, Glycine max
  Soy_ogl_4127 Gm12:373044..37658900 Cluster 4
cacacacacactctgttgttctgctgacgagagagaagtggaaatctccgttggtttcgtcagataagagtgtaattgggggagggaggatttgtaagcaataatttcgttcttggtggatgagtaagcagcataatataaaaagaatgtgaatatgcgttgaactaacaacaggacgagcaaaattcactgtataaagcttatattatcatcattatatcaaacgtgtatgtatataatcgcatcaatacatgtataacgagtgcccttatgaaattgcatgtcaaccatgcataaaaataaaaaaataaaaaattgcatgtgtcaaattaaacttcttgttcttaaagtattaggacatgagcagctgaaacaaagtttggtgttgatcgagttctgaatttgcttttgctgcttagctccattggtttgaaaagattttcatgatggttttctttgccaaaagggccccaatggggggggagcattctcttagcccccgggaataatggagggttccccatttgaaaaaaataaccctttcctatcttcttccaagttatagttatctttcccctttaattttaattttcaaaactttcattgtaacctatggttttggaaaattattccaaaccatataattttatttatcccttttacttttatagttttatttataatccaatgatattttgtaacaatatgaaagctaagaattatgaaaaaaaaaatgtattgcaaagtcaagaattaaagtatttgatacttaaaaatttgagaactaaaaaatatgtttggaaaatcattttaacattttataaacttatttaactaaaatagatgtgttccacaaaggaaattgtatctcattagtttagaatattttttttaaaatcatgcttgaaataatatttgagcttaactaattattgtttataattatgtttttactctcaatacttaaataaaattcttatttaccatttccatttaatattatactatttattactttatttattaccgtacttacacacaatatatatattatagtcaaacatatagctagtttaattaattttctctgtattatcaatcaaacgaatcaatgtgacattttctgatcaaacatattatactcctataattatgatatttttaataaaattaacaaattaaggataaaaaaaaaacaatatgaatcaatatgtggcgcaacaagccattcccaaaattaagagtagttcgcaattttgtagtcaccgtgtgggggctgtcacccttcattacttttgtgtcttgacacattttgtagccttactcttataattcagtttgtcagtttgcacacacctaaagcttactgccttatgacctcatttttttcttttgtttgctcagccacatagcttaattacttataacattgaaagtccaatttgtcgagaccccat

SEQ ID NO: 1150 - DNA, 2157 bp, Glycine max
  Soy_ogl_5197 Gm15:50518501..50520657 Cluster 4
tttctgggtgcgtcggtcgtttctaataactacccacattttaaccttatatactttattccatgtttagaaaaatagttgttaactttcactacccatttctcctatttgttaagaaaatcatggctttatatacatttagcctttgaaaactatctgcagctgcataccatgctcaaatcttccttccaacttgatattcctttaagtaggtttgattctaagctgcctctaagttcaattctgctacgctagaggtcaggaataactattaaccgttagaaatgattattttagccatcagtcattatagaaactactattttagtcgttaatgatttttagcaccagatcaagctaaaatccatttagattgagtcacattagtcgatagccatcgattaaattagcatgctgaattagtcgttagctgatgataaatggcaagcctcaataacaaacatttttagtgccaacatttaaataacttcatgaaaaaaatacataaattttatacaaattttaacatttatactaaacttaaattattgtcacaccgattcttatatataaaaagtcatttcactttcacacttcattatgataaaagttgatggtacgtgtgtgtaatttatttaaaggctaaaatatacatttagttctttatcttatattttattcaattgggtcatttatgttttaaaatttttatttttagttttttaaaatgatttactttgatactttccatcacaaagttaactttagtgttaaaaaaattcaagatattacttttctatcagtttaaaaccaccaatattttttaatttgtaataagtttaaacaattttttggtggctttaaattgctagtaatttcttttttgttttcttctcccattcttcactcagtcttttgcttagatttaacattacacaatgaaatcttcaaatccagaacactaatcacacccagaatccaatgcaaaaatggatggcctcaaaatggttaacccaatactggattgaggttcaaagattcaaaatccaaaaatttcccaaaagatgataaaaaatagagaaacagataatatagacgcctcaacaatcttcccacgaggtagagtaaccacttattaagcttaatcctctctatttgtcttcattcagcaatgataaacaattaaactaaaataaaaaatcctaacggctaagaagacgaaagtgacatgaatagataatgtaatagatagggttacggttacataagtagaaaaaagcgaaacaaaaggaagaaacaaataagaaatcaaattacagatctaaacaaaataagattaaaattgaaatcaaatgcatatctaacttgagtcattggaagaaacacaaataagaaatcagagagagagattcgaattgcaccgacgaaacatgtcgccttccgcttttgttcatcaagctttagtatggcaaaaacggtgcatgttccaagggttatgaatatggctcatgtgattgttatgaaagtgaagagtttaacatttccgataaggctatgaggccctttggaagggaaatgggggagagggattttgatggtgtgagcttggtggggttaggaaactttgttgatgttgggttcaacaatttggcgttgatcatgaccattgctgatacagagaaaaaacataacataatgcataaaagagaaagtggatgatataaatggtgaaaaaaggtaccccgagccattatcaatgacaatagctggacaggaagtagagggatcatttacgccttgtagagcaagaaaccctttgtttttgtccatccacttgttgttgttgcacccttatagtggtgttaccttttttggatttgaagattttttttgtgttgttgaattagagtgaagattttgtattttgtgacagtttttaactacacatatcttaaaattattaacagtgttgaattacattgatgaaaggatcaaaatgaattgttttaacaacataagggaccaaggtgattttttttataaaaaaagagagaccaaactgaataaaaacaaagaaaaaggatcaaagctctatttaaggagcaacgaaatcttcaaagctctatttaatgacattaaagtgcaattggagttctt

SEQ ID NO: 1151 - DNA, 1900 bp, Glycine max
  Soy_ogl_6213 Gm18:56794701..56796600 Cluster 4
gtaaaggaggaaaacaaagcgtgataaaagggatcaggaaagggaataaaattgtgtggaagtttatttcgctttttaaatattattagtttattatcttgcttctaaaattggtagtggtttaatttagggtttctgggtaggcaagatttgcattgaggttatactgatctgtgttggttcctacaaacttttttaattttttagtataatatagatgtataattataaatcgtttttacaatttaaaatacagtgaaaaaaattaatatacaataaaaatattgagtacatgagtatttattgttctcccaacttaaaatttctaaatccgtggctcttggttactactgacaattgcaggaattattattggttctcttctactttgcattgttgctaagataggactcctgttggtgcatctgatctaatgtttttggctcacctttatctttggtttcttgtttttggttgcctgctgtgaatgttacgagactatagtgctattctttttttttaggcggtctacagtgctattttacattgcactttcttgtaagtacttcagaggggtgaagtatgagtggatgttatttaatgtgggaaggttatttcagaaacattgcaactttgatatctgcagatatagtctttttttataacttgatttgcatttggtctgtcgataaagggatactactatagattttttttggcttgtggaaggtagttatggggtttgctacttaacttttatcatgtcggaggtttatttgtgaattgtctatatatctgtatcgatcttttgcgttgagtatcacttgtagtcttttttttttttttttaataagatcttgtagtcatccttttaataaactttcatttacttttaaaaacaaaaatcttgtacaatttgtattgatctttttcctcttgatcgccttattatgaaaaaagagtgacaatatcaaggagaggcggttgtttatatataaaattaagattctttgtttacacatctccttctcctttttggaaataatagccctaagcgccccccaaaaaaaacattaagaaaacttcagcatgaaaaataacagaaacaaaggatgaaactaaaggatatattacaaaaacctaggaacttacgttgttcttattcttaaacaaaagcacttgacactacgcaaacaaatttaagcaacaccagattgaaaagtaactgaaacaaaatatttcaaacactcacaaacgtccatattccgcttaaacaaaaccacttgacacttcaaaaacaaaattaacaacatcagaattgaaagtaactgagaccatgcaaagacttcacacacccacaaacataattgttcttaaacaagcacacttgacacaacacgaagcagaacctagtatgaaatttcatggtatgtgatcatccattaattaattccctcctggtctgcggctaaagacttgctgaattgtgggtaattttgttcccttaagcgtggagctattggaaacctttggaggcttataacgatctgaatgcaaaacatctttgatggtaatactacggctaaccttgaggttagttagcttctgaggcccttttgaagtagttggcttggtggaactttcattaggagaatcttttgaggcattattcattgtgagtgattggagaagaaaataaaaggattattagtaatatgtgagcttgaagacagaaatataatgaatgaagggtagcaatgaatgacaacaagtaaatgggtggttttataattggcaaccccgggtgacctaggtttgtgaatttgcttgcaattaccctttcatcttccttccattatacatccatgaaatggggtagtcaacattttccaaagggaaa

SEQ ID NO: 1152 - DNA, 1600 bp, Glycine max
  Soy_ogl_549 Gm02:14701401..14703000 Cluster 4
aatgaaggtcatatactaacttggttttgctagccttttcaacttcatgctggttctcattgattgaatttaaattcggggggggggggtagaataatttaatgaatgaaataatcccatgttttttacctgaactgtgctccatacgaattttcacataccatccaattcagtcgttactagttagcatgacatccttgactatttaacatactcagagaattaataatatttggcaggtgaataacttctataatatacttctagatactttaaggcccaaacaaagtatctaccaaacaaaattacaacacatgcactggctagttgactgaaaattgatcaagtcaccaattcaaaaaaaataaaatcacacaaggttattctaatttcataacattttttattcgacagctagttcagatctgttatatgattgtatcactagttcttaattcaaccaactagagccaattttataatactaatataaaatacatgctatttcatattttatagtgcatgttggaattaaagtttgtaagttaagtttgaatgaactttattttggaaactgaatttgcaaggactatatcagatagaagttctataactttctggaatgtactagattttgtattttgtatttgtatgatatgacatcttatttttaatttggtacacaaaattattgtcggtgctccttttcttggtaacgataattaatttcctgttttcttttgcctttgcaacggcgatgtagttttcgtctttgggccctgctgtcctcaacgtgtgacaaaacatttgcacgtcaatttgcaccatatatcatgtcttaattactacaattgaacctcgtttgttcattaatgatgatcatgaagtggatgagaagaaaggttaatcaatggatacatgtgacacgcgaatgtacctataaataatactcttatagtattaattaaagaatttaaccatcaaataagactgttaggctttactaatggtaattaagatacttttttgtacgtataatcttttgttttttagtatgttttttacgtcttgtttttttagtcctggaaactaaaatttccatgatgattagtccgtgtaacttctgttgcctaatttgctggattatacttatacacatttctattctaaaaaagagggtatatatatgtacgtattgtgttaacttatttgaatcgtgttagcaattcttttgacataatatatatatataaaattcaactcacctaaacttcttaataaaaaaatcctttttacataaaagtctctttctaaatcctgtatgtttaggaaaatattaatattaatcatggatttgatcacataatttttcatattttttaggatatgaaagtttttcatgatatattgtaatggaggccgaaatgttttattttatcatttaaaaatataataaaaatagtatataaacatttttgactggtgaacatgaatcaattcaaatctcgatgctttgccaaaaatgaaaaaagaaagaaagaaagaaaaatcaactatgagatgaacccacttcagaaaatgcttattcatctttgtgttg

SEQ ID NO: 1153 - DNA, 1456 bp, Glycine max
  Soy_ogl_2565 Gm08:8786345..8787800 Cluster 4
tatgtctttcgaaaataaaattgtaaaccaaatatttcttattttctctttaatttaaatttaacattttttcttttcccatattttcttcacttggtatcgaacaaggcttttcttcatttaaccacacacaaaacaaggcttttctactttgtttttctccaaaagaagtgagaaaagtgaataaatacttaatatttatttctaaagtactactccaattaagagtgtatatttaaatccctttaacttgtacgtgcgccaaatatgtgcaataagaagtatgtattaaagtagtttgattagtgtccatgcataagtagtagccgatgatatatatatatataggtgccatatcacattcagtagattaaaattaccaaaaatctagttgtgcggagttggggtaactttgtaaatgtataaggacttaattaggctcgacttttttttgtcttcattatacactagagaaactttaaattcaatgcatgtttaaattatatatatttaaatttaaattacttatataaaataaaacatccataatactaaaaagtgattttccagtctggtccatatatatgttttcaaattatcatcattaattaattaacaatgatataaacatagataattaaaaatgaaactattgatatacattgctcattattggttgttttttattcgatctcatcttacaaaagacataaaatagattgatacatacgtcgcacttattttcttagcgaataaatcaggagcacatacggaatactgatcaatatagtagttacataaggagttgttgcacataaaaattaagaatatgaggtaaggaatgagaacacgtaaaacagtgacatcgttagaggagatgaggaataaacgcatgacataaattatcggccaccaaacgagaacgtagctgtagtgcatgcttgtgaattaagtaattaatgccagctggcctgtaaagtgtcatcgatttttcttatgttttggtcacttttctactgattcagtggtcacttctagccatgccactgatgtgaactctgaaaaggaaagaaaagaagaataaaataaaaccctaacgcgcaaaccaaaagaaagggccaccataacaccgactcaaacgtttgtaggtgagtttttttcttttttttgtacgtgttttcgagtgttttgaccgtttgggaagtgttgtggctgtggaactagtcgcaacaaactcactccccaaaattccaaacaccataaattacgcaaaagtcaaacactatccatcccccatagtcattcattaattcatttgtttgacgttggttggatttgcttcgttttccttctgattccattctacgttatctttatcttctaccgccaactaaatcatacttctattttttatcttcggaactacccatgtctaacgcaatttatatgcatgagc

SEQ ID NO: 1154 - DNA, 1600 bp, Glycine max
  Soy_ogl_3852 Gm11:16611001..16612600 Cluster 4
taatagttaattacacaaacaaatggtagttttgaaaaaaaaaattacataaatttatttatttttctttcaccaatctcatttttcattttttagaaataatattatttaagatacaatcatatattaaatgttgacatctctcctaacaaagattcaaaccttgatttagtcagtgaaattaagactagctagcccattctgttccatttaaacccattagtattactatataaatttatttattaaatatataaaattatttatcagttaaatcatataatattttataaatttatttatcaaatatttttatttctatataactacaccgcaagtaaaaaggtagaagatgtataaataattttaataattgaataaacatatttgtataattagcataaaaatatttaataaatcaatttatcatcttaatttttaatattttttataaaactataattatgcatttagggcagtaaaagagtaattaacaaatacagtaatggtttatatattatataatataatttttatatacaaatcaaacaagttcaatgatttggcgacgcctttggttgcaaagaaagaagaggtcaaggtttggatcccaactctaaaatgcttaattgcacattagaggcaaaatgcatgaaaatatgtgagtttgggttcaaaatgtgcaagaaaaatactttataaataagcaacatgcatgcatttcagcagccagatgcttaattaaggttcattgaacagtgttgaggagtgaagaataaaaagaagaaataaaatgacggcagattcttagcgtagcaaagtaaatgtggtaagttgtgttgtgtgaggcacgtaatgtaagctttggatgttgccataacatgcaactctcatactgctacatatataaattgctttcctcaacacttgttactagtgcccatcccttcgaaattttcttttgaaaatgaaaagggaaaaatactaattaattaggaataacaaaaaagaagaagcagataaggagagtaagagggtggtggatcagaaaaatacggcatttatcattttatcccatttaaactcaatgtgaatacgcagcctttttccaaccaaggccactacaatatttattttatattcgagtacttctcaaagacgttacttgaataaatgttggtttatggttgcatttattcttttgaaaactatatatgcacatcttccgtcgccataagaaaataaacaaatattaagtcaaacatatacctttgagtgtaaaataagtatgtttgcagcttgtaattacaatatatgaacaaacggtaggattaggacataatcctcattaaggaaagggaaataataaatatatagaacccaccaaatgcaaatgcatgaaattaaccaatcaaaaccaattatttaaaaaaacaaagttgtcaaaagttcatcttatatatggtatctcgtatcctcctagcaagctagttacctaattagatgataaggactgctcaattgtcaaagaaagagttttcattatcttagaaaaagaaaaatgacaagaatctcatgttgcacttagacgggatacatc

SEQ ID NO: 1155 - DNA, 1800 bp, Glycine max
  Soy_ogl_829 Gm03:3573701..3575500 Cluster 4
tttgagagctattttcttttttatatctgattttccttttaacggagaccaacgagacagagaaaaggtgaattgggctcactgttttttcatgattatttagtttccgtttctacccttaccctctttcgctgttccctcgagtaaagcgagatgaaaacaggaacattatggtaatttaataaccatatgcaacattgatctgtttttcggagctgaatctgacgacacgacataatgaaagctttttagaggttcgtagatatcgaggcagatttggacggacaagattttcagttggaacgtgaaaacgtatggctgagatgcttggcaatgtgttctacaatacactttcaaaatattaaatctacaagtttgtttttaattataatgattatagtgctcattccaatgcaattcaatgaataaaaataaaagtaagagtctttattgtttttcaaaagtacttttgcctataacatattttttcacttattttcaaacatatactcaattttatttttaaagttttatttctacatcagatcttcataattataagattgttttgtttttatataaaagataagataagatacattagttccttcattaacagatctttatttatttggcttaaatataagtatttacggaatatttgacttcttgagataatattacattatatttttttaccaaaatataaataaatattaataagatagtaaacacaaaaaataatgtagttttttttctttaacaaaaaaaaactctacttgattttttggatttactttcttattaatctttatttatttttatttttactctctaattaaaatcaaatttttgattgattgattttttcttttttttttttatcgcttttaatcctatcatcaagtaacaatattaatcggtaacataatacttattattttttgtaaaatatatttttaattcctaatcaactattttgaattggtgagatgagggattaaaaataattttccaaaaaaacatacatagccatccaccatcaaactctttaataatgtggtaagtcattagactatcaacgttgatattatgttatcagctaacttaatatttaataacaaatactaaaagtggtaacataaaaaaaattaaaattttgattgatcaaaatttagattaagaaccaaagctagaaattaaaaagggggagtagtaaaaaaaaattatcctgaaatgtttttaaaaatgtcaaataaagatccaaattgatcttttaaaaaataattaacttgatttgatttttaaaacttgaacttttttttttatatttatctttgtccttcttcctcagtgctactttacctacaccaagctcccaatatcttccttcactaagcacaaaaacagtgttcttttcatgaagaataaaaggctctcactaactaactccatggcaccaggaaccttgccctttacctatgtacagcacattgcccttctacttctagtcatttttaaaagcaaaggcatagggtatgacctagttctaggttgttgtcgaatgataattgataagctttcttttttcttttacgagatgagacactttcttgattttgggttctcatgggagaagtttgggtatgttaatgtatattttgttgtacattatgaggagttatatatgtaggacatcaataaattaactcaaggatgaacgtcatcattccttagaagattatgccacaaagtcacaatctatccctattaaagattaggataatgattatcaagatg

SEQ ID NO: 1156 - DNA, 1675 bp, Glycine max
  Soy_ogl_3853 Gm11:16613026..16614700 Cluster 4
atgtatttaaacctaaaataaaatatgatgttcttatcttagtccgctgcattgttaggttcaatacctttgaagtattatttgttttagttcctgtatatgtaccaatatattgttagtttaaataaaactaaacttaatttttttaaataaaatatcagatttcaactttgtgaataacataagaaaaaagaaaaattctactaataacagtaaaacagatttttggttaaaattaatcattaatttacatagttggtgaataatttgcaccaaaaacaaaactaatgtgtgcaagctttaactgttttgtccgaacaactttttttattagttttttaattttattaaaaatatcagtaagaattactcgaactcactatgtctccatgctcaatgctcccttcactcttaatcttttttttcaaaccatcaagcgaatcttatatttgtccaaataccttattaggttaaaagagaaaaaaaatttctaaattatccataatttcaatcggtaaacaatataagatttttcggtataccagaacaagtggatttcatttattttcttaatatgcaataaaaatagtgaataacatagtagttaataaggttgctaaaaaaatccttataactataactagatatataaaagtaggcatacaattataatcaattttatagttatcaatatttcaaataacttatttttatttaaaaagtagttataatataaaactataaataattttataaaaatgagtattttaaataacttatttttgttcatccatagttagatatataagtagtatgtaactagtttattcataactagttatacattaatattttaaaaataataacttttatatgaaatcatacttatattttaaaaactagttataatattgacatataatttaattattgataagctataattatagttatgtaaatattcaaatcatgaacatggatagtagttaagaatatttgagaatagggtcttcacaagccggtgtgtggaagtgataaagtatagctagagacactaacccaaactagcaatcagcagagacaccgaaagtagtggaattaatactccaactccactttaagtctttaacagttcacacgtcactgagtgagagaagcttctgaaccactcatgagaacaaactagttaattggttgcagctaaagcacctatatatataacattatcacaatcaaacatatttatattttgttatttttccttggtcagcagcgaacggaactgcctctgaaaaccaaaattttcatattatccacaataataatattagttaaccgtgccaatcccttgctgtccaagacagtgacatgcatgcctcaagaagaagaaaaaacactttattttctagttgggaaaattttcccacttcactggcatatatatagtttttttctttttcctctcacttcatttttctggggcaaccagaagtccagaaagatgctgtttgtttctacttgcttaattcaattgcttatatacacaaattcttgcactaattaattaatgagtttaacttttacataaaatttacattatcaattgataaaaaattataataattatgaattttaaataattttcataaaaattatttgaaaaaattcaaatcac

SEQ ID NO: 1157 - DNA, 1100 bp, Glycine max
  Soy_ogl_3380 Gm10:5377301..5378400 Cluster 4
taatcaatgtatgttttttttataatgtcatttagttacatactatccatatcattaaataaactttaattgattttctaaaataatagctattttgcactgagactaatctaaatttaaaaaataaggtgtccctgcagctatagggtttttttcttcttcttcttcttatctctaaaaataaatattattaaaatattttaaattttacataatggaaacataaatggattctacataaggttgtgctcagggacggatcgaccttaaatattatgggacaattgtctctattaagattttttttttacttaaatatatttgataaaaaaaattatttccataaaaatagatgtggccctcataatatgaaactgttttttaaataaatataaaaaatataagagtaaaataaacaataaattgatactaattttatgatcactttatcttttaaccaaacaagtgacacaaacacacacattaatccaattataatttctagaagcttaaataattttaatttttttaccatgagattatgtattttgtaaaaaaataaaattaatatttttctttgaaaatattctaaactagtattttttttgccctattgtaaaatatttatggatccgtcactggttgtgctatttattaagaatacaaaatgcacgattacacataacacttaacagaaaaaatctaagctgagaaagaaaacaattttagaggagtataaattattaatttatattcgtatatcattcagtattattcttttacataataattttttgcaccttgcttttatccctataattttttaaacatatagatataaaaatatatttctttgttttattattaaaagaagtataaatccgtgtaagaaaaattgttaaaaaagagaagaaaatccctaaatatatacatatatctttggagaaacctgttctcatttacaattacaagtcatgaggctggcccaccatatctctatcttatgataaggagtggcccacaaagcaaggccgtaagaaacaaaacgtaggacaacaaagtcaaccagtttaattatagtaaatgaagaatgcataaaa

SEQ ID NO: 1158 - DNA, 1360 bp, Glycine max
  Soy_ogl_1962 Gm06:15591041..15592400 Cluster 4
ctcaaattgtcatgtcaagcggattgcaagtggaatctgatcgttcccctggattccgttacccttttctttcctctgttttggcccaaaaaggaagaaaaaaaaagttaaatagttacaaaacaagaaagattaactatttaattaataataactatgagtaatttccaattaattaatcaatcaactacatatggtgatatgttttggattggttacatttctatccgttgatcgatgttttgtttggatagaatttagtgatgaaatggtaaaaatcaaggaaaaaaatgaatatcaatcccatggttcgatttgagattatcaaatttagaacagtcaagaactaataaaaagaaaagtttatttcatataaaagattttcaagtttttgttttcaattaaagttgatggattggttatttggttaagccttgggagatattttatttttctattataacttacatgaaatctttgtgttccagatacctttttacagtagttaaattctttaaactttataaataaaaaaaatatgcccttcatttcttttacaggaaattatgcacttcatatgatctatatatttaaagaagtttctcataaaaaaatattaaaagaagctaatgactaatgatatattaaataatcacataatattttaagcaacaaagcatatcaagaaacataatttgtaacttttatatttgaatagtttttattgagactaagagaatagtaaaacaagagacatgcttgacaatccgtgttaactatatagaaataaatattatattaattaaaagtaatcaaaatgagggtttacacttgatagttatcgaaattatgcgttttaaaaataaaaattatcgtaattatactattttaatttttttaggtcttttatggaaaaataagttttaagacgatatatagtgtggtttgattattataaatgggagttatttgcataaccttcctaaacttgagttctgaaaacaagtcttaaatcctaaacttgctaattagaatctagaacttctcttctatgatgattctgatcctttgcggcagtgtttgctatggaaatgctcgatgagggtacctataattgtgtttcaatggtaaacttaattaagagtaacttcagaagaataatagcaatggttaattaagatgaatccaaatgtattagagtcaacatgtgccttctcttggtaggacttaggaggtgatagaaaattttacaacacttctaacatgttaagaccaaatcatttcagtctatgttggattgacaaaatgacccatatataaacttgggcctaggcctttagactttagttagtctagaaga

SEQ ID NO: 1159 - DNA, 1400 bp, Glycine max
  Soy_ogl_2640 Gm08:12709001..12710400 Cluster 4
tgataaagttttctttataaatatttaatacaactatgtaccaaaaacttgaactcaagatttctatttaagaagaaacaacccactccagttgatctatttgacggtattataatgcttttttagaatacccgtcaccatctccttaagagtatttaagaacaatcataaaaaaagtatttaagaacataaaataagttaattttcttaaatactggttcaaaatttataataagtaatgaaattatataaagcacatgtatttaattaatgttatcctatcacttttttcatttagtgtcgaaaaagctatacacgtgcactccatattgaagtcgaaaacgtggcagctcatactctcttagttcataaaccataataaaaacataaaatcaatctgaatctgtttaaataagttatatatatatagagagagagagagagacacacacacacaagaagatgggattgatggccacggcacgcgaattctccacggagtgataggtggctaagaatccttagccattaaggcaaacactgactttgacaaagccagagaaactatgacaataaataataaattaaaatttaaaattctgtttcttctacgttctctccttttattttttctgtctttatttattttccatcttctagtagattcctagtccctctttgtcttctttgaaatatacaaattatattatactatttccctaagcaaacaccaacacggcttccgaacaataaagtaaagcaaattaaggattggatttgtcatttctattttttttttcgattaaagtctaagttcccacgtttcttgctcaattgcctccatgatatataccaaatatattttgatgttttgcatttaatatgcgagaatcaggttatgtcaacaatatttaaaagaaatttgacaatatataattttttaaaggatttttcaatatgtaattagtagtttagaatgagtggagtaaatgaattttaatcattatattatttatgtatagttaagattaaactaagatttttcttttacaattgtgtgatctttgaattattttttgcatatattttaatgttcaacatttaactctcttatctgtaccacggttattctctctgcatgcacacatcatattattaacaaaaagaaaatataaaaaattaatgattccgtaaaaaaagaaaaataattgatgaattatataatttcgcatacatgaatatttcttttgtcactacgtatattctttattaagaaagttgaagtaggcatgcaatcaatacactcttttcggttattttttttttttcttatatatgttttacatcagattgaattttgttttgaatatgttttattttgagttcataatatattaaaa

SEQ ID NO: 1160 - DNA, 1300 bp, Glycine max
  Soy_ogl_1929 Gm06:13779401..13780700 Cluster 4
ggtataaagaattgatatgagattcaaagaggatgaatgtcaaaacgaacatattcacttgcaagttggtggtttcattaaaatgcaaactcttataatacctgcagttgacttaatttgccacctctcccacgatagcttagaagaacacgtacaacacttagcacgttagtattgatggatatataaatcgatggtccctcttaatattttaagaacatataaacttttttttattctctttccctggctagtgtcacagttttggtatgacatagtgaaggacggagaagtaataatgcacgagagtaccgatgacatttaattcgtgataacgaagaatatgtatgtcatcatcatatatataacgataaactattttattttatgtgacattgtgatctagataatggtggctataaatagggggttccgtcattcggtgttttacattataaaggttgagaacttgagatagagttaagtgaaagagagatctatatgtagatgacgagtcatgtcggtagcttaaccacaattcctcgcacattaaaacttaagcaatactttaggacattaaaaatgtttcttaatcagtatctttaaaaagttcgttaataaaaccattccagaaactaagaactgcattcaatagcttctgataaagaaactgagaaactgtaaaagtgtccgtttagcttattcatcatattcatatgaataatatgatatgggaagagggtaggaaagtctggcatgcatatgcatgtaagaagagataatcaacgaactttgagagtaacatgcctggttattgactattggatgactcacaccttatatataacatttcacatactcaatttcttgataagtaattattttttaaattccgacaatcagttttaatcgcttttatgattaataattgttcccataaattaacatcggattttttaatatattttattctcactcacatgctttttaaaaatttatcaaaaagtcattcatctcataattacttaaaattaaatatatttaattaattgtgaaattcttaaataataaataaaaatgcattttattgatataaataatactaattaattatacaatcttatatcaatacgacctgtctagatctctgtcaatattattcacccgggatgttacaatgagcatgatttgcaaaaccctcagcaaacttgttaatttgcttctctaaataggtgcaacagacatatgcattacgtaccaattaattggatcggcttgatgatttcattcaaagagaggc

SEQ ID NO: 1161 - DNA, 1238 bp, Glycine max
  Soy_ogl_6658 Gm20:607767..609004 Cluster 4
gaaaattttattttaccaaaaataccctattttatcccgaaagcaaataaccaattcaattgctcaaaagaaaatcttgactttggcggcaggtatcgcattttatttcatctaacttcaacttcgctagaaatctcaattttgttggccctatttggaatcaaaaccatatgttgggccctaaactattctaatgatggctttccaagaaacatatatataggccctagaaaattggttctattacgtgtcttccttctatatattttcaaggaatagataaatgattaccctcgcactgtccatcccttcttttttagggctgtacaaagtacagagtaaaagaaattaaactaattaaattaattggtttgatttgattattattttttaaatcattttgaaccaaattaacctaattaaaaatattagttcaaattgggttaattatttctgcttatatatacgttgagatttttttagtcaccataatgatgcgtagtaatgtttatcaataaattactattttttcagagtcttgtatatttttcattcataaggctcgtatttaagattttatttttgtgaagaccaaatccaacataacttgaatcaataacttatttctaaatttcctcaagcaattattattttaaaaagtattatatgtatgatgcatgcatacatgagaataaaaaaggtggttttaatgttttaaaaatcattgatgttatcgtctaagggtaaggtattaaataatagagatcgagtaatttttcaataacaaaaagtgcaaattgacactaaattcaaaatgttattatttctcaaaaaattgcttaaaatgtgggggaaaagcataaattctttttttttttcgtcgaatgtatgattatgatgattggtacatccaatattaaaagtatgttcacacagaaaaagacgcgttttggattaattggaaagcaaacctaatgtatatgtattaaataaagattcttacgtgatatccactcatatttaagcatgagaataatctattcttatgttgtaaatgtaatgatttacatttgaactagatttttatatatttttctcaaatacgattgtttaaatttaataattctaagtttaaaattttgatattaattagttaatatgaaaatgatattcctcagataaattagtttattaattatgtaatttttattccaatttaaaaatatttattctttaat

SEQ ID NO: 1162 - DNA, 1600 bp, Glycine max
  Soy_ogl_6669 Gm20:1230301..1231900 Cluster 4
tgtcactaaaccaaactattgacaagttgtttgctatttttcattttcatttcacacctaaccaattacatattatacatttaaatacaataaagtaacttatatttgattatatgttagatatagaaacatatagaaattattgatgagctttcactcacactcttaataggactgatcaccgacattgtattccctgtgactaataattcgtttaccggtacaatctattactcacgattggtcttaataattagctattaaaataattatgattattttttaatacctttttacattttttttgtacttcgttatagtggttaataatttatattgactaattgtctaaaaatacatttatattgactaattaacaactagtttttctgagttataaggttttcttatgtgttttcaatttattatttaaatattaattagctactaatatatttgaaaaataagcgtaactggatatgttctaaattagtatgcaattatgttaaatatttattaaattttttttatcacttataatacttctatcatgttcaagtaaattgtctctagtaaaaatttcttatatgattcatacaaaaaaaaggaagaaaaaacagctaaaaagagaaacagagtcatataaataagtatagaaaagtgtttttaccaaaaataaaaagtgtagaaaagtgtatcagtgtataaaaatacaagactgcaattataattttctataattgcttaagtggcattattcagacaaatcccactaccctttatagatcactaacgacattcattaaaaaagaacaaataagcttaaaggcaacgagtttgtcagtttaacctcatttgtttgcaacactctgttgaggactagcttgagaagacatcacttaatattaggtgtgattgaaactggtgcacctatgttcaagggtgtaattatttagggcgttgtatggcatgcatcaaagtgtatatggagtagtttattttttgcttgtcttttttgagtggaggtaaaaaaaactaactgttcccacatagtaacaaagaattacaggcttggtaaatatgagatttaggagaaacattgcacttattttctcttgaatgatgcatgtgtcgcatatcatcgttgatatataagagttgaccttgcaatagttaacgttacaaaacaactaactatttatttgctatttttataaatattaatttttgttagttttgttaaaaatgtcggtaaaaagatttgaatccgtaatctttttcctcctcttatatcttaagctttattttattttataaccattaggtcaataagtgctcatgatagtagacctattgcgaatgattatgcagtgttaaggttatgaacagtaagatctaataccaagttcaaagttgctcacttgctcttaacccttcatgtgattttttaaaattaaattttaatttcatatataattatacagtttaaatttaattttctcattcttatataaaatacatcctctggtggtcagatatgtatgttggtaagaaggatctacagtatacaaatgttaacaaatcaaagcagaatgtgttt

SEQ ID NO: 1163 - DNA, 1095 bp, Glycine max
  Soy_ogl_4375 Gm13:30987706..30988800 Cluster 4
gcaaagaatgcttggttgatacgaattaataatgaagaaaggtgtctgcatgtgataaattatatgttttcttttagtttaatagatctggaattctggatcttgtactgtgttacatattcctgagaatctaagataaatagaccatggatacactcatgttaaaataagctgcgcgcctccttaatactagctaatcgtagaaagatattagtactactttttaattacatcatctatcattttttttctatttttcttcttcatccacaccaatccacctcattcagaattggacattaatcatataataatatatgcatagaagtgatcattaaagcaacgcccaaagaaaatgccttatgtcccaacatggtatctgctgcatgctggccaattgattttcaacaattaagtttctaattaatcaaattcatccaatatttaaagttatattttattgaagcattcttgaaattatactacagtaattattaaattttggtcgagttttgtcttgcgggtatgtcatgtatcactttatagttttaatgcatatttggtatgcagttaaaattattgtgatacctattttaacataatttaattaataaaattatttgatttaataaaaataagaatcttgattctttgatatgtaataaaattaattatttttgtctcaaaaatatttttttactaaattttcaaatatatttttagatgattagttgtgatcgatgataaaggaggaaagtctatggttcatccttaactttgtcggaagataaatagatgtgcatgattttgttttgttaatgttattgaaagttaaatggatagcatggatacctgtaaagctcacatgtaaggaattagctgttgctactatggattgttcttattctttttataaaagataatattatctaattaagtattcaataatcggactgcttttatacaaaaattaccctaataaatattaaaaattaaattttaccggaataattctcatcaaaatgtaaaaaaaataaaaattatgtgattattttaataatttacatgaatttaattaagtaaaacttaatcttg

SEQ ID NO: 1164 - DNA, 1500 bp, Glycine max
  Soy_ogl_5404 Gm16:32017801..32019300 Cluster 4
ctttccacagggaaagaaccaagagctttccttctaaatttggctgacaaacctcgaatgatgaatgaacttaatctgactatacctaagaaagtttcttatgacacgagtacccaatctataagctcaatgaataatatcaaattggattctgtttgcagtccaacttgtccaacacaataaaatgaaataagaatacgaaagcaaaaaaaaaaaaaagagaggcaaaaatcatggaaaaattaaagagagacacaagagatggagagagtggggaaaatatgcacaggaaaaaggatccacattctaatattttttatctctttttttaatcaaatttttatcagtttttttatgaatttaaatctaatttaatttcaaaaattagctataaacgtgagagttgttcacttgtttatatacattgttttgttatatgttgaagatacacttcttatacttctaaaaaatgaagtttataaaattgaaccactttaaaaatattttaacgacttaatgtactaattattaaaataaactctaatatgattcattagaactaatatcaaaatcatcttctcatatcaaaaaaaataaataaattgcattatattagaattttgagttaaactctaactcaattccaaaaatttaattgtatttaaactttataaaatctattcaaggatttatgttctccaatatgatatttattaagaaattagaataaaaatgacatgcaatgtgctccttaaaaatttacaaagtactcaatattttaatgtattttttagcaaatcattattgttgtgaaacagcaacataaaattcaggacccacattaccctaggcagcctatgtggtccccactatattttatcttgaggacccacgttaacctatctatgcttaaacagtgaatacgtcatggccaatatattaattaccgtatgattattggcagtgaaaaatagtaggtactagtgactagtgactagtgagtacttcccagataataaaatataaatgattaatgattcgtcaacaacaacaatgagtcacttttccacgtgtgctaaagacagacacgtaagcccatgggtccccctctcttacgaagttaactgaaaagactagacacgtatgcttgtgggccccatcttcaattatgaaggaaagcagaaagtttatataggcatggcccacattagtgggttacatcttggggagagagaccagtattttcgtcggtcgaaagcgaaatatctcattaatatgactagtgcacgaacaaaatatatttataaattttcttttcaatatattaatattaattaaataaaacttatttgaaattatttaactacttttttaattttacaccaagttttagatttttctcatagcaaaaaatattacaacattaccaataaattattaatttgagtcatttaagattataaataaataaataaaattaaaaaatctcactaaaaataa

SEQ ID NO: 1165 - DNA, 1200 bp, Glycine max
  Soy_ogl_5139 Gm15:47495001..47496200 Cluster 4
tagttgtctaaacgtgtcaaatataaagctgtgaacaatatatggaactcaaaaagaattatttgaacataataaattggcatgtcaaaagttacctctaaatgcagcaatgtaccatgaaattaaaacaagaaccactgcagtaaacaagaaatattgcatcatttaacaatattgaagggtaatctcagttacaaatccattccattgaatgaaatatctcatcattaaatcgctaaaaatatttaagctacaatacttacagaatgaggagctttgttctaaataagatgtgaattcaggattgaaccaacaactttgcttgatggatcagtgaataatatccaagaaacaacctacataacatagaaggcactcagaaaaatagaaaagtatgtttaaaaaaaggtaaccaacttgatgagttagccaaatatgtagcatagcaagtttctcaatcaattcactatgaattaactaataataattacatagtaagttcttttattttttattccctaaacaagcatctagtaagtattaagaatatttagtgctacatatttggctaactcatcaaactgttttgaaataaaatgggataaaggaaagttataacttggttcttgatacaggctctgattcgtgtaggaaagaaagacaagtaggttctattttttattccctaaacaagcaaatgctgtactaggactaaatttttcatcatctaaatgtcaacaatttttattttaattttaatttttaggatcatcttgtacaattttttgtttgttagggatagatacaaataaacaagttgtgactattcctctgtctaggctttgagggcacgatttcgtgaaaactaatatgccccttttgatttctaagacatgcaaatggggagttaactttttttcttttttcttttagggaatattagcaatattcatatagtcataggccacttgtatgtttatggagctaagagcgcaagccagtccatcgaaaaagtttccaagatttctaaagatataatataaaaatgatattttaactccgtgatggtagatagtttaagcatcggtggtccaatctttgagttaggtaatgagttgttttcaaagaatcccatgcacttgatgcatatatacaagagaaggcttaattaggttatagctagacttcgatctgcacaaa

SEQ ID NO: 1166 - DNA, 1993 bp, Glycine max
  Soy_ogl_1112 Gm03:46211408..46213400 Cluster 5
aacctatatttgaagggcattgtactctttttttatttatttgatttgatttgttcggatttggagcttctgatataggtccactgaattacgtagagctttcccttcttgtcatagcaatcaattattgtttgttgaatgttgacggttggattgatactttctaaatgctagtagctccctttataaaggctaccagtgcttgcaaaatactccctctccaatgttcacggtgcggaggtgccaaccccagtttataattttacatcttattaaatatctttttctaatgattttgtaatttttaataaattttttttttacaaacatctaatatgttactcccttggtttcaatttgtatgacactttagagaaaaaaatcatttcgaaatatgtcgttttaaaaatttaatgttgcattaagtatttttttctaaaatgatccttaaccaatattactccatgcattactgatatttttctcaatttttagaatctatcttttcattttaggaatcaagtaagcttcaatcccgctttattcaagtttattgtctaaatttagtgaagtttattgggagtacatgtataacaaactaaatcgacgaccaacaaggtttaaagtactaaagaagaaagtgtgcaacatgaacatttattatgagaatctgtgacacttaatgagagtattgtgcagtagtatgagtagttattagaaagataaataatatattaagaaattgtctaatattttctatgaaattcaaaaaattaattatattctttaatacatgtatcataatcttaaaatcatataaactagaataggggagtatatatcatacatttaaaaagaaaaaaaaatataaatatgataagatttacgatgtaataggaaaaataaatagaaaaaaatgaaaaatattgatgggatgattaaaataaaaggtttttttttgtctatcattacttttttaataaattttacccaacacttaaaatgtattttaaaagaaatgttttaaaaaatatgtcattaacacttaattatacaataattttaaaacatgcgtaaaaactaatcatatgaattaatagtaattagtagttagtagtagtttaagtataaatcaaaacgaatgcaggtgatgtcatttcattatattccatatgaagaagaaaacaagtttcccttaaatgtgacacgaatgtttaaccaaaataaaaaataaaaaaatgttgcatagtttgctcctacaagataaggtgtagtttcaattttcaaacacgcacctcaaggcttaaaagggactacttcatcttgttgactttaaatacaggcctttaaataccaattaatcattattgcatagtgtaagctttccaaatgaaactttaattttaattgaaaagtaacatttaaaaatttaagaaactatcctaaatctatggcaactatactaaattttgaacatattttaaaagttattacaactttctttggcaattattaactgttgacagttgaacggatccttttcaaataaagaaatacttaatggtacgaataaattaggcatgaatttgacaaaaacagtttatgtcttatgataacatatatagcatgatatccgtcaaattcaattttatttcacatttttaatttaaatttaaatttattcaaccaaatgtaattatgtaaacacgtttttttcatgcatagttagtacgtactggtgctctttcaaatatcatatcgtgtacttaatagttaatatgagtaatgatacttatactccttcgttttaaatattctataatttctcttttatttattattattatttttttagcatcacaaattttataataattatattttttttttctctttcttactatgcgtataataacacgtgtgatattcatttatctttctccttaaatacgactatattcacactgtttagcggctggtggtcttatgaata

SEQ ID NO: 1167 - DNA, 1788 bp, Glycine max
  Soy_ogl_3981 Gm12:2788501..2790288 Cluster 5
ctattttttaggaagcttccgtcctgaaaatgttaaatcgagagaacaaaaaataatgcgtacgaataataaaataaaaaataagataaatgtaaaattaaaaaggtagtaaacaaaatagaattgcttgaaaaataatgtattacctggtgacgtgatcacatggtccaaaattcaaaaatgtggtttcagtgagatgataaaaatagaccagaaacttttgaattaaaatatagtgtagaatgggtgagatttacaagaaattcacacaattttttctttatttccttttcctctcctcaaccaaccataacataaaatatgagttttaagtgattaaattggtcaattattttttaaaataataggtagcctatttagtgggaagaaaaaataataaaataattcttataaaaattatctcaagtaaagaaattcatgaatagagttgggttgaatttaatcaaacttgttatcggatccgatcaaaataattttgattgaattacattggatttgtatttttttttatcaaatctgaaatgaatggaccaatcaatagtgagttgatttgggtttggacaatagatataaaaaaagtaaaacttattttacgttttaatagaaaatcttagattttcaaatgttagtttgatataactttcaaatatttatgttgtatatgcattttgatttttatttattttttactttcaaatagttatgctatagacacaactttatatgcaactatggcattccgaaaaatgttcacattttggtttttctaaaatgttaaatgtctttgacgtttggacatacacaaactcttttactaaaagagacgttcatttttacactaaaatgactttactatatggttaacttaaaacaagtaatgccaactcgtgtaatggttgtgacttgcgacggacactcgtttgtgtagtagggttttatgtgtatattcgcatgtggtcaatttttgtctcaatcgtaatccaaaaacaaaaaaaggtagagggaatcgaaagagaatagtgtgtagtgtctcaaatctcaatcaactagaaaagcccactatatatagagcttttgattagaacgtgggagaaagagagataaaataatttaacaagcgaacaagttaatgtataaacaagtgaaatgaagttattataggccatattggactcttgccttttgaaatactgccaaatacaataataagtgataagggttagaaatacactttctcatttaaatatgatatttttaattgattaagaattataaaataaaaaaataataattaaatataccatgagatcgataaaattttatatttttaataaaatttaactaaaaaaaagaagagtgctagtaatactttcttttgaatattctttatgattaattagaatttattgaaaattaaaaattttgatagatttttttatctcaattaatatttttctcttctgatttttttaataaattataatataaaaaatagtgtcaacgagactccacaataaaaaaatatacttaaaacagcgtgaaagatggtgtccagtatttcaacggctaaatttctagtatttctcattattacattctaaattgtttggtaattctttactaataatgatgttgtccaaaacttaatggtcatcgtgttgttcttgaaacaattagttaacacttaacacgtgctcgtaacataataacgttgttagttttgtcccctcgacattactttttaatttcacgttattctattatgtc

SEQ ID NO: 1168 - DNA, 1345 bp, Glycine max
  Soy_ogl_6293 Gm18:60107215..60108559 Cluster 5
atgattaaactaaaattcaaaaaaaaaatagaagaggaaaatagtgattaagtaaaaaaagaagctaattgctcgtaaaaggtgttatgtgacatataattatgtgtgatatgctaagtgtcatcaagattaaatttatcaaacaagttagtctcttttaacatgataaatcaaagttagagtttttattgaagtagtatctacttagcaatcaattatatttaaaataagattgtgtcttaaaaaatgagttattaccttaaataccagatcaagaaaaataatgaagaagagaatattttatcaggaaaatgtcacgtgacaaaatctttctttacaacaacaagaatacttaatgttgatataaaataattgataatttataaataaagatagaaaacacatatgaataagacgtgcaaggggagtcaaagcaaaacacagaagaagcaagatataatattggatgtaattagcctaattcattaaaactaatccaattatcataattttaaaaaatatgttttagaggttacttaaaataatcttaattaccttaattaatatatatcggtcataattgtctttatttaaatatatactattgtaattatctttactataattatgtatttttatgaattaaaaaataaattaacatattttagtggtacttttgcaagaaaagagtcgatgtgatattctcacttgacatctaccaacttgacaaaatcctcttttactatatatagtttttagtcgttaataaataaatactcattgttattaccttagttgtcgtaattatgtattattatgaattaaaaaataaatgtaacgaaacttattttatatatataaattgatgatttataattcatatgcattgttctatgaattttggtttgagacaagctctacgaaatcatgtttaaatagtttattttacattcagagaactgctttttttttttttacaggaaatattcagagaacttctaattaatcaaaaacatttttaatttcatctatctagtctatacaaacatggtaataaagattcataattaataaataactgatctctgaactcgttacttaacctccccttaattatgttttacgttattttgacatgcctattgccgggcgtacgttttcataatgtgtttccaaataatatctatacagtttcgcaacatttaaatatcgattcttttatagtttctttattttaaataattaattgatctttattttaaatatctattcttctagtttcccaaacaaatttgaaagataagttatgaaaagagaaattaattaataatagattaatggtcct

SEQ ID NO: 1169 - DNA, 1347 bp, Glycine max
  Soy_ogl_6268 Gm18:59187901..59189247 Cluster 5
ttttaatttttcctttgccttgagttctaatgtcggatatgagattgaagccaccaatgttggatcaagtgtacctcttatatatatagttcatatataattgtaatggatcagtgattgaagctggtgtgctaaggctacttgtggtggagttctaccacatgataattgctttgctgataagttgggaattgtttttatcttggatagctaaattatcgtgaattttatttagaatagtggttttagtaatatactattgttgtatattctgtttctccaatagtagtgagccattcgaataatggttgctgtcacacactcgtccttattataatttggtgaaggtcattcatatatttattagtaccagattatagatcaggtactttgaattaatgtcttgtgaaattaaagcgaactaggttgagatggtttagcaaaatatgtgggttgaatcttcagtttacttttcgtgttttaaaataatgctccctcttttcttttaaaaaccttaaataagggctagctgaccatacttgcataagctttttctagagatttctaagtctctcaataaagattcattcaaaaaaaaaaaatagcattcttgtcaactaattataacacaatatcccatcaatgtattttttaaatgagtcaaagattatttgattagttgagaagaatgctgataacatatttttttaaaaatacttttaacatatatttttttatattatcagctaaaatttatttacaactaaaaaattatatgagatggtcaataaataaatcttatgatgtatataattttatgatttctaaggattttaaataataaaaaataatgtattcaaagtagtatattaaaaaaatgttactaacattagctaattaattttttttttaaaaatagctaattaaaaaaaaatctaattagtattaacgggggggattatatgatttggttttgagaaaattatgtgctccttattttctctatcgttgctttcaaagtgacgtgacgggtaattattaataaaggcaatcagagactaactggtccatttaattagtttctatccattcaccaccaacttaaataaacagttatgtataaaaaaggaaaaaaaaaggcagcttttttcactgtatttatctaaatttctttttgttaagaaaaatgtttttttacttattttagaaaacaaatcctatgtatttcttaagaaagaacttatataaaaatatttatttaaattttttaaaaaaattaaataaatccaccctaaatcagataacttaaaattgaatcatcatgaaattaattaagcgccacaccaa

SEQ ID NO: 1170 - DNA, 1200 bp, Glycine max
  Soy_ogl_6572 Gm19:44766301..44767500 Cluster 5
aaaaaatactaataataggatgaaaataagataaacaagtatgagaataagatgaacgtttatcatttttttatttcttattaatcatcttaattcttaagtgatattttattgtaaaaatatatatttattctaaaagtatatttttggaactatgaataatagtttctaagataattttttggaaaacaaaagaggtgtacttctttaaataaaatggtataattgagaggtagaaaggggtaagggagtgtaaagggattttctttctgcattcattattttgccaatacacctaacagtgagaggaaaaaaaaatcaaaaatagccttacatataatcacatatggattgataatccatattcataaagacaatgttaaaattataaagaaaaatgactcaggaaaaaaatctctggtgtaaaactagattcacaaaccaaagcccaaatgcatcaagctcaagcccgaatgaatacaaagctcggaactaacgaaacgaagttcaacacgacaaaattcaacattgtattgtttggatgaaaataaaattaagcaaaagctccttggaatcttctggcattaatttgtccgtaaagctaatctgaaactaatctgcaacccatatccatttataaaagtttctcaaaaggctttcaaagttagcccattatcaattggacaaactcagcagattgaatcttgaaataagttacttttaatttggagcatataataagaatgttaggagtatttggtatttggtaacaaatttcaaaccccacgcttttgagagtgttgtgcattgaactaccatttctgcttatgctaaaactaatgctaaattctaatggaatgtttccttcaacaaaaagaatgttcctaataattacagttttaatagttgcattaaattcttctatatttcattttatcttctttttaggtgctattgttgtatgctactcactcgttatacctgcttaatttagtgacatacatgcttatgttatctattaaattattcactaaatttaagaaatattagtataagtataaaatgaaattttaataaaaaaggttggatactatataaataaatatattaacttaagttttaaggttttgatttaaggtgagatgacagttttatttatgtgattacttatggtttataatttttttaaatatttatccc

SEQ ID NO: 1171 - DNA, 1100 bp, Glycine max
  Soy_ogl_4114 Gm12:37245201..37246300 Cluster 5
tagtacctataaagacaatctaatcctcaaattagagatgtataggtatgagatatatatcaagagtttgttagaattgaatgagttatatgaaatcctagtgattccttttataacgatgaaattaggtccataagcataattttcctagctaattatataacgttaataatttagataagattgaatctaatcttatcttatttgataattatgcgcctaatttataggtaatcttatcttgatctttctctattttgaagatggccgacttaacttctctcttgacaagtctcatggaggaagagcaagaaatttacttgaccgaccaccaaatacaaagatttggagtctgagtaatacaaaaggaaattgtatttccaacaacaataaagccctcgcatgcaatgggaggttgtatttcttctcctaatgaaaaaaaaaaacttatttttaaagtgacatcacgaagtgttgaagtcttttttccctattgacattaatcataaattttcacacatatccatacatcattttttttatcagcttggcatagatacaccattaatatcagtttggatagattttcctaattaaaatagattaagttcataaaatttatttatttaaaaggatgtctaaattatttaaattttaatatacataattataaatttaagaatttaattaaaatatactaatagtataaacaatacactgacattctattataaatttccgtatacaataatattgctaagttttgttataattattaatttaaaaatttatatttaaaaataattccaaattaattgacaatataaaaatatttacattaatattatatcaaaaataaacttttaagataataacagaagatttaataattaaatttattaaacctattttgtaaagataaatgttaaagtataaatatttttattggaaggcaaaacttgcattgctcatgcaataaatatttttttttagtttcttaattacaatgcgtagttaaaaagacttttttgtaaaatgatattgttgaggggtcatttagaatgtgagtaaaataattaagaagctgtttattaggtctg

SEQ ID NO: 1172 - DNA, 1234 bp, Glycine max
  Soy_ogl_678 Gm02:45355954..45357187 Cluster 5
attataagtcatttctcacgataaaaattgttctcattttttcgggttctctctatataatattcaataattataaattatttataataaccttttgaataagttcatacataaattaattgatgcgaaattgtttaagtttaacaagtaatcttatcatttgagtaacacatataattacgttagatacttaaaaggaatagtttaacgctcataataatttcattcgatttgaataaaattatttacgaggaaagaataaaaaaaagtgtttatttagaaaggtaatagaaactatgtctaatgtgaatctatcattaactttctttcacatttagagtctttttggattaatttctttaaaaatacttttatgagaacaaaataaaaataaaaaaatgaaatgagtatgaacataattgggatgccaatcccttctcttctcttaagttcacctccctttctttgcttaaaaaaattaatttgtaaaatttttcacataattttcaatagatgatttttaacttatgtataaattaaatattttagcttatggaaaaattaatttatttttattaaataattttctttcattttgtttaattgatgttcaattataaaaagttaacccctcagaaaaagaaaaaaatgtccaattataaaatatgtcggaaatgattataaataatatttttattttatttgtttaaatgatgtcctataaaggcataattatttgacattctcctttaatatctaaaatattaagaatatttaagactaattaaggtgatgttttgtactaaaaaacttaagattcttgaaaaagttgaatgggattttttaaaattgagaagaacacactagaatctgatccgaaagaggtcgcagaacaaagcttttattgaacgttgtctagccttgccattgaaaacaacggatctcaaaattgcaatttgaaatcaggaattgtaatcaaaatctcaaattgccgtaacaccaaacaacaacttgaagcccatagaaagggcgatgaattgaacttcagaaaatgcagagaacgcacataagtgtcaatttgagtggattttttttaagaaaatgaaaaagaaagtgaacgatttgatccaatactgagagaaagatgcaaaaaaacaaaaaatagtatgaaagacgaaacaacacaggatctgcacaatagattttcttaagaaaaaaaaatagaaaatgaaga

SEQ ID NO: 1173 - DNA, 1122 bp, Glycine max
  Soy_ogl_5557 Gm17:6991101..6992222 Cluster 5
tggggagttgatactataaattaatgtgctttgtagtgggagctggcaactgatgtgatacgagggtgggtagtagatgtttttggaagttatagcttatttatacacaaaatgctttcgtgtatctaaactaacctctgggctttttgtcttctgtattgctaccctgttgatttaggtacctctggtaccatttattcatgcattttgttttgccaattaaaaaaaaaaaattgacttgctatatgttcttcttcacgaaaatggaatcaaacaaaattcgaaaaagataatcacaaaaaatatacataaaacattgtaaaacaacaaaagcaaaatgacttataaaaaggtgtttgcgatctttaaatggaaaaggataccacatcaacaaatgatgtttacctccatagaataatttctcttctgaaacgccatttttttttaatccaaataatacaaataaattaattattcatccaaataatatattcaaaaaattatttacatatgaacgatataaaatattattcaaggttagaacttaatttcccggaaatcgatttctcacattctgcttttatttttgtttccttacttaaaaaatgaattttccaaaaaccgatttcttaagtactttttgttttttttatacgtttagtcctaggaatcgatttctaaatgttaattttttttaattgttttaaaattctttttgcatttttatttctttttgtattattagttgtctatatttatgttttgtttaaactgaaaataatattattttacatatgttgttgttaattttgtgtgtgcatattttatgttttatcattttttgaagagtttaaatcttttgtattttcatttatttgattattaaaatacataattaatcaataacttaattgaaattaaaaaatatttaaccaacaagttaaattgaactaaaacatttaaattaaaaaatacatataaaattacaagaaaaaatatttaaatttaaaataatagaacaattttttttaaatataaacaatatgacctaaaattaataatttaacataaacttaacgttgttgcgtacataatttttttgaatatagaattaacaactgt

SEQ ID NO: 1174 - DNA, 1767 bp, Glycine max
  Soy_ogl_5497 Gm17:3953031..3954797 Cluster 5
gcgaaaaaatcatagattaagagaaaggtcaaattatcaaactcgaaagtaaataaaaataataatatcactaaaatgaatacaattttatgccgagttcattaaatatttaagttcatttttattagttatattaaaaaattagttacaataaaaaaaattatatttctgaatttttatataaaaaaaacattagtgttattttccttaacatggttggaaggcatgaaagatagaataagtctgtcaaaaaaaaaaaaacggaagaataagaatagacgaaaagcacttacattgtctctccttctgtattatagtttttaggtgaatatcattccctcgtaatttgatatcacttaaaaatgtgaggaaatgaaacatttttacgagactcctgtttttttcaattctttcaaattgaaccgaaaactcacataaaagttatttttataaaaagaataaaatattttattatgacatatttcactttatacatataactttttttccttttgatcttctttacccacggtttgtttatagtaagagggagaaacgtacaaaaagtgtttcaacacatggaaagagttaagactctatttgttttcaacaaaagaagagagaacaaaatatgactatccacgaaaaagaaagaaaaatcaccttttcaccattcgtttgagtataaattaatagtaaatttcgtacaaaatatatggggtccaccaaattaagtttcttggcaaaattgagtggatttgtaaagaaagaatacataaattattaagtttacaaaataaacctcttgtgggtaacaagcagagagagagaccccatgtcactttcaaaatcgggaggcttgatgttattcaattgccatgaaagagagctgaagcctgaaagttgtcaaaattttccgaacatcgttcatatcttttttcacaaatttagcatgggttccaactaggttaaaatagacatcatttaacacgcatcttaatttttcttttcgcttaactattaatttggtcagatttttaaaaggttgattttgattgtcaagtttttaaaaataaattaatttttttttcaaattattttaaataattcaatttgatatttatgttcttcaaaatataaggatcaaattgatttatttttaaaaatttgagaactaaattaaatatttaaaagatttatagaacaaattgattcattttttaaaatcttataatcaaaataaatcttttaaaaattttgagaccaaattaaataatttaaaaaccaaattaataattaagcctattatttttttatatcataataaaccatattctgtcatcccctcccctcgcgctataattatggcaccaataacacagttgttttttttaggattaaatacatttttttagtcattacaatttaactttttcttttctttttatcctttcaattttttaaattcttttagtcattctaaattatatttattttatttttcgtaattaaaagtaatttaaatgatatttttctcataattcaagcacttgaatttaaatattctatatctttttcactgtgtttcatctaaatcaaagaatcttaaattttatgtttttgtctataaatccttatttttttttattatctttcaactattttcattcattttttaatcaaaagaaaactatatcatttcattccagattgaaagttcaataaaggagaaataaaaaaaagggggctagaatacaatcgtgacac

SEQ ID NO: 1175 - DNA, 1600 bp, Glycine max
  Soy_ogl_5797 Gm17:39693301..39694900 Cluster 5
ttattatgttttacaataatgaattaactacattaaaagtcctactaatgatttataattaatagattatataaatttcttttaaattgataatacataactattaatatttttttaggacgattcatcaatataataagggaagacttgctcccacgtaaagttgagaaaatattaccatcttaatgagattgaattcatgttttgactttcttagagtgaaaatcttaccaagtaagccaactctatttacatgaaagttacatgaatatttttatgttatgagttaatatttagcaagtcagagattagaggtatctatcggaccaaactcctaatttggcatattcatctataaatatcagactgttgaaaaaaaatctacaaatataagagctggaagtaagtgaaaagtcattaatattgaacaatccatttaattattgtataaataaagtggtctcatgttgattattatgttatatcacaactcgtgtaaaaagtttgtgtaaaattaagtgatagttatataattttagaagtttgagtctgaaatttataatttttaattcctggcactatataccaaattatatcaactttatctctacaattcaatttttaaaatattctttataattttagataaaaatatatatgcttagtcttgtatggttattcaaagtctcaaatctcaatttcatttttttatcactctctttatttttaaatattctttataaattgttttataactttcttttgttaatgtgaattttaattttttaacaagtattttagcattgcaacacacaataaattatataattataacttttaataaataaatactttttaaatatataaaatattttatttaaaaaatttatcataagtaaatatttgttatcataaaatttatattctagatatggcataaaaaatttatattgtgatataaagttatttttaattattgaaaattttaaaaatactatattcaaatttaatttaaattaaatattaaagtggtggattaaaaaaattaaaaaatatatctaaaaacgttattgtttaaaaaagttccaaaaaaatatcattaaaatataacatttaaaaatattctcattcaaaataactattctatataaacatagaagattgcaacaatatcgggaaaaaaattgcaacattttttgttatcaagattgttaggacaaaatctagatgtaacaccataagtattggcaatgttatctattaacaaaaattgatatttaattttaaaaaactagtgcttatgttatcgacatcaaaacaacaattaatataattgatataacatataattttaattatgaaatagtactaataaatcaaaatcatcttatttaagttttctctattttttaatcacctaacaaaagtattcacaattcaatttaaaataatttagtttttatgaaaagaaaagttaattttatattttaaaaacaaaactaaaactcagaatataaaagactaaattaatagttttattaaaaaataatatatttcccattttattttttaagttaatttgtatatattcactattatt

SEQ ID NO: 1176 - DNA, 1700 bp, Glycine max
  Soy_ogl_783 Gm03:922001..923700 Cluster 5
atagcttgattttttcaatagaaacaatattgcaaatgaattgggaaagatggctgtgaaatgtgtttgatagagcatgaaatgtttagggataaagggatatgttgagacagtagttgaaaagaagatagaattggactccagcataaatacaaatatttttttaaaaaaaaatgttatacttgactatttatttaagtgaattttttatatttttattaattaataacattataaccatgctagtaaaaatgaattattttccttaacttcattctcatttttagtctttttttttgttttcgctttattgctaaagttatatctaatgttttgtgaaagaaatgtaattttttcttgatttaacttttgtaatgtagttattcaacatcatatttatttatttgacagataattataaaattactaatacaattttataaatacagttatagatatttttataaataaaaatcatttttattatattttccaatattacactggatataagaataaaccaaaataattttatttatataaaacatttcttcattgtgtttccataagcatgataagaaaataaaaaatatatatttttatcttaaaagtaaatttatttattacaatgagaacacaaaaactcttttcatcaagcctttttaattaacttaaaacattaaatgaagtatatttaatactttttacactgcagtgggccataacagacagtagacaattcaatggtaataaaaaaattaaaaaaaaaaagacagtagacaattcatactaaagtgttaataacttcatactactaataaactcaaaagaatattgtaatgtattcctcgaattatattttcttatcactttctatatgttgttagtgtaaaaacgtaacatttttttatcaattagaaactatgataatacaattttttatgtaattattgcaaaaattaataaatttataatacatgaaaatttctaattagataataatgtaagaaacttttatatttttagtatatagattattttttccttactaatactcttaatacattttttttctttttcactttcagaattttatttatccgtacattttaaattcaaggcaacatttaactattgttttttttttcaaatttggactgggcctagcccattagaatttatttatagactaaagtttcttgtaaaataaatattacttaaagaaataaattgtaaaacataattttaaaaaactaatactattgatttaaaaataaactattactattataacattatttcttatatgttataaaataatatgtttatataatcaattaaaattgtaatgtcttattgttgttaagaaaaagtaaaaaccatattttatatgtgataaaaacaattcaaataaaaaattgtaatttttaaataaaaacacaaaagaagaaattgatcaattagaaattataataatacaaatttatatgtaattattgtaaaaattaataaatttataatatacgataatttataattatatagcaatgtaaacaacttttatatttttagtacataaattattttttccttattaatactcttaatacttctttgagtagtttttatttgattagatccaaaattttgtattaaattttactcataattttattttataataataacattcaaacata

SEQ ID NO: 1177 - DNA, 1394 bp, Glycine max
  Soy_ogl_1566 Gm05:3067207..3068600 Cluster 5
tacaaaaagacaatggtagcagtacaattttttttcaaaacattaatttttgagaaatcctaacaatacatgtttaatataatcttttaaatatatattttttattatcgtcaaaaacaataaagtttcatttcttatttaatgaatttttatgtgtctttcccctcttcaactaactttttttctacactgttctatgaacttttattgatgccaaaaatttggtatcaatttttaaatcttaatataacaaagtaatatatataacacgtgaaagcttataaacatgatctgaccttagctcagttggtaaagcggaggactgcagtggactagtatccggcaggtcggattcttttataattctttcaatcaattattataatatgaattaatgagacttttttttttttgtgttgcacgttgatacataggcttaattgtatttttatttttaactttttattttttaaccaattttattttcaataaattaaattgatgtattttatctccaacttttaaaaaatttataaattcactcgctgactatttatgtattaataaggataaaagttggggtaaaatttgttaaaaaaaattaaaattcaacaaaaaaatgaaaaagtcggatggaaaatttgccaaaaaataaaagttgaggataaaaatataattatgttatgagtaaaatgacatgagtaaaactgataaatttcttaaaatttaagtttaaaatatgtcaaattaatttgttgggataaaattcattaaaaattaaaagtctaaggataaaaaatgcaattaagttatatacataaaaaaattacaattgaaaaattcatattttaagtttacttgtaaatttttgaaatatgcaatgtttgtttgtcgaaaatttccaaatatgagttgccctccacagtccacacacatattttcggaataattcttgttaaagtcatgttcctttaaataactttttatatattaaattttattaatataatagttaaatatcttgataacacaatggccatgatatttataattatgtaattttaaagcaatatttacgtgtatatttaaaaagtatattgtacattaaattgaatctatttactaaaatatcaaataatttcaaaattttataaaaatttgtagactttgatctactaacttttttttaatttaatgactaaattattaaaatttaatatatacaaagagttattgaaaaagaaaagaacttgttgagagctatccttaaaaaatataaatgatgatttatatatgatgggaggacaatgccattgtctttaaattaaaaactatctgttttagaatatccagcaacaaccactccttgatccaaagagaaatgtaattactaa

SEQ ID NO: 1178 - DNA, 2010 bp, Glycine max
  Soy_ogl_3602 Gm10:47321098..47323107 Cluster 5
ttaaaatataattttcatctcttttttttttaaattgaaatatttcatctttttattttttaaaatcaattattttggttcaacctcaattttaggatattgatggataataaaaaaaatgttaacgactagatcgttgataggacattgtaattttgatttttaattattaatttgattagtagagtacttaatttaataagaatttagttaaaaattaatgattattaaaaagagctcattaaatcatattattaacagtcaattttcacatgtcttgaaaatttgatggttaaaccaaaatctttatttaaaaaaaatagagaatcaaatgtatttactatcctttacaaatgattaaaaatgtatttttatttttatctaaaacaaagctactacgttatttttatttcagttgtacgaaattcttggaatgtgaaactccaaaaagaaaagagaaaaaaaaagtgactgccaagttaatgagatgagatatgagagcaatgatggattcagaattatttttagtgagtcacataaatgtgtatgttatttttacagatgaaaaatattataaacttttataaaataaataattttatggtaaaaaataaaaatacttaagtttttacaagtttgatgggataaaatgggtcaaattaatatcaattttttttatctttaacttttttaccttcttttcataaaaaaaaaatcattttatgggacaactcttattttttataaggataaaaataatataattatttaatatgatcaagtaaaaaaaattacttttgggggaaaattgcttcgtagtcacccctacataagagtgacattggattgtagtaaagaagaaaccttcaaggcttcagtcacactagtttctcattacagtattaattaaagaattaaaaaagaatatatttattgtaaatattataaaaaaatattaaaaaaaatgacaaacaatacaattttacgtatattaataatttttttgtttactttcttaaccaaaaataaactatgggtaccggttaacttgctatttttatttaatagtagcttcagcagaagacttggtgcttggcattcttgttcccaacaaaataaaccttcgttaattcgtttgggttaccctccagacccactgaatatacttttgcaaaaggatagtatgtgtattttttgcttcaaaagtaatttttggaagcttcacactggtaatccgaaaatgctactgtaagtcattctagaaaccagtaatctccaactttctcaaaacaccaaaaaagtcacttatttgagacttttttttaacttgatacggtagtttttcttttaaaaaaagaatctggtgtttcatctatgcagagaaaaaacattataacatggacgtaaaaaaattaattaatgaaataatgagatagtttgtcacatgacaaaagctacctcaaaccaatacatatttttttttaatcgataatttccaaaaaaaagttcataattggtagagataagtcaaagtataagaattttataaactgtatgtctgtatgacaacattaattcaaaatcattaaatacaataattaaaaacagggataaaaatggataataaacacagtattatcctaacctcaaaaattaacacacgggtacttacataaatgactttgtattcattgttttttcatgatcaatataaaataaaaatatggaaacataagtatacaacaatatatgtattgaagttgttatttgtacaagtattacaaaattatacactacaagaaatttgacttgcagtgtcactaaaagataaaaatccgtaagtatatattaattagacatttagcccgtcctttgtgagaggcatataacaatgcttatttgactgtcactatagtctttgattgtaactttaggattttacatgtcaccatagcataaattgtaatttaacgtgtctagctaattcaatgtgtctgtaggtaaaagtag

SEQ ID NO: 1179 - DNA, 1500 bp, Glycine max
  Soy_ogl_3994 Gm12:4495601..4497100 Cluster 5
taccaaataaacagataaatctatattctttcctaaaagtcaagctaatcaactgagttcgttcataatttcgtattcatttcttaattaagtattagaagcaatactatatattgttatatattacattagttttatcttttgaaatcaatgcacattattactgtctctctttttttttgaaattattttttatttcaaccattataaactcaaatattttagttttaatatataattaggaataattgttctaaaacttaaaattatacgtaatctaaattaatatacttcagttaaaataattcaatcgtaaaattaatataatggtataagattttgttatatttaaaatacgaaaaaatgatttatttaaaatgaaaattgtattttaatttttttccgtatacctattatatgtgaaattagtctaagtgggttgagaaatactcgatcatatcggacccataaaaaattcaaataatatttaaactttagaaagaaatacaaaactattaaatcaatttcctcgcatattaatataaaaaagtatttatataatttattttcataacctattttcatctttaattactatgaacgataaaattcttaatatgaaataaatgttaaaaatcttaaaatcacctatatgactgacttaacttgacagttagcagcttacattaacccctttttattttcaaaataagtcagttacttggcgtgaccggtgacccaatctattttttcaatttctcgcccttaataattacaataaaaaaagtatatagtaatgttttaaaagaaaagaaaacaaaatcaaaagacaactagtcaaacttaggacgcacaaaaaaaaaaaaaaaacatatgcattatgcaaaacgcggttctaactgaacaagtcaacaataatattcaaaaaagaaattctaaggtgtattagattaggatttttaaaaacttaaaagatatatttttttataaaaaaatattgtgatatataattaagattttaaagattttttaagatagacaacaaaatcttttgatattaaaacatataaaaatttaattattttttaaaaagaattttgatggtttttcataaaatgagaatgagaccatactgtttcaacaaaggtttagcatagaaaaacataaaattggaattaatataactattaaaaagatttaaaaaattatattaattttatttttttatccaaatctcattattttttatatttttagtaagccttttactaatttttcatctttacggttctctttcactgtaaacctattattgcatctatttaaatatgttattaaatttattatgaaataattataacaattaaaaaatcaaaaaactaatatataattttaaatttattgttcaaatgtaaaggtgaagatgagaagtttgaaaaaaaataagtataaaaagatataaaattagaattaatataattattaaaaaattagattttt

SEQ ID NO: 1180 - DNA, 1397 bp, Glycine max
  Soy_ogl_4618 Gm14:3586490..3587886 Cluster 5
ttagattgatcaattaattgaaagatctcttaaaaaaataatacttataaaaaacacttctttagatgttctaataaaaagaattttttgtttttcgtcactaatgttagtttataatattttttttactctctaacatcaatttcattattattatagtctttttagtgaataatataaaataaaaaatagaatatttttttaataatgattagataaatccttcatatttttagagattgaagacaaaatttacataatttttgggcaaacacattccctaatcttaaaagggtatattttggctcatggttggcctaagtattttagtgacctattaaacatatatattgtggagtattgttaacgatttctatggtttaaagttaataaaatgtaacttaagattaatatctcaacaaatatttcataaacgtactttgttattaattcaaaaacgctaaataaaattagtacaatattttttcatgttaaaagttttttaaaaaatacaattgaaacaaaaatatctatattgaattcatatggcatagtaataactttaatctctatctctatatcgatgtaaatttttttatcgatctctatcttttatacacctatatattcatacatactcacactgttacacatacttatatgtaaaatcaatttgttgataaaaattattaattaaaaaatttctccaaattgaatcgaaaaatcattctttaaatcatataaatataatcatgcacatgagtaatatcatcatttaacataattattcttaaatataatattttaattcttaaagttgattaataatgcaggtgtacccattatcctgagtatttttttaagtacccataaagtattgatagaatttttgtccctattgttaaattatatttatccttgtaccaagtcttagaccacttcgtaacaagtaaaagttctactttaattaaatttgtccatgactacggttgtacttttatttgaatacaagttataaatgtttttgaaaatttcttcactgaaaatatataaaaaaaaattagtagagaagttctaaaaaaaatacttctaatcttgtatttgcttaagcgaccaagtttgtactagaatattttattgtattgtgatttaaataagaaataaaataaaattttcatatgttaatgaaaacatatttaaagccatttgtatttctttttctctttgatccataaactgacgttaatttgtgcacctcctaacataattactggtacatataataaaacagtaaaatttcattttcatactttcttaaagctgatatgaattggtgaatccataaattcaatacaaattgttaatccataagtctcatatgaatgtgatttttattt

SEQ ID NO: 1181 - DNA, 1500 bp, Glycine max
  Soy_ogl_5947 Gm18:5554801..5556300 Cluster 5
ctaaaagagtttttagatctcttattctagcaagaaatacaatacaaaatatcttttaaataggaagttgaaaagaacgaccaacaacgataaatgatgtgattcgtgagacattgttgacaatagatcaacaataataatggaaacaacagaggattagagttgaaacttttttattggaaaatatagtgaattatttttaatgaattcttctttttaatcatttcttttgtcataaaatttgaatctaaaacctttcttacaagaatagatctttatacctacaccatcataatattaggttatgtttcaaaagttatttcaactaattacaattttttttattagttaaaaaattatttgactatttgataaagaatttttttaataatttttaatattttttgaaatgctatttaattgaggtaatgttttttaaactacttttttatattttatttccttttttatctttaaaatatttattaaattttcttattatacccttttaaataaaacatttttattatgtatttttttttactcaatcaccttatacttcaaaaaattgacaaaaacaaatgttccatttaattattttatttctctattattttttgaataattttacattagataatttattttaattattacactaattaacataataaaagtataatatatgcgtaagtgtatttttttatcactttaaattgttttaaatttgattaaaaatattttaagatataatattagattaatagtagaatacataatatgaaaaaaatgtaattgttgaaacaaaaaatgtaaaataaattgatttacctgtaaataaaaattacaagagtttaaaattaattaaaataaataaattatagttctattaaacacttatataatttaataagttaacttaataactttcaactatcaactataaactaacttttctatttctagttaattttttaactagctagtttcaccaaacataattttagtaaaggaaactttgaaaatgaaaataaattaaccactcaaaacaaactaaaaaaagtaaaaaaatatgcttattttgtcaagaaaggttggtctaataaggatggaatctaggtgtctgtgaggactttgttaatgaataatatatataagtacctttataaatactatttgaaccttgagggctgagacattccttgatcccaatgaacttttaaaacccaattgacctacacttctttttttttttttgtaaaaagagagagatgctcattttggttcaaatttcactagacattgattttatgaaatttaatacctaaattgaatgtcttaagtttgacataatttaaatttgaactgatttagtgaccataactaacctaaatttgtaggttcaattagtttgaatttatcaaatttgtaagttgattctacatatccataattggttataagattttctttttatatataaatgatagtagtaaaata

SEQ ID NO: 1182 - DNA, 1822 bp, Glycine max
  Soy_ogl_803 Gm03:2010808..2012629 Cluster 5
ctctacaaacaaatggtttcttaatgattaaactttgcattttctatgttcctttcaaaatgaatttaaatatgaaagagtttataacaatttacacatttttcaaccaattaaattaaatctttttttataaaatggcatattaagttagtgtcattacaataatcttaaaaaaattatacttttcaatatttttaaaaataaagtaattcgtaatttaaaagtataaatattattaaattttcaatagttgtaacttgagaaatatgaaaaaatttaaattttagaattattttataaatgagttcaattttgatacatcattgatgttttcttggtaagtggttgatgtaaaaaatgtaagagtgttcaaaatcaaatcaaatctaaaattaaaaaatgatctaaataattgaaaatcacataaaaatcaatgatcatgagtttttgtatttctcaaaccgtgcaattcagtttgattcgcggtttaacacttgaaaattaaactaaactaaattacaccataaacatccctataaactattgttacaattagtgttttgtgctttgttggatatctactttttaaattttcatggttgaaaacatgcattatgaatgttgttttacttttttattttaagtttatttgttggaacttagaagcaagtattatattttttttacttttaaattgaatgatttattatttaagttgaataattattattcaaatattatttaacttgaaaacaattactattttactttaaattcaattgtttttcatttaaatgttgattgttgaattattattcatattttgtccaattaataaaaaactttttatatatttttttaacacttactaacagaatttttaaacggcaaacaccataaaagatttatttaatttggttcatattttataaataatttgaatcaaactaaattgaatcacacctaattttctcatttgatttggattaattttaagttaaaatcacaccaaacaacacaacccctaaaaatatatacactcaactaatttaaaaaatataagttagaaataatttttaaaatatttaaaacaaaattcaatcatttttaatattatgactataattggatgatgtgtaaaaaatattacactatctttacattttaatttagttctctagcaatattttttaaaaacattttatgaatgaggataggttgtcgacaacgcggaggaggtcacctaatcatcagtaacttaattagtgataaaaattcttttaaagcaagtatgttttaaagtgactacgtaggaaatgatttatttatttatttcctcaaaaaaggaaaggaattattttcaaattaataagctaaacttaatcacacttttaattaaataaaaataatacaccttctttttatataaaataaagtataatatacatgttatgattcccctctttgtaaatttttttcttaactataataaccaatgatacgatgagttttgggattgattcttatcccattgtgcttgaattgactaaattttttatttcattctttttttgtttgttgatgttgagtaactttatatctctttgcaattcaatatcaaataagaatcgtttgtccccctctatatcgtggactagagcacccaatgcaataaaaatatatttctataactcaatcgtcattatactttcaagttaaattttaagtaaaattatctgcatataacataaataacttgtaataaaattattcaagatctccggaaacttttaacaagctagccctgtattagtgatgtaag

SEQ ID NO: 1183 - DNA, 1545 bp, Glycine max
  Soy_ogl_4150 Gm12:38422228..38423772 Cluster 5
attcagtaaaaaaagcaatctatattaattactgtcttattatcttttattacttaaaggaataaacattgatgacaaaattcctcctaaaaattcttaaggtcgtatttgtaattttaatgcattaaaattttcaaaaaaattcaaaataaaattgaatggaaagtaataattatattttaatttatcatttaggattgatttgatttaataaatatgaaaaaataatgcatcatatctctctcttattattaaagctaagaagttttgtagatttttttatacttttttttgcatgtaaatcccgaacataaattcacgtaaattacataacatgcacattgatattattaaagatattattgaagatattattaaatcaatctgtgttaattactgtcttatcctttattacttaaaagaatatacatttgtaacaaaatttccacaaaaatctgaaggtcatattagtaattttaatgcaataaaattgtcacaaatattcaaagtaaaattaaatggaaagtaataattacattttaatttatcatttatgattgatttgatttaataaatataaaaataataatgcattaaaactgtcacaaaaatcatagcacttttagaattttcaaaataaggccttaaatatagacatgcatttaattttaattaaatgtattttttatgaataattatattaaaaataataattaatataaaaattagatgcacaatgattattataagtatataagatttttcaaattttaataaagtaaaccaatataattagaacaaaaaactaatgaaatgatcatcttgatatctaatagagacactttaatttaggagatgataaatattttttttaagttggggaccaaaagtgtatttttattattagatacttagagaaagatagtgaatttgaatgatttcaatcttagtacttgaaagaattaaaaaaaaattaatattctttttacttccaaataaatcattggcattgtcaagaagtaaatttgttgaaaagggagtttggaaaaataaacaaaacttgagataatagatatacttaaagttggaggtttcttgaccatgacgagcaaaaataatttttaagctaaaataaattaacgttttaatgtcattaatttttattaaaaaaatatattattttttattattcttcttaagttttaattttatttttaacaaataaaaaatattactctctcaagcagaatttctcttgtgagtcgcacctgcacatatactagttagttagttcttttaaaaattcagacggcactacataatgttagaaaaaatcctcgatatgcattattatttgtaaaaatatgattagccattggtatgaaatttctcacacaaagggtatatgttaattaaattcgtacaaaaatcaatgaacaatcaaatactctgtccgtttattatagttgtcgtataaaaaattatcctaaaataacaataatttttttaatataacattaattacattttttatttatattcttt

SEQ ID NO: 1184 - DNA, 1300 bp, Glycine max
  Soy_ogl_5809 Gm17:40066901..40068200 Cluster 5
ttttcatggttactgtactctaatgatttaacgtctgatttaatagtataatatttatttaataaaaaataatttggtaattagtataaacattataattttatatatgataccttatattagtacataattctattaataaaggaaataaatatatgttaataaaattgtattatattatttgtatagacttatagtatctatgttgataatttaatttttattaaaaagataatactaataaatacttgacattatttttaattagtaaataatactttcagtaaaattccttcatacgaaggaatcttgttgtattctttttacataattaaccaacattattttaaaaaaattagtgctttacaattattttttttggtgtagatcatagcaacgaggtataaattttatgcaaattatctaacctctatcactaggttgactttatagtagtgttttagttgataactaaggatatgtttggattaacgtttgggaagtgctttttgtgaatttcagtaaataatactttcagtaaaattccttcatacgaaggaatcttgttgtattctttttacataattaaccaacattattttaaaaaaattagtgctttacaattattttttttggtgtagatcatagcaacgaggtataaattttatgcaaattatctaacctctatcactaggttgactttatagtagtgttttagttgataactaaggatatgtttggattaacgtttgggaagtgctttttgtgaatttcaatgtacaatagtaattaaatttcagtacaccaaatgaagaagagaaaaatcggggcatcagtttgtttaaattttaaaaaataatttttaaagaagtaagttacagttacctattaaaaaaaagtagaaaactacctcttttttctataaaaaaagaaagttgtaacagacacataaaaaacatagaatgcttattttgttaaaaagtacttttttagagaaaaaaaatggtgagtttggataacgtcaagaatcaattttattcctcaaaatcataaaaagtagaaataattaattgttaaagtacttttcctttctctgaaaaaaaagtattttgcattcaccattaaaagttaattgaataattctcaccattaatctaatccaaaacactacaaaaaggttcattattgcttctaaagtaaaaatacttttctactctctcaactttaatcgtaagatacaccaagttaaacactctttcatgtttaataattaatagtgtttttgattttgaagcctaca

SEQ ID NO: 1185 - DNA, 1415 bp, Glycine max
  Soy_ogl_5868 Gm18:1550201..1551615 Cluster 5
tatcactaaatctccactttactattttttaaaaataaaatttaaatttatgatgatattaattaaattaaaaactaaataattataattttgatcttcttgtaattcttaatatgtaattttggtattcttattttaaaaaattataattttaattcaatattcaactttccgtatatttattttttattttaaattttcacaatttcaatctacttatttaatttatttgagttatcatattataaataaaaaatattcattatttttctttatatacaaaacttacaagattttatttaagaaatttgaatccaattttactcctactatcaacttgtttttgtataattatttactttaaagaatataaaagtacaacctatgttatattgttagttaacaataattatcgaggatcacgatgattttgtaaagaattatatctatgcaattttttctttatatacaaagcttgaattcgagattttatttaagaaatttgaatccaattttactcctactatcaacttgtttttgtatagttatttactttaaagaatataaaagtacaacctatgttatattgttagttaacaataattatcgaggatcaggatgattttgtaaagaattatatctatacaattttttcattatatacaaagcttgaattcgagattttatttaagaaatttgaatccaattgtactcctactatcaacttgtttttgtatagttatttactttaaagaatataaaagtacaacctatgttatattgttagttaacaataattgtcgttattcaggatgattttgtaaagaattatatctatgtaattttttaaatttagaaataataaattttctaaaaattaatataccataaaattagtactttttaaaaaaacttataaacaaacccacaatacttttatatgggaataaaataaataagaaaatgattcctcgcgtcctctcatgtttagatttatatatttttgatgtaaaagaatcttgtatttatatataatgtttgaaaagaagataaatgcaaaaaaattaagtaataaaattatatttttttttaatacgaaactattcatttctaaataaacaaaagcttaaatctgtgaaaaaagaaaagaaacttaaactaatttattaattgggtaacttctaggtttttgtcataaggacttaaatatgcacatggtctcttacatgattaaaggcgtaatgtttcaacattaaaaaaaggaaaattattcgtcgtcaaacaattcgattaatgtaaaaattatatacatattgatagtcggggtcttgattttgatttgtagaacacgtccttcaaaagatacagtacttttaaatgtaattaaacttaaactttgaactgaaatttaatat

SEQ ID NO: 1186 - DNA, 1900 bp, Glycine max
  Soy_ogl_6905 Gm20:40920101..40922000 Cluster 5
tatttttattttcagaattattcaaagaaaaggtttatatgtctacttttgtaagagaattgtgtttttctgtttatttgtccatttaaaacttaaaatatataaaaaaaaagtataccaccatctatacctaatttttaaatgctttactggcttattatataaataaaagagaaataatattgacagataaatagaaagctaaaaatagtataaacaatgttattaattgtatttcgtatatattactccctccctttgttgttatatatctatattttaaagaaaaactgtttttatttatttgttcattttaaactaaaaatatattttttttaaaatattgtacctatttcagtcgatctaattattaaatattttacatacttattataaacaagagaagaaaaattattagaaatcatattaagaaattaaaaatgattttcataaaaatatattagttacattttttttaatatgtgtactgtcttttaaagtcaacaattaaatataataagaaaaggaaggaaaagtattacaaaataggcataaaaacaaacaaataaacagactatatatggatgaaattttgagtgaagtcttacgagttccacatcaaatatttaacagagtatagtaagtaactcgagaactttaacatgaagtttcaaagtgaattaaaaagaaatcatcactgtggcttggatgtttcaggactcaatataaactgatcgaccttaaagttccagttaagttatagttttaatgtacctagtaaccgtgttacagctatcaattgcatcatcactcatgcaatgcattcatatatacctttaatcattcaaaaagatggtcaagttgtttaaacaggaaaagaaaggttgatcatcaatcatgtacgtggccaatagtatatgtttttctctttttctcagtgtaaaaagttaaatatgtgtaaatgaaataagttaacattattaaatatagtaaatattttataattttcattacaaaatatttttaaacactaaaattaaaacaactaaatgagagttacgttcatctccaattaagtagtcttccaaaaaaaaaaaattgggaaatgggttcttccgtattaaaatatccgtggcgttatttattgccacacaaatcaaactcgtggctttagtattcctatattgttaaaaatggtaatgaagataggttattataagggaatcaattaaggtgttagtgacatgcatgatctagatcccaaagaaaaagcaaaagctaaattaaataattaactccatatcatatcagtaggatgtatagatgagagttgactgtattggtcttaagtttaaattttgggtatataaatttgttaaatatttaaagagatgattttgttattcataataactaatcgatttaaataagattactttttagtagaatatatttgtggtttaggaaaaaaaaatcagtgtttaaagtttaagttttgcttataaaaaagaaaggttgtgtaagtttgatttatttattttaaaacatcaaatttaaagtttgacgtttgcttgatttaaacaataataaattaaaatttattatttgattgttttattttgtaagaaaatatttgagtagttatttatttatttagtttttaatatgttttcatgttaaaatgtgaattaaaataattataaaatataacttatatttataaaaattacttctgaaaagatgaagtgtttgacggtagaaaatgatgaactttttaaagatgaattatgggcattcaaagtataattaaaattatatcaaatacgtggttattaatttctttaaatgtaagttgaatccaacatgaacatgtcatcaagatattttatttgacattttg

SEQ ID NO: 1187 - DNA, 1653 bp, Glycine max
  Soy_ogl_4641 Gm14:4150448..4152100 Cluster 5
gcctcattaataattttaataatattaaatgctattttaaattttttttcattaatttttgtgtcatcataaatgcacattaattttctattgatatcatattatatttttaaatttaaatttatgtgaacttttatgattatataaatttacgtgcttgtccttattagattttttggggggtagggggattacgattggtgtgtatctctttatgtaacaaggaagttaaaatctataaaagaattatgttaaaataattttttaaaattttaattcaattagtttttattttttttaaagctcagtattagtttatattaataattaataattttggattgccttattcataatattaataattaatagtattaaatattattttaatgttttcattaattcttgtattatcataaacgcacattaatttatatttttaaatttatatctatgtgaacttttgtgatgtatataaatttacgtgcttgtccttatcagttttggggagggagaattatgctttgtgtatatttctttacgtaataaagaatttaaaatttattttatgttaaaataatattttaaaattttaattctattagtttatatctattttaaagctcaatattagtatattaataattaataatattaaatgctaatgcacattaatttttaattgatatcatattatatttttaaattaaatttatgtgaacttttgctatatatatatatatttacatgtttgtccttatagtttgggtggggtgggagtatctttccctgttgacattgttgcttataaccaatccaagatacactagatatccaattgttcgatattaatttgtattcattttcattacagagttaagttgatgtatacaagcatcaagaattcaatgctacttaagtaataaaaaaaacattgaatgctacttcataatattgataattaataatattaaatgctattttaatcttttccattaatttctgtattgtcataaatgcacattatattttaaatttatatttatgtaaacttttgtgatgtatataatttatgtgtttgtccttatcccttttgggcagatcatgcttggtttatatttctttaagcaattaaggatttaaaaacagaaaaatcctaaaataattctttaaaatccaactagtttatattaataattaataattttggatttccttattcataatattaataattaataaaattaaatgattttttttcgttaatgtttgtattatcatatatgcacgttaatttttaattgatatcacactatatttttaaatttaaatttatgtgaacttttgtgatgtatataaatttacgtgcttatccttatcgatttttgttggggaaattaaggttggtgtgtattccttaaagtaataaagaataatgtcatttatgtggttctttaagaaagaaaaaaacataaacacattctttcaaagacatacattatttaatctgaaagattgtctatcttatatttgattccgaaactctgttaaatttaaaagtaactttatttggccgaaaataaaaatataagaaactttaccataaattttgtaatgatttaatagtatttcatttaagaaaaagggggtgaa

SEQ ID NO: 1188 - DNA, 1384 bp, Glycine max
  Soy_ogl_1572 Gm05:3344442..3345825 Cluster 5
cactatattttatatcattataacttaaaagatagaaaaaattatataagataaagaaaatagctattgttattctctcaattttttaataaactcatcgaaataaatctatttcaaatgttaccgaatagaagaaactaaagaaaaatgatagaagggtcttatcaaccaatatcttaagtatgctggtcaatttattttttttaaaaaaatatgtgtcttaaatttgaaatcttaaatgataaaaaacaaaacgaaaaaatgattattttttttaaaaaaatcttaaattgatttatcaataaagagacatattttctaatgtgtcttgagaccttggtccataaacaaatgtattagtcatcattcaaagatttgaaaggctaagaaaatacaatatactattagaagaaagatttgttaataaattttaattaaaaattcattataataacttaatcaacaaacttaaattgttaatggcaaatgctaacaaatttatttaggtatcggttaaaaaattaggaaaaaaaagtaaagtttctattgagatacaaataaaattgtgtgatacattatcttttttttgctttcctataatatgattttcatacttatttctgtaaatttttaaatcgatctctcagggacattggttagcaaatattttctagtttctaattataaaaataattcatatcttttaagaaaaataattaatttagttaatcatattaaatctatcaattaattatactatcattctaaaattatcatttttatctctctattcacttaattttttcttattaatattttataaacataactaaataaggatatacaaaaaataattaatatatttaaaaatttaaaaaatattataaaaaataaataatttattttttaaaaatattataattacggacggagaaattactattatttgtttttcaaaaagtaaatggacattatatttgtaattattagccatcatgcattcagcaaaccaacaatacatgatgctatgcttgtgtttccgtgccagaacagtttttgacctgagtagtaagtagtcaataatattatactcacaaaactttatacatgaattttatgtatattatttatagtttgattttcaaaataattaagtttaaatttttgaaaagataaaaaataattatttcttcaaaataaaagataaacactttatgctataattctcattacctaattgattgtttgattaattaaaaggcttaattacaaaaagtttgatataaaataaacagttaaattaatgattttaaaatcgaatcaatcgttaaaccaataaatacactaattcaaaattttcaaaggttcaacgtgacgaaaccag

SEQ ID NO: 1189 - DNA, 1306 bp, Glycine max
  Soy_ogl_75 Gm01:3212395..3213700 Cluster 5
atacttacatagtattcaatgtaaagcttaaatcaaataacctgacaatgtctctttctttatttgtttatttagttacagccttatgttcatgggattttaaacgtatataagttttttatgttttgtcttttgagggtgtaaagaagcgttaatccattaccacctatgtttgtggattgtatatgaataattagttaattaatccattattatcacctatgttttgacttgaaaaattgttttttaaataaaccttaaatatatttttaatcatttaaagttgatttatatttttttatccttcaaattcatccaatattctttttagtctttttatacggcacgagcaaacacatgaaataaaaattttacaatttgtgacaatttttcaccactaaaatttaattttttattttacattttaaagtatatttctaatggttaaaagttataataattaagtcataaacaaaatttaagacctattaattactttaaaaatgactttaatttttcttattgacttgattttgacaatttcaaaccaaaaaaaaaattatactttaaaatttaaaatataaaataaaaaaattaaattataatggtaaaaaatatcaaaaattataaattttttatttcattggctcaaactttatagaaagacaaaaaaaaattgcatattacagaagactaaaaaaaactacttcaaacttaaagaacaaaaaaaaaatacttaaacaagggactaaaaatatatttaattttttaaataataagtaatcccattttctataagaaactattataaaaactcatttattttctatagcatttataaattacttaactttaagaacgagcataaacaactgtattagagtttgctgttaaagtaaggaattttggttaggataaaataagaaaatttggtgcacatgcatttactcttggttattcattccctccaatctctaacaagcactgtcacagaatcacaagacgcagtttattcatgcattcattggttaattctatttttttaatagcttgaaatgttaagaaaaaacaaagacatcaacttagggttaaataacataattataatagaaatatcattctaactaaaatatctaaaatttattatatttttcatattacaaaatatgttataataaaaataataaatattaaaaaataaaaaatattaaattatatttttaaaattttaataaataatattgatcggacagaaaagaaaaaataactcattaagtgatagaataaaaatcttcatatatatgta

SEQ ID NO: 1190 - DNA, 1647 bp, Glycine max
  Soy_ogl_4407 Gm13:32297501..32299147 Cluster 5
tttgtcttgagatttgaataatgaatgacactagtttgctacaactagcacaacgtctacaaaaggtaaatgaatgaatatgaacattgagtatgtataataaaaaagagttataaaattgacattgtaaaaatggaaagatggtaaaactactatcaacgtgtaacatatataaagcctattagttttaaaattggttttcattaaataaatttcaaattattgaacataatcaaaatatgtgtctaaatcatctaatcacatcctatattgatatttatctcaagacaagaaaaaatgattttggtacgtaaccaaaatgggatacatggtctcgtttcccatataaagcataaatggaatcagtagtatgaatgtataatttctagttgtaataattaacttacttgaagtcttacttatataaattcttccacacaaaaaaagtcttacttgtataaaaaaaaattatttgaagcttttttttttcatggagtggaaaattttgttccaaattaaagtgttgtgtatatttttaccttccatccattataattagactttgaggaatctcgaattctatgtttatattcaaggcctgttgcctgaagctaggggcgaactcagaatttaatgacaagcctcaatatgaaaattaaaattaatctagtaaaatcaaactttatacaaactattcattattatatcttttttttaaataatttaagaactatataatagagaacttatttacatagtaaataaattaaacataagagacctaaaattataaatgacaatcaccaatttcaaatgtcatcgaaaatcctaatgaatttataataaaaaaaatagtatttacactaaacattttttacgaaaaatcatattatgttaaaaaaaagtcactaacttagaataaattatgttgctaattaactaaattatctttcacgacaataataacaactaattttctttcagatagttggaaaatagaaagaaaaaaaaaactattgtatcataacaaaggctacaactttataagtaaaatacgactgatctttgatgcaacttcatatataatatacttttcatagatttatattacatgtatttgaacttttgcactcgtgacccaaaatacattgaaatctttcaaacaataacaagaaaaacaaagatgagacaataaaagcaaagagaatataagaataatgataattggaagatagaatatttgtagatatgttttaaaatttaacttttcaatatctgatacagtatttgtaattttgaccaattaacaaaagattaataaataacatttaaaattcttagatctatattaagggaatgataataaagatatttgattacaaactaactatttataacttttcaataataataacatttaactattatttgaaatgaaaatatatgatactcaaatattttatttgggaaaacaaaaatataattaactctacaataaatactacaaaagaatataaaattttgttaaaaagtaggaaaaaataacacttcaataacttatttatgttgcacttaaatgatgttatttatataattaaaccccatattatttagatgattaaatttctaaatcaaaataattatcta

SEQ ID NO: 1191 - DNA, 2000 bp, Glycine max
  Soy_ogl_3637 Gm10:48982001..48984000 Cluster 5
acgatacataataatttcggctggatactactcattgggctaggtttccagtccatcttactcttgggacatcattgggctggctcgtcacgctaatgctttactgaactgaaaaggaaaaaaaataatgctttaaaaataaattatacatcgataatatgaaataatttttagttacaaactattatatataaatataataaatttttaattttataataattatttcaaaaatgacatgaactttgatttattattaattgatggtataaaggttttcagttttcacaccgatattatcattaaattcttaaaaatacttactgaagatcatttaatgtgcattgcagcaaatacttattaaatcattttttatataacaatgttttttaagtaatttttaacaatttttttgacagctttaacaaatacttttgtaacaaaaaaaagtataacaaatatataatttttttcaaaattactttctactagagacttcacatttgtcagtatttgtttgtaaaatataaatatttctgtgcatgtgagccgtaaaaatacaatttaagaaataactagtacacccaattaaatttttttattactataaaataaatattaaatgaatcttatgttttattagagtaattttttttgttatatatatttttatttttctcaaccacttttaataaagataaaaattttatgttagttaattacttcccaaataaagtctatgcctgtaaaatagattatttttctgcagtgttttctatgcagaaaaaaaattgaagaagagagagaatggaaaaataaaagaggagggggagagagagagagagagtaacgtttgcaagttatgtgctaattcctcgaatattcagcattttccataatgaataatttattttttcagtgtgtgtaatctaagagttcgttttacttataagttataaggtataattttattataaataaaagttgaagtgggtaaattatgtctctatatattttttcttaaaaaaaatccatttaatatttaaatcggaggtatcattgctaaatattttggcctttcaataaaccaataattaaatataaaaaaattaaaacctttaaatttttggtaacgtggttgacaatatgaagccgaaataaaactatttgccaaggatagactcaattagttggatgaaagtgcatttatttgtaaatctgagacttatgagttatgagacaacatttctttccccgagtactatgtacaagtggaaaagaaaaagagtatgaaacatgtagatataagggagagcgtagaactcttaatataagagttccttcccaattatttctcctttcacaagagaatgggctggagaagcacgtgcagcaagctgaaattagttataactagtacacgactacttttcttcttttttttttttcaatctacaagataaattgataaaagatgctaagatgattcgtggaacaattcattttagtgaaaatggattatcaaattatcagaaaagtgtacgctatgtttgttgaggcttttaaggagcatataaatttctttcactaatttataagtttttctttatcagatatttttttgatatatgagtttattttctataagttacttcaagtgatttattttgacaacttattagttttttttcttaattttataaaaaattattttaatattttattcaatttaaaaattcttttatttttttgtttgttgtctaaaaacaactttggtatctaattttatgttcctagaagcacacgacacacatgatagtcaactcatcaattgcggtcattatattattccttaggattaaaaattctcaatcatttaaactttataattatttgctgaattgatctattttttttcttcttaacctataggacctaaatgtttccttacatgatttttattttatcgattcaattcataaaagcaaaattatcatttt

SEQ ID NO: 1192 - DNA, 2000 bp, Glycine max
  Soy_ogl_5027 Gm15:12918701..12920700 Cluster 5
aagtattaaaccgttattttagtagaaatcgagttaaaattaatgtagttaaaatcaacaattttcaaattaaagtcaaagttgattaaggtgagaagtaattttccacaattgtaaaaatttgtttaatatattttaaatattttagctaaatattttctagtgattttaaaccgccaaaaaggatccatcataaaatataattaaataatactacaaaataacaatacaacaatatttaaggattatatttgaatgtaagattaaaatcattgatagacaaaaacatcataaaataagacgggtcaattttttatttcaaagactaacaaaacaaaaaataaaaaaaatcacgaataaaaacataattaaccttttatttaatataaactatatcatattatttaaaatataccaccatatcatttaataatttcagtattttaagtatccaattaaatgaaattatggtatgttatcaaatgaaaatgtagaggcttagaataatgatgcatcaaatcaaagtccaataaattataatgatgttcaagatttttttttctaattaaatttcaggcatctaaaagattacacgctaaactggctaccaataaaatatcacacgctttcttccatttccttttctctccatttcttaatttttcgcgtatcttttttaatttcttgatttcagatgcagaatttaagtatgaatctttgaaacttgttcttaaacaggcaccataaagacaactttgacttattaggaattacatctgccattacatcatttacaatttgtagatgcaattgctttgctattatttttaggataaaattgaaagaaattaaattctgcgtactgaaagtatgaaactaataaaatatgaaattctgccattacatcatttacatcatttcaaaatatttttgtaataaattacacatacattttataattttattttttaaattataatcgttagatttatttaaagtatgaaactaataacatatattttgtgcttttaaatatttttaaaaattactttatcccctataatttctcactattttagcttatcgttccaatttgttatattacgaaacttcctaaaagtttgtgttcaattaaaaaaaataaaaggacgaaaatctcactaatatataacctttcttataaaatttggtatttcttataaagggacatagttatggtacgctagcaaaaatatattttattatatgtaagtataagttacattattaaagatacaaaattaatttattatatgttgtaaaagaagattaatttaaaaacattgctggtctaaaatttaccgttttgtttaatatactaccatattattgaaaaaaaaaatagtattctaagtatcaaatccactttgtaacaaaaatatcaaatagagtattatcaaatgaaattataaagtttaagaataataatgcatcaaatcaaaattaaatcccaataataatgatgttcaagtttcttttttatttaccatccatgaaattgtctttgcttttaaaaaaataataataacttccctctataggatcacgcgcttttcttatttttcatctcgctctaatttttaagaaaggctaaaaaaaacaaaatttaaaatagacaagggactaaaaaattatttaacctatataaaatatgtatccttttaaatcacattagttcttcatattgatttgatttttatgtgctttgttaattaaacataagtttttataatttttgtttcatattattttcatttttgtgttttactacttttatttttaatatactttagttttcttatactatttttgttaattacaaataatatatgcttgctgatttttttaaacctactttaacttaaaaaaatttaaaataatttattcctatgtcatattgaatgcattctactaatgtgtattcaaataaagatggactcaagtttgagtctcgttgataa

SEQ ID NO: 1193 - DNA, 1600 bp, Glycine max
  Soy_ogl_3584 Gm10:46577901..46579500 Cluster 5
taatgtctgatgatagggttctagagacaagaattctcgggctataaaaatgcctggatcgattttattctgattattgtcttttcgatgttcactatctattggctggtcaccaaaggcaatgttggtatcttgcaaataaaacatcatcatcatcctctacttgtctatgtttcactgcgcaattcgtcactaacccaactgaatttactaataaatattcagaattgtatgccttatatgcacataacaacagtagcgttatatatactcgaatatatgcagataaagcatttactttagaggaaaaaacaagattttaaatttgcttaattttcattacttattaattaacttaaatttaggcttcagggttttattattagtttaaaatttaaaccataagtgaagagaaaaatatcatacaattattattattattattacaaatgcagttgggatttgattccttcaaaataagagttacacatttctgagaggaaaaaatgcgaatagatgtaattgctgatgaaaaattaataattaaaatcataaaaaaatatgaacattttatcaaattaaatctgtcaaaagtttctataaatgtaatggttttttgttttttaattgctgtatatacttttttaaaatattttaatatttttcgttacttattttgatttctcaacagtaatatagttttatgtacttataaaacatatcagtttttgttttatgtacttataaatataggtttttttgtctttacaaattaatagtatattttttagtgtttactttttacttccttacaaaataaagtgatttttgtttgtagactctactattagaacataaaaaaatcaagagataacaatattataagaatagtttttaaaaaaatttacaataaataaaataaaaatcactatattttgaaatacttaaatgtatttaaaccctgatttagatatttttgtagctagtgtcagatcatttataaaaatatttattagcatcaaataaaaaattgtgtattacgcaaacattttctggtctagcactaataagtacttttatattttttttcttcatcaaaacaattattaaagtttatattatgcacataatactcataaaactttacgtgttaatagatcattttgtatattattagaacatcatatagttaacgtatctttttttttctccatatattttcttttagagatgctctagcattttcatcatcaatatacttttaaaatttgacgattttattaatactctatttttaatctgaaaaatgtacatattttttatataaagctcccatgaagatatcatatttgaaccgaataaaattattataaatggtaaaaatcatccttggaatgtcaggggcataatattattcctaccaaaaatgtttggtacatctttctattttttaggaatgttttaaatttttttaatttaaaaataaaatatcaaataaataaatatactatgttgaatgagaagaaagtgaaaagttatttaaaataaatattcatatgagaaattaaatttttcattttttttcatgagaatatgaaga

SEQ ID NO: 1194 - DNA, 1145 bp, Glycine max
  Soy_ogl_2409 Gm07:38107431..38108575 Cluster 5
caagcataatcaaactcagcctttattatcaattgagttacattcactatccaaaatctgtctaatctaaaatttcataaaataaactttgataaaattaattttaaaatattaaatgtaattaaaacatttacttaatccaaattacatattctatattaaaatgcatatcctttccactacagatattccggtgaacttgtaatagctttaatgatttgatgttttctggactcagtaatcatcatgaatcgtatggtcacaactcgaaagggcatgacccattgacatcaatgacatcacgtatcatattcatatgacaccattcaactaaagtctaaaatacagcagcaagtactattatgccaaaccccgacttcggaagggtgaatatttattttgtgaatatgctttttttttcctattatattagtacgaaataagaattttagattagctcgaaccataataataacacataaacactcgtgtatattataaatacttttttatttataaatattaatttgttaattttattaaaaatattaatgagagagactcaaattcatgatctcctcttctttcatctttaaatcttctccttttcacatcaaattaatcttatatctcctgtatattataaatacttaacatagatcttttattcactttatttaattttgtacgacggatataaaaagaatcttattacattatttatcatattatatttctttctctttttcttaaaatatcaaatattatagagtatacgtgcatctttatataaaaagattggctttattgggaaaaggaaatacatatagtatttttattatcaatcataataataggttttttattgataaatatattaccccttttaattaaatcatgttgctattaaataataagatatccaaatcctttgttttatttatttatgtcagttaaaatattcttatatccgtaacataattttttttccaaaacaaaagtgttaagaaatgatttggaaatattagttaataaaatgaaagtaatcaataaaaatatttattttttaaaagaatggttcacttagtattcattcttaaataattttttaaaaattattaataatgtttaagcttgtcggttgg

SEQ ID NO: 1195 - DNA, 1284 bp, Glycine max
  Soy_ogl_51 Gm01:2370601..2371884 Cluster 5
ttcttaaaatttagtacttaattatcagattcaaaaatcgaatggtgataaaaataaaaaatatctttaaaaatttattggaataagtggattctcttgcgtgtgtgtatatattatcttactttttaacatttcatttgagttattgagtttgtatatataaaacatgtctttttagtttacgctttgaatttctcctagagtcctaatctacattgtaccaaaaatcactgtatctgatactggcactggcctatggataagtaatgaagttattataggtcaaatgacatgtttttcttctgagttaaaaaaaaaactattttttgttttactgagactgatacgatgcatcttataattctgctagatcagaggtgaacaatggattgtatatcgtttaatgatttagttctctgtgtaatagtaggttgcttctgcagagtgaaaggtatcagagcaccagtacttgacctaatgccctcctttgctatattcactcataactcattctaatgtcctcctttgaattatgaaaccgtctttcgagaaaatgtttggttttttggtttggccatttggggtctttaaaattttgaaaaataaaattagtttggtgatatatttagttatctttaaaaatatatttattttttaaaattatatccgaaaactcaattttgtaaaaatatgatttagattgttttgacaaaagctgtatttgaatttctggtagctccttccatttgtgtccaatatttatttccagaaagtagtatctttcttacttttgtcttgtatttcgtgttctaagtcacgagagatctaaatatataataactcaattagtaaacttaaggtttgactcaaacttaaatttacaaattttaatttaaacatacactgctatactgaatggttggagggagtttttttctttttttttgaaggctcttcttggacggagatttgcctttttttactactaattctaagttctgactttgaaaatattttgaatataattataatacaataacaataatgtaaagaatgtatatgtatgtatatattaaattatttaattataaattatcaagtataataaaattattaattttttggtcattattttaaaagtgggtgatttctaattagctgaaaggataaaaatctttacttgcttagaaattaaattccaatatttttaaagtagtaagcatgataaaaaaaagtagaagaaaattaaagtaggaagttattataaaactttattatataaat

SEQ ID NO: 1196 - DNA, 1917 bp, Glycine max
  Soy_ogl_786 Gm03:1325001..1326917 Cluster 5
ataaatgagaatataaaggattaacttgagcaggagaggggtataagtcattaagagacaaatttaccaattataaccaaatttgctcataatgtgtacatatgtaagtaaatttgttataatttgagaaaaaaatattatagagaagcctttactagtttaccaactatattaaaaaaaattactatcataatgtttccttttattagttgacagaaatattgagatgacttttaaccgtaatagaagtttgtttatattcaaactgtatcgatgaaaagatatttttttttttatcaaagattcttatttgcaagtattgattttttatttcttagttggtttattcaatattgacaaatgatgtcaatacatctaattcaattagatgaataaagtgcataaattattataaatttccatatactcttaattaaaaactatcttggatggataaaaaaattgttgacaaatgataaccttagaaactatgactcaatcctcaaaatttgcgcaccaattactggataatacgttagtttcagtttttctttttctttttttttggatatatctttatttagaatttaatttgaccagcctttgtttggttagagaagaaaaaaaaaggaaaatttgaaaaaaattatgtgagtacgtcctacatcttttatcttttaccttaattcaaataattttttttttatatttcttttctttcatcctcttctactctttcaaaccaaccctaatggtggactttcgagtaatgatatatgatctaacctccctgttgctttttcattatcttaaaaagtaaaaagtatacataaaaatatcatcggctagcattgcatttattacccgaagctgagcgctgcaggataaggatcgtttggtcaaaagtttatcagaaaacttttttttcttctttttttttgctttaaatcagaaaacttaatcaatcggaatcattatttaatcttcattgtgtggtaaattattcttaaactcaagatagtgtcataaatttaactcgatcataaaaaatgtagtgtcttaaactcgtcattttgcaaaagcaattagtgcatgtattgacaaatgtaaaaagaaaaaaaatagttgatgttttattttttgtgaatcgaaaaatattagatgtaagaatccatgaatactattttgaattgattccatatgaggggatacaactataaaaatatttagaatatagaagtgggaacagcattacctaaatgggaagaatcactgagaagtacaagatgcgaaaagaaaatgcacaataatgtcaatacaccatgccatacctcgcaaattctaatttatttttaaaatacaatatgttaatcaaacaactaactaggacaaagagttagttttctacaatgtaacaaactaagattttttttagtgagatgttcatatttaatgttttacgtgtctcaaccagagctacttctgagaaataaagataattgacattgagaaacaaaaaagtatatatatgaaacaacgtttacaaaacataattttacatttgattcaatacagtgtcacaatttaatatgttgttttaccttatcccaagtaaaagcaggattaaacaacttcaaagaagatgatcgatccaattaagaatattatacagatgatcttaaaatacacaattaattgtacaatcattttcaatgaattatttatcttattctgatttgggataagtttttttgaaaggaatttgggacaagttagacaacttctaatttaatacttcattcagaacaaatagttattttaaggattttgctgaccagtcttttaagtacaatgatttaaaaacattatttttttttatagaaatccactttaaaaatgcattaataatcatattag

SEQ ID NO: 1197 - DNA, 1500 bp, Glycine max
  Soy_ogl_1694 Gm05:37241701..37243200 Cluster 5
cattacagaaggtgtgtgagtttttatgaatgagtttggtaagcaaaattgactaagcatgatatgcaattttaaatataatcctaattttattataaatattagagattcgggagaaaaaagttcttttttattttgtaatcgttatcattcgccaaaatacgataagtaaattaaattatatatttgttcgtacaagattaagtttgtaatattgaatcatataaattagcagtggcacattatttatcttgtatttaatagaatataaatgtcttgatgcagatttatccgtactgtatttaactcttctcattgccattgccaaatcaacaaagaccatttaagaattagttctgaaaatgtaataatgagtaggtatggcatgctttaaggatagaatggagaaaagttttgtatccattaattgaagaacgttaaattaataaatttcagtacaatggaagtttattataatacttgttagaaatgtaaaaaaaaaaaaaaaaagacttgttaaaatagacctatctaactgaactagtgagccagaagtcacaaaatatatatacagaaataattctaagaaataattaaaatttatatgattaaccgtaaacatttttagaaatttttcacgtttttttttttacaaataaaaaaattattaaatttggtttcaatagaactttctcaaatataaaagtatttttcttctcataaatactctttttagtgaaaagatatgattagaaaaacttcttgaaaaatacgtggtttgaaattttaatatttttatttttatcatataagaatttatattatttaaaataatttatattatttttggaataatatttttttaaaatatatatatagatatatatactttctccaattaactcgagaaggatgtcccttaatcttaagtatctttaggtgcaaaatattttttggaaaaatcaaaagtacatatttcattacaattttttatgaattgattaattttaattaaaatatcattttataaaaaaaatcatgaattcttcttttaaaaagataggtttatttttagaaaattaaatgtactctaaaattttgaatccaccttctcacaataactaagtggaaaatagattcaaaattttatcactgacaacaatgttttataaattttcaaaagatttaattatatttttaattcttaaaatttgggataaatttatttttagtccccaaatttaaaaaggatcattctagtccctcaaatttataaaaatatagttataattcctcaaatttactgtttaaggactaaaaatagttttcaaaagattatttaatcccttaaatttagtatttaggaacttaaaacatatttttaaaattaagggactaaaattattttttaaaaaaaatttgaggaactaatactagatttaacacaaattttaggaactaaaaacacaattaagtctatcaaaaaattaaaaattattg

SEQ ID NO: 1198 - DNA, 1266 bp, Glycine max
  Soy_ogl_6989 Gm20:44558535..44559800 Cluster 5
ggtttggtttattgtgaaagattgacaatgtcagtataactatcaaaaataaattttttaaaattaaaattgcttaaatcccaattgatattaattatgttttaaaataaattcaataaattagttatataattgatgtagtcagagtgatatataagaattattaaattgaaatatttaataaataatttgcaactcataaatgagttatattagattatatcttgaaaaaaatattttctaattaagatttaaattgtttagacacaagtctatttaaatatattgtttaaacgtgtttttagtttctataatatatataaaactttatgttgttccttcgggaacatccgataaaaatttatgttattcatttataaaaaatttaaaatagttcatgcagtattaaatttttaagcattagtttttatcgttatatacttaactagatgtcgttgacatctgtgtcaacttatcatgtgatgaaatgttattttatataatttttagtttagttcctgtaaacatgtttcctttttattgtgaggattttgggggagagagaccaaattattttctaagttttatccttcgcatatatatacgaagagatgtaaatcatttattattttttagcgtaagaaatatctttataatattatatcgttttttatttattttggtttaccaaacaagtgaaaagagaattaaactttcttttatctattatacttttttctttaattcaaacaacaacaaaaattgacacaattttttcacttcattttcttccctattttcacatccaaatatagcttaaaattttaaataaatcattaaatagctcaacagtttaatttgtattcattatcattgtaaaaaaaatcatactttcaatcagccaaaaatcatgatgattaaatgtcactttaatttaatgtaactattataaattttaataatttcttacataattttttaagagactttcttttgaatcatgtcacttaatttaggtgtcaaataaaattgtggtattcacatatatttttttaactacttatataggttgatagccctattaatccagctagagccgtgcacgtcacggctacttcatgttgtcaataaaaagaaaaaaaaacatgttaaagcgtctagtacattgacaatgaactacggacattcactcaattttcaattgatgatgaatggttcccattaataaaagatgtttgtgaagcactatcaattttttatattata

SEQ ID NO: 1199 - DNA, 1241 bp, Glycine max
  Soy_ogl_6331 Gm19:1992101..1993341 Cluster 5
gtaatttataaaacttttaagattaaaaagggtaattttaaaataatagttaaaaataaggaatgatattgttttttttttttaaaaaaaaaggagtggtacaaaagtaaaatccattaggtagataaattagtatgaagtgtgagtacgttgcaacttgctacctagtatatgaactaaatattcttgatatgattatgcatcttattaatcgatgtgttaaggataaggatacccataaagaaattttaaatagagttttttttttattagaattcatatcaggaatgtattgaaaatcataacaaaagtgtattaatgttatttttaataaaatcttttattttaaattttttaattaatgtctttaagatactagttaacagttttcacctaagcaatggtaaaaattgtctttccggaggttggcctgtagataaacggacaagagctacccagagcttttgctgaaaaaaatacttttttaaaagcacttatttaaaaaaattaagttttaacgaaccagtccttattatcaaatttgataatcaattgtctttcgtgtgggaaatgattgataatttattgggtaaaaaaataattaattattttacatcgaaaatatgttattgttgaaaatcttgtatattgagcgagaacataaaatcatgggagacttatgtgccgcttgatttgagtatttttttttttaagaaaataagaataaaaatatgtttgtttaaaatttaaaaaatattttttctgaaaatattttcaaaaaacagacctaaactaaaaataacaaatcaatattttcaatttttttaaaaagcaccatgataccatagagtattttcttcactataatattttctaaatttaaaataaaaattatttcaaaaaacaaaaataaacactcaaaccaaatttcaccttatatattttttctttttctctcttttccatgatgttaaacaactaaaattacttatttcttgttcatttattctccttccctcccttcttccctcaaattcatttgtaccaaatacagtggttggaaaatttctttttcacatataaactatgtttattattcttccacctaacttttgcgaagataatgatgtttgattaattaagactttgataaaataaacgtgtttattttaaaaataatataatataatataagagttcattcctaaagcacaagagctgcaagttaaaaaaagtgagag

SEQ ID NO: 1200 - DNA, 1473 bp, Glycine max
  Soy_ogl_2501 Gm08:4590328..4591800 Cluster 5
ttctccttttatccaaggaaatatttttaaagaacaaaattgtggatactcatgggagacaaattgagcaatatcttattgaagtgagcttaacaatacaatacttaggttgaaacaatcttctatacgtacaaattgaaataattatattgaataagagtatgtttagtgattattttttaacgatagtgtttttagtgattttctttacagtagtttttaagatttttttttaactttttaatttatatcaatctaccattttctttttctacatcttttattttttgtttttaacgttcatagtgatgatgacagtagaattctagtattttttttctcccataaagacaatctttcgattattgatagtgatgatgataatagaatttaatatttttttttctcataaagacaatcttgcaattgacaatattttttgtatattaaatttttttcttaatgttgacttggctaactttgtaatgtgaaaaccactttcaatcaatacaaacaacttctttgtgttagcatcaataattaaaacatcagtctttaaaacaaacactcccattgtgtaatatccttttatctttttttaagcaatatatccttttatcttgttatcttgagaacagattctttaatgtgactttgatgaaaatcacctcttagtttattcatttttgttatctagcaagaaatattataaaaatgacacgtgacacatggctggtgttgagtatattttgttagctcaagttaacagaaagacttaagtgactaatggaaatttcattaaggataaaaatattagggaatttttttataagaactaattaaaagcataaaaatccctaaaattagaggctaaatatatattttacgcattactatattactcattttatgtcgcattttctttttttcctatttatttcataactaaaagaaggatgtcgaagtttgttgcataaaaacaatttaaaacaaattttctttacatttttacaagttttggacacctgcttttaatcacacatattgattagtaattgttggatattgttgagaacctcattgttaagactcaagagctttagattcatggtagcctggtaggtctctgatctagtaatttaaaatgaataaaacttaggtttttgtattgattttcaattaatcttatagttcatctcgataacttatactgatcttaaatgacaatataaattaaaaacgcacataatcgagataaaaaaaatacaattttaaatacaaaaaataacacaaaatacttatgacttgatagtgtatttaaattttgtcttttcaaaacataactttctatgctcattgcacaataaatgagggaacagtcttcccaaataatttggaaattcagtgtggcaaattatatttggtggctagctgaaggtgcttgaagatgcaatctaacaatcaaattattgc

SEQ ID NO: 1201 - DNA, 1205 bp, Glycine max
  Soy_ogl_4579 Gm13:39661701..39662905 Cluster 5
ataaaattattttagtgatttggcaattttaatagttttaatatttggagtgaattaattcccataaacataaatgataaacatgattataaactcttttttttgggaggcttaaaaaatttgataatctatcataagtaatgtttataagtaaattttgatcacatataatagttttaaattgtcttattatatttaatgaaaatctttaacttagttaaagaaaaaaacctaacaaaaatggaacatatttaattttaggcaacatatgaataattttattattatacaatatattttatacaaattttaatatgaaacatatttttaaaaagactaacagactaaattaaacttatatataggtcaaatctaagcctaaaattaaactattgatgaataattagtacaagcttaaatcaaaaatataaagtagctcatcaaactagacttaaataagacaccagcttacccaacccatttccacaccgacatgggaggaaaaacttaaaaaaaaaaaaaaaacgttcagtctctcgtatcttctattacatatactgatactgattaggttacacatgaagttgttttgatcaataattcctttctcatcattcttttacgctgtttccgagattatcattattttgttcaaatgagataattattagtctatgtttgtttgagtatattttacttcaaacatttaaaactttgagggtttactattttcttaacaactatttttttaatttagtgatatttatatattcacttaaattaatataacatgcataaaatatataggttatattaaataacttacatagataatatcaccccagcaacacaaaacaaaatacaaataaaatttaaatatatttttaattcttataagtatatatttttttatttcttaaaaaattatatttttttcgatctttaaatttttaattttttgagacaattcttattatcacttagcgatgatcgatatgagatacatttaattatgtcatattaatattatattattccaaatgtgatataacatgaacaactcaatatataatatattatatatgattaagtgatgaaaaagtatatattcaaaatttagtatttataaaataaaattactatattttaaagtattaaaattacactaaattatattcgtaggaataaaaatatattttattctg

SEQ ID NO: 1202 - DNA, 1900 bp, Glycine max
  Soy_ogl_5949 Gm18:5666301..5668200 Cluster 5
ataattgtcggataaaatgtaaaggtttatattttttacacttttttatcagactagttttttacatttaagaattactaatgttttattaagtttaaaaatagttaaaataataagataatgttggaaaatatagtttcattatatgagatttcaagctggctcaaattattttaatataaacacattttcagatgaaactttttaatctaataaaaaagtttactgataattttttttaataaaaatgtttttaaatcttttaaatatataaaattttatttaatacttatttttaaatgcataacaagatagataagtaaaaatatcattattttttttattttaacataattacacgtgcacagaacaaaactaaataaatcaaatcaaattataattactgagaagttaatggggaaaattgataaagaaaaacaagaaacataaaaaaaatacacaattttttttacaatttagatttcatcttaaaataaatttaaagaaaaatagattccataaaaaaattatcacaagtaacaactaaaaaaattaaaaacgattttaaaaaacccccaccaagaaaataaaatcacgacactataaccactatgggcctttggccacgtggcaagcccaaaaggttcagaataaagtttcacagtaaggaagtaattgttttacagaacttaaatttaactctccttgagtttattaagaataaaacaactttcaaaattttaagaatacttataaaaatatataatttataaattatttattaataaaatttttatctcacatccttttccttttgaaatataagtatattctttcttacccaccagaacaatccttataagttatagagagagtgtctataattaaaagaatattcactctaataatatatgtctcataatgataatttttatgtaaataattatttttaaatatctatttgcaaattactacaaaattacttttaagtttaatctttaaagccatcaaagtacacttctaatatcttaatcatattagtaaagacccagtagtattgaataaattcttttaattgatcaaaatggtaaacatttttttttgctttttaacaagtgtttttttcacttttcttaccccaatgagtatctaaatctcgatttcaaaaggaattttcaaacaggatttttttttttcacgcagaatttccaaacaggattaatattgataattatgttcgaatataaattggaaaatgatatttaaaacggtgggatatggaggcggggtatcaaatatcaattatcaaaatgatagacgacaaattatgtgaataagtaatagcattaaacgtggcatatatgctaatctgatgtggtttgatttgacgtaagcagtccactggcattagattgacctgcatgcttaaaaattaaacccatacattacataaatttgttttctgtaaaagaattttgttgtacatctaacccaatttaattgaacatttacttaaccccacctgtcaaatgaattaggccaccggaattgagacccgacctaattacttcggcagaatgcattgtttacctatgccttttaatcatattaattaaaatttgggttatttaactgtatatatctatggtcatcaatttcttcatagaaaacagaaataaatggattaattatcttgattaagggcatgctttgaatttaagtttacaaatttaagtatagccaaacttaaagtctacaaaattattttaagttctgtttctctaaaattgagttagaagacaaaattttactcaaacttatttttgagaaataattaaacatgattttaaactacttttacttttttttaagcaaaactaatttcaataaaaaaacctga

SEQ ID NO: 1203 - DNA, 1169 bp, Glycine max
  Soy_ogl_1810 Gm06:6676632..6677800 Cluster 5
ttcacataaatcaaaacaaatttaagttcataatttaaataataaatttaacacaataatctttaaacacaaatgcaaaataatataaaagtgtgtaaaattatataaagtagccaagtgagaaatgtatgataactcatgaagattgaccctaagtccgtccgtatctaacggctaacgtgaccatgagaaagtggtggagtatttgaagtactttatatcaaaattcattttaatgataaaataagtgtttaatttaattttataaattatataatgcttgaaaaatatattatttatgatataaatttattaaacaataatgcttatattaacaacattatgtgatttgtttcagtgaaaataaaaagttaagcaataaacatatttattggacatgttcttattatgagttaaatttctaaaataaaaaggattcatttttaattttagttctcatactttagtttatgagtaactttaatctttctaatcgtacacgtttattttttaaattttcaaattgtttaaatctagttctcactctaaaattttattaaataattaataaaatataaaaataatttgatatttcattaattaaaaataaaaatgtccttccttatatttctttattttatttaattttttgtttagttatataattaaatgctggcaatttaaaataggataaaattcacatataagctaaagtataagcacgacgattgtaatcatggaaaaaaaaatcatagttgtttgtataagtaaaaaaataaaaatagaaatgagttatagagtgagataacttacctgaagtagtaatataaggcgcaacttgtgccttttaaaaaaataataataagatgcaatttaattatataaattcgtataaattcaaatatatgagtcaaaactgaagtaaaataattttacacacgtttgtagtagtatatatatttataaatttgatatatatttagttttgatttttttaaaatttaaaaatctttcaatatacaagagtaaaattataaattgtcgtttacgtaccaagatggtacgttactatttactagccgactataatgattcatgatatatttataattttggtagttatattttacatgaataatatgattatttaaatggtgtggccacaagct

SEQ ID NO: 1204 - DNA, 2493 bp, Glycine max
  Soy_ogl_4227 Gm13:23567408..23569900 Cluster 5
cctttatcctttaccttagttattggccacaaccaatatctaaattttgtaaggtttataaaatttctctcctcctttataaaattcataaaaatggttcgttttcccccgttgatttctttttgatgatgtttatcctcttgtttgtgtgatgttaaatatgacgaagatctattccttttataagattctattttatcttcttatgtaattatactattattagtacctgtgaaacgcatggggacatggagatatacaaaatttattgataagctttataaatattatattaagtaattattgatgtgagtgtcataagcattgtaggtatatattaaaattatttactctcgtgaattaagtgaatattttcctgaaaaaaatcttcatgtgttttattttatatataattatattaaattattacaacaattattttttaaaaatataaaaagctataatagaatatatttctttcaaaaaattgaatttgtaggtgatttaagttaataaaaaaatattataagttaagtctaaattcttcttaatactttaatgaaaatgttcatttctattataatttttttatattaatttgatgttaatgtgaatttaggtaaaattgttcgtacccattaaattctcaataataacataaattatttaaatcataaaagagaaaagaaataaaaaatgtttgaattacaattattataataatgaattaaacaacattattttaccttaataatttagatatttatgtgattttaagtaaattgtttgtccatgtgaattattttaaaaattgtctacttgttttcatgaaaggttgaaaatgatctccttatattatatttcatatataattcctattcaaataaactatttatttaaggaagatgataatagataaaaataaataacaatttatcaagaataaattttagacactaattttgcatgataaagataatagtgatcacatagactgaatttggcttttgttatttaattaaagatatactaattacattaaaatatttggtaaaaaaattattcccgtgaaatgagaaagaaatattgtattaataaaaaaaaaagttaaaatatgtccaaggacaatgcgatgatttgcattatccattttctccatcacatcaagtgtaagcttcattcttaatatttattatttctcagatgtgttatattttatattcaattactacaataataattaaaaaaaaataaaactataatagagtatattttctttccataaatttgaattttaagtgatttaaggtaaaaaaatcctataagttaagtttaaaattttcttcatattttaatgaaaatattcattcccattatttatattttattttataataattagatgttcatgtaaatttaggtaaaattgttcatacccatgaaattactcaataataaattatttaaaacataaaagagaaggcaacaaaaaatatttgaattaaaaatattataacactgaattaaaaatacaatttaaccgtaattatttagatatgtatataatttcaagtaaattgtttgttccggtgaattaagtgaaaatttttctacttttatgaaagaaagcaaatatccacatgttacattttatctgaaatttatattttagtaaattggtctatgcatacaaatgtataaaataaaattaatttttgtccacataaaacaaaatattgaataatttatttaagttagatgaaaataaataaaaaataaataaaaagtttattctatcaagataatgaaaaataaatgagataataaataaattataacggattatatattcttctcagaagttcaaattttaaggtgatttaagataaaagaaaaaaagttatacatctgtgtataacatagatttgcatttgttcagccaccaagagttcgatgtaggaaccttaataatggattagttagaaaaacttcataaataacgtataaattatatatatagtgttcaattaccaaaattatcaacgaattttttatgccgaggcaacaatgatatttttgtataaaaaaatgacataaaagaaaaaaaatcaaaagatagtttttggatacacaattataactaaaatttaaagttcaattcttaatttttgggtgtgaagtgataactaaatgtattattttatctcaaaaatagacccaatcttgagagagattacaccttccctacataccctattttctctaaaagaaaatataacgtgctaataacaaacatcctaattaaaaatatttgtacaacattaaaaagtaagtattaaatatttaaatgctttaataataaaaaaatatttagatgttttattaaatgttcatatttattttcagtacaatatctatcactaaatacttttcattagaaaaattttcaaccattattatcattttctaaaaagtatgagaaccccttaatta

SEQ ID NO: 1205 - DNA, 1254 bp, Glycine max
  Soy_ogl_905 Gm03:36507987..36509240 Cluster 5
aatgtgaataaatggttcgccaaaatacaaagattatttaaccttgcaaatacaaatttggtgtttagtggttgcaaatttggctttaatgcttcatatagaagattctctttaaaaatatatttgttctatagtaggtcatgatctagctagttaacgtctaattaaatttattaatgttgactacggaacggtcatatgaatacattaatttaataaataaagtataaaatggaaaataaataaaattaacacttgattttgtacagttgttattttaatactttctttattttaaattatttaaggtaatacgtgcatcttaaaacaattattaaatataccaattataatgataaactgactttcttgaaccaaaatgtccataacaaagatttttttttttcgtttaccatgttataagttcaaagtaatgttatatagtcttgataaaagagatatgagtttagtttcatcagaatgtaatataatgttggtcttaacaaaagagtttgatcagaataaaaaaaaaacaaaaagagtttacatacagttttataaattagtttaaattcttaaatcacatataattccaaatgaaacgagaatgatttgagttgcattttagattattttaaatatgagaattcatacttaaaattagataaaacatacatttttattttaaaattgagtcataactttgacttttacagaagttaccaaaataaaattttaaaataattagaaatttgattatagacttaatgatatttgttactttatttaaaatatttataaaattatacgataaatttatgttaataaattaagaaaaggattttaattacgttaagtttaaaagttttggtaatttcaaagggtgaaataaaaaataattcaaattctctacatgtgacaagaaaaaaaatactaactatcaaattctctaataatagatatttttttcttcctagcataatcatgcaatattagctaatcataaaaaaatattaattgtaataaatacttaaagaagtgatattttgtttaaatattatatcagttttctattaaggatttctaatgaattatattatattatatatcatagcatactaaaattaatataatataagataaaataaatttccaaattaaaacatttaattatgatgtaaaattatatattttaaagaaccaaatcatataatataatttgtgcaattgtagtagtacacgggtttaagaatc

SEQ ID NO: 1206 - DNA, 1400 bp, Glycine max
  Soy_ogl_3483 Gm10:40810901..40812300 Cluster 5
aaaaatattacttaaaataacattttaaaaactgttacaaacttcaataaaaaaaaactgttataaactacgaaaaaagtttatttattactcacattactaattaataaaaccaaacaactttttaattaataaataaacttagaaactagtttaaatgatgtgataaaaataacataaatatcatcaatgcagttattaatacatttggatgtttcctctatattcagaagattattgctagctaataagcctttttatatggtccaaacaatcatatgttattcaccacgtggttattactaactagtcgcctgagatgcattttttatgttgacctgtattccagtcttgcaggttatggatggaccaagtccaatccaaaacaaaattcacttttttatgccataatatatgcttactaaatcattttcacacttatcttataggttcaattattaagatgtataattcagttgattgaaaagtttgtataaattattataaaatttttggtatttaagtttaattcctataaataaaataaaaaaattcttataggattcaattccctatataaaaagagaatttgtgtcaacttctaattaacatcttaccaaataaaatgtaaaggagatatttatttatttgagaggaacgaaagaataaacaaggcatattaacaagctcaaaattaaggattggcaggagacctaatttgatgtaagatcatactgtgtccgtatgtaagaaatgattaatttattgaaataatttgtatttgatttattttgtgtgtaattttttttaagttaatgacaataataaattactagtggaattagtcttccatcacgtggattcaagaacatatctttaacctaagattttttttttaaaaaaaaagcattttaacttataactattgaaatacagtattatttaagttagtaaaaaaaaaactttataggctctctcacttatcaaacatattcaataaaaaaataagaaaataaatagtttaatcgatttcggattattttcgttgcgtgacagaccactccattttttgtaataataatgttctacttttattttacttattactgcagaggtgaaaaaactaaaaaataccttttttttcctttaggaaaaaaaaggcatgtcaagtactaaacaatgcaaaatttgctagacacgccacagattccaaggtaattttgtcccttgtttgtatgaaatcttggaaaaaaattattatcaaatcacaaattattataaatgataattttaatttattgatctgataaatttaaaatcttatttttagtccataaatttagatagtgttttagaaattaaccaaaaacaagattttaaatttatcaacaaccaaaaat

SEQ ID NO: 1207 - DNA, 1000 bp, Glycine max
  Soy_ogl_3128 Gm09:36486801..36487800 Cluster 5
tatgcatcccaccatttcatgcatgagtggccaccaaatcatcaattgatcactcactctctacactctgggcaaaacaaggcaccaaatttgctgatcagagaggcaaatacaaagaaactcttgctcatttcactactttattgaggacaattcctgttaattaaatatcaacccagtcatttagggcatcttggtggttagattaggatagttattttattcgattttgttgtaatcaattattttatatattaataagatatgatttcttatctcattgcttatcctaaagaagtttttttaggagctcacctaaagaagttattcttatatgatatgtggctttacaaacaaatatacatatataaaataacaaagtatatataataaaaaaatatttaaataataattataaattaaaattttatatagtttaaagaaaagtagttacataaatttaaaaaatgtgtaatttagttaaaattatatatttttataatttgtaaaaattaaaatttaaactaaagtcattttaatttaagaaaattatatgtaacttaaatgaaagagtaattttgtcatttgatcacattttatattttatcttatcattatatgattggtatcatatgtgagataagtgaataatacaatattattattccctttcttcttaaatatatgatttctttttcaatttcgtttgtctttttctataagattattttcaagttattttttatattaattattttttgactcaaatatccttgattattttataataaattttatgtattaaaatataaattttatgtattaattaattaggtgagaaatcaattaagtgaaagagagaaatcacgagcccaaaaattttaagaataattttggtaaattaatataaattattaataaatttaatattactaatttatattaattaattttctttaaaatgtgaattagtcataacagtgttatatattaaaagaga

SEQ ID NO: 1208 - DNA, 1600 bp, Glycine max
  Soy_ogl_346 Gm02:3360001..3361600 Cluster 5
agagattttaaaaagagtcattgataaacctgaattaggtattttttttaacaagactattctaagctaactggagtagaagtagatcgggctatccatcgaaaagtctctatctcaatttatttgaagtttggtctgattcaactcatttaacaaaaaaaatcaagtcaaaccttaaaaagcatatttaattaaatatgtctcatcataagttttaacaaaatatattaaacctaatatgtcaacttgtttaacaataatattttagatattttatttaaattacaacattgaaataagaatagaatcatattcaagaagcattcagtagtaatactggtgacctaaaaaataaactgatcataattaacatatctagatttgagttattaaattataaaataagtcaattacaaagtggatcaagttagacttaaataaggtccgatcgaattcattttcattcctattaattaagaataaaaaattaatctctcaataaagatttatttatgaaactaacttttttcaataaatatttttatatatataaacatggagatagaatctctaatatttaaggaacatatttatcataaaaaaatatatcagtttatgttaattagtaaaaaagacacttgagttttcaattatcaaccttcatcaataacaatcttatttgctaaaagaaaaaaaagacagatgttaacaaaagtaaaagataattactaaagaaagaaacattgtatcaaaaatgtaaatgtcatttactatttattataaaaggcagatgttaacaaaagtaaaagataattactaaagaaagacacattgtattaaaaatataaatgtcatttactatttattattttcagttgttaaaatgatgtatttcgtatgttttaatctatatctttaagataatgattaaagaaaagcatatggggtttagcacctctccaaaaccagcctttcatctttagttttgcacaccagaaattttgacaaagtcttttacttttgagttggaaacttgttatataagttaaataaaagttaaaaaaaaagtagttccctaccagtcaatttttggaaggcatgtcaattattacacaattagaacgtgcatttaaggtaaggtaacaatcccaaagtatgcagggagggtaccacaccttggttgcttctgatagagtttcagttttcaactcttttccttaaagaatgtggataccattacggtagaaatccaatgaatctcaggagaaaaagatatatttttctcaacaagtatgttttctttacattggaaatctgacaactaaagaaaaaaaaaagtagtgccttagtgacgatttttataatatattttaaggtgtttatggattgaattcactcaatggtgataataatttaaatcaacttgaaatgatttaactatttagtttatttaacttgaaactcaaactaactgttcttatatttttccttttataacccaaatcaacttatcttttttttaacctttgaaatccatatagtttaacctttagtatttagatccttcttatatttttttccatttattttaaaattctta

SEQ ID NO: 1209 - DNA, 1633 bp, Glycine max
  Soy_ogl_1544 Gm05:2168369..2170001 Cluster 5
ttgataataattaccttaaaaattatattaataataatttttatttgttgacagtaaaaaaatttatactgagaatagccattaaactcaaaccttgtacggttgaacctttgataaaattgcattctggttttaatttattgaggtgctcgttaggttcaccaaaaaaaatatgtgctggtcttcacaataaagaaaataaaaattatgaaaaaaaaggtttaaaatcttgcttctttcattttttatttttcctttcaacaagtaatatatttttttaaaaaaaaaatatttcctctctatcattattgtttttattattaatgttttcaaaccatacagacctcatcttttaaaaaggcaacatattatattcacctgaaagacaaaaaataaggaaatttattgtcatcttaaaaaatgactaaggaaagacaatctatataagaaaaagttttaaatagacatgaatgatataattaattcttaatattataatttttttgtttaaggcttaaatattttttagtcttttaaatttgagtagctatttttaatccttgaaaaaaatctatttttattagtccctcaaatttttaaaaaaattacttttaatccctatttgatcatcgtatttatagttttataatctataatgatttttaaccatcacaatttgtttttaatttaatttttaaaaatatcttctgatgatttgaaaccaaaataaagaaaaaaacatgaatgtaaatttgttgcagttttttatttaaatttacaaattttaacaattttataccatcataaatcaattaaagaaattaaattttaaatgatttatgatggtaaaaaaactgtttcaaattatgatactattaatgcaataaaaaaggaaataaaatcatttttcattaattaaatctattttagttgttttaaatttgaaatttttaaatattcttgtcgttaatatttttaatattgattttataaccattaaaataatttacactacatttcaattttatatttttgataatcaataaaatgattttaggaggtttgtaacatatttcccctcacttggtgatttgttaaactacttttcaagagtcataaattattttccttataaatatcaactaccacaattaataattttgattcaccttacaaaagtattgattttctctaatttcgctttatgtaatttaaaaagtatttttttatttcctctaattttcttctcacttttcttaattatatcattaaaataagatttaaatatgcttttagttttgagattttattttttttagttcttcaaattaatgtttacattttttagtcctttaaacataagaaatgttatttttaatctttttgtctaaatatcaataacattgtcaaacaaagaatgttaaattcataatttgtagcgatttttatcggtgaaaatttaattttataatttaaattttaatatttaatttctaaccaccacaaattaaaaataaaaatcaaatcccccaaaatctccacctaacaactccgctaggatctccacccaagaagctcttggcaaggaaatcatcaaatactactttcaaggtacatgctttagtatttatca

SEQ ID NO: 1210 - DNA, 1944 bp, Glycine max
  Soy_ogl_3646 Gm10:49164201..49166144 Cluster 5
aataaaattaaaacaaaattaaagtatatagattgaaatagataagcaagttagagtgatttgaaaatgtcgacaattttttaactaattgttaaataaaattaaatttttttaaaaaaaatatttcttagatcaaataatatataggcttaaatatatttttgttatatgagatatataatttttttagatttttatttatttaatatttttttatctaacgtttttaatttgttgactttgatacatgccattaatatgagaccgttaagtgacgtgtacccgaaataacactattacttttcacatcatcccttttaatttcacgtatttaataatatttaacaaatacactaagtttaacgtatgagatttagataagacgggcatctcaatgagaccaataacattgtaaaacactttaaaaaatgctttcatttaagaaaaatactaagttttaaaaaaaaaaatactaaaaatctcatgttgattaataatagccgtttaaaaaactctttgttgaatattcttattcctattcatataaaaaacaaatattttaaatttatgtacagtcatttaaattatgatataaggttattttgaattacttacgaacaaattctaaaaaaaactattacaattgcagtgggatcaattcattaaaattcataaatttttaaatttatattattgttgttcttataaaatagttattatgactgtattatgaccttaaaatttaaattcaaatcgaatccttttaattttacaataacaaatgtgattatcttttaaacatcctttttataattataatttttttatgagaaaatgttagttattagtttacttagtttttacttactcgtgaagaattcaaactaataacctcatgctataattataatattaatttagaaaattttgaatttaattaaatatttttatattaattcactcattgaatttccaccaaaaaaaattactcatcgaaaattataataattttttaatttatcttatcaaatgattatatatatagaaatactgataaaatataatcttcaccaatcaccagtaataataaaaaatatattctattatacacaagtttcttaaaatagaaaacttttaccactggtttaacaattgtgtgtttttcttgtatatttatacttatattttaaaaaatcatcttaattgaaaatgctcatataatatatgagaagtttttagtgtacaataacggctatgaaaattgaacattaatgctcatgctcacgcatctatcccaattcctcaccacttgctaatactagtggtcatacgtgctactgttatttaaaaatagacattttttttttagtgtacgtgtgtgtttctctcatcgtgtatgtgtgtttttcttacatacgtgtgcccgtgtctctttttttctcattatgtgtgtgtttgttattttgtgtgtgcatatttttctcactacgcttgtctgtgtatatttctttctttcttttttatgaagagggggaaaatattttttcttattatatgtgagtccgtgtgtaaatacgtggatttttcttatttgtttggtgtgtgtttttttattgtatgtgtgagtacgtatttgtatattttataatttacgctctatatacaatacaactatggtgcatgtgtgggtgtagctgtggtgcacgtgtgcacatgtttttcctttctttcttattataacgtatgaatgtgagtattttgtaatctataatgatgtgtaccaacattacatcataaaaaaaaagatttatgttaaattataattttgatttctagttttataaattagtgattttagttattttgatagattattaaaaaataaattttgattaattgagttatcaagttaattataaatcaactaaaatcattagttattaa

SEQ ID NO: 1211 - DNA, 1915 bp, Glycine max
  Soy_ogl_2949 Gm09:2430086..2432000 Cluster 5
tttatttgtactcaaaaggaaaaaaatagttaggaaggaagatattaaaaaacattattttttgaaaaaagaagagttattgggagttctttccctacaacctaacttttagaatgaaaatctctcaagtaagaatagtaaaagatccagtagacaaaagttcttgagttcaaaatttcctatgaaaaatgttcttaaaggtgcttgttttaatgaattttgaattctcaaaaatgttattcttaagaatattatagatatttttgggtatttctagaaaacaaaaaatttgattgaccattgagaagctttttttatatcctttgaatttttttaaaccaaaattcttggaaatatttcaaatatatgtttggttctcattattttttccctaagaatatatattatatttgtaaaatattatttacgtgttaaaaaaattatcacgttacatatcaacaatcaactataccatgaattaatcatgcatgacgtcaaaattgtgcatcatttagacatacatatatgaaattaaaatcaaacttaaaacacaattaaagatattttgcacattgtacaatttccacctaaaggatagaaaacaaaccgaaaaacatcatagaggaagatgtaaagtgaaattttgatttacatgagcaaaatatatagcgtagtgggaattatagaactggtcggtaaataaagaagtagtaggatagtgaatattagtagtgatgatatattagctagtatttttacacaataaatcacattcctaccacacaggaatccacgttctcatcctagctcattccatgggaatcaaattaattaaaaaaacacacacaaaatgagcatcagcatgagaatctcattttgctgggaataaaacatgtccaagaatcctttttgactatattataacaaacatggaaaaacatatttttatctccatgtttaatggtagtctaacaagattccataaaacaaatgtacttttagcatgtgaaaatatgtgagaaatggggtgtgatttaatacatccttcaatgagtggaacaagaaaaaataaaagatgacattttttgttcttagtgatgtagatctcacgtgaacacacacagtatgtttgatttagggtaattaatatttattatggatatttatgaaaattgaatttctacttttaattgataatttagaggttaaatatttatattcagattattttttattactgtaataaatatgcatgtgaaataaataaaaaatactaagatagtcaatatttaatatttattatggatatatatgaggattagataattatgcgtgattatcgttgaacaaaaaaaaattacacacgaaaaaaatatttaaatattaagatagtaaaaattactaagatagtcaatatttaatatttaatactaagataacctttttgaaatctttaaaagatgatgtttatatatttatataaaataattttatttatatatagtcttcgtaaaaatgttaaaatttttttgactctatggcctatataaataaattcaacaagggggacaaattgtatatttgtatttgagttcaaatctatatctgtcgatgtattatgattattacaaacaatttgaaataaattcatttctcttatgaaaggagaataaataaaaaataattattaatgatactcaacgtttattacaggtacgtctaacggttgaatttctatttttaagtgataattcaaaaattaagtatttttttttttgggtagagtgagataagtaaacaaaaacaaactaaaacaaaatacaattgaggcctaaaaattgcaatccacatggcattagccaaaatttcaactctgtcggaggctgctacaagtcaacacgtgttactccagaat

SEQ ID NO: 1212 - DNA, 1364 bp, Glycine max
  Soy_ogl_4959 Gm15:9542037..9543400 Cluster 5
caacattcattttcaaaatgtatgcaaaatatataaattagttataaattataatctaaccaattattatcatagaagcctaactttaaaaaaatcttcctttaaaaaaaaacatctcttgtgcatattctaaagactagtatttaatacagaaagtactcaaagtatttaataacaatgtgaattattaaatgtaattttaaaaaacaaatctcgtaattattgtctaatattaactatcgaatagacttctccagtaaaaaaaatatcaaatagaaatatttttataaaatatatttatacttaaaatatctaattttttaattactaaggaatatatataatgatatattttaacactattttgcattaaaacacacacacacacatactattgtgacaaaatattttttgtcttttttatagcaaaaatatttttatttctataactgtatatatattataaataaaataaattatactttagatttacaatttataatttaagttgaggcataagattatttgtaattatttacaaattttaaaaactattaaatttcgatttagtgaaaaagaaatacaacagagttgattaaaaggaatatgcaaacatgcagttgagaaaatcattcattattctccctctgccataataagtgtcaagttaaaagaaaaaataaattctaaaataagtatcattttaaaattttgaaagtaatattagttatttcttccatttataaccctaataatatatattttagaatgtttgtgtggtttatctattatttatagcaaagaacaataaggttaatttcctaaaattattatactattccatttattaattaatataatttttcttgatttatgtaacaaaacctaagacacttcacatgaaaaatatataaaaaaaacctaatacacttattataagagagaaagtaaatatgtacaaataaaaaaaatagttatatataattgagagaaattgttttgctaattatgataatagtgcgtgaaatgtacatccaaagtagataaaagagtaaatatttaaaatgtttaaataattgaaaaagtaagaggaatagaagttttacaactcaaagttttaagtaaattgttatcatctttatttaacttcttcaatgaatgagtttcacccttctattatgagatttaaattatttaatttttcattttaattaactgttttttagttttaattattttttcattttcttataataatcattattactctattcaattttttttaacgtgaaataacttcttaagtcaacaaattttaccactatatctattggttatgtggtactttttagtttttttggctt

SEQ ID NO: 1213 - DNA, 1217 bp, Glycine max
  Soy_ogl_5749 Gm17:37661084..37662300 Cluster 5
tacttattttacagaaatatattattttacagccaatttattattccgatcttttgatggtctatttgactcaatttcaaatattttttgatattccaaccaaacaaaataaagagaacgaaactccaaaaaggaaatgcgtgaaatgatcgacgtagcatcaaataaaaggatgaaataatcgtcgcctcaagaaatggtatgatacgtcattgctgtttcttaaattttctttggctgttgggttccattcaagaaggaaattaaagtatagcaatcctatggcaagggatggggcaaaaattcagaaaatccagcaaataatatttcaaacaattattaacaagtatatataaattcaatatattcaactaaaatggttgttaaattagtataatgttttattacgttcacatgagtaagcataatcgatatagtccgttcaacagaaaaattaatgtgtaaaattcctttgagtttatgagagtcacatgttgcaagaggaattaataaatctcttaatacgggtttcaattcctatggaataaaaacaaatccatacattgtaaatgtatatgtaaatatatatttataatataaaaattaatttaattcctataaaattgttattttattgataataaaaaatcaaattaaaatataagcatattatcatttaaatttttatttttaaaaaataaaagctagtttatttaatagatactgctttttttagtaatttattaatatattattattaataataatatttatatttttatagtttaaatattattagagaaattaagtaaagtaataattttcttttgaataaataattaattaataaatatcttaatatagtcttcaattcctatggaataaaaaaaatccatacattgtaaatgtatatttaaatatatataaaatataaaattaacttaattcatataaattttttatttattgataataaaaaataaaattaaaatataagcatattataattaaaattttgtattttaaaaaaaattaaaagctattttaattaataggatactgttttgttagtaatttataaatatattattattaataataatatttatattttatagtttaattattaattagaaaaattaagtaaagtaatcatttctgttgtataagtaattaattaaaaactttaatttgatataaaaaaatcaaaaaccaat

SEQ ID NO: 1214 - DNA, 1169 bp, Glycine max
  Soy_ogl_16 Gm01:11101..1262569 Cluster 5
ataaaaatattttaagatattttattagaataaaaaataaaagagatcttaaaagtaacatgacactctcagttatccataaaaaaagtgactaagatctctaaattaaaaagatgttagtgattttatttttgtctaatacttaatataaatgttgccaaaaaaatttagtaacatttaaaaatatcattaaacacaaataattgttactaatacgtttttgtgatattttattaaatattaggtataattcatgttgttaaaacctatcatgttatatactatatataacatttgataaaatgttaaaaaaaatattagtaatatttatttatttttgacaatatttttttaaatattattaaaataatttaacagcatttttattaaatgttaaacgttaaactttgttaaagatcatatagtaatgacataacataaatatttatttttatattattaaatttataactaataattactttttgaaaatataaactttaatataattaaagattttttagagcaacatatacccacaacttgcagccatgagactaataattcattgaggcatagaaagagaaaactaatatacaaaatatacgaccaaaaaaaagagaaaactaataatttattcaccgaagataatcttattcgagttggattggattaacgtagttcaaaattaattttatattaattacaaaattaatatacaaaatatacgaccaaaagaaagaggaaaaaatgttaaaaagtatctaattaaaaatgaagagagccaaaatcctgctcttcaaattatatactccggaggtagtattataattgcttttacagaaaaagcattacttcatttcattcataataatagaaaagatacaagtaggtataagtgcttttacagaaaaagcattacttcatttcattcataataatataaaagatacaagtaggtataagattaaaaatatggctggaagcatataatcttgattctcttgctaaagcatgatcgacatgacttctctatctccttataaaattcacctctgctgagttattaaagtttgagaggagctaagagagtattatactatgtatcaaacaaatattatattttatactactatattataatttaggttttttttttccatatatac

SEQ ID NO: 1215 - DNA, 1625 bp, Glycine max
  Soy_ogl_3771 Gm11:6547701..6549325 Cluster 5
cacaacattaatcagctggcattatattaaatctctgtcagccaccaaacttaatcaagctcatcatcacattaatcacgacacctaggactacttgtacattggaggggatagatagattgaatttattttgaggagaatagttatttaatctaaatttatcttttttcttattttattatctaatcgatatttatttatttttaattcaaagtcgccaattcaattaagatctaaaaaaatggccaatccaattcagttttcagttttttatttaatcttttaagaatcaccaaataagccttgtaatacatatataataagtattaaatatctcgcctgattagtaaattgttgcaacttgcaagcctaaaagtaatatatacccagtgcatgactttaattaatatatattaatgtcaagcaattgctttcaattagtactattaatttgaaatttaatttttaaggaaaccttttctagaatggtaaaatttattttaatttgttgcaaatgacaaatattttgtccgtatatttctaattcaaaatctaattggaaaattcaacaaaatcaaacaagataaataaaccatttttagattattttttttagtccttttttattttaatttctttgttaattaattctcttaatattaaaataaaaaaaatagttttactgttaatttatttctactcaaaaatctcaaattttcaattttatatttatgttcacaggtcttggttaaattattttaaaccatattctatttaaacatcaacaactaaaacatcaaatttcacttttaaaaaaacttattcaaactttaatatcactatttcgcatattacgaaatcttttatctcaaaattcattataaaatctcaaatatttttattgaaactaataaatttaaaatattaggtagaagaaagttgagtttattagtacttgatattaaaaataaaagaatttaatttactaaaaaaagtagaaagcgacaattaagagtataggcacaccgacgaaaagtataattaaacttttgcattatagaattccaactcaaattgacaagtaacaacgtatgcgaacaagaaagaattcatgagttctgcattcaatgaattagagtgtatattaactaacgcgtacttaatgaaaaattgaaaaaagacaactgctgggaagtttttctagtcaaaacattttatttgagaaattaatcttacaataataatatcccaagaaatgctctggtcaaagataacaataataaatattttgttatcaataaatgttaatttctttttaaccgataaatattaattattcgtttgttgtcatatttaataatgattaaagaaatttaagcattgagtaaatatagtttaaatagttggtttattagaagaaaattgatattgatttcattttattcaatcatgttaatttgtaaataaacgagttgggtagaattagtcttcgaagtaaatagacatagacttatgaaatactaattcttacaatgacatgcggttgataggtcataggttagcccttttttctaaattaaatagattattatttaattattttaaagaaatctgattttttaatg

SEQ ID NO: 1216 - DNA, 1476 bp, Glycine max
  Soy_ogl_4538 Gm13:38501..38118076 Cluster 5
acaacaacaactgtcgtcaataattttgtttttgttttcttatctggattcccttattatgtaagtttttgactgattaaatttttagtggttgtttgtgttactttatagtgatagtcttggaagtaataataaaggcatattcttgacatgaggctaattagtaaactttattatttgttgttgtctatataatcataaaggagcggttagtttaattattagtatggcctttcactgatttttttcacactaaggttaacagattttttttttatgcattggaaaggaaaaaaaaaaacaagatcaccctacactactgttaacagattgattattatacaataattaaaatctcttttttttcacaacacaagctttccctttatttttttattactttttttaaactatcaaataatttttttcagctgtttgttttcattttttttaatttgaactgtttttttcatgtttaaagaaatccatatcagtgttgggttgaatttcattaattttaaaagtgtcgggatttgatttggacaattaaaatcgcccattcaataaattatagaaactaaaaacttaattaaaattaaaaaaatattaatctctaaaaatttctgtattatttgacaatttttaattacttcttttaattatttttcttctttaactaagttcttaaatttgtatttatttttaattaggttcttgtagggaactagatcccttaaaaatatatatatatataagttcaacaattcaattgaaaataaaaataaaaaaaatttaaggacctatttaaaaattaccataatttaggaacctaattaatcaagtaattgtcaaacgtctataagccaatattttcactccgcatgtcagtattctcacgaatgcagctttgtaggttctaaagtcagtattctcaacctacaaggtgagaatactatcatagaaagatttggaaatttttaattaactatttatcatttcgaaatagtttcccaaactatttttttaattgagttactaattacaaaataaatacaaatttagggattaattaaaaacactgtttatgaatctaattaaaaattatcaaataatttaggaacctaaaaacttaatttaacaaaattattaataacggtaaatttattatttattttttctggaaggctatggtaaattttttatactgacaaaaaaaatgtgaatcatatcaattttgataaaataaaacctcacaaataattataaacaaattactaaaattcaagataaatgttattatatttttcattaaaaaattatattaatttcagtattccgatatatgaattatttgatgatatattttcatatttttattaaaatttataatatttaattcttcaaacttatgtaatgacgtgataagtgacaacacatcaaaacatagaacataaaatgtgcaacaataactcatgt

SEQ ID NO: 1217 - DNA, 1353 bp, Glycine max
  Soy_ogl_3703 Gm11:3638948..3640300 Cluster 5
agtaaaaaatattttagagtaaaagttaaggcatccatttacaactaataaacaagttaagcgactattcctatagcatatattaaattattacattatcctttgctttcatgcgtatcgaagaactatataggttttctttaattttatgcatcgataatagaacaattaacaagagcacacaaaaaaatagaacaattaacaatataaaaagttattaaaaatgtcaatatcaatccttaaattaattttaaacgtttaaaattgacattttttattaaaaatatattatattgaaaatataaaatataataaatactttctttctcaataaaattatatcacttttatatatttaaaaccagtcctatgttaaaaagatttgttgaaatgtgaagcttgagttctataagaaaatgtattgagatggatttacgttaagcatgagaagagtatagttaaaaggatttgaatcggactcaattcctctgtgttcgtgtaaactttggtttctcttttatttgtatgaggtgagattttatagtactctcatactttttgttaaattaataattgaatgattcaatattttttttatacttattttttattcctacaaataaaataaaaaaattgatttgtactttcactatttagtaccattttttagtacttgcacggacttatacttgtttctaagtcgaactcggtctatttttaattataaaattatttttaaaaatttatttgtcttttttataagattttttgtaatttttaaatgtattgattttttttacatacctttacttaaaatttttttccaaacattaatgagaaataagtggatagaaagagaaaaaaaatgaataaatttaaatttatagtataaataattgatagatttaatataataattacttttgttatgaattaattaaaagagtcttattataattaaagatgaatgaaataattaagcttcaacgggcttaagtttgtacatttttttaactatccgtgtttgtatttctcaagtctcatttgctcattttttttttcaccttttatttgtttttggattggtaggaattgttataatattagaagtctaatatcatattataattgtcgcaatatcccaatacaaaataaatgtggattaggctgaattttgttaggtacttaaataatagtaatgttgaaaaatctgcctttttaagaaattgtacagttctccacttctccaacgctaaccgaaaattattatatgaatgttatgcgccattttgcagtctcgatgatttctttctttttttaataacagtctttcaatatgaactactaaaacat

SEQ ID NO: 1218 - DNA, 1700 bp, Glycine max
  Soy_ogl_219 Gm01:49101901..49103600 Cluster 5
atatcaaatgataatctaacctcaataattaaattaaaattgttatttatctatttcattagtataatttttaggtaaatgctgaccagagtctattaaggtacttactaaataatcgaaagaagaatttttttttattattattgaaatactcgtcattttcctatgatttttataataaataatattttatttttacttttttaactaatgctctatggacacactggttatccaccctaatttttaatactattcgtatatttttaatgtcatttaaacaattactgctatcattgaatttttaactaatgttctcgtaagacattggtaaacaagtttttcttgtatgcctactgtatatgatctaaaagtattagatatattttgttaaatattttaaattgttaaaaaaattaaattaccttctatatttttaataaaatattttattcttgtttttttattgtgtgtttatgggtatcctgttgaaaagtccaaattcaaattaagaaataaacattaaatatatccttttgaattcttttagttagttaataaaaataagttttaaatgattattatattttcaataacaaaaaatactagtattttactaataatcttttttgttctcctaaccgagtgcaaaggacaaaatgttaaaactatattgaacttcagtgttgatttaaaataaattttttattatatttaaaatattaaattttaataaataatttatttccaataataaaatgtttttcattttccttaaaatcaaaactatagaccaatatttacaaaaccatagaaaattgatatatgcatgctaaaaaagtatccatttagtatatactggtactttaaagagtatttaatacaaacaactaatattttaatttttaaaataaatattaaatattttaaacttttaatacaataaatacattttttttctaatagaactgaatgcactattataaatgaatggccaaagtatttaatacaaaccattaaatattttcaattattaaaaataaatatttcagtaaatagttttttttttaattttaatacaataaatacatttttaatccttataatttaatgttgttttacttttcgtacttacaaaattagttacttttttccttataaactatattattttatttttaatctttaaaatattttagataatattttaaacagtaaaaaaatatttaaaatagtataaggacaaaaataaattataataactaaaaacaacaaaaaataattttgcaagaacgaagagtaaaaaatactaaattccaatgaaaaaaatatatttaagctttatttttataactatcatttgcttacatacgagaaacttatgaaatcatactctcgtaaaagaaaataatactaattacattataattttttttctctttaattaatgtcttaagattaagaaattaaaatgagaaaatatttattaaataaattttaagagaacaaaaaaaagtatgagcaacataaaccaataaaagcctttttacttgatattttctaaaccaagtatacttagactactgtttaacatttataaaaataaaattatccctaagaatcaaatacttgaaaatttaccacaactcatagatttgctcaaccaaccacattatacccgttgctataaatgaatagtg

SEQ ID NO: 1219 - DNA, 2260 bp, Glycine max
  Soy_ogl_1164 Gm04:1620001..1622260 Cluster 5
tatttgaatttgagactttactaaaaaaatagaattcaatttcaaatgtttaaaatactttaattatttttaattgtttattttttaactcccatcggaaaaaagttatttattacttgttaacgttttatattcgctactcttcggaatattgtcaaaccatacacgactgcatgaggtcatgctctcatgaattagtttgtgagtagtttttaaaaattaaataagaatatgtgccccaaaagataattgtttcctattcatactttccacttgtcccaaacatagtgatgaaaatgactgaaaataaaatatcagaaagcaacatattttagtattggaaattagaaaccaaccttaaaaaatcatgtgatcgagatattttcaaatgcttcctaaatcctttttttttttagaagttcctaaagagaagctaaaaaaaatatgagttacgataattcttaaatgcgtaggatatttttatcgctttatctaatgcaagtctatattttttttattaacaaaggttaattatcagtattgttagttttttataaggaaaaaatttagatttatgatctctttttctctccttcttttcattttttggttaccactaaattaacattatatctttatgcaaatctgtacatatttgattatgatgtattaaatatttatattttatttttgaaatgttaactaatttcacagtaaatgtttttttcttcaaattttttttttttcaatctcacagcacattaaaaatacacttttatggcaaaaatcgaaacacgaatacttagggggaaaaagacgattttcaactaacaggcaaatttcttaacttggatgtacacatatttagaggttgaaatgaataattatctcctaataataataatataattaattgtagtctgattaatatattttataatcataattattatgtcaaatattgatatttttagctgagctttatattcttgaaatttgaaacatactaattaggttttttatttttaattatgtatgtgcatttttttttttaaagtcaaccctcttttcaacattttttttaattagccaaaccaacatatttcagccatctattcacttcaaacttgaacgcttaaaaagatgaagtgtttatgaaagtgacaaaaatatcacactggactcagtgcatttaagtagacaactattcaatttcttttaagtacttattataagttatttaaataattggtgaggaaataaaataaaatcatcattttcatttatatttatattgtaagttattttataagttatcttgatgaccttattaaaataaattaaaaataatttataaatataacttatttttataagttctcctaaatatttatatatacatgtaatcatataatgagataaacctaaacaaaatggaatttagctctttcaaatgcgctttaaataaagcagcgaggatgtggataaattgatgtgaagttgtttaaatttaattaataattttgagattgagtattaaatatttagaataagaattttatgaactataataatcataatttatttaagcatctttgattcatgtagatacatgtggttttgtataaaaatgcactttaaataactactactacttttcactgagttgttgtgttaattggtttttatactttttcttggagaaagaaaataaataatagtaaaaagtattaaaataaaagtaattaaaatactattttttttataaaattaacttcttttaatgaagttaaagtattaaaaattatattttatttattgaaataataataataattaatacatacatacatgttcacaattgtaataatatatagtatttttttcataaagaatttagaaacatttacgataaatactaccatgtatgtccttttagaaagaaaatcatatttgagttggatggcaaaactttttatcataaaaaatttaaagattgaaataaaaatcttctataaacatcataaaatctaaattccatacaaatcagagagatagttttatttaaattttcgttgttttatttttattaatatttgtgaaaatatcactttattttaaatatttataaaaaatgataaaaacaaactatttcaccttttccgttacaattaaaaaaaaatcctgtggtcctaggttgttttatacaaatcaataaacatgataaaagaaaataaaagtattacaaaaataacgttat

SEQ ID NO: 1220 - DNA, 2000 bp, Glycine max
  Soy_ogl_5472 Gm17:3311701..3313700 Cluster 5
aataatatcttaaggatacgggtggatttgtttaaacttttttttaaaattaaaataaaaactttttttaataggtagataagatttgcttatcaaaataaacagaaaataatttttttaaaacataagtagtttagacaaacacattaataaaacagaaaactattttttttattaaaataagtattttttttcaaaaaaaaagtttaaacaaactcacctttaattacatcttatgattctaacacactataagttatttgttttggattaatttaaaattattcttttgtgtcatgtttttaatcatttaaaataaaatttatttacagccttttaaccaaaaaaccaaaagaataaataatatatgtattgaccatcatatagtttttttcacaattatttaataatcaccttaaaagtgatataaaaaatatttctaattggttgataacgtaaaaataaattatattcacaatacgtatctaataaacacaaaaaaaaaagtatgaaaatcaaataatccaaaatacttataatcaaattaaatttaattcatatgctcgatattgaattatattagaattgacgttgtatacaatatccattattcttatctaataaggagtttgctagggttaaatataactggcagggttatcatatttttaatccttacaaaatcagctaatttatatttttttttattaactttcaatatctttaaagtaacctaaaatcattgtttgggacagattattttttgagatttcaacagtttgtaaaataagatgtatgttggtgacaatagctgaaatttgcaaaaagcctttttttcttatctgaaaaataagttatgttttttaatctatgatttttttttcttatctgaaaaataagttatgttttttaatctatgattttaaaacttaaggtcaacattttttttcctaaaagacattattcccaaattatcctagattttccaataacttattttcctttcatctttacacataccatttttcataatatactatatatgtaaaatctgatttttgtcattgtctccaagtgaaattaattatcttacaattacttttcaataaatttactcaaacagaatcttataattaattataataataacaataacaataaattatacgtaattaattactaagataatttaattttttaattatttcaaacacatcctcccgttgagtgacaatgttaattgcttagttcttttaacaaaaggttaatttatcatatgttaattacttaggtcttttgacaaaaggttaatttatcatcctaggtggtatccactaattagtgtctatgatgtcatgtcacgtagagtaacaatgttaattgcttaggtctttaacacagggttaatttatcaccctaagtggtattcactagctagtgtttatgatgtcatgtcagcatcagaaaacatataaaatagattgaatggttactgaataagaaaaaagaagaaatgtttcaagtttaattaggaattaacattttaataaactaacattcattgctaaaaaatatcatgtcaccatgtgacacttatatatttttttcttttaaatccataaaacaaatgttatttgtgtaccttaaaataaatattagtgataaaacaatgattttaaattgaaaaaaaaattatagagaccaaaatcaaattttactttttcataagaactgaaaacagtgattttagatggatgaaatattgtaaatcaaagaacaaatttaattttaaaaaaacaaaattaaaactcactcattttaccgggactaaaaatatagcttaaattcaatcaatcccaatttaaattagaacttgattttaagtttttttttacactattagtaaattataaaattcctatatataatatttaaaacacttactataaaaattaataaacttatcacatataataatttataattaaataataatataa

SEQ ID NO: 1221 - DNA, 1600 bp, Glycine max
  Soy_ogl_5770 Gm17:39034201..39035800 Cluster 5
ccattctcatatccatgtaccttaccctacacgtcctataattttaaaaatcaaataccaaaaatataattttaagaaaaaatgaaacaacattgattttctataaaataatgacactaaatatatccaagaaaaaaaggttctattaacaacaataaaagactaattcaataatatatgtagataatttaattattaacatattagatatgggtatgattacggggcgcatatatacatactcatttttgtacccattttttaaaattagatattactcgtagtggtacttatctttgtccaaagcgaaaatttttcatcaaactcaagatacacacaagtacaaatttatttgtcatacgtaatgctggataaacagtagagttttagtaggataatcaatagataataataatatccataataccatacccaaactcatctctatatttgtataggtattaactcacatttatatatccataactaagttcattattttcattttagttattaaactcatctctatattttctataggtattaactcacatttatatatccataactaagttcattattttcattttagttattataatactaacattattaacgatgaaaacattgatggtgaaataaataaatatttaatatgcatttagttattataagtttaattatgtttgacaagatatttttggttagttttttttattaattgaaaaaattatttgagtgttcagtaaataagtacttttagtaatttttagcattttttgaaactacttgaagtaacattttttaaaatgttagcttataacttctaattttttatattttatttcatttttattcttaatatatttatccattttccttattatcatttttaaataaatcaagattttattatttttatgtcattttacactttttaactatttcacaaactagttctactgatcacttataatttaataagctattttttaactttcagatttcaactactaattaacttttcagtttttaactagtttgagataatataacctttaatacatattttatattagtttgagataatataacctttaatacatattttatatttatatgtgcataaccaaactcgtctctatatttgtatagttaaaacattaacgctattataatactaatattaatgatgaaaattaataaaaaaaatgtaattcaaacttcaagggaaaaatattgagaggaaagttaactcctaattataaagtatttatatgaaaatattttatcttaattaaaacctatttaaaagctttaaattatagtaataaaatataaatatgttataaatgtatgactaggattgataatacacatgcaattttttatggataaatacccccacaccaagatctgtccaataagtcttactgttgtaaataatttttatggttagccattatgtctggattcaattaccatccttaatgctatgaagtattaatattttgttttcatgataaaagtttataagtttattaaaaccaataaacatttaattactgaaatatatatttttttttcattttgtatgaaa

SEQ ID NO: 1222 - DNA, 1693 bp, Glycine max
  Soy_ogl_9 Gm01:703901..705593 Cluster 5
aaaataaaattcttgacaatattttgaatccaaggcagaagctatcccacatgtgtttgatttggcattagaaaattgatcatgagtctataattgattttggatatatttttacatgtttggtttcatcatagtgaaaattttaaaattaatcatgagtcaagaattaattcttggttgaagcaactttgagtaattgctttgttgaaatataatatggggctcactattttttaaaattgtcatttttttgaacggaagtagggaaaaagcgagcttagacttaaacttagataccaaatgaaattatatttttatttattaaggatgttcaaatcattttaaatttacatttttttttctttctatcctcttttatttatcttttcctattcaataatctgaaaaatcatctcaattttttttcttttttctctttcacttttgtttctaaaccaaatatacccttaagtatggcccatataatttgactgtcaaattttatcattattcttaagttatgttattcaaataaaatttatatgataacactttcttttgtatctactacccttaattatttattacatctttattttttttagttgtataatttcttttataaattattgcataaataacatttaattttcgttattatttacgtcatttaatagaattaagatgatggtgcgtggtacaattatgcagaaactgcacaggatttgtacaattaggtaatgatggaagaagtgtggcacatatgataataatattagcatccgctaagattagagatatgtatttattttttttctaaattctttgatttattaagagaaaaaaaatctaattaatttaaaattcagttaaaaaataaagaaaatttgattaaaaattatattcataaaaaagttaaactcaatattatttaaataattggatctcagtacattaactttttgagtttaatgatatacattgaataaaatgaatgaatatcttccgtagagtacttgaagataagttaacaagaagaacagtacagtaccatgcatgacatcttcactctccctctcaatatgtttacgtcattgacccattcgtcacacctccacagcccacgtgtcacctttctatttggattctgctggaccacgccaggaatcaatgttaccatcaacacaataaggtgctttgagaaaccagatatcaattactaaaagattattttaataaatttaatgtttatttacttataaattattatttgagttatttttaaataattattttaaaaattaataaatttattatatataactcatcttgattgaatgattatatagatgtttaatattttttttctctatcttaatttaatagttagtcttaaacttttgagttttcaacgtgtaattgtattaagaatttgatgaaaggattttatcttgcatctaactcaaaaaaaatattttcattcgagaatatgtgtttaacaaaactttgaaaaactaactacaaacttaaaagtttatagcttttaaactaactaataattaagtaataagtgtctgctaaaattatttattgaactaattgaaaaatataaaatgataaaaatatatatattatatgatatttttatttgaattttaattttgttttatggataaaaatatattttgaggtg

SEQ ID NO: 1223 - DNA, 2005 bp, Glycine max
  Soy_ogl_3154 Gm09:37420896..37422900 Cluster 5
attataaaaatttaactattttatgtacagcgagtccgtgattaatgatgaatgacaatatcatataatacttttatattatggtccatctattaatagtatattgaagttgaacaatagattgtagactcaaagttttatcttgggaaatgattcagaatgtcactttcttatctactctaatggtaaatggctattaacgattgaaattagataacctttcaatcactcgaaaagccaattatgcattgatctttcaacacgaacgccacgcggcgaatcgtacacaacatcatgaaaacacaattaaatcttatcttatagtaaatcaaaattattagtttcattagaaaagataatgtaaaacagctttggcaagtagtactttaatgtagtaactctttggtgacggtaaattttatatttgtttttttaacaaatataatctcatgaaaatttaagaaaaagaataatttttttcttttgaaggtcttttatcatctcgataaataatttattttagattaatgtgttaaatttttatgtatagttggatctaaaattatataattgtaagtataattaaataaattaagaatatgtattaaataaaaaagatattatagaaataagaaagagatataataccaaagtgttattggaagaaaaaggagatataaaatgttataagaagaagaaaatgttattgaaagaaaaagagtaattaaaaaatacttatctgaaaaaaaaatgattgagaacatttatagtaactcattgatatattaacatcatatgaacttaaaatatgagggtatttataagttttaatacttattaaaaaacacctttgatatttataaagtataaatcttaaatatcatgtaactgttataattttctcctcatttttactgtcaataattttagttttgaatctttatcattgataattttatttttaacttttattgttgataattttgatcttcaatatttatcattaatatctaatctcgataattaaaatatttaaataccaatttttgatacaatcaaaaaataataacgttaaaactcttataatttatctttttcttccactagtacacctaaaaaataaggtgcatgttttaacattttggagagtacacgttattgtacatgaaagtcaaaattatacaaattgcaaaagtgtaagatagactgatagaacatctgtacaatttaaattctcatgtgaaaaagatgtatgtacgttgggttaatgtgtcaaataagcaactttaacttccaatttaaactttatatacacttaccatataaatattttttacattatttaattatgtattgccgaataactaaattttaaaataatttatcaaaaaaattacaaaaattactttaaaatcgatatttaatatgatttgaaattatttaacggtataaaaacatttacactttccttaaaaacaattacactgataatgtattaaaactgaattcaattatttttccaccccaaacattaactaaacattcaattacgacaattgtaaattattttgtttagcataattaatggatgttgatttttcaacaaggctaatttaataattcaattcagttcctttttcagaagcttccatcaatttttttttaagagaaactatttttgcagaatataattgtataaaggtttttacaaccatgagagaaatagaaagagatgaaggaaaattgtgtgatgaagaaaaataaaaataaaactatatagaaaaatgttatcgatatgattttctactcatatgaagttccctataataagtgtataaaaaaagttccctaataagtgtatacagttataactgcacccaaataattgagacaattcatgcatgtgaattttttgtggtcctaagctccttaaccgaagtaatttctcttaagttggcagaaaacaatcctgcaatcatgtataccaaaatggtaatggtccata

SEQ ID NO: 1224 - DNA, 1567 bp, Glycine max
  Soy_ogl_4954 Gm15:9518830..9520396 Cluster 5
ctgtgcactttcttaagacccgccattgggtcatgcggcactcttgtgctaaaactttttatcactttcttaagaccaagagcatatatatatattaacgtagcttatttctttctttagctaattatttctactaaattgtattacattagttttttttattgtaatttaagattcagatataaaaataaataatataaatacttttttattaaaattgtcgtgtcctaatttttttttactatgcattttctttataatataaatacagtataaaaattatactatcaatagattaaaattattttaaatatgatttttaaaataattattatataatataaacataaccaatttccaatttttgtcaacttgaagaaaaaataattaaaaatgaaaaaaaatagataaaagttattacgtttgtttattacttgatgagttaattaataaatgtaaaatgatataaaatttgtatttatagaaattaaatacttttatgattaaaagaagcagtgtaataatttaaataaataatgtaatattaaaaaggattaaataagaaattttataaaaaaaatactaaggatataaccaaaaaaattataagtttaaacgttgttttaagtagtgtttgaaaaaggtaaaatatttaactagataaatatagtcaaaaaaatttaatgagacaaactcattaatttaataatcttgttttaattaaataaacttgtaaagccgtcaaataaattatatgttcattaatataactatctaaatctaaatacactttttttcttttaatggttacttttttttataacatattcactttatcttagatttcttaaataaaagtatttaattaatataactatctaaatctaaatacactttttttataaacttgtaaagccgtcaaataaattatatgtcccgccatacttcacatgtgatgactgaagcaatatctcccttttgtgtaccacatatatcactttaaatttagatttcttaaataaaatttaaatttaatctttaacttagatatgaagttacaattaaatgtatctctttgttttagaaaaaattaattaagtaaaaaaataattaaaactgacccagttaaaaagaattagttaaatgtcaaattaaaaaaaaaactgtatataagaaactctagagatacctctggttaaaaaaaaaaatctatttgttaaaaaatttgcattctctcttttcattaataaaaaggacaagaaaataattcatttggaagcgaatgtggccaacgccaattactgcagtgagattaagaattgggtgtggaaatggaaatgatttatttttaatctatattttagcccgtcgtcttcatttaaagttttgccaagaaaaattataattattttaaataaacaaattcacactcacgttcacaaagttctcccctactcattatctacacttttcaggagtaaaagccaaaatgtcactaaaccaagcattatagcaaactcatgtaaatattataattaactcgtgctgagaaatgatggtcccgcag

SEQ ID NO: 1225 - DNA, 1800 bp, Glycine max
  Soy_ogl_6880 Gm20:39927501..39929300 Cluster 5
gatcttgtctcctaggatcttgatgtatatatgagaaaaaatttaaaatttaaaatattaataaagaaaatatataagaaatatatgttcctgagttaatatttatttttaaaaaattagtaaaagatcatatctctaattttatctataaaattactgattaatactttttaaattttatcatttattacataactatttattaaaacttaaacatttaaataattatgtaagaaaaattgatcctccctttaatactcctgaatcaacggtaagaactggagacaaaaaacataacggagaaaaacataaaaaccaaaattaataatttttaatagtaactaaaagtaaaaaattaaaaaaacttctggaactaaaatgtaattaaccctgtaagttacttcgaaaatttcggttggccgggatctctcaccagtcgcaagttgattgaaatttgtctcttgcatttcacattcttcctttcactttaatagaacaccgtccccttggttggttttaatgatttagggaataaaatgtaactgtaatggatttcactgtttttgtaaaaatattataaacttatgtatttatgacaatccatctatttatcaatttctctctgtatatattttggtgcacaccaatgacatcatatgttactttttattcttataacattatataagatacaaaatcaataaattcaacagttaagttatttacttttttttttatcatgatatcgctatgttttttttaagcaagatctcctcttttaataatatttttttatttataaaatttaaatttaagatattatttaaaaaaattaaacttaatatcactcgaactaatattattgttaatatttgctgtcagatcttatataaattatgtattcttatcatgtatatatattgttgtaaaaaaatcgtgtatatatataattgttatttcttactattaaaattgttcaaacttgtcacttttttctatctctcttgtatatgcgtgtgtataattttattttattattcatgtcttttaaactttcgtatcaaattaagttaatatttattttttcattattttccaattaaataaaaaaactaattaaattttttaattaatactcaaatatgtttcagttgatatcaaacataataaaatatttacaaaataggattgaatttaaataccttaatgtaaaataactatttttaaatattcaaattaaaatatttaaacacttatttttataattcagtatatgttttaatttaatttataactaaaaatgtttttgtaattatttttatatttttataattctactctatttacaagtacacagtaaaatatatatcagatatttgcttgttagtgatgacaaaatttttgttcaaatactttacttttagtatcagctccaactaaaaatcctgattaaggtgcgagggatttgttatataacaaccgaaaatacgagttgttagattcaagtggattttctttctatgtattgcatctctaaactccaatcacaattcacaagcactaagttttgataaggattttctttctgtgtattgacatctctaaactctaatcacaattcacaagcactaagttttgaaattgctatccaagctaccaatgaaaaagagaagatgctatatgaggaaatcaaagtttcaacaaattatatatagtaacctaaagtaccacggtgcgtgcgctacctaccatatcatatcatttcatgtattacacaagcatgcctttgactaacctaat

SEQ ID NO: 1226 - DNA, 1500 bp, Glycine max
  Soy_ogl_67 Gm01:2864801..2866300 Cluster 5
attcaaaataaataaataaaataggaggtggaatataaaagtactcatcttatttaggttttggaactttcaaacattttgacttgctttgctgcacaaacaaagatgtttagcattttaaacaacggagacactgtttaattaattactaattgtgggtctgatttggttcttagtccttcatttaatcgctaacattgcacgtgttgacggttgaaaactttatattcaaagcatccagaaatcttctactactagtttttttaggtcaccaattttgaaatatcattgggtcattaatggtcgtcaactatgtggcttaaaaaatactaacaataacaagtctactttttttctcctcgttagtaatgaaaaagtaattagtttatgtttgttttctatttttaagatttatttattttcaaaaacaaagcttgttgggcaagaatgatttcttaaaattattttaaaaataatatattttattgttgttttttaaaccaaaaaaccaatgcacctgtaagttatttttttatacaacagtatatataaaacacaactagtatatatattataaatcaattaatcaacaccatgttttgtttttttttttacaaaaaaaaataaaaaatcaacactaggtttcgggtcatgcaatctatttcattatttttctatacatcaaaataaaaatatatatatgaaaaacaatgttacataatccttcaatggcctcctcagttagcttccatgttactgacggatgctttagaagtcattcatttgaggttgtaaactttttgttttctgctttgcttttagctttcggcccatgcatagaaaaagatataatttcattactttaagctgtttaggaaagaagataattctttaagaactacattaatggtttacttaaacaagcatcattaatatgaaatttgttcaagtaaaatattaaaaaagtatctatacaaaattttgattaggtttggattacattgaatatatgaaatcaatctgtttcagtcttctttttttttagcttttagacatttttaagctcaaaataattttatattgaactaaaaatgaaaaaaatataatgatgtttagtttatttttacttattattttcagttgatgaaaaaactgtttttctaatttccttaacaaaaataaaagtaatacccttttatgagttcaaataaaaatatatcaactaaaattaaaatacaaaatcaaatacttctaaatattatcatgatgaattaatatgaaaaagggaaaaaattaaaaataaagattaattataattattaatgaaaatgataatttggaattttaataatctataaataataaataaatttacattattaaaaacacataattaattttttcattgacatttaaactataatttttttagaagaacattttaactataatttattctttttaaatcacaatatcttactttagaaaacaaaagaattt

SEQ ID NO: 1227 - DNA, 1038 bp, Glycine max
  Soy_ogl_969 Gm03:39564201..39565238 Cluster 5
tctaacataattggtgattgattgatattaagatgtcactacatagattttaatctctaataatatattacatttttctaatataattttttaaagtaaatagtctttacattaataatgtaatgattgaatttatatgttattattgatcaattagagattgatatgtataataggttgatagaattttataataattatcttaaaaattatgtctttcatgatttctcatagattaagaatataaaaaatttacattgttaatacatagaaaactaaattaatatatttagtatataaaattagaataataatatattgataaagatatgctatcaatatattctttaatacactcttcaagtacatactctatattagttgaaatttattaaaaaaatatgaattttggtgattctcactttttaattaatgattatctcttttaattttataatttttaataaattttaactaataaatgtgtgttagaaacagtattgttacaattcttattagttccttaaaaacaactcctctaattagtatatcatattattagtaaattcatcatattaatttttaggttaaattgattttttgatcatctaatttattttttagattaaatttgaatctctaattttttaggtttagtttattcatctaattttaaaaattaatttaatttaattttgccgtttaaattaaatcaataatattaaaaaattgtactttgtagtgatttaaaaccactatcaagtgataataagccatcacataacgcatatttcttagcacggccagtttaatttagacgtcaagccaaattaaattagttttaaaaattaaaagatcaaattaaacctaaaaataattaaaacataaaatcaaacgtaaacaataaattagatgataacaaattaatttaaactaatttttattgtgcaaattcacaatacatatattaacagtttaactctcttttcgttagccatgtaaattgaagcatagcaagaaattaacaatatttttcct

SEQ ID NO: 1228 - DNA, 1263 bp, Glycine max
  Soy_ogl_1529 Gm05:1850369..1851631 Cluster 5
ctcacatattttgattcaacataaaaacaaatatatcttcgttaattctatcccttgtacttaatcaagcattaacataagatagtaatgtgtcgttgttgttctgagtggaactagttaaataatttttagtaaaattttgggttttcttatggatgaataaagaatcatgattgaaagattctattaaaggtggttaacttgatttgtaacgaaaattaattatcaataaaattagtaaaaattttgtattaatgttatgatgataaaaaaaattagaataattcatcataaatcaaatatataattgattcaaataaaattaggcttgaattttttatgtttaattttgaattcaagtattgtgaatagaaaaaaatataaaattaaaatatataacctcccacaagatgcctcaaggtgaatcctagctagtgagttagaaaattattatcttctatacatttttattcataaaatgggaattataacaaattacagtaaagtgataccataataatatttggacactttaacattattagcattcctgtcatatctttcatttctcttgatttttcttttcttattaaattatattatcaatcatatcaattatttattttttctctttttccatctctctcaaaatgtttagagagataaaactgaaaaaagtatacatcttataggcaatataatttgacataaaaagaaaaatagagaaaaacattagatttaaaaaaaaaaatgagtgttcatgtttcgtgggtctagaaattaattacccgaagtcttatgtttgtattttgttgaacaaaatttaaacaacaatatagaaaaagaaaactgatttgacatccaaatcacgcgtatctctgtattaaggttgcacaaattcgtacaatggagacttttccaaagcaaaattcaataattgaataatcaacatataattaattagttaccctcaaaagattcaaaatatcatccgatatatattctgaaaaatgaatgagtagtgctcaatgtataaataaaatttgtagtgctcatatacaatttttttttattaattctgtggcttaatcttcaaggtaataaataaaataatcttaaagacatgtcacctacaaaattatgaatatttttgcaacgtaattagtttgaaaatttatttcacgcagctgaccaatacaatactctagagtctatagccatactctagctcgtttgttgaaaaggtgagtttttttttttttt

SEQ ID NO: 1229 - DNA, 1038 bp, Glycine max
  Soy_ogl_1547 Gm05:2217901..2218938 Cluster 5
ttattatgcattaccaacaaaaaaaaaaaacttatgttattacaatttgtttctcttttattgaagtaagccaaacatttatttcaattcagagttgatccaacactaaataagatttaaaatattttttttaaaaaaatatattaaatgtgagaattatatattggatattttttttccaagattcgcgatttttttatcatcataggaatatttttgttttataaaagctaatcaaaattgtttttttcgaacttaaaacttaaattttaactgttttatcctttgaccaaccttatttcaattttaacaatttgtttgacaaattaccacatcaaaaattttcttcttaaataaagactttattggaaaaaaaattgaaaagttttaacatgtctcatttatttattgaaaaaaagaatatttattacacttttcagtgtgataaatgctttctttctcaattaaaaattatagctttatattcttagaaattagaatcaatcccaaaacttaagagtcaacgttaataaaattgagaaaaatatgaaatatttgctccatttttttatctgccattccatattatagtacattaaaaaataattaattttatttttattaaattatttgtaattttttcatatatatgtcatttatctcttttatttataactctgacaaatataatattatttatttctcttttttttataaggtataattgagaaaaatagtcaaaatagtgtcaatcttctcttgtttttgtattttgcatatattttctcaaattattaaattgataaaatagtaattattataatattgaaactttaaaatgataaaaaaagtagaaaaaaaatcttaaaaactaaagataaaaaacgtagtattcaatatattaaaattattataaaatatttaatatttatttttaaatgattagtaacaatgaagattttaaatattccttaactaaagagatataactcttataacatttaccatcaaattaactcactaaagtctgtgggaata

SEQ ID NO: 1230 - DNA, 1600 bp, Glycine max
  Soy_ogl_2908 Gm09:512501..514100 Cluster 5
aggacaaatgtttgaaattaatttttcaacaaaaataataagggcattgaaaacatagcacagtacttaaccctgtgttttgttgacaagaaaaaaaaaatagtaagagaaaccttgaaaatccgagttgaaagaaaatagttttttttattataatagtatgcaaagtttttactttttatcatatacgtactaactaatagtaatatgaaaattagtttagaaacttttttagtatgtgtggcaatagtttgatatacgtactatgctcatatttgatgtacaggtacaagataaaaatgatactaatagtatatatcgatcttatatttcttttttgtactaaaatatgcatataagcataatgtatcatattataaataataattaaaaaatacctacagagactaattaatctaataccaattcattatgaaataatatttttgtaatgtttgatgcaaattaaatttgctatgggggattaagttactttagaagtcatttttggtaaaattagtttattcaataactctttgtatatgttaaatgctgataaactattgaatattttaatattatcttaacgaccatgtaggttaaaatttaaataaacgagacatttgtaattatataattattcaataactctttataatttacatttaattatattttaaaatgtatattatatgtcaaattaattttatttgataaagtgccgaatagtttcaattttttaaaaaaaaattacagacttaatctactcaataatatttttttaattaaatggttagatgattgaaatttaatgtatacttaaagttattgaataaaataactgtgtaaaaaattaatcatgaaataacttgatcaacttgttctttatataaatattctctcacacacaaatttaatttggatacactattaatgtggttttttttacattatatatcaactgattaaaaaacactctaaaaaacttttaaaataattattacataaatcaacattttcaattatataacaattagtaattaaataataacgtaaaaaccattctcagacttataacatataagacacacacctttatttttcactattgattaatgattcaaaaatttatacattaccaaataaaaaaattaacgattgtttgatcaattttggcagtttcattatagtattctttttatagtttttattttaatcagcagaaattttcttttttatagtgaaaatccttttaaaaattactttatagtggaaaaaaataattaaagcgtacttacaatttatatttttacattgacatttaattataaattattatatatgataagattgtcactttttgtaataattcattattaaaaaatataatgatttatcaaaattaagttaaaaaataattacaacaaaaccacgttgacttataggattatttatggaatttttttattaagaaaatcaatcactttacaaattattagaaatatatatataatgatattggaacaaatataataggcaataacttggagttttaaatacattataccagtagacaattaacttagagttttaaatacat

SEQ ID NO: 1231 - DNA, 1886 bp, Glycine max
  Soy_ogl_2946 Gm09:2207853..2209738 Cluster 5
aaaatgattttgataaaaagggattaaagattaacactaaactaataaccgaaattgataaattctttttgggactttttcacaaacacatagaatgcactaatgaggatttcgtgccctgccatacctataaaagcgtgccccagcttaatttaccaattgcatgtgctttatataatatatagatagatataaatgctattttttttgttaaaattgatttgaaaacccttttcaaaataattcattaaaataaattaatcataccaaattaaatttaaacgtgtaattaaccattaggaagaataaatttgctatcattgctcaaagaaattaaatgtgattttgcatcactttcagaaattccgattatgaacaaaaattgtgtcctgtataaaataaaatacacattatgtaatcatttccaaaattaaatatttattatttgttatgtaacgtatttgctaacaataatcgagaaataaaaaagagaaacaataaccaatgtttccctctgttatcgtatctgtcatttaatgcataataaaatgaaacgtatattacaataaaataaacatttaaaatttaattttaaaatatcatttttcttaactgttaaaatctttatgatgcatgattaaattttaatcgtggagttagaaactttagtcttatataaataagatggtttaagatcgatgatttgtttattaatcttttcttcctcgggattgagaatttgttcttctaagttctaatgcttatttaattttatgtgaaatttcaattgtatttttttctgtcaaagtttcgacgaaacatcttttattttaggaaaagaaagattctcatgtataagctttaaaaggatctgggtgaaggttagtgagattacgatttgagcttgagcttagaacatttaatttttcttttccacttccatttttccttttagaacttttatgttactgagaaatgaattgaattgtgtgttgtgagtgacttgaaggaagacaggataatcaaagttgatgtttatttgtatgatcctattatgatatattattatgttatttttgtttaaaaatttttataaaaaaaattaatgattattaatatttttttttcaatttttttatgttttaaggttataaaatgatagtatattaacaaaatatttgtaaatttaattataaatttagtgtttattatataatattattatacacgaaaatagtgtcaattgcaaaataagtgaaattttttatattaataaagataaagaacttacataatattactaattaatattaataacagagctagattgttaaaatatcacttcaaatattatttatagagaaatctttcaaaacctaaataaactagttagagtttcttttttatgaacaacatgattaagatacaataaaaaattgacataaaaatgcaacatgagattcaaacttaaaaatctttactcttaaaaacatatctttttatcgttgataaaccaaaaaattgacataaaagtgcaacacaagattaaaacttaaaaatctttagtgttagaaacatattcctacaaaaaaatttcattttgttacaattcaatatatatttcatcaatttcagcatataagatcatacgatattgaattatttttatctttacttttttttattaagtgcttagaatatgagaagaataactaaaaatttacatatttgtttcaacaatcatttataatactttgtaacaataataattgttttgtcaactgtaaaacatgtcatctaaaaattattaatttgatttatttttaatgttttacttattatatgtcaaaaaaataatttcataaaagacttgattatttttttcg

SEQ ID NO: 1232 - DNA, 1115 bp, Glycine max
  Soy_ogl_3243 Gm09:40629062..40630176 Cluster 5
aaattaaaatattaactataaaaattaaaaagaaatcattttcatactatcgagactaagaaaaaatataaactatgaaacgaataattaaacctaacttaaataagaaaaccttttctattgaatttatcaagttatcccgtgcaatcaattgcaactatattttggactattttttaaatgagaatcaacaaaaagaatcatcaagaatttgactattgtgaaagcttcattgaaacctttagataatagcaacttaatagatcgccatgtggtaaaaacattattttattcgtctcaaaactccaatgaccaaataaataaattcacaattagcaaaaattaaagtattacaataacaaaaaaaaataacatcacagttattataataatatatcattaaattggaatctaagaaataaaattaaaaaattatattattatttatttactttttgtctcataatatcattatctaaatttatttttagaaaataaatgtgaagaaatgtaactaatatattaagcttaaaatttttaattttattttaataatataagtattaattttgattatattgttttaaagtatactatttaatagttacattttctgcctgcgtaatagagttttttttctctttattgttaaaattttgaaaaattaaaattataccaaataaagttattttaaagaacaataaatttacttatgttaaagaaaattattataaaaaaattctcttctgtttatctcaacaatgttctagctaatttggaattaaattataatttttgtctctctttaatttcttatccatgatttttgttcctctttgtatattttatttattttatttcaattcaattgaatcttagaactaatatatccatttagggtactatataaagatgatttaattaattaaaatgtaaaaatataaaaatatgtaaatttaataattatacaaaaaaaaattgaattttcaagaatgtggaactaaaattgaaaaaataaaaaataaagagattaaaatgtttttgtttattaagaaatatttagttaaaataaaatattgttatatttaaactaaaatatttttatttaatgattg

SEQ ID NO: 1233 - DNA, 1539 bp, Glycine max
  Soy_ogl_4951 Gm15:9400822..9402360 Cluster 5
cctatgtgactcatgctctatatattggattttgaagcagcagactaagataacaagatatttttatatagctcattcattttgacaattatgtaacttttttttattgataagaataaaaacatgtattaaataatttataataatttatgtatctcatttaaccagctaaattttcttgatatcgtgtaatatatttgacactcgaatattttgtacgataaagtgacaaaattgcaaactcctcgtcaattttattattaatggtgttgagtaattaggtaaatgacgttagaaaaattgaaaactccttgtctatcattaattttaaggatttaatatttagttagaattaatctaaaattttataccttagatgttattgtatttgaattacaaatatcatttatgttatttagactctttgttgaatatatattaatatttatttttaaaaaaaaaatagaatataagaaactcgagcacccctcaaaaaaaaaaaaaaactcgagttaaggaaacatttcatatacacgagtacttcaccgaaccgtcttaagacgaatactgtcgatcgattacccgttttacatcaaatatatagcaatcaaacacatcgagactaagaaacttctcgctcaatttagaaagttagcttcacaatatattcatcaaaaaagggaaaaaataaaaataacaatttatattacaattaaaagaaagagaagtaaagaatctgttaatataaacttaattacactttttgtcctcctaaaatcttcaattcacgattttgatatttttctaatcatggaattttagtttcctaatttttcaaattaagtaagttttgtccatctgttagttgatcatatgttcaatggcaaagcttgaaaaaaatggaagagccaaaataaaattaagattaaatatattaattaaatgtaataattttgataatatcattattataatcttttgtgattggttttaagcatttgaattatatggtattattcaaatattaactatttatttcattaattatcatctatggtattacaatttttttttactttatcaataacagtccacaaagaaaactcataggttcaattgtataagtcatattatataagttgcagtaaagaaaaagtcatattatataagttatcctatagcaaaatgaaaatataaaagtcagagaaataataagtttgaaaaataaataaaaatagtttgaaaatgtaattaattaataaaaagttcatttatgaaaagtgttattaaattattcataagaacagatttatttatttttactacaagaacagatattatgaaaaacaaagacttaaagtgaaatattaatataaatttatttattaagtattcttgattttgttttctatattttgcatattttgattttatataatttacatattttttattagtttacacactcaattacttattttcattagttttttatatttttttatgtttagatgacatatttttcacctaagacaatct

SEQ ID NO: 1234 - DNA, 1443 bp, Glycine max
  Soy_ogl_5886 Gm18:2133301..2134743 Cluster 5
gattaatttgctgtattttttacatatttatttaaggattaaattaaaaaaaaatttatcattgaggaactaatttatatgacttagaattttttattttcatctttaatgcttctttgttaaattaaattggttcttttattagtctattaaattattttaattaacttattaacgtgacacaaatcgtagcatatgtttgtttgtaaaaattaacattgttaatgtaaaaaaaaattgacaaaaatataataaaaaccttcaaagggactaaagtggatttttttaaaaaaaaaattggccgaccaaattaaaacaaaataaaaaaagaagaaccaacattttataatataaatatcttaagattggacgcgagtgtaaatcaataatatcttattttttttatagattagtaacgtgttaggaggattttccaaaattaattttaataattatctacacataatacttctttcgtcctaaaataagtgttatattttaaaaaaagttgatccaaaataaatatcttattagttttccaatgttatactacctctaattctatacataaataacaaattgatttttttttctaattataagaaataataattaatttttaaacttatttaaagtcaaaattattttatactcttgttaattcaatttattagacactcacttatttggataatgggtttttgaaatacaatttaaatttataatattaaatgtgatcattagttttcttagtcttgataatttattttatgtttcttaagtagaatcaggagtattattagtttccttcttttttattaattaatatttctaataagagtcactttaatttttcaaagtgatactaatattactcactttcagttatttaatcaggttaattttgtacaataattatttatttttatccatttattaatttttctttatataaaataaattaagatgacccttaagaaatattacatgttgttgcacatgcacttaaagaaatactatgatactattataacatgtccaaatgcccatgcttttttcccaaggctgtacagaagaagagaaaagaatggaagaaaattgacaaaaaaaaaacatttaaattaaaataatgtgatgaaggtatgacaaccaaaccaagactatcagttcgttggatgcaatagaaagaaaataaattaagataaattttttaacttaaaataaaatataaaagtgtaaattttttatttttacaattcatttatctgtttttttaatattttttttctcaaacgaacatgacttaaaagttcattttaaatgaatgaaattgaaagaaaagaaaattgagaggaaagaaaaacaaacgtaacaaaaaaattttggttacagataaaatgaagaatttttttttaaaaaaaaattgacttcaacaaataaaaa

SEQ ID NO: 1235 - DNA, 1600 bp, Glycine max
  Soy_ogl_6951 Gm20:43433401..43435000 Cluster 5
gatgacaaacttgggagaatatgacttaagatttgagatcataaaatacatatgattgaagactgtgatctatcaaacttattcgtacaaataattaaactttttattttaatttctatatattaaataatatatgcacttaagtatgacaaaatgagtatatttaaaatgattttgtactattaattaaattcatttatttgataattttttgtcataaatattttttttgaaaaattgttgaatttgagtctaattattagagttgttcgtgaagagtcttgtcttataaacctgacttgacctcaaactaatttcaataaatttatttttaaaataagatttaatatatttgaagaataagtttgttttatattttaggccatttaagtaggtttgatgttttatattttttttaaataatatattacttttttaaaattatgcattcattataagtttttttaaaaaaaaattgtgcaaaaagtaagcttttgatttaattttcttaatatgattttatattttaaaattatatattataaaatacttaattttaatttaagtatttaattaactctacgatttacttatacataatgtaaatattgatgcattatatcaataaattaagtagggttgtggtaattgcaagatcaatgagacattgtcctaggctctgaattatttaaggcctcaattttttttatactttgtataaaatattgattatcaatttgaattaataggagataaattttattatgatgtgatatattatttcttattatttttattagcatgattacatagtcgtaagattgtattaattgaaaattttaaaactttaaatgaggataaattgaaaaaaaatattgaattactattgagaagatatttcagaaaatataaataaaatacgagtttatctttttagagaaaaattgaagaggagtgaatgacattccagtataaatcaagaacaatctcttaactcaaaaaccacttatagaaaaatttgcaattaatttatacacattatcgatgtaaaacattttttacacaaatatcatataaaaaatttctccaccatcgtatcaatttaatgaataggaagttgtagccaatagctcagattttattggatgtttgtataaaaaatatttacactaataatgtacgtaaattattgacaatattatattaaaaatattttattggatgtttgtataaaattatactccactaaaaatattaaaatatatccaaaagactatattctattccaaataaaggcattgctagctgcttaaatattattgacaatagttttttaaaattataattgattgctcaaattttatttgatattaactatatatgttaatggataaattgaatgagttaggcattttatatattatggtgaaatatgagaataatacttgaatgagtttgttatttttatattaaaagtgaaatttaagaaatacttaattataatacttagatcactaactttgtagtcaataaaaatttaaaatagatttgataaattctattaaactaaactttgagtgtaaacttagccgaaaacctt

SEQ ID NO: 1236 - DNA, 1500 bp, Glycine max
  Soy_ogl_260 Gm01:51011001..51012500 Cluster 5
cgtgcacttcatgcccattcaaagtgacagttttatcgatctttcctatttggagccactttttgtgtttttaatctgatttctctgtcttgtgtttttattattttaccacatctaattatttgaaaaagcgagtgcaaacaaaatctcaaactaaacataaaattgtttcttgtctgattcttattcttgaaaaaaaaattatttaaacatcatacaatttcttaaaagtgatttttttcataaataatttttttcccataattttttttagacaatcttattctaacgaaaatttgttaagatatgatattaagagactaatgttcagcagacccactcccgttggttaaacaaatgattaaagaaataattttaagcaaacacgcctatctgttttaaattgaagtatactttttaggaaaaatattaattatataaattattattacctataatcccgtaggtaaaaagcaacatactaatttgttaagactaataacaatagtcaaacaagttaatttaaattattaatgtagtaagtttaaattttatttgaaaatattcttaaaattaaataatttaagcagcggttatatttaatactactcctaactcaaataatgtttttttcatcaatgagggtgacttatattattaataggccaataaatttatcaacttacataaaaaatttagtaattttttattgatagacgttataatatgctaaggatgtaaacatttaaaaataaatttatgtttcttacaagtaggacaaaataattaacctatttgtttactgtataaagagagagagagagacaagtaaataggagaattttctcgtcctacttacaagcaacgtaaattcattttcaaatatgttaaactgttgatttttttataaataattagaggttgtattatgctaaacaattttttatggatatttccttattaaaaaattataacataattgtgaatttatttagatgtttatatacattgctaaatgaaggtattattaaaaaatataatatcatcgaacaagtgaaataattagcacaaggaatgtgtcaatttaacaagtggtattgagttgaagttgttagttgtgttaaatattgagaactttgatgactatagtgattttacacaattcacacaaatttacttttgataaagacacatgtagtgtataaaaaaatataattaatactttcttaattttcttaaagtgacaaatatattaagacaaatattaatgagtgtcttaagaatagtagttaagaaatttaaagtataaatatttttattaagaggtgaaaaattatgttattcataattttttttacatatttctgtaatttatacaataaatattttcattgttttattctttaatcaatatcttaagatattaattaggaagataatatcttaaaatagactgaaatatttagagagccatattactctacacaatttaatattgtc

SEQ ID NO: 1237 - DNA, 1477 bp, Glycine max
  Soy_ogl_663 Gm02:45004005..45005481 Cluster 5
cttctacctcgattttttttataagactttttttatctagtccatatatactaattttgaaaaaattaaagtagtatcattttttcaatcaaattcattcaagaataataaaaactaaaaaaaaaagtatttaatgcttgaggattaatttgctttaaaataaaaattatcaaatacttttgattttaaaaaaataatatttaactccactatattactttcttactatgtttgtgctttgtctctaacacatgacaaattacgtttttaaagtctcaagcagtattttggcattaattttttatgtttgaaaaataatttaaaattaaagtggaaaatacgaatcttaaattttggaattcagctatttaataaatttgtatctttttttttgtaaatttaaaatttacttttaagctaaatttttggaataatatattctaagattagaaataaagaaagggcatgtttgattgtgtttttcttttttactcggggaatgagaaacaattcacgcctctatttttatgaaataaaaataaaataaaggaggacgagagaatatacggtaagtattaaatagaaaatgggagacagtataaggaagtagtggctaattttgagaatagttatgcgaaataatcttgataaaatatggtgacaaaaaataatattcaccgcagaaatgatatttgtacaataattcttacaagaggagtgttagaaagtcatctaacacactttcttaattggttaaaaattatagaaaattacgaaagaaaattatcaaatataatgtaagacgattcataaaattaattttatacatttcaatcaataaaaaaaatatgtttgtgtacatgtcaaaaagtgtgtttctaacacttttgcttcatacaaaaagtttgtacaataacattgttgtgtgtccttctcatatatatcatttattatatgttataatgatagaaaaaaataaacaaaaaaataatacttctttcattctattataattttcgtgtaagaaagaaaaattaatcctaaaataattattattttaactttacagtgtaatattaattattatttttcaattatattccttatgatattaatcatgagttgaaaaacaaaaaaaataaactaatgatgataaagataattttataaaattttatcctcttttatttattaattaattttttttgtctttgtaaaataatttaaggctgccattataattggacagagtattgtaaaagatattagataaattaatgcatgtatatcacatctctttttactttgtatattgttatcaatcgaagataggatctccaataaggttttacaaaataattggatgaagcacattagtatatttcttttttaatgagtaattatcattcactaattaataagagaagaacttaaatttatgtattcacttaataatctcatattcattcaacagtac

SEQ ID NO: 1238 - DNA, 1100 bp, Glycine max
  Soy_ogl_4525 Gm13:37635301..37636400 Cluster 5
cagcaaattaagatgagtgtgttaattttttcattttatcatttattttattcattctaaaactagaaaactattaatatttataagaaaaaagattgatgtaacattcaatgaaaaaaaaatgataaaaagtcaattaaaatgatttgaacacgtataaaaatcacaagaattgggggttagaaaaatatattgcatggtttctggtctttgaaaaagagaaaaatttaatttaataattttgataatataatctcttatggatgattttatgcatttaatgatatgtttttaaaaaaatattaattaatttatttttatttattatatttcgtgatacatattaaaatattttttgcttaattaataacacgtgaattgcaacttttagactctctagtctatatgctattgaataaaaagaatttaaaatttatctccaaatattccgtgaaaaaacttagagatacattaggtttttttatacaaaactgtatttgcacgaaaatccataaaaaatttatatcaattttcaattgaattaaaaaatacaatatttttgctaaaattataacaaattaggcaggaaaaatatctagaaaaattgcaagaatatcacgaaagtacattgacaaaatttgcataaaaaatccacaagaaaaatctgcaggttttttaagttatattctatagattttataataaaatgatgttataaaacttatataaaaatggatttttaatatataaaaaattatattatgaaaagataattaattaataaaatagttaacatataattaaaaagtgttattaaatatttagtaaaagggataatgatataaaaaaaaatattattaatttaaaattatctacaataaaaataataattatataatgactaaaaaaatatttcatttattttttaataactagtaatttgtaaattagtattttttatattctttctataattttaaatcattaatagttgagaataaattaaatttaaataatattatcaacactttattattatatattaatatttttgctaaatatatacatttttatgttaaaattttggggccaatgccccc

SEQ ID NO: 1239 - DNA, 1092 bp, Glycine max
  Soy_ogl_4674 Gm14:5376501..5377592 Cluster 5
cttgtgatgtagagcattttttttttcttaattatcgatttgattatcaaattactttaaatagttgaatttgattttcaaaaatttaaaaattttaatttggttatcaaattattaaaaatgagtcaatttagttctcaaatttttaaaaatgaatcaatttgatctctaaatttttaagaacttaaaagaccaatttgagaaataaattaaacctttaaaaaatttacatatcaaattgacttatctttaagaacttgaagaacaaattaattcatatttaaaaatttgagaactaaattgaaccatttaaaataatttagaaaataatttgataactaaggtttttttttaatattttaaaatttttataatttacatactattgtaaatttatatatatctacaatttttatcatttttttattttatgttaaaattggaaatccatagaatatataaatatactttaattacttttatcataatattatcaatatatagcagtaaaaaacaatatatagtacagtaaaattatttatttttgtaataactatctttattattattttaacctgataataattatatgcaacaattatttgattgttgaatggtgaattcatgttgaatcaggactgtctaattaatagtttattttttattaattgcttgaaatgtttttttaaataagcatttatttgatgttgcatttttaatttttgaattattatagaaagtttgtattattttaatttatattttagagtatttttttcaaaatgtggaatatttttttataatatagttagtattatttcgtattaaagtaaaaaaattatttcaacaggattattatttaatcaattaaaaatatcaaaataattaaaagtatttttattttttactaaagtacttttataaatgacttatataagaacatgtaaaatatataatattgtaaatttatgtaaaatatttacaaagtttttattatctttattagtttttttacattagatgatctatagtatatacaaaatgtaatttattttttaatattggtaatatacaatatagtaaaaaaattat

SEQ ID NO: 1240 - DNA, 1438 bp, Glycine max
  Soy_ogl_5319 Gm16:5464463..5465900 Cluster 5
tctctaagaagattctcatgctaatattattttgtgtgtgtgtggataagaataggaagtaggtgttgcctccatatcctcgagatccacctgcacaggatatatatattttaatatgaaatgataataactattaaattaaattattattaaataaaacatgagaatgaataattaatttcatgataataatttaataaaaactaaagaataaaaatattcaacaaaaaagatacaccaaaataaaatactcaaattaaaatagtaatagattattattataatcaaagtataatattaaatatatttgattcatgaaaatttagaccttccgtgaaagtgtaaataatgtttagtgaaattaacactgtattagatcctgaactttcaataaattttattaatataatatatttattttataaaatagaggtttaaaaataatgataaaattgtgatacttgataatttcagttttttcctggtggataaagtgtggataagtattaaagacacactgtcataattaattaattttgaaaataacctaattatttacttaatatgtcaaccataaatctcctaaaaaaatgtcaaccataaattcatttatattttatttaattaaataactatatttttttaatttatgatcagtgagccacttaattcttattttatataaaaaattattattcttaagcaaggataaaaatgactaacattaaccgttagaataaaataaaaaacattttttttaaaatattttaattaattcaaattaaaacatcatgatctcctcattgtttatactgaaaaatagtaattaataatttaaaaattagtataccttattatacaattcttattttttttaattcataattccgaattcaaatattaacaaaattttaaatgttaaaattttaacatattttataatgttgtccaagatatattatatgcctaatgcatagcttcagtttagattttaatttataaatatataattacaaatatcatttcgtaaaaaatatttttttgtcatttattttttataactaagaactcttatttcagattgcataaaatatcatttcacaataattatttaaattactatcttatctaatacataattattttttatttctctaaaatacaaaaataattatttttttaaatcatagtatacgagatatataatcaactgtatattaataaaggaaaataataattaatgattaaaaatataatttaataataaatgattcttaatacaaatttaagaaatatatttatatatttaaaatattctataaaaatattcatacaaaaattcactcgtgcatgacacgagtcacacactttagtattataaaatagaggtttaaaaaacaatgataaaactttccctaaaaaaacaatgataaaattg

SEQ ID NO: 1241 - DNA, 1600 bp, Glycine max
  Soy_ogl_5489 Gm17:3630101..3631700 Cluster 5
cagaattacaaatatactatatggcaatactttggatactttagttttaagtttataattttaaatgattattcaatttcacatgtcctctacacaaattctcacactcatttaggagattcttatgagcttactatttatctaccatcaatatgtaaagtcttttatattaacaattactttaaaacaagtaattatttgttattatataaaagttattgaagtaaattttatgttattaaattattaaatatttataatgaatggaaccataattaacgcattcaaataactcatttttttcacatatgattacaaattagtatctcgttaccaaaaaaaaaaaaattagtatctcaattgagagtcaaaatttgtaattttttttatagaatttgttggtattcatatgtatttgtttttcatacaacctcaatttcctataactaaagttactaaaaagaaaattcatgaattaagtcgctattttttttaataagagaagaccacgaatatcttctactagactcaagttgaatatataagattattataagtgataaagttttcccttttagaaatctaatttaatttcaataaactctttgaaggttttttatattatcaactaatataaattattttagacttaacttgaaaaatataatgaagaatgttataatacatgcatgctaacagtgttgcacaatataattattatataattattgaagacaaatgatacacatgtgtaacaaacttaaccgttgcaacataactgtaaaggagaacatatttttgtaatcaacaaaaccaccaccaattttaagcaaattttgtggactatttgagaacgttttaaatataagaataatgaaattaatttttaatgtgtaatgttatgtaatactcctacttatgcatttctcaacatatctatctagtgttacgccattggttttaattaaatgccatgtgtttcttactgttttaacttattatggtaaaaattattcaaaacaaatatcctatatatgttaatatttaatatgtttatacacatcaattaaataattgaattagtattttaatttaaaacaaaattatatacaagaaaaaggtataaaagtgtgaattgcttaactgttacttaaaatttcagcattaaaataaaatatatctgagtaactaaaatatgatgtaaaattaagtaaggcacttaataaatagtaggagataaaaaaatccaaaatcaataacttaaattacagaatcgaaaaggctctaataatgctacaactgtataggattcggatctattatgtattcacatacatatatttatatatctttggagactttgtatttttttttcctttatcaataaatattagccttaaaatattagttttattaataaaaagattaaatttgtgatttttttttctttcttaactattcaacactcttattatgactttctttggaaggttacaactcactggtcctttccatcatgatatccttgcaattaaaacaagtttaatggagttatttctgagcttaaaaacttttattcataatatttatcattattttt

SEQ ID NO: 1242 - DNA, 1492 bp, Glycine max
  Soy_ogl_6757 Gm20:34759209..34760700 Cluster 5
gtattttgataacttgcattgcatataagaaattagtggtcacccgctttctcattcaatacatccacaagtaattttttacattgcagaaatattttaaaattagataaagttcaaaacataagttacaagaaaaattatataaaataaaaatataaaaaattaatggtaaaatcatgagacttaacaaagaataaaaataatatatgtatttaatttcaaaaaataaagatttcgtattattatactactataacataatttttttaaaaaaaaatctattattatattttattcctttttaactcatgattttaccattaaatttttatatttttattttacataaattatcttttaacttgtatttttgaactttatctaattttaaaacttgtctgaaaagtaataatatttgacaaaaaaaaatgacaaacatgaaatggttgatataagagaagtcacttaccgctttgagaaagagtagacagagacaaaatccttactcttaagaagcaagttcaaatttaatatactaaggactaacacgtttctatacgaataattttaattttaagtggtaaactaaaatatatagaagataaaaatatcattactaaacaacaatgaaatcgtatatcttaagaaagaagaaagtatattgagatatgtctttgttatcgataatgagaatctattttactagccaaaaataaatatagaagataatatttttaaaattgagaaagaaactatgaaaataaaatatttgaacatgcctattaatttaatatgatgtgttaaaatttgaaattcaaatctaaatctaattgtgattaaatatatttaagaattagcactttagaggaataaaatatagaagataaaatatgagatcgatatttgacattaaaaaaaaaaaactaacttactaagacaataaattaagtcttttaggctttgtttagaatgatggagagaaataatattagaaagaaattttgtacttcttttttaggatttacaccttttatcctttaattaaaaaaaaaaatcttctattttcaatcgtctaaactaaatacacccatagttcacaagtgagtactcaattattttaatacataagagttgatatatagaaagaaaaaaaaaagagttctacaatcagtatccttacgtaaggaaataataaatagaaaaattttataaataaaaaatatgataagagttcattaatattttttttatatttaatttcttaatcagtacacgttgattaaccaaatgttgtttagtgtgaatagttcggtatagatatgtatatactcttgtcccttagccaaaatattgggaccaaattttctttgaacatgaagtcacaatattgtagagtacgtactttacttattagaagtcgacttggtgcgaaggaaggttggccaagtctgcatgtctcgacatggtttaaaaaaaaacataagaagaaagt

SEQ ID NO: 1243 - DNA, 1200 bp, Glycine max
  Soy_ogl_6830 Gm20:38061401..38062600 Cluster 5
aaaatgtttgaaatttgtttctgtaaaatttttaatgttttttatcctcataaaatcaaaaataacatttttttgttccaaatgcaggttcaagtaaattcaaacaaataatgatgatttttttacattgattatacatgtaattgatataaaatatgttttttttacattaattatacatataatcgatgtaagtgtaacatttttattggaaatgatactgaagatcactaataataaattttagagatatgtatgagtattattctaaaggacttatctatggtacttatacaagtctcatcaaaattttgtaatttgatcccaaaattttgtaatttgatcttcatcaaaatcatttacattgaaaccttggtttttttagtaagcttttgaaattcaaaataatctctcaaattttttttttaataaagtaaaatgtaaaaaagattgaacaacccattatcacacgagcaaggaggcaaatcgatggatttacaatataacaaactcacatagcctaaatttcatgtgcacaagactttcatctcttgttagttaatttgaattttttttatcacaagttgatatataaattagtgagtcaaggctattttatgtaatgtgagactttttcttgtgtaatatccattaaaactataacatttttttatattagttgtgcatgtaatgatgtaaaaaaataatgcacctaggttcaaacttgtttcgggcaaaaaatgatatattttaattttataaggataaaaaacgtactaaaaatttcaatttttttaaaacatactcatatttatgaatttatgaagataaaaaatatattttagcatttattttattcttctaattatgttaattcaagttgaattgtttttaaaaaaacatgataattaaatcaagaaacacatatttatagtgattggttcgattcaagttgaattaattttaaaaaaatgaaaaattaaatcaatataaatctttctacacaaaagattggtttgattcgaattgaatgaatttgaataaagaaaatacaaacaatttaattgattataaacatccttatcctaattgctataacctcaaacttaaactacaaacataaatggctttagcatctttcatataaaattattatatttattttaaatataggaagtcaatctattaacccatcactcg

SEQ ID NO: 1244 - DNA, 1200 bp, Glycine max
  Soy_ogl_291 Gm01:52360501..52361700 Cluster 5
cccacagacgggtgcagaaaatacatagcctccacttttgtagctttccactttttaaatttgatcatgttctttcaatttttggcctccaagagccgttgggatcacagcattttggattcttaatgttacctagggataaaacttttaaaataagattctagtaatgttgatttaaccttttattaataagtggtttagttagtatcaactgtagattaatttacacaaaattattttcacttaatcggacattttgagcttaaatttttgtatgtatgtaactatgtttaatactaaagtgatagttttgttctttataataataataatcaatatgattcaaacaagattatatgtttatatcaaaaaataataattgatttagtatagtcataagtaaggtgtatttctttggtgaccgatattcaaatgttatgaaaggaaaaatcaattttatttaatgtttctattttttttctctcttccataaaattaatttttaaagattagttttaaacttgtcacagatattgtacaacaattaaactcgtcagttattctaaaaattaatattatgaaaatttaaataattttattttaaaatactaaaactaaatttacccatattagttgtgcctcacaatatttgttggggttggtacggctaaaatattcttccacttgccaattgaaatgccgggcaaccacgacaaaaatttaaaaatgattattttaggcagaaatattagaattttttaaaaaaaatgaaattacttgccttaaagattttttttatatatagaaataaaaaagatgcatatcaactcatacacttttttcaattaattaaattaaatatttttttaattaaaataataatttaatttaactagataattaaaactacggttaaagatattttaaatttcatttttttttatcaaactctttcttaagttaagtaattgcccaatatctaaataagtaatttgaacataagtatttaatgtgctgaaactaaatttaaattgattgaataatgtctaattttaatttttgataaaaataattattgataaaattttatttgtttcaactaaactttgaattagtgaaattccttttttcctaaagattaaaaaaaaaacctacgcagcgaacgtatatctttaccaataccatcaaatactttattct

SEQ ID NO: 1245 - DNA, 1680 bp, Glycine max
  Soy_ogl_1553 Gm05:2540521..2542200 Cluster 5
tttaataaataaaaaaattccaaaaaaataaaatttctacttaaaaagaagaaaatcttttttttttaccaaacaccactaagatgtttggacaggattatttttagggaatctttttgaggataaagttttttttttcagaaatttatgtttgagaaaataatcaaagtgataaaaaaatgttgtttcctatgatataaaaaaacgtttttgttataagaaaaaatgcggagattataattaaaataatgttgttttctaccacaattaatttttaattaaatgttaagtcaactgctatatatattaattttgtttatacgatcttaataaaataaattatctaaaactcattttcccctaatatatacaaatataaatcttatttgtaaaatttattctaacaataattaattatagataattgattgataaaataaattttttccatggtcaatctgaacacatgccagtagtattatctagtattagcacatgactaataatcaaacataatgcttatcctaatatgcacactggcttacatatttttggtgtccctacttgtaagtgtggcattatttagtaaatggcagtttatttgactttcatgctttagtattgtttttaactattacttatgttttgtctagttataagattatttttataagattattttataatttttaaatgtattaattattttttcttatatatttttttttcaaatattaatgaaaaataaacaagtgaataaagagataaaaaaaatgataattttgaaatcatagtataattaattgatagatttaatgtgattaagtaaattagttacttttttaaggaattaaaaaaattatatttaatgacggaggtaatatacttttaaattatatttttacctgtcaatctcacttgattaaatagaggacataagttattataaatctcatcacattgtcatgccttttgattccaataaataaaaaactatatttttaccctataaactttatattacttttacatgaaaaaagaaaatcaattgaattttttttttggcaaaatataggtgtgataagttgtgtaaaaaacgtgagaaaaatgtttattttttgttgttgttttaatccttagaaaaaaaattgatttgatttttctaaaaaagaaaagggtaaacagaaataaagagaatgattgagcgattcttataggaagttctattagtattttttattattatttaagttctgttagctaaacagtctcattgcttggattcgacttattttaattgaaatcatttaattataggggattgttaatgtacatatttcttttttaattgaagtgtattagcaacctacactaaaatattttggagaaaaaaaaaatcaaaaacttattttacttaattaatttaatttaaagacattatagtaatttaatgtttagatattataaaaaatgaaaaagaaaaactcgtttctctatcctctttatttttttcatgcacttttgaaactcgttgaaacggcacagggcaaaactcccacgaagcaactaaaaacattgtgaccaaacttttccgaacacaagcctcgacaccattcatgctttctcactattttgttctcaaatttaagaataactcttttctcatattttaacactatt

SEQ ID NO: 1246 - DNA, 1574 bp, Glycine max
  Soy_ogl_1693 Gm05:37175001..371730 Cluster 5
atacatttttgtcgtgttattttttcagtgaaaaagttaacaaaataaaaatatgtttccattttttattttttctaaatataagttgtttttaaaagtaattaataaaattaatgcgattttaatgtttagtgaaaatggtgaaagggacaacattttgttgtatcaaacctcactgtgacgatacagcatagttttctattgtactattactaccattattactaggaaaaaatggactaatttatttcttacataaaggtaacattctaggaagatatgggtaagtaattttagtacgttctttttaatatagttttattattaattttttttagaaatcatgacaatataactgaaacttattaaataaaaagtaagatatatgatttctttagtttaactaaattttaattaataataagaatatattttaaaaaatgtatcaaataatgaaataattctttctgtgaatagtactgatcaagtcatatttttaacgagcttaatcttttgacaaacataagatttaggcctcaagtctactttattttttaaaagtttagtatttttaaagtcagctaattagaaaccttatttattaaaaatacattttttagtatggttttcgaaattaacaaatagaccgacatatatataaacagataaatgagcctcaacccttacatataccatcagaatttgtttttaccaacaaataattatatcatttaatttataataatattcaaatgtcatcagatttttatgtgttgtcaactaaattgtatttattgaattaaacctttaaataatatatttaataaataaccttacatctaattaagtctaatgttaattaggctattaatacgcatataacattaggctataaataaaatattttcacccctaatgattaggatatctcgtataaagtgaaataaaaaaacgtaaaaaaggaaacatactgaactatatctatttcaaaaagcaaaaagttaaagtatgttcagacccttttatttacttaaaattaaatgcattgtgctcttaaccaattaatttgatctatccccggttactttgcagtttgcacaacctcacttagaatcaagttggatacatacataaattaatatacataaacatttttaactgaaaaaattaattaagtacaaaagtaatgaggaggttttgacgtgtaattattattaaatatagatgttttgtttttttttttttttttgtggaggggggttgtctttaggctaagaaattatgaatttatttggataaaattttataaaagcacttatataatataaaaaaataggaagaaaaataaaataaatttctctctcggctaacttgtagaagttctattgcattatttttcttggactcaaatataaatgagaaaatgctaaagctaatttgatgtataaacaaattttaattaattgaaatctaattaatgtcattatttcaaaaatagtcttaagttaattcaaatgttttcatcatgtctaataaatatgattaacctagtttaggaaatatgtttttttggt

SEQ ID NO: 1247 - DNA, 1900 bp, Glycine max
  Soy_ogl_3340 Gm10:3098501..3100400 Cluster 5
agttaagcaaaccaacaattacacttttaatgtgtaggaaagattttcttagccgtaactcgcttctgccaagacacatataactgataaaatatttgattttaaacttttgcttggttcctttccaaggatgctcattaagccagcccaagcaaagtggcaaaacgggctataaggaatccaaagatgatgtcaactggcttaattaaactccttttaacaccccttccttgaagtaacaatatttcaatctttgagtgtaaaagaagatagaaaaagaaattaagtgaaattctagctagtagctagctataggcttttgatttattaccagaaagaatttaatttgaatgaattggcagttaaaaactttatattatttgatatatattgttaaaagtgaattggtattacatcatttaattaaattgacatttcatatataaattgttaaaatttaaaggaattgtctaactaaccacatataaaaattgggttaaacaagtctataatagatgattaatacaattctttcatgtattatcaatatggttaatacaattttttaactgtatcagtaatttacgattttgttcgaacctatttttatataaacaaaggttaaattaattttttctctaattcattagttaggtttagcttggtttttttattatttttttcaatttggtcttttaaattttttattcaatttggtcctttaatttttaaaacaatttatttattttttgaaaaatatacattttgtagccctttaaaatcaattaatgatagttttaaactactgtaaaatatgatttcttataatttagattaaagaatcaaattgaattagtttttaaaattaaagaatcaaattgaaaaaaataaataaccaaattaaacctaaataataaatttaaggacaaaaactaatttaacctaaaagaacctatttttatatgtaataacttagagaatccttaaaattattagatatatgtgacaacgcatactacttttatactctataaaattgatttttttaaaaaaaaaattaataatgaatatcataattatatttgcaaaatgttgtagtccattcatcgaccattaataatgttctatgatgataaaacaacagttaatatggtccaaaatcgagtagtcactttcaacaaaggtatatttccagtagaataatgaacctactattgattgtgtcaaaaaaattgaacttactattgatttttattggattgtgcacaaagtagacattgaccatttccaacagcatctaatcttaaatgatactgttgcaaggaaagtcaagcattatgtatttaaaaattgatcaactttgggctaaaagaggttattcctaccgccatgaaagctacaaatccttttgaaaaccacacgtaattttggcaagataaagtgcttaataatccaacacgtccctaggaaggcaagttaggtttagtggcatttgtcatttgttagatagtgtcaccgttattgtatacatgaaatgatgaatgctctcttctttgtttcttatataacaataaattattatacggttcgagactacaccgtgattatactctcttaatctcttttctttttaaatcactctcttaatttctatatagtatatagttgagtttttttaatatataagaattaatacaactcaatatgtgttatgtgaaaattgacggagatgatatggtcatgtaataatttctcgtatacaatagacattcatgcaacattgccaccactagagccatacaagcttctgtatcgtcctttgtctttaaaatctaacgcaaattgaaggataatagtggttggttcaacgaggaataattgaccatttgggtttaaaaaa

SEQ ID NO: 1248 - DNA, 1200 bp, Glycine max
  Soy_ogl_3517 Gm10:43500501..43501700 Cluster 5
atttaaatttaactgagtcaaaatttaatgttttttaattttgcaaggaaaaatatactaaaaaatttgtagaaataaaattcaaatatttttaattttaagaggataaaaaacatattttaacaattttttaattttattatttttagatcatcataaaattaataatttaatatttaaagtatccactaattttattaacaattaatttaataaagtcttaattttttttctttcaattatatttttttatctacaaaatttaaatttgacatctacctaaagaaatccaatttaattttatttagaccaataacatgtgattcttattttttatatatgataagtattgatttttatatttaaaaaatagtatatatgtaatattttaaaaatagtttatatataatatattttttcggtaaaacaataggaagttctttaccataaaaaaataatacgagttataacgttactctttgattaaaataatagccgcgattatgtttttattcctctaaaacttaacgcaacaagttggtcgatatcatatattataatctgataatgtgtgggatgacggatgaggtgggtgcagctatgagttgtcagctttcttcacgtcacatgttttgagtaagagcatatttaatcgagatttttttttaagatttcttataagtgaagaaattaatttttataattttttttatcgaagtaaatttatgtgacagaggaagtttcttaaaattaaaatttgtatcttcaacaataaattattttttaacaataaaaaataatatttatttgacacataacagtgtcataattaaactataattaaataaaagtaaaagtaaaaaagtataaaaacattggttttttgaagtttcttaaagtttttttaatattgaagtaaatttatgtatgattttcttataatggtatgggactatgaaacaacaaaaaataacttaaaaatctaaaatgaagggtaaaagatatcatcaaaacacttccttaaaaagaaaatgaattataaaagtgattgtttaattgtccacttaaataatagagttcaataattaataattattcggcatgtgaatcatgtattataagagtgttccagtttaactaatattcttaagttcaagttttatattttttctttttttatttataaaacttaaattttaa

SEQ ID NO: 1249 - DNA, 2100 bp, Glycine max
  Soy_ogl_3631 Gm10:48714101..48716200 Cluster 5
actcaagagtcaagactaatttacactcaggttgccttcagttcgtggcgtcatggtatgaaaaatcgtcgttagccacgatgatgatggtctctaaagtgtgttgaatgtctattttcagtttgcaaggtaaaaaagatcaaaatttctaacaaccttttgatacaacgtagaagcaacaaatggttgctgcaactcaaaccttgaatggtttgaaagggaggtgaattggaattttttttttttgttacaggtgaattggaaatttgcaaaataataaattatatctccaaaaatgctttctctcataagattttttgctaacgtgggtttatctagtctaatgtcaacccaaacacacaaaatggtgtcctgtaattaaaaaaaaaaaactaaaaaactagatttagcattttattaccatcagttgggttgaatgtgtttttctcatgaaaggttaataggcggcgcacgcacatccacattttaattatattttttagtttgtatggaaaactttaaataatatatcaaaatagtgttatagtttttatagttttaaaaattctgattttattaattaatttttaagttttctttcatgttaattgttttaaaacatcatatttctaaaacaaaaaatgcaataattttatgttggaatcttttgtttttaaatctcaactatttattttctcaacattttaatatttccaaatttagtcttttcctctcaaatttaatcttcttatatttttttgttcttgttatgtatgtaaagactgtgtataaatttctcataattgaaatatttttccattaagtattttttgtgtactataatgcataagacacctattaattgctttcaaaatgaaatacccattaattagtttctaaaatccatgagtttctatttctttgaatggtttggaatccatctctaatcatatacgttaagatttgttcataaaaaaattctttgaattagtttcataatcttcaccaaaaaaaatttgttcgtaatcttgagcaaggtgacatttaggatataccttatttcttggtaagttatgtacatctcataaatcttataagttatatgttttttttctttttaaatgctattatttaaatttaactaattttaattttaaattttagcataaccatatcaaaattagtagctataaaaaatgttagcttaaataatcatttagtcccaataaaatattcaattttttattttagtcctttaaatatattttttgttgttagtcccagtgattttcttaaattttaaatcttttgttgttagtcaatgttgcagcaacaacgtaacgttattaacagataacgtaatagaaatatatggagtttattgatttattaagccattaaagagagtctgatggaataaatatgtgtaatttttttgtaatttgtttttaaattctcttatatttacaataattgataaatgattaaaaatacagtttataaaaaaaatatgtagttattcaattagactttttaagaatataacgagtcaatatcgtcaattaatattattatttaacaaaaaattcaattttgtagggaaaaaaatctttgaaagactaaaactaaaaatagaatattttataagcatcaaattgttatttaagctaaaaatgtatcttaattcaattactttaaattcataattttcccttaaattcaaaagtcttgtatcattttaattcataatattgttaacaaataatattgttataaaaatattttattttaaattttattaaaattggaaaactcatataatacacgaaagacttgttgatacatttgctaaaagtaaaatgctcaggatacaaaaggacatactcaaaatatgaaatttccgtaaaagaattgctaatataactaaataattttcaacgaataattaactgaacataatgttatatctttggtgttaattatcggtacaaatttatataatcagagatggatatttcgtcatattccaaagactgaggaatattcttcttcttatttttttttccgagagtcaaaaccaagattattgacttgtgacca

SEQ ID NO: 1250 - DNA, 1900 bp, Glycine max
  Soy_ogl_4524 Gm13:37630901..37632800 Cluster 5
ggataaatagataggatcaaaagaaacaagaaaaagcttctttcattcattggtcggtaaaatgcacaacagctcaaaggaccaaaaatggaagtaagcctgctgatgcaacgatgagcattccaatcacttaaaatgttgtcggcaacttgaaaatttccggcatcacatatttgttcgaaaattgcacaccctaattttacatattttgtttgtatttatctatttagaaaaagttaaaaatataataaattttacttattttgtttatcttattttaataagtaaattttttcttcatatataaacattttattaattttaaattaatgatgacttgttacatagaaaaaagtttaattaagatggcttccatcgacctaagaaacagaaagatgacttgcataaataaaaaaacatatattttaagactacattacgtattagctaataacttatatcaatatttctaaataattcataaatttccttaaaaaaatgaatagtatatttgttacaagaatatttttaagccctaaactgcaaggagttgctattcccaccttaataatctctattttcaacccagtatttttttttccttgaaaatattcttaacataaatgtgtttttgttgtacaatatacacattgaaaatgcattttcattatgttaggatgtgtcttccatatataaagaaaacacattttggttttgcatatataataaaaatatgtttctattatgtacggaggacacactccttaatacatcgaaaatatatttttcttgaatatcatatacaaccagagtgtatttttgttaagtatttgggaaacataaacaacaaaaatatgtattttgaatttataaatgatgaaaatttgtttttgcgatgaattttgatttttttttaaattcaattttttacgcacaacttttaattattcattgatgtgtgagcagggagtgtgtttgaatcaacgtgatctagaccctccattaatttttgtgtaatctcgactgttacttttttttatgcacaagaaatttttttgattggttattagcgtttgagcagcgcacacatttgaatcagtgtgatctggacccttgacttattgtgtgattgtttttatttttctgaggacaaagcttttttgtgattcacttacaagtgaataagacacatgcttgaattaatgtgatttggacccttgatttattcagtgcaatcttgattgtttctttttctaacgcagttgactaagcttttaatcattcactggcgtgtcaacaatattttcattagtataaaagatatatgctctaaaacaaaagcattttaaagttgcgtcatacatacgcattgagagattaattatgaagtactgtatatgtgtatgcgaccattcatagttgacaaccaagattttaacggctgatacaaggaagtcgactggcccaatccaacagtgtactgtgagacacaaattttaagagaaatttgtttacgttaaatatgtaattgtacccttttttaataaatgtcacatttctttatcataatatcataatgtgatcttttttcattataaatactaatattaaatatttttttgttgttgatggacttaaaatttaagttttaattattttatcttcacaatccttgaaggcaaccattcatatatacctaccaagtttgtcttgcttcatttttacgaaattgctttcaatgatgtgtatacctgcaatattaattgtgtgtgctttgatataaagtaaaatcagagaggatcttacaagcgtacaagaccatcattatacgatatgcttctttgactttgtttcaagttgggcaggaagttgcatgcatggcttctgctgatacttgatg

SEQ ID NO: 1251 - DNA, 2074 bp, Glycine max
  Soy_ogl_4930 Gm15:8921701..8923774 Cluster 5
caacccaacccaacccaaaacataactctttgttattatacaccaaacccttcatgtgcatatccgaatctcttctcacactcactccaaccctatatgcgaaaaaccttccctctgtgcaaagccatttttccatctgtatgtcttaaaataaaaagtaatggcaagagttatattttgaaggttgatgagagaaattatatatattaaaaggtaatttaagaataaaaattatgtataccaaaagaaataattatttttattaatatatatattttgtccatcacgccatccgtcatattgacatgacacataaatgtgctcactgttatccaccataaaatagtatattgataaccttgctttgatataataatattgaatgtatctgacatcagaaagattagagattaaacggtcttcttactgaatattaaatcaataattaaaaaataacaaaaatatcaaatttacaaatagccttttagactttaattaccaaaaaaaatccttatattacacgacaaagactatatatcattaaatgaacaaatgagttaacctatgttatttgcaacctaaatagaagtaaaagtatttattgggtggtttgatttgattttaaaattaaaagtcatctgggttaaaaataaaataaaaatacagtttgaattagtttgattcaaaccttaatcaaatcaaattaatcttttataattctataaactcaatttatataattattatgcaatattatttttaaaaaaaaattctattaaattttgtttaacatattttagttaaaaattattatttttacttccatttcacagtaatataaaatgatattaccaaatcttttttaacataatttatgtatcacttatatttaacattattttttttaacattattaatacattcttttaaaaataatttaatacaaagaaaaatacgtatcttaattatacaacaaagaaaaattaataaattatttattattaattaccacaataaaaaacaatgtaattacaatatatgatttattcggtttgttttgatttttatataacaaaatctgaaacaaaattaaactgcaaaaaatgtcatttttttaaattgttttgttggattttggtttaagtgattttttttttatcaatttaatggtttacagataattataagtaatgtcctatttaaaatggtaatcactaaattttaagttttgtaataaccaagcgaaagaaatctaaaataatttaacactaactccctttagtttttataaaatatttaagttgacaaaactctggtattgaccaaatacaaaagagatttaaaacgacaaaactctggtattgaccaaatacaaaagagatttaaaacgattaccattaacagtcaattttcataataattgtctaaataagaattatatttaaaccaacttttatgtagggagacaacacatagtttattttattttttaaactcaagacaacacagagatgacggaatgtaattaaatcctcatttgtattaattgttttaacttcttaatgtgatattctcagttatttctcttggtttataataaacaagctaagtattttaatttcaataaagattaagacataattaaaaaaagactaccagtaattaatattatcacttttttaaatcgtaaaataaataaataaaacttttagaagtggacggttagaaagatactgaacaaattatatattactaacatttctcttactcaaacactacttaaatgttttattttaaaaattaattattgattaatccaataatctagaaataagaatggaataaaaaaaatacaaagacatattataaatcaatttcaattttaaagataataactcaaatgaaaattataaatactacttatttttaattataattctttcatttttaaatgatttaattttgtgtagtaggtaaataaaagtaaaacatgaccttgagcaaagaaaactacatcaataaatgaaaatatgtaccaaaaaacacatcttaatttgtcactacataattgtac

SEQ ID NO: 1252 - DNA, 1983 bp, Glycine max
  Soy_ogl_6275 Gm18:59419994..59421976 Cluster 5
catgatttgattttaatgggagggaagtttagattattttcactccttatttcttgttttataagtacacatgaaaagcctaatggaagtcagaaatactttacaaggaggtctttaactttctataagacttaaagagtatatacagaagtcagaaatattttacatggagatctttaacttaatttttgcaaactgtactaaaaagaaatcaaattttctaaatgattaagatcttgatacctgtataagtactagaccgatatttattcaattttaagtacgttatctacataacatcttaagatactgattaaaaaatatagcatcctagaataagagaatttaatttagttttattataatgttttatcttgtttagtctttttaaaacatattttttaagactttaaaattttgttgttcgtaatagttttactggtctcaaataaaattgtttttttattgataaaaccttaaagctttaaaagcatattttgacatataccatataaatgatctaaaatttgtataaatcaatagaactaaacttttgaataagtctcttaaagaaaactttgaataagtcagcaaatatatattttgaaatactccaataaaattttaataaaatgataataatagctttagcactaataaagctattattatgttatttatatttattcaaaatgggctgcttgaccttctcttatcttctattgcaatttgaataactaaaaataatgagaaaacatttattacgatcacataaaagtttacattgattagaaaaagagagcatcttatatacatgataaaatttagctgacgtctgaataagtaaaatataataattagattattttttttaaaaattattctccaattaaaattggaattccacctcaataacttatattaatatttagggatcacatctaaaattttaaaaatgttaatgttgtcatcataaattttttttattaatttaatttttgtatcagtaaaacatatttttgttagttctataatctcgttataataaatttaattactttctctatttatatactcaagcacaattattatactaaaatctccttgtttcatttttcccaactctcatcactacatagtatgagaaaattagtgaaaaagtgatactaaattataattttttgggatgtttacatgtttgttaaatttattttggaggatttatctatcacaaattgttcattcatttgtaatcaaattacatgtgtaacattaaattaccatttaatagagttatcattcactataagtaaaaatatgttttttttcatcgggaccaaataaatataaaaacttttatgagtataaaattaatattttaaaattttaaaaacaacccaaacatattttacactaatatttaatgcaaacttttatcatgtatattttttttactgcaacttttatcatgtataaagagtttttaaaatatcatttcatcacacattgtcatgtacttttattcatcgcggtagaaattggattcaagctttatttcattgcacagatttatatatatgaacaagattaattgagaacataaaaatttattgcagtgatgatatataaaaaaataaactcttatttatttcattctacttctttttttccccatcaatttgaacacaaccttattgcttgtcttaattttgaatcgagattctcccaacaagctatttttcttatcacaaaacgagttacatggaagtaaatgccttaagttatatttttaaaaaataatataaagtatatatttcaactttttattcatcaaaattgtccctaatttcataattatcatacttttcatcaattaatagttttattactacaaaaatgctcataagtttcttaatttataatataaatttgtttcatctgttggggatgattccgagttttctaattattagtactaaatta

SEQ ID NO: 1253 - DNA, 1200 bp, Glycine max
  Soy_ogl_6788 Gm20:36521701..36522900 Cluster 5
aatgtaactctctcgacttgcattcatgttgacttaaacattagtggtccagtgaaaattctagatgtttttgggtttaattaaaagtatcagtatttaaatattatattaaaaatttgatcaattaggttaagtcaagtaatagcacactaggatcgataaaagtcgtataacagcatttccatcaattaactggatattgaaattttggttaaaattaaggtttaattataaattttatcatcatattttagtgattgtgtgaattttatcgatgagcttgcattcttgtgaattttaccattttgttaagtttacatgaaatctcaaacagaaagatgatatgacagagaagataaatgtatcatgttgaaatttataataatataattataaaattaaaatattttagtttttataaattaaaaactaaaacaatgtggttttcatttgcccctgcagcctcttccttttcgtaaaaatgatatcgtttcaatttttaattataaacactaaaataaattaaccttataattatattatattataaattttaaggtgacacatctatgttatttgtcatgtcattgttctgtttgagatttcatgaggacttgatggagtgataaaattcaagacaattgaatattacaatgataaattttacaataataaaagtttgatgaaaaaatttgtacaatcactcactaaagtatgatgataaaacttataaataaacctaaaattaaatagttttatagtagttgagttttttttttttcgtttagtagttgtatctttagactaaaagaatacagatatgatattatcattatctttgatataataaaatatttttttgagctagtcttatgtttctattgatgtcaatatcctctattttttttttatgaatactgcaacaggaaagatgacatggagtctacatggagtctatcttaactgttaatactttctctatgttgaaataattgttgtttcaataaataaataaaaaaatcaaattacttgtcatttttagcattaatattaataaaatgtttatgattttttctcaataactattatataatttttcaatttattattttattgaattctgaacattttattttcttttaatcacccaccctgtgtctttacaattttaaaattaagtttttaggagatgaaatatta

SEQ ID NO: 1254 - DNA, 1274 bp, Glycine max
  Soy_ogl_19 Gm01:1339227..13170 Cluster 5
cataaattgtttgtttgaatgatcctcaatttaatcttcgtatgcaagatttcgaattttagtctttttgtatataaataaattgtgattagaaattttttttactaaaagtgatcaattatatttttttgatgaagattaatcattatcaaaacttcacaccatgttatagtattaaaaaaagtagcttaattaatgtaaaattttgcaaatataatttatgtaaaataaaattttaatctgataattaatttttaaataaaattatgattttatccttataaaattacctttatcaaaatgatttcatccttgttattttgtgttattaataaattttttcatttttgtagatcatttatttttagtccctattaatatttttctaaaagattaattcaaaatgaacaaaatattattgttgagaataaagaaatagatatattacaagaactctaataaactaacaaggatcaaaacaaaaaatagtattaattttgatgagaaccatttttaaaaaattaatttcataacaaccaaaacaaaacaaaaaatagcattttttttattgttcttaacgatagtttgtacgactttcatactcataagcacctcttctacctctctgaaagagaaataaataaataaaacaagaccatttctaccagcaagacaaattcttaggctgaaattctttggcaggtgaaaatcttagaaactacagataatttctaccagcaggtgaacagattattttactttagtgatatatgcatgtcaatttgatcattttaaagaagtaacatcaaattagtccctcctcgatcatgtaaaggtgacacaaaaagaatcactaaaaacgttgattgaggaactaaatcaatcgatatcatatttcatgatcatgagctaaattataatgtaaactttatttatatgatcaaatcagtatcagataaaattaaatactgacattttaaaaattgatcttgattatttttttcgaatgtgtgtgtatataagatatatactttatctttccaataactaattaattaatttgctgttcaatgctaagaatttacgtactttgggttttatctagtttgaacactatgccaccagaaccttctcaaatgtcaaacaagcactctcaattaatcaaattgtacagtgttggaaaactatgtcaaagtcttacattttcctagctgcataagtaaaatctgaaattttcttaaatgcaatcttctagagaagttcatagttgccca

SEQ ID NO: 1255 - DNA, 1298 bp, Glycine max
  Soy_ogl_36 Gm01:1768101..1769398 Cluster 5
atgtcactgttctcgagccacagcatactttttttttaagtgacggtacgttaaggttttagaaaatgtcccgtgaataagaaaataggatattaagaattattctgtttatttaaagtatactttttagtttttagttgtgggtagttgaaaaaacaaataatagaagaataactatagatgatattacatataacattcacttttaataaaaaaaattattaatttttctatttattaaagagaagagactcggactaatctaaaattcatataagaggtaattaaaataaaatattattgaaacgatttgattttaattttaatatttaataaatagtagaattgaacgataaagtgcataatgatctgttatataattagtgaggaatataaaatggatagtgaagtaagaaacaaaagtgagggtggctttcagagggaaaagtggtatacacgtgaagtggagaacaaaaagatataacagtttatacttaatatacacaatacaagcataaagtaaaacgtgacacaataatgaaatggttgacaatattttaagacgtcaaatgaaaaaggcacgcaataaatcagaacgaccttgtccatggctcgtcaacaaactctttcttatcttgatgtgcttcaaatgcaaatcatccaggtagaaaaggaaactaatgttcaagaataagtgagattcataatattttttataatttaaattcatccgtttaattttacttttttattattatattaaaatagtataaaagttatgtacaatattattatatttttttattttttttcttaatcaaataagaagaaataaaaattttatttgtctctcttttcgtttcattcaaataataaaacaaaattttcattttttcatccaaaaaaaatcatagatgcttatcatttttttcctagtgtggtaatatattattacatacaaaaatcagttctaatataaacattaattttttaatgataattaccagttgttccagtgtataatacactatcatttttttataaaaaaaattataagtaggattatataagagtttattttaattttttataggagaaaccatgagtatcttataattcaatgagtcatagactcatcgtggtacataattattattaacttaaaaaaattatacttaaaaaaaattaaacacaaattatcttattaaataaattcttctctcacataaacaataaaaaaaaaccttacacaatttcactaacctgtaggttatagtttttttataatcttttattat

SEQ ID NO: 1256 - DNA, 1400 bp, Glycine max
  Soy_ogl_1441 Gm04:46597901..46599300 Cluster 5
aatttaattgagatccatttactaaaacatgtctttgtttttaaaatttaaaactgaaaacgtataatcactcggaatatattttaggttaataataactttttgctatatagtaaataagcgtgaatggtattcgattatcttttttttttctctctcttttcaatttcttcttatttttcttaaacttcctcagatatttctttttttttttcctcacttttattcatcggatctctcgcctatttttttttctattaagcaaactgttagtcactaacccactattgtaacaaaaaaaaaaaaaaaaactcactaactcaccatagtcccacagtaaaaaaaaaagaagaaaaactcactagagtccctttactatttattttccatttaaaataacattagaattaagcaagttataaaatagcatcagctataaaaaaaaatgaaatgctatttttttacttttaaaatattaaattgtatatcaaacctcaaattattatcatcttgataatctaatttgtcatttaccaatattaagaatacgttcaaaagaataataataatttcattagtcttctaaaatatatacattttatactgattatagattatagattatagatattctttattgaataaaattttacttaaaacaggtaaaaccattataaaataacaatgatatttttgcaacaaaaaatggaacaagaataaaacttaaaaaattatgagtgtataatgagaaacccatatttttcggtacggttgcctacatgtcatcaagtatttcaatcgatattgattactttttgcattttgttaactagtgttttttggaattgaaaggaaaaaaaattattttttgtggaatttacaaaaaaatataaaaaatcttatggaaaatacaattttacacattataagaaagtctattttttactagaaagaatttttttttactcctcctataaacttcaaaatatgtttcgaatattgtaacaatgatatatgatttcacgattatttttctgaattattttttacaaacaaagttaaaaatatcaaattttaaaataattaattttaatataatatctacgttgttaactagaaattactttaattataacttttaaataattattataagaattaataattttattatatatgattatttaattttggatttgttatattggaaatgttaaccttcctatagtatggtaatctaaaaatgttttcatttttttacatttaaatactttattaatattattttaaaacaaagaaaaaaacataaaattagataaaggacgtttgaatttaataaaataataagaataaaatagagaagaaaagaaagataataacttataaactatgaccctaaa

SEQ ID NO: 1257 - DNA, 1300 bp, Glycine max
  Soy_ogl_3725 Gm11:4396801..4398100 Cluster 5
cgcttcgtgtgtgtataaaacacacgactttttaaaacaccactacattttgtacatacgaaggttaatttggtgcacatgtcacttgaaatgattattttttggtttttaaataaacaattcacaaactcaaaggaatgatgcaatagtataaaatataactagatttatatatgggaaaatattctattattgagataatctgtattttttcagtatgtaaaatttctttacttctattaggagtaaaattaatttttgactcaatatattgaaaaacattcataatttctattccagaaaaaataacgagcaaataccaagtagtttgtctttgatagaataatgtggagggcaaagttgaaaagatagtcaatcaacatctttcatttttcaggtaccacaagtgaaattaatttttgattccgtgcattgaaaacatttgtagtttgtgaaaaaaaaaaaggaacaaataccaaatagtttgtctttgatagaataatgttgtggataaagttgaaaagatagtcaatcaatatctctcattttatttttgtattttgtaatttaggaatgttagtgtcattctcttttacactctcttcatgattaactataaattattgaaaatcataaattttggtgaatttcatttctaaattaagagagaaaatcattagataacaagtttagttcaaccaaattaatgatttacaataaattgtatctaattatagatataatgtcagcaagagaatgtaagaaaaagtgttgcttacattccttttttcaatgtttcatgcttattgagatttttctttttataaactcgcctattttattccttttataggtttaaccctttatatataatttaatgttcaatatttattcttttcaaacttaaataaaaaaatcatataattattgagtaacgtaaatcaattctcatacatacataattagaggaatctaattgttcaattgattaaatagaatgtgtgaattagcaatttatttaaaaccttctacctgtctttgatacggataaataaaaacacataatacaaattacaattaaaattataagctacacgtctacacatctataattaaaattgcactcaagaatattgctggtgattcgaccaaaagtttgcgaattactattgtacgtacatttgaaaaaaaaaaagttactccctctttgttgcagatataaacaataatagtttcttattttttttatcttattattttaaatataagtaaattttaattattatgtcttatttaataa

SEQ ID NO: 1258 - DNA, 1174 bp, Glycine max
  Soy_ogl_4696 Gm14:5898401..5899574 Cluster 5
gtagttttggagaagaacacatttttttttttggctgaagagagtagaaattttttgctttctattgttttcgtacacatttattttacggaggagagagtaactgagttacattgtttttatacaatattttataactttattttacatagttgtgaataattaaaaataaataactgtcacttaaatttatatattttacaaatattttttttaagaatattagaacaaatctttagacttatgttttaggtttggtagtcaattacttatgagaaatataataatatcctacaactttaattctaaaataattatttttaactaaacgtgcaagattaagatatttctaaaatatgcattttactgcttttacaataaaaaatatttttaggagaacaaaataaaaattttgaggatatttatttatttatatttttcgaacattgttcacttataaaatttaaatttttatttttggagagaaaagaaaatgtaataactgtaatacaaaaaggaaaaaattgttaaacaaatcattttgaacttatttccttgcctttttttaatgtaatagaaactaaaattacgtatttctttagaaaatattttaaagtggattaattttaatacataattttataatcgtgaactattacaactcatatgtactttatttaattataagattaataaggtgtgttacacttaagttatttttgaaagggatcaaaattgaaaaagcgacaacttacctgaattaaaattaaaaaaaatagacttacagacactaaaaattaaaaaacgttaacttgttaacttacaggactaaaaacacattttaactttttttatttatcttatttcataaggaatgactaaattaaagaaaattattttttcagaattttctaaaatgagacggtctccaaaatcaccttcttaattttaatgaaaaatttattctatttatatccttttctatcaaccctttatatttccattttttgttttctattttatgtattttattcacttttttagttttttttaacattttctattgactacaccgtaattttcttttagattttcgttttcatcgttattttatttgataatatgaaagaagaaagaaaggtataaatgaataagagaacaaactttaatattc

SEQ ID NO: 1259 - DNA, 1200 bp, Glycine max
  Soy_ogl_4699 Gm14:5918601..5919800 Cluster 5
tttgtaataataattaccattttattttttaatttcaattttctatttttattattattaaaaataatgatattttgcgtgaatttagaatatctctcaatgtacttagatccatgtaaggagttgatatcttttagtaaaaatcttattttgttgaatttctgataacatgtttaagaaataatgttatttgttaattatatttttttaaaggattgttaactatatgttgttacttgaagataatacgaagtttaattttatttatatttttaatttgttttttttctaaaatttaaattaattttaaaaaatcatataaaacatgagataaattgttaattttgtttctaaattacagtaatgtcctgtagccaaaaaatacagtagtgtcattaaaaaaaaccagtgcataaaaagttatatggacgaagtatatatatgtgtaaaatttttaaaacttgagagaaaaaaaaatcagcatcaacttcatgaatattccttaaaaaaaaacttaatggatatggactaaatttcagtgcataaaaagttatatggacgaagtttatatatgtgtaaaaattttaaaactgagagaaaaaattcagcaccaacttaatgaatattccttaaaaaaattaatgaatatggattaaatttcagtaggattcaatatttagttcatgaaataaccaaattaaagttttcattattttaaagagaggctattcgtaattcatcaaaatcaacgtagattaaatcttaatagaagaaaaagtatatcgtatgtcgtatcacgtatggccttcattaactgcacttggtcaacgctggatatcctaataattcccaatcaattttttattatcagtatttccaatcaaattcaataaataaacttgagattcctttaaaatataggcaagaagttgagttctatttatttattattgaatagagaacatggaccggttttatatatttcttttttataaaaaaaaaagagtctcttttctggggtaaattgtgtgttttatttaatagttttaaaatttctttgatttttcttttaaatcggagatattgtgatcttcaaattttacaaagttatttttcacaaaatttaaatttaatttatttaaactaatcataaaacattacttagaatttaaatttgtgcaagtattatttctttttttc

SEQ ID NO: 1260 - DNA, 1000 bp, Glycine max
  Soy_ogl_5900 Gm18:2422601..2423600 Cluster 5
aagatagacactccttcttgtatactcaaactatgtttagcaagtctatctattacttgattggcctctctaaatatattagagcaaacgactctattcttctgatcagtcatacccaaactatgcgtgactttattaatagttttagtgtttttatgagcactatgtgcctctcaatttataactttttttaattgtgattaaaaagtattgataaaagtccattatataattcttcgaaaaaaagtctattatagaaaatttcaaaaagaatataataattattacgtgaagtaaatatgtaaataaattttaagttctttataaatatttaattaacttaacttctaacgaaacacataaaagtcaaattgaacccaaactttgtcaacttaatattaaaaacacataaatatcttgcgcatgcatgtataaaagcatacacaaaattataattttatgcaagaaatgatatagagaataataatttgtctattgtattacttaatgaatttattttaagtagataattataattttattcatcattagttacctggcaaatatgtaactctaacgtttttttttcataaaggtctcttgtaaattatttattaagtaataaattaataaagaagtaaaataattccatggtaatttcaataaataaaaataatcatttcttaatgaattataaaaaaaaaataggttcaatcttcatatttgaaacaattaaaataaatttgtttaagtaaattatcccaatttgaacagtctcgatatttttcacaagttaattataatctgcaaatactcaatccattgaggcatttacaccttattgggaatgtttaaaatcaattgcagcttacaaaatgtagttacgatatttaatgtcattgttttacttttgtttgagtttaattaaataatattgataattaaagaaaaaaaattataattaactaatccaaggaatatttgctttaataataattta

SEQ ID NO: 1261 - DNA, 1012 bp, Glycine max
  Soy_ogl_6818 Gm20:37796101..37797112 Cluster 5
tgaattcatcacgcatcaaatggcaatgaagtacagaggaagaaaaaacagatggaccttgcatgtgttattttagcacttaaatgttaattttttcttaagatattttaagtaaattgggaaatttttcttacatcagtgttcatatgagtttaatatgcatgtaatcgtgagtgtaaaatttttacattattggataactaaagtttatttttggtataattttaagacaattattataaagatatatgatcatataggtttataaaatttagttatttattatgcattctattcatattttaagttatccaataaggtaaaattttactctcaagttacattcctattaaactcatatgaatactagatataagaaaaattccctaatttacttaaaaatatcttaagaatacataataaacatctgaacttttttgaattataactcacgttacatgactaaatttttagactgtcgatgcatttattatgtattctatccatattttctttatattttcgaattattttagttagtgttacttatttttttttaccaaattagtatcacttaaatttagtaaattgtaatttaaatttaaaatttccatgcattatattaaattgataagtatatagagcacatattttgatttcaatattttattttaataatttattattaaattgaaaaaatatttattttgtttattcttatccagtaaaatggatctcctgttatttacaataaagatattttattacgtttttcttttttcctaagatacatgattttttttcattatctaatcatggttatatttttagttttatttacatatattaaaaaatacttgagtaatataaattggcatttgatataagaaatgttttaacattttttatgaaaatgaatgaaagaaaagtttattgtgtttaataataaaatgcttgagcataaatgactcttaagtatgttattttatgaataagtggaaataaaaacttt

SEQ ID NO: 1262 - DNA, 1000 bp, Glycine max
  Soy_ogl_6970 Gm20:44018401..44019400 Cluster 5
tccaaccactcatgcatccgagaattaaaaaatcacaacatagcccaatgtattctattaaattatttataaatttctgacttcctaatttgttataaacaaatattctttcttttttacaagtagtttcattttaataagtgaataagacaattccactattcagaagaagaaaaaagattcttgtatgttttagtcttcgagtttttttgcgtgtgatttactagttgaatgtggatcatatggttaataacactcttttcaactgtcttcttcaaacatattttttcttattcattaaaattcatgttattttctttaatttgaaaacaagattcaccaaataaaattataaaattatgtttagtaagacatgcattttagttggattttaatttttataagtttaaaaacttatttgaccttataaataatgtttggtagctaaacaagttttttttagtaactagtaacaattttttatgtgctacttaaattaatattttttttaaataaaaatttagtttctaactttatatatttatttatttcttgtccttataatacctattaaatttttgctttaaaatttttaaataaggtaaatttaattatatttttaagacattttaaccattacacaaagcagtataatatttacttaggtgtgtttttactattttaacctcatttggaaaatattttaagatattgtaaaatattagtagtggaatatacaatatgaaaaatataatacttgaaaccaaacaatatattcaaaataatgatttataaataaaaacaataagagtttaaaattaattaaaaaaattataaagaccccaaaatatatttttatcaatcaaattaaattgaattttacatataaaaaaatatcatttgaacgtgccattattgtcattttacatttatcagttgcttaaataaataatttatcaaaccttataatttgataagttagcataacaatttttagcta

SEQ ID NO: 1263 - DNA, 1100 bp, Glycine max
  Soy_ogl_200 Gm01:48461601..48462700 Cluster 5
acataggaaatataacagcttaattatcactacgtcttttcctattcttttcactcaaacttacaatttgttagatgtttcaaacatattttcaccatgtttctttgtcttcttgtatttatttatgttttattttaagaaaaggaatcctatatgagtatatatgtttttcctcattgctaaaacaaattaatttagttattaagttttattaattaaagtgtactttaatataattttttctaagtattaattaatgttgaatattttactgcaaatcagtcgaagttttaataaaagaattaaataattaaattaaaaatatccttttcgactttaattatataattttttttaaaaaaagataataaactcaaccatcctcaatttctttaagtttatatagaatttattttttacataaaaattatgtactttctcagagaaaagattcttcttactttctcttaattcatttcttttgcttaagtacatttttagtttcatcatttatttattttatttcagtttcattccactattaattcaattatgcctcattattttaaaaaaaacattttgtgtagtccttttagtgacagtttaaaactttcgctaagtataaacattggtgacgaaattgtgtgcaaaagactacattgaggattttttttttcaaaaaaaaaaaatagttggaactgattgaacatttaattattagtgtgacaaagttgaaaaaaaacaaataaataacagaaccaaaaatgtagttaagtctttttttttattttttaagtattttatattttattattttattttctcaaatactatttattaattaaatttagtcatattttttaataattttttgggtgtatatctttttttgttaaatttagtcaatatgttagaaactttataagtttgatttaataaattattagtataaatatttttgcaatttcaacgaattaaaaatagcttttaatatgatttttaacataatttttatagaattaataatttataatttatgattaaatgataatgaaaaaactctacattatcaatatgctccaattaaattcatttatatt

SEQ ID NO: 1264 - DNA, 1900 bp, Glycine max
  Soy_ogl_690 Gm02:46141901..46143800 Cluster 5
aatctatagttatcacatatgacattgtctacacttacagtttcaaaatgtggttttataatatataataaatgtcttcaaacatgtattcttattactattagaaaagaacaattcagaaaaaaataaaaaaaaatagtatgacttgaaattacttttgggaatagtaagtgaaaaataattgagttatttttttttttaattctatgatttagtgatacataatgttattttttatatataatataatgtcaacaaattggattaataatatgacattatcacgtatattattgagttttgatagagtctaatttgagtttaaacaaattaagacttatatatgtttctgaaatataatgtttttttagttttggtctttccttgtaattttttttttggtttttaatattttattttactccttacaatacacctatattttttgttttaattcttataatattttgtttattttgaattagtctctttgaattttttcggataaagactaaagacaaatgatttacatattataaagattaaaacaaaacaataaggaaaaaaatatatacgtcttaatttattatctcattgttctttgtttttttttttctttgggtgattttattatctcattgttaaaaaaaacttattatctcaattaacaattagagtaatatcatattataaagactaatctttgacaattaatattatgtggaggcggtttaaaatttgaaatcacttaacagtgatagagttactttaaaaaatacacgattataattgattatttttaatgacctagtaacattgtattttccttaaaaaagtagaattaattttattttattgatccactcatttttataatcatactaagttgtttacttatagtgtgtgtgatataattgataaataattattttatttaaatatgtgattaagtttcaatcattaagtctatgtatgaatcaatatttatgtgaaaatctcaatttattaaatgaatcttaataattcaaggtatttgactaaaattcttggtttggatagagagaaacacgcaaaaaagtaggataaaaagaagcaagagaaaagataaattgagtagaatgagtagaaagcagataattttttaagttgattattagtttaattactctttattagttcggttgaataggcgaagaaaaagaaaataaattttgttgtataaatatatttttgtacttaatatatgtacgtattgcttgtgaaatagaaaaaaataacaatgttaaaattgtaatttaaacgtgggttaaatattttttatctttattttttctcatcaaaaaagagaatttattactaaaaaaatagatattttattttgaaatgagactcactttatgactttattttcttaatttttatgtcctatcttcttattcaaacaacataaagttattttttctctatcccttctcgatcattttctctctactgacttctaaagaaacaaaggtaaatatcccgtccactcatcttaataaatgaaagtagaagatcaattgatcttgtgccatgcatcccataaacttattttaggagtcaggaccaaatttgaaaaactaattctagctcttctttttttgcgttttattccttgaatgttatactggaagtgtttgccagtattgactcaatgtcttccacgtgaaatttatcatagtgaaaaggttaataggaacatagccaaaaatattttagcattggaatatcacattcaatgtcttggctgctttacatttaccgattgatttgatatgtttccattggccaaaccccttcagcaaagttgtactgtaattggttaattgacccaaaggatctagttgccgacgtgcgtgat

SEQ ID NO: 1265 - DNA, 1300 bp, Glycine max
  Soy_ogl_2199 Gm07:4958101..4959400 Cluster 5
ataaatatatctaatattacttgttcatatatagatttttcgagtacgaaatgagttacttcaaaaaaaatcattgctttgacccaaaatattaataatccagcatgggctacacctgggagtattttgccttacaatgtggtccttgctcgttcacaggggattctacttgtattttatgttatgcactaaaatatcaaataataatataaataagaaatattggattagatattctatattttttaatactaatagtagtatatttagatactggtctaaaaaaatatactttagaatttgtactttagactaatatctgatatattttttacatttagaagaatacgtttatgtttattctttacgaatatgatatttttggacatttataataatatcaagttttattcatagtttgacatttttaatttttgaaattttagcagcaggtaaaaataatattaggttgctttttacatgtatttatcacttgccaacaatgtattgactttatcataaatttttattattatctagagatttcaaacgttggttcatgtgaataagatataaaattaacttgataaaagaaaaaatgaggaagagagaaattattgatttgaatatcatatcttttaataacaaaaattaataaattaacactaatatataacaataaaaaaaactttggtgcatgcatatactcgttttagttcgtgtcaatcataatttactcaaaatcagccatcctaactcatatatactagtatttttttttatttcccatgaatgttaaataatatgatgatactactgattaataacatttgtttatataaaaaaaaactctgatccatgaagagtacaattaattaaaaagacttgttaaataaatccatgaaaaaaatcattgacacttattttattaaccaatagattattttttcacaaaaaacacataataataaatgtcattttctattttttataaagaaagagcattactaattaatgtatttaagacattatttgaaaaactaaaaaaaatatttattacataaattattagacaacgtaaaaaagataataaatagtcaaatattatactttacaatatttttattttaaattttttaaccaatatgttgttgaagacacttgttaacaatttgcggtgaagaaatgctcctgcaatgctgagattgcaaaatcattgaaccaattactggcatgggcttcctctgcacaaagcaagagtatgtgtgtgttccctttttgaagacttttttgtatttgc

SEQ ID NO: 1266 - DNA, 1247 bp, Glycine max
  Soy_ogl_4642 Gm14:4154501..4155747 Cluster 5
attaatttaattaaaagtattaaatttatcttaaatcaatacttttttaaattattatggtaaataaaaataaaaaacatttatgagttacatatttctccacaaatgaaagaatttcagttttaaattaatcatataaatattttttttcaaaaatttcccagatgaaaagtaacattattatattccacatcacatgtctttgtattttgtgagaaatatctctggttaattcactgggtgtttagattaataataataaaaataataaagcgtcattatgatttgtatcttcttttctttataagtaataatattatttaatacaaaagacagtttgttaaaatgtattacaaattcattaattttaactaatcaaaagtcaaatacatatgtagtggagatttaaaaaaagtgttcaagatattaaaaaaaatataaaaaatttaaactttcatgtatggtacaaaaatcattttgtcccgttttaatatttttcttataaagactgccccttctttgtaacgccttgtttccttttttaagaaaaaaaaacagttacacgattctttactccccttctcacattatttaaattaaacgaaaaatcaaattacttatcatatgaatattttctcttcttttttctttttgttcaatcatttaatattaaactaataactactgcatgtaaccgaaaaggtttaaaattaagatacgtataattttgtttattatttaaattttattttttttataaaaaagttaattgttttttaacatacgagcataaaatgttaaaaaatatctttagaaacataaatattactcgtaagacattacaactataatttcaaatatttgaaaaaaaatattacatttaagatgttacaaatgccaatttcttttatgtatatatgcagataatttagtagtttcttatctccctaacaatttagtatatccaaccatcatatctttatttcaatatttactcattttttactattgattataaaattaaatattaaaataactattaatttaacttataaattgtagatatataaatataaattaagtataataaatttagaaaaaaaatacatacaaaccatttttcacttgatattaaaaattaaaagaggaaggcggtttcattttaaaattagaataaatttgtcattaataaataattttttttaactattcaagatttttaaagtgattgattaagttaaataatt

SEQ ID NO: 1267 - DNA, 1245 bp, Glycine max
  Soy_ogl_6960 Gm20:43618939..43620183 Cluster 5
caatgctacatcagacttgttttatatttctattagttattgaataaattttaggtgaaagattttctcttaaaaaatgataaattaagaaaattaaatgaaagacattaaaagaaggacaatcaaaatcacatataaactaaagtataagaaatgaaagtagaattaagtaaaaataggttagactaaaatacagtttataatgtctaaataatacatatttcatgaactgtatttaatataatcttcctaacacacttttttgtattgattaaaatttatttaaaaaaatataaaatcagaagataaaaacatcaaaatgatgtgaaacctactaaaatttgatatttttaataaattttaattaatgagagaaaatatatttaaaagagtgtgttagaaaatatatttgtagtatttttctaagtctttttattaaagcatgactaaacttttttaaatgtctttcgtaacccaaaagtttaattaaaaacttaatatgcattaaaactttttaaatagataaattttattttgggagcttaaagctttaaataaatagatggataaatatataatttcaaagtattatattaccatttaaacataataatgatctcattattatgaaaagcttatgtaataataatattatttatatttatatttaattgggtaaattagtatgtttttgtttttaaacgttttataaatttcccttttattttcctaagcaatttttttcagcattttgtcgaaagattaaaaatataatttataaaaaaattacacataattatgctctgaaacttttttatgatctcacaagcggttgtcaatataatttttacattattaattagttttgttgctcgatagtaatggattaaaactattaatagaggacaagcggttgtcaatataatttttacattattaattagttttgttgctcgatagtaatggattaaaactattaatagaggaaaatggtaagaatcgaagatactaaaaaaaatttagagagtaaaagtaaaattaaaaaaaaaataaaaaatacaattaacccaatttacttatgtggattacctcgttaagtttaaatttgatgtttaaaaccaaatacacttttaaaaaaacattaaattatttttacataattttgatcgatcgtgtaaacttaatactactatcagcgtaaccatagactcccgacgagtaagttattctatttctaccaataaa

SEQ ID NO: 1268 - DNA, 1500 bp, Glycine max
  Soy_ogl_1556 Gm05:26201..2652100 Cluster 5
gtgtgaaagaaactaatagaaataatatgcagaatgcaagaaagaaattaatttttgtgaatatcttgttcttcatatttataatattcatgtggcacaaaaaattataaacgtatggcttaaaaaaagttactgaaaaataatggccacgaagccaccaaataggaaaaggaggaataaacgttcagtttttttgttggtagtaaattagtttgatcatttaatgagagtaaaaactttgaaatgttatgttagtgttaaatcatttttaagaacttgaatatgattggttgaagggtcctttaattactattaataataaacaatgataatattaagtagtaacgttttatttgttatataattattttcaaattaatattttaatataaaaattaaattaaatatttttatatatgtctacatatatttgtataatccatttttaaaattgattataaaatcagcgagtaaacaatctatttgttttaaaatgtttaatatttttttacattaaatttccgttgaataaaatcaatggatttgcattgaataaaataaatggtttctgtaaaaatgatttacaaatctaatagttataaaatgtttaaccatttttttacaattttttttaccacaaccaaatcaatcacgattgtgaaattagaattttgatccaatgataatattaaatagtaacattttatttattatatatactttttaaattaatattttagtatagaaattaaataataaaataaatcaacaaaagtaaaaaatatatttattctaaaatgtttaatacttttttataaaaaaaacacgttgaataaaataacggacttttttttacaaaagaattttgcaacagccaaattaacggctattgtgaaattagatttttgatccaatggttaataaatattaaagtatgctagatatttattcaatcaaattaataattattgtcaaattagaattttgatccaatagttgacaaagtttcaagcttcttttaaatataataccaaatcaacgaccactatcaaattagaattttgatcaaacagttagcaaagcttcaagtttcctttatatatagtatcaaatcaatagttgttatcaaagtagaatttctattcaatcgttgacaaagtttcaagtttcctttacatataatatatagatacaatcaacattaatacaaagtttcaagtttcctttacatataatatatacatacaatcaacattgatactatcttcattacaaaatgactaatgtttatggttttttcacatggattaagaataataatcaacaggttacttattaaaacaattttacccaaatatttttactttccataaatgcattacttgtaaatattagatgattaatggtggttgttgaaaaattgataggtacaatattcaaaatcattatatttatgtgacctatttgggcaaatttgaaaaaaaaagttttaatacctcc

SEQ ID NO: 1269 - DNA, 1279 bp, Glycine max
  Soy_ogl_892 Gm03:36097820..36099098 Cluster 5
gttggctttttaagcctaattatttttttaatagtctaaagtttgacattttgaaataaataaactatataaatccttagtctagtttctaagaaaagcgttaatcttgcagtaaaaaaaaaacaacttaagtctattactagacctagaaccttatcaagtgactcacccttagtaaaaaaaaaaaaacacataggagaactagtaaattaaaaataatataaatacaaaccaataagtattgacaaaacgtcaatattgacattgtaagtggtcctcttagaactattttgatatatcgtgtcgtagtctcgttgatagccttaaatatatcatatcatctagtaatttaataatttatataaagataagatataaaataaaaattataaagatatctacatttgaattaatcttgtttgaaaagaatttcactaagaaaagccaattgtattaaattataaatatttcccactccatcattgccataaaagatgcccacgaatataaaaagagagagagagacaaaacttggtttacatatttattccaccggttcaatgagaactattgctgcataaagtttcaattttttttttgtaaacaagtaaaattgatgatataataatattaaatattttatttttaaatgaatctattttcataatacttgttaaatcatcttaatattattgcgtttcttaaaaataaatattgaataattatttatattttaatatgataaatactttttaaatatttaacttttattttctcaatctctgcaataaggacaaccattaaaatcccccctcgaaatcacttaaacgtctattttgtatttgtatatatattttttatcacttaagatgtacgtagagatgacatgacctcgcagttagtaggtgataatgctatatcataaaacatattaattctgagcatactatcttgaacattcaaacgttgaattaattagaacaattggataggcataacaatgtcgataaaaatatggtataagaatttgtatttgtataattaatttatgaattttcttataaaataaagaaggagataataaaacaagaaaaaaatggatatataaggtactatgttcaaacaaaaaaataataatttaattaaaactaatattaaacctgaattaatgcacatgatgatcaagacttatttttatgtaattataattatatttataataaagaaatattttttaattatataaattatatttagatttataataaaaatttccttg

SEQ ID NO: 1270 - DNA, 1700 bp, Glycine max
  Soy_ogl_5022 Gm15:12780601..12782300 Cluster 5
cacattatttgttgatcgaacttttgattttgtgtctgttcatttttagtatattggatggcctgctttttgtttgtggttcatgatttgtgtattatttttttcactcacggatcagatttgaagaaactcaagaaagaagatgaatctgattttttgttttccccccctacaaatcatgataatttttaaccactagaaattggtctttgaaatttagattaaaaattaaattttaacaataaaaaatcgtcataattattgatttattatttctgtttgccattcactgatgcatatatggataaggggaataaaaaagaatttttgaattttgaaggattgaaaaaaaaatattctaatttaagcgactaaaacacgaacactccatatttgaaagactgaaaatcatatttaagaatctatgttatgtcattaaacaaaaataatttattttgtaccaggatttactcttgctccacatttaacaggggaggctgaaattttagaaaatttgttgggaagtcttgtgtcaaaaatcaaaataaccttgtaatttcaggttcaactataatttatattgtaaaaataaactgagtatttaatgagttttgagttaatataccattttgtctctgatggcacttcaattatgattagaaaaggccgaaaaggaatatgtgtatggaaaaacaaaaagtagaggtgaagggaaaacaagccaacagagttgatatcctgccgtgggactgggacacgtacacaatgatggtttatttttatttcttttggactgaaaataaggtctttaattggattctagcaagatgtttgaaacttttcacatctaattgtggacttttctatttgaggagagaagatgtgtgatgaaatatgctactatataaatgagaaacacatcccttaaaatagtcatttaactcccgtcacgtgagcacatttaaatgtatacctacaccccttagatttaataaaattattattaaaatacaattttgtcttcctcttatttattttctttaatttggtgcctaaattttttaaaacattactttgattcttcataatatttctataagactagaatgattctttatttcttttaaactagtaatgttaattttgattgacctaccaaattgatctaacaaaaacaatttaagagattaaagtaaaataaataaatttagaaaatcaaattgaaaaaaaataatcagatgtactctctctttatatgtataaaattaaactaaccaacctcaattcatataataatatgagaaattaagggaattttgtgttaataagaaagtaacatgatattatgttatataaattaaagaggtgcctttacaaaaataaataaataaaagaagtacgtgtagagtaaaaaattgatatttattttcaggcaagaaatgacattaagtgtaatttcgttaaactttaattagcaggaatgcaatttatcaattttgttaactaatattgtaaagaagataacgttaattaatgatatatttgcaaattgttattttacttgtaaaccagtctaaagtttgatatgcttattgttgtgatatgagatattaaattaatattaacaaaacatcacaatgctaaaaaaataccgaaggatgacccatatttgaccattgatttttttatttattgttaaa

SEQ ID NO: 1271 - DNA, 1108 bp, Glycine max
  Soy_ogl_5609 Gm17:9581993..9583100 Cluster 5
caactagttcaacttctaatttcataaaaaaaaaaatcaaatccaagatgctaattaacgtatctactactcgctcgggactaaaactattgatatttaaggataatgcacacaacttaaaaaatatttaatattattcgcaaactacatatttagtctaaaataccccacttaatatatgatagaagtagttgtggatatagatcacaattatccagataatgttaaataaagatatatgtggaaattaaaaaaacaattaaagagacttgaaatctgtaaaaacttcaatagtattgaaacaagaaaaggatgctaaaataatactctttttgttccataataattatggtgtaagaaaaaaaattttactgaagtaattatcattttaaaattctaatgtaatattaattatttttttaacttatattctttataatattaataacatgggttaaaaaataaaaaatgaattaatgaaaataaagttaattttttaaaattattattttcttttatatacttattattttttgggtttgtgtaaatcaacttaggatgataattgtaatgaaatgaaaagagtaataatttttgtccaaatgagatataaaatataaactttgtttgtgggctataatatagaaaataaaagggactaaattgacaaaacaagaactaattttaagtaataaaaataaacaaaactaaaaataggccaaaaaaattagaggataaaaaatgcacaatagttgaggggctaaaagttgaaaaaaaattgagggattaaacattataatttgaaaaggtggagggactaaattaatcattttagtcattactttctttatttttatttttatttataataaaatattttatcattataaagattgataaaaaaaattaaaattatttacaaagtatattttgtcttaaaaaatcatttaactcacgaagtaaacaacttaattcatataaatctgcatttaatataagtaaacattaccatattaagcttgcacaaactgctaattaaacgggccaactcaagaaccatagtaatagatatatccaacctaacaaggaagctaatagtgggatgttt

SEQ ID NO: 1272 - DNA, 1300 bp, Glycine max
  Soy_ogl_4444 Gm13:34083401..34084700 Cluster 5
ttcaatcaaagtacatcaaagataccctgtgttttttatatccactagataaaactttgatgaaaagagatttatctttcagtaatttaaggattcctgtatttaatattgattatttaaaagatggattatgattagatatttaaaagtaaatcactaaattgttagaaacatgcggattaggggtaagtttaaaagtaatttatatttatactttacttaaaattaaaatattcataaaatacaaatgatacttattgatgaattaataaatgtaattccaccgttattatatataacactaaattatataattatcaagattaaaaaaattgttaatttaattaatgataataaatttattttaaatttataattttttttcaaaactataattggtgttaatatttttttctgttttaattgtttgtcaatatattatttctcttcttttaataaatgatatttctaatctaaaattaattaattaataaaaaattataaattaaatgttataaaaaagataaaatattattttaaatttacatcttataaataaataaaaatatgaaattagtgtttgacgtcctgatgatgtgactaactgtggaccagtaattgcgataagcaacgttatttggaatgattaaacacaattatttgcttaaaaaaaattaacaaagcatttgtgagtggcttttcatgtttatcatcaaatctcaaggcttaactctaaatacgtggtggaaactggaaactggaaactggaaaccacaaaattagagtacggtgggagcagagaaaattatcggtgaaataaaatgagtaaagatcagagaatatttttaatggtattcacataactaatacaacttttgtcactacaattttattttttttacaatgaaagtttttattaataagttatttaatttacaaatattctatttttttatttaatgcaaacttaagtaatttatcggtaataattatttatataagtaattcttttaatttttaaataactcaaaatcacatttatcatattaaaataatattttttttataaccacctcgttaagccactttgattgtgaatgttcgttcttataggctgatataaaaatacaagtaaaacgtggatgccaatatataagttaaaaaaaaaagaatttggaatatttaatataataaaataaaataaataataacaactagctaagaaaatattaaagaaacagtttcagatttgcaaactaaatttaagaaatctcctttataaagtcgatcgagattcctg

SEQ ID NO: 1273 - DNA, 1455 bp, Glycine max
  Soy_ogl_5307 Gm16:5070455..5071909 Cluster 5
gtgttcaataaaattttcttatagaccaatgtaaaaaaaagtactaaccagaaaaactaaatctaaatataaaataaaccaaacactgtcttacttgagtccctatctttcattgagtttttgtttcaactcgtcgttagtttgtgtcagtatgcatgcatataatttcaattagtagtattattatcaaataattttagtatttaacattttaattataaatgtgtaagaagttacagtactagtacttaatagttcatcatcaatatcaatatatacagagacattaaaattttaaataataattgatagtgtgcatctaaattaatgtttatcaattcaattgtacttgtagattatttgttttattaaccaagataactaacaacatctaagacgcatagttatttagttaaattgtttaccttaattttgtaagtattatgattgtacataaccttaaatattttacataaaaattcacttcaatattaattaaagttgttaaagtggtgacttataaattaattttacaaatcttaccatacttaaaaaaacgtgttaaggaactattataagtaataatgcttattcaagcaactttatgtcatttccttctggtgaattttaatatgtgaattttttcttccgttaaattttttttttaaagtttttggcttgcaaacaagcagacttttgtcgtgtgcatgcgagtcaaagttttataagtatttacagacttcggcatattcacctatgctttgttattcttaaaattaaagtaagtattttctattatattttttaagaaaataaacctaactttaatattctcaaattttatattacttttaaatttcctttcttacattaaaatcaccaaactctaattatttttacactcgttaatttaaaaaaatcacaattttaattaaaacacgcctacttattatttgcttaaacgagatggatagtgaaattcgtgacaggtatgataagattatacaagtattttatttttaaataaagagataaaagagaattgactattatatcgatcatgataatcacaacaaaaacattttcataataaaagaacatatacaatatattcccccgcctacaatgctcacagtctttacagaataaattgaattggaaggaacaaagcaagaatatttgggcctcttttattacctttttaaattttggtcttttaaaactgtttttttcttaaataattttatgctattcaacaattatttttcatccttttttagtgcaatcatttttcatctaaaatctattaaatactattttttttaaaacaagtattaacaaaagtagttgagcgatacttttttccaccttttttttcctactttgtggtcctaattaaaagacgcagtcatatgaaacggtgttgcatgtaaagagacacgccagtggtatgag

SEQ ID NO: 1274 - DNA, 1100 bp, Glycine max
  Soy_ogl_6897 Gm20:40710701..40711800 Cluster 5
ggtttttaatatgatattatgaaaaaatttaaacgacaagattttgacataatttcttttaagtttaataattatgcattaattaattaatattgatataatttttaaagttttttttaccataatattagtatgaaataatttgttgagtttgttaaaaactttgaacgtagaagataaatattttttctctcaatacaatttatttcattttcattctcaagatttaattcctgtattgaaaacaaaaatcattactatgtaaataattattggtatatgatttttaaagtttttgttattattgtaaaaaaaaaaattatcatgataatttatggattatatgatacaataaaattaataaaattattttacattggtagtagttaataaatagctctatttctcttaatagatagtattattctaaatttaagttatataaaaataagcctttattttgtgtaatacataaactaaaatactagttattataaaaatcaataaatttactatacctaaaaatttatattcaatggaaacctttattatgcagattgatttttatactgtattgaattttataataactaatattttaaactgtattcatatcaaaattgaagtttcagctcaataatattattgatatttaatggaaacatttattaagcagattgttatcgtaggactctaattttgattataaagtaatactaaaacttcttataaaattatatctaagttttttccataaattttctactttaaaaatattagtaatatatgtaatatatgggttagagttagcgcaaatgtacataaaaaagattatgactattacaagagaatatttatcaatgtttactagtgaagctgactttagatgtgtagtgcttggaccaacaaaaaatgaatttaataaaaaagattagtttctcataatataatgaatcaagatttaaattttcattgaaaaatgtatttatatttagtgtcatatcatgtttctgtctcaaacatgttaacctttaaagaatgattcatctgaagaaaaaataattgtattgtgctttgattaatactaaattaattcttat

SEQ ID NO: 1275 - DNA, 1795 bp, Glycine max
  Soy_ogl_4803 Gm14:47472906..47474700 Cluster 5
aaaaattatataagattatttttaattataaaaaatttattttaaaatattaaaataatgaaagacgcggcccttcaatcattacattttacgactgtagttaattttccgaatggtttctatacctttcaatccaaaccttcgcgtttaagactatattttacatactttttcctccaaagaaagtacactatatattaaggatacataattattaagttaaaaaattaaaattaaaattccatataactataagtctcttcacaaaacaaaaattaaatttataaacaatattatttattaagtcctagagtcttttctaacatagtatataattattaatttatttttaatataaaaattttattacaaaaaattaatgttaatcattgatgggattgcatttagtcataaaattatttgttttaatataaaaaatttatcacaaaaaattaatgttaatcattgatgggattgcattcagtcataaaattatttactaataagattaaaatttattgagaaacacatgatcatctaaaataaattagtgattatgtatttgagttttgatcatttaattatgtaaaacgttatactatcaaagagttttaaggatcaaattgagtatacggaactgcaaagagtacaatggaataacatgcatgaggtaaataatgaaaggctcgatcttttaagcattacattacgtgttgcaattagtttcccaaatgcttcctttgtgtttaagaatatattcctcaaaagaaagtacgttattattttctcgaggatagaaacagtaggtggcaagctctggggaccattatcctcccttaatttaaacattctatactcataaatatttataaacttaattagaatgtagttgcaatatagagattttttatattctcaatttgtccttacatcgtagattaatactgtagttaaatttttattttttttattaaaatatttaaaagtcatatataataatttttaattgactaataatgtagaaatttttaggctaacaatgtattgaaattaagtttaatatttatgacggtaagtttttagtttaaatgtttttataattttatttcagtttaatctttttataacaaaaaataatatttatcaatgatgaaattttattcagtaagaaagttattcacataagagtataacaaataattttcttaatcatactagtgtaagaatccttgtaatgtacgaatgttaaatttgttatattttttaatttataaaatatctattagtatatgtatatatatggatattaattaatgtcaattcaaataattttacatttacacatcttatcactataatttataaattgtgtttaaaaaagattgttttcataaatatattctcatttatataacttcacacacacacatatattaaagaagtgtggttatatattgtaaaaatgtggttatatattgaataactatatatgcacaatcacctcttgtaaattttaaggaatattaaaactttaactgacgattacgaaaagtggatttggatatataatgtaatttaagagttgacaaagttatgggcttgaaaaataacttctaactctaattctattttctttataaaatatattttatatttaattttttaatatttaataagcatatttagtttaacttctcatttcctattttctaaaaatgaaactgttgaaaatgtgtttgctttaactgctttgagtaaaagttcatacaatgttttttatacaagtttaaaaaaa

SEQ ID NO: 1276 - DNA, 1486 bp, Glycine max
  Soy_ogl_271 Gm01:51808301..51809786 Cluster 5
tgtttttatccacgtgtcagacccatatatatatatatatgcacctattctttctcatcaaaataactcatgtattgtattttttttttaatttttggggtaaaaaataaggatttttcacaaacatcagaaaaaatataaaaattatataataatattctaaccattttttccacttaaaatgtcattttatcatacgttataataattatctgacaattattttgtcttgactatttttgttaattattcatcgttatgttgctatataattatccttttgatttttcaattttttttagacatacagaaatttaaatctaaatataattgatcactttgagtttgattcaacattctgggaatttccagattaatatttagacttgcacacaacttttaacaaaataacaaaataatacacacacatgcaatggcaatatttttttatcggcacatgtaatgacaatattaatactaacattattaatagtgttaatattaatcatgtcaaaactaaagatatgtaaaaaataaaagtgaaaacttttgaatggagaagtgtgtttttttagagtaaaaaaccagattgaaaagtgaggtgaaggttatagagaagtgggatttttgagaaatagtggagaacaggattatatatataaagttaatagtgaaatatgaaagatagtaaaggctctagattagcagtcattttggttacaacgaatgaaaaagtgagattgaaaaattctgaggcgtgatttggacacaactaagaatttttattttttatttttatcatttgtgaggcgtcagcaatgaattggtcttttttttcggtaattgctacaagtaagatagatgttaattggaatatctgaaccacattgtgagataaattttgacaatttcatatttggctaaaaatatattttagttcattatatatttttcgtcatttatgttttaaaattatttttttattttttatgtttgcaaatggattcaaaaacatcgtttagtctactaaatgatgatataacgttaattttattatttgtttattatatttttttgaaaatttattttatgatgattcataatcctaaaaaattatgttcctgaaacatttaatagactgtattacacaacttagttaaatgttgataaaataatttctgacaagaaactctaaaaaatagaataaaaatataatttcatattaaatataataaagaataaattatataaataattcctttttttcattatattttttaaaaaaagtattagtataagatttgaaagagtggtgaggaaatgtcattataatgtgttcaaacatagaaggaaatattagtgtaatattttcaaacaaaggaagttagtgtgggaaaaaaaagttgagttatttgtatctagatggttttagagtaatttactctaaaatatatattttttggattcatatataagcaaaaacatg

SEQ ID NO: 1277 - DNA, 1685 bp, Glycine max
  Soy_ogl_362 Gm02:3845701..3847385 Cluster 5
atgtgtgctttttattttattgttgtgaattagaattttattagaaattcaaaataagatagatttataaattatataagtaccaaactatacaattaaatgatttaaaaaaattagtcttttatttaagaatttcttaattaaatgtatatcgtaccaaggaatgttacacacgtgtaagataatttatacatatatttaactatgtaatatgaaaaaaacatatattttattttctcttggagtcgtgagcacttcttacatgtctaggcacatcaaaaactgcatctataaagacgcggctatgcatgtgtactttctcccttttatcacatgctggatcttctagttaccagtagcagtgccttcgtagttgaagtacagtaatgatgttaaaaatacagtgctactttattattttaccatactgagttattattattattactccgaagatctttaaaatatttgataatttttaattaattaggtttctgaactattttcttttttaattcagtctatttgttttcttttcaattaagtcttttatttaattattgttaaaaaaattaatcacaaatacctaattatttcctcaatttgatattattgtctttgcatgcttgcacttatcattcttacatttttcatgtcaatattgttacctttttttggctaatattcttatatttttatgcatggaattcactcattattctcatataggttttttaatctatattatcacttatgcaagttcactcaattcaaataatttttttataagtctctctttggactctatccaaaattaatttgtcacaaattcacgtaattaactaagataaatattttttttattgacaatggacggaagaatccaataaaaaagtaaatacgagtctaagatttaattaaaataataataattcaaacatctaattaaaagatttcaaataattcaaaggcctacaaattaatttaataaccttaaaattaatttgattatgtattataatgaagtttaagggtgcgcttaaatacgtgttgaaatcatgttcacttcaacgtaaaaatatcaaatttttataatctgacttggtgcttgagaatgtgaactcccttcgacgaaagttaaaacgtttgtacagacacacactagagtctatttatattccagacaagaatttcattcatcaaaaagtgagatttttctagaaacaatagaaaaatgagttttctccctctaataaaccacattgaaggaatctttaaaatcgtcaattgagtgtgtttagcaaggaatgaaataattgaaaatagagtagataaaaaaaattaaagtgaaaaaaataggtaagacttatatagaataaaaacaagagtgtttattagtttaagagaaataaaaaaagaaaagagaaataaaagttaaaattcatttcttttcatttttagaaagaaaaaaaaatatgaaactcacttttattttttatttttctttactgatttctcttctgtcgaacagatatcatttcttatctttcatctatttcacccgcttaaaggtctaaaacagatacaaatttaaataaaaaaacacgtaagtaatggtgaaatttttaaggttcaattgtaaatttctattttttaattttttaaattcatgatttttggttctc

SEQ ID NO: 1278 - DNA, 1656 bp, Glycine max
  Soy_ogl_436 Gm02:7233064..7234719 Cluster 5
acctaaaaaaatattaaaaaaataaattagtgaaacttgaacttgaagaactaagacagtatagaattgtgatatttgatggattaaaagtgtaattaaatctataatatactaaaaaccttttaaaaataatttaaaattaaatttttaatattatattactaaattaataataagaatttcatcgtacttaaaaaataaaaaagaagaatgtgtctttatatgtcataaggaaaagggtaaaacatgtcttcacatttaaaaatgaagacagtgattttctccagagaagtttaaaactgtacaattggatgactaacattttttaaaaaacataataaaaaatttcaggaattttgttttggtacgaagaaaataaaaataaaaatattaattacacaaaaaaaattaattatgtaaaatatgtttaagaaatactactcacttttataaaataattacaaaaacaaaaagtataaaatctttaaaaacaaatagcctggcgttaaccagaaatttgcttttacttatttgtcataacgagtgtgaaaaattagctgtagtggctgaggtcatgagtccttccagcaacgtgtttttctcaaattcaagcatcgtttcctagtcaaagaccataaaattgtaacaacttaaagttcaaaatctaatcaaagatatagtgaccactataatcatctctaagtagaaaatcaatgtccgaatgaagacctcagtttttctagcttccctaccttaattgcaccttcctatgttgcttcaactcgtaaaaatttggtttaaatattttattttgtcttttagatcgggtcacttttgtttttagctctccaaatttaaatttatttattttagtccttaatttctagaaatgcttattttaatttatcctgagtaatttgtggtggtctgaatgcataatttgtgatgtttttattttataaagaactaaaaagaatattttttgaaattatgggactaaaaagaaaattaaaattgaggaataaaaaatattttctctagcttcaaatttaagaaaaaaattgatttaaactaactaagataattagttaatcacatttaattacataaattttaattaaaaaataatttttttcaatttactcttcattaaaacttggtatcgagaataaaaataaattattgaatctaaaaccataattaaattaatagtattttaaagattgtaatattaaatgagaaaaaaaaattagatacagatagtataaaaagtttttcatagtaattcaattataattattatgtatggtaagtttattgattttttaaataattattttaaaataatttaaatgataatttatgattggatgatggtgtaaaacactttatacaatcaatgcatagatattaaaatcatattaaataagataagataaagttagttgaaattttcttatattatttgagaaaaaaaaaaaaaacatttttatccttgtattcgataccggaggaagtatatgataagggtatgcatataaattggttcgaacttaattgtttgtgaactgcatcaaactgaattggttcaattaaataaaactgaattaattttttaaataagtttggtttgaactaaactactttaaaaccggt

SEQ ID NO: 1279 - DNA, 1600 bp, Glycine max
  Soy_ogl_1140 Gm04:544401..546000 Cluster 5
aatgatttagcagctaatcgagcttgggaaataatagctcatagcctcctatatatacattttcgttattgggttaataacttctttttttttagagaaagggttaataacttaatataggtttgtcatggaattaatcctttcctcattgtacaaaaaaaaaacaccagaaattactaggagattttaattgacttgacgccgatcaaatgttatcagttatagaaccaagtatgttgttgacggctgaaagttaattttactggttcatattcacgcttgactttaacatttaaaaaaagtgagaatctatatttttttttgaaaaaaaatcccatttatagttataatatattaaatttcaaattcattaaatatttattttaattaaattttcataatcaaattatattttcattaacctcttttataataattctgtttacacgattttataattcataaattaagttagcaattacttatcattttttatgatttttttttgctaattttgaatttataatttcttggaaggagtactcaacgtcttacattcaataaattcttctttttgaatatgtaacataattatatacaaatgactcaaatttgagatttgaataattttgtgtcaattaattcatacatacaagtctttttttttatatatcttagaaaataacatcaacttaaaatttatagttgaaataaatttaaacaaataattaaaatttcaatgcgaaaattgtagttaaaattaacttaaacaaatataacaatcgcatttaataatttaaaattaaatggaaaatatttatttactcttatagttatataaattttacctttcgattcttgtatgcaaaaattattcttttttagtccttgtacaaacacttttggttttttaatccttttgatcttttttattacaaaatgataaggacaaaaatgtaatttgtgtaacaaggagaaccaaaaaaaatctaaaaatacttgtataataactaaacagactaatttttaagtataaaaattaaaaggtaaaatttatataaatataaaaatcaagataataattttttcaaattaaatctattaaaaccagtgttaatttcatacggaccctcacttgctaagaagcttaatatcaccatcttagcttattctttttacaataattccattagatttgaaattataatttgatgtatataaccaaagggttgacacattaatgtatgttgtgtttatatgaatgaaaataatagaataactttgttcaattttcatcttatacacaaaaaaaaaaaaattgaacaagtgacaattacatattccaaacaaaattaatttttaatcaaatggatgcagagacatgtaatttcttaccggaaaaaaataataatctcatgcatactagtaaaatctccattcagctttacggcttttttatacagtctacgagcgtataataataagtcagaatatagaaactttttattatagaaaataaagtaaaggaaaatgtgtaatttaattaaagtgagaaaagaaaaagtgtatttctattgatttgaagttagttcagattatg

SEQ ID NO: 1280 - DNA, 1545 bp, Glycine max
  Soy_ogl_1172 Gm04:2065756..2067300 Cluster 5
aaaaaaacaaaatattatctaatccgagtcatttacaaccctcttcttgtggggtcaatttgttatttttacgtgatatttttaagttgcatttcttaggatgattatttgttagtttttcggggtgtagcctaacaggaaaaaggttcaaataataaatatttcaagacaataaaaatacttaaatgataaataattaaaaaacgtttttttaattattacatagaggggttttttatatacgaggaaattttagtttttcaataatgtcaattaactttgatgtttgatatgtagttttaaaaatgttattgggaaatattgtttttagtaatgcttttaacacttggtttctcatgaaattattctcataaaaaaggtgaatattaattttcctcgttggaaaaaaattaatattaaaagattgtaatatcttcattagcccggccaatgcatggcattttgaaacattttattattaattatgataaatattttataaaatatatagttttgatattatttatatatcaaatactatactttttaaataccttttattttttaattctataaaaaatcatcacagcatcaactaaaaattgttagtgtaacattcaagaaatattgtagtagaacccgtaaaaaattcgaagtaaagagaatgaaaaattacagtttgttaaaactaaataaatcatattgataagagtttaatgatggagcaaataactgtaaaataattttatattattattcaatcataaattatgatttatatgattctcaagataattttttgcaaaagttaatgtgtataaccttacttctcatataaatattataaatttgtcatgacttaaacatttctttaaatattttatattttcggtgtataattttttttattaattacatgaatatattttataatttaaaaatttataaaaatatatttagaacaaacttatccaactatataattcgatagaattgtattttgaaattcattccaatttccatataaatgctataattaattatttataaatgttattatttgtgtaaaaaaaactatattgtctatataaatcatttagattcaactagtaacaataatatttgaataatttgtaaagggaaaatatcaaataaacaacataacaaaaaataaagtacatatatttaattatttataaatttaattctttttaattttttaattaatatcttattaaaattaaattaaatatttttctgacaaaatggtttgctattttggatctaatattttatttaactatagtaagaccatcgtattttgtgaaatctataaatcgctatgaattaataattttaaagtttctaaactattaaaaaaaggattcctaataaaaaaaaatatgggattattaataataattatttcatatttgatcaccatgagaatcttatgttttaaggaatatttaagtcatgttaactttgtgatatgtaaaagagaaaaaaaatatatataatttacaccgtcatctagttataaac

SEQ ID NO: 1281 - DNA, 1523 bp, Glycine max
  Soy_ogl_1554 Gm05:2542301..2543823 Cluster 5
atgtttatcgaaacatcatctttgaaatgttaaaaaacaaaaaagagatagagcatggaaccatggtcagccactgtagtaaataaataattgaaaaaagaagagaaagtaagaaaattacaaagtcatcatcgttggaaacctaatatggttttgtagggtagaacatagaaggacctctttcaaatgtgagagaagacgaaaggagagagaaagggatttgcattcattaagacgtgagatacgagagagagagaggagagagaaataagatttttatttttaaattaaatactaaattattattttatccttaaaataaattaatgaaaataaaaaataataattttttggtgtagattgttaatgcactttaactgaaaagaggcatgagtatattaataatcgccttaattatactatctatatttatataatacaatttacgaaaattattactttaattgtgtatattttaaaaggtgagtaaatattaattattaaattacataattataaatgtctattttatctaaattataatgtgcattatcatctgagtcaatactagaatattcacggctgaaatatatatatatatatataaaattgtaaatagtttttgacttgaataactttacctacaatactttcctttctttaaattagtctaaactaatgggaaattatgtaattttatttttgagtaaagtctcattttcttgccaagttccgttatttcgtcttttcttacattcttttcgatgcaccattctgattcaactgcaacccttgccctttgcatgtaaatttttatttttttaagctctcgtaccctatgctgctatagataatcagaaagataacatcaaatagattaatagttagatttattagtttttttacaaaaaaaatattatgtagtgtaagaataaaagtttgacacttgaaatcaattaatcttgttattcttaaaatattttatattattgtgaattttatttaattcacacagcttaatttatttaatgggattcacatgaaatttatcttaatgtgttagaaagaatttattgttagtgttttaattttactattataattagaatatatttgttcaagtagttatattaaatattaaaaaaataccgttcaaagtagtatttattgttttccaggtatttatgatctctaagaaaatattaataggataaatactttttaaattatcaattaattataaattgacatatcattaaatttttttgactttgtaataactattttaaaatatataattaatatgccattttattagttaataatattccaattttgatgctaacaatatatcaaaattagactctttttaccactgtatattatttaataagaattcatgctaattatacttaccaggatgatattgatttaaaagcaatatataaaagagtgatgcaaaataatatattagtattttttttcaaattttagtgttttttttttactacttcctccatttc

SEQ ID NO: 1282 - DNA, 1182 bp, Glycine max
  Soy_ogl_5478 Gm17:3454619..3455800 Cluster 5
taatttaaatttatttatattagagagttcaaagggagtacaataatgtaatgagtataattaaatgatattaaatttaatgagttataaattgaatcatataaagtataattttttgttggttgttattccctggttcatatatatatatatagagagattcaattatttaatttattaaaatgaaagaaactgattaatttagttgataacaattaatttatcttaaaattttaattttttttaattatttttgtcactaatacttctctttcttttaatggtttgtcaatacattattttttaattaaaaatatttagaatctaataataattaataaaaaaatttataaattatatcttataaaaaaataaacattatttcaaccttaaatcttataacaaaaacagagagagtaattgttagtgtaaaaactttattagtgtgtagaaattaaactcatatctagtgatggagcccaaaatctagctcaaagggggccaagaaaaataattaaataaacaaataaaattttatgtataaaaataaaataaaaattaatattataatttaatatttttatataattatgaaacatagacttattttttaaaatgtaccaattatacatttcctctagcatctttaatttatcgtgaccttaatttattgtgaagtttattacaaatgaaacacttaatcatttcacatataaatgaatggattcattagcctattaatattaacgatttaagtcaatcttataagtaaagaaaatcttaaattacgagtaaagttattaaatatagccatcattcatttatatgcatattttcataataaaatttaaatttatgacattatttattaaaattaattaactttattatttttattgaaatcgatgattaattaatttttttatatatataatagagtacatgagaaaaaattgatatataaaataactcatagaattgtcataattgtgtaagatattgtcacgcgaatgaaattagtttataactcagtatattgagatatgtgatctttgtaggaaaaaaaaaattaatatacaaactagttttagattagaaaataaaactatacattaacattataaaataattacatttacatgtgaactcaacatcgcgaatatttcaataacatttgtattt

SEQ ID NO: 1283 - DNA, 1162 bp, Glycine max
  Soy_ogl_6749 Gm20:34587439..34588600 Cluster 5
ttcctatttattggaattctattgaggtctggattgaataaaagtaaataattgaaatttaagtaaattttccccatttatttcaaagaattaaatttaaaatttaatatgaactatttgtctctttatagaagaaagaaaaattatgcactatagtataaaatatatttatactaacatctcatcataaattatctgataaatttattgatttttattaattattttaaaagtcaaaccaacaataatttatgattgagttataatataaaattgttttgtgttttgtgtaattagtatatgactattaaactctttataaaatcatctgagtgaatataatacatgcactcctagtgtaagttacactattacacaatttaaattataatataagaataatttgtctattaatatttaaagaaaaattttaaatatatatttgatcctctaaatttaaatttattatttttaatttttcaatttaaaatattacttttagtctctcctgcaactatcacaaattatacatgaaaattatcgaaatcaatcataagagactaaaaaaagtatttttaaaattaaagattaaaaaaagtaaatataaatttgggagactaaaaagaaatttgattcaaatatgagagaacaaatatttaggaattactttttttttattgaaattcaattaagaatatcgcaaatatacaaatgaagataaaataatattagtttgagattactgataaagaactaatggtgtgtgaagtacacaaataaaggggaaaaagaaagaaaacattgaaaatatttaattgagtgtgcaaagtgagataaaacgtcttactcttcattcttcgtgttatatattcaaatttatgatatatgaacagtttttttttttggccgatgaatatatgaatatattttttaacagtgaattaaaaatagatttatttaattggtaaggtaaaatgggttttgaaatgtgaacaatttggggctcactctcaaaatcaatttcattcaatgaaaatatttttttttttacagatattatatgaaaagatgatttttttacgaaaatcaaatatatcctttaaaaaacgagaagaacgttactagaaaaatcaactatgataaaattgattttattggctaa

SEQ ID NO: 1284 - DNA, 1735 bp, Glycine max
  Soy_ogl_396 Gm02:5255488..5257222 Cluster 5
gcatcaatatttatgatagttaaaaaaaagaaaaagaaaaaagatgacaccctcaatcatatgggacagtaggtagtactagcatgctagaaaagatcaacacaaaaattaccacaccgacttatttcgttagcagttttaaccaattatgatgctgaaaaataagttgaagacatgttatgctttctttcttaagagaactcaactttgtttattggtgtcgtagtctttatatatttttgccatgtatctattttttagtttcatttattatttttccttctcttagtgccggcatatgcatgtaattaacttattacagtttgattgtttgtgatgttgcaaataatttgtaaagtttacaataaaacaaataaaagacttaatctcctcctaaaaaaaaaaaataaagacttaatctcacttattatatctttcagctatggataacgtgtgacttttggctctctaaaaattcttgttaggtccagtaaaaaaaatattaatccctgtattcctttttaactttcttttaaggttgttgtgaagaaataaaaaaaaaaagcaataaatattttttattctaataaagcaattgtgagatttcatatttttttttcactccacaataaatatatgtatacattaattaaacattaggagacgagtaaaggtataactaacaaaagagtaattaactttaaaaaaataattaatgtgatattaaactttacaaatcacatataaataaaatagaaattctaaaaaaattgacaatttaaaagcaacacagggaataagagattgtttgtttttctaagagatataatgttggtttgatgataaagagtgaaggaggaagaaatacgttgtaagttcaaattttttgatttaaaaaactaataaattaataattaatatttattgataacaactaacaactaaaaatttgatccatagatattttgaatataaagagagaacttaaggatttaagaaagacttaattataactagttttttttttttacaaccacttaattataacaattaagaaaagtaagagatgattttagatttttttttctgaggggttaaaatgacacagtaaaagatttaaaagtgtagtttaaaagaaagaaaaaaagaagaagaaaaatctagtttgcaatgttatatcctgcatgctttcaataccaaataaataatatcttgcatgcagcatgctatggtctttgaatgaggttactatgacaatatgagcataaactgtaaaaaataaaattataaagtgtgtgatttatttgaaaaatatagaaactgtagctaataatttgaaatttaacaattgagattataacaaaacaagacacgtattataaattataaaattgttaaatttgtttctttaattttctggtcaataaacttaacccctcaacaacgaaagtgccatttgctttgttttgagtgttgatggccagagttgccaatatgtatatccaatttttcctgacggtgactggcttttgaaaagtacctttcgtgacaattttctgtgcgttaggagaagtgatatttgtgacggctagattttgtttcactacatcgaccataatgagtaaaaaaaaaaactacatcgacaataaaaaatattttttttaggttacaataaaaattagtttagtgataggatacagttataggattttcatgatatctattaattttgttg

SEQ ID NO: 1285 - DNA, 1438 bp, Glycine max
  Soy_ogl_3644 Gm10:49132601..49134038 Cluster 5
aaaaaaaggaaaatgttaaaggagaagaaaaagaaattattacatcagatcagaatcacaaaaaccatttattaaataaaaaacattatattttactaattgtttaaaaaaatattaaatatctttgtgtgcgtatatatatacatacacactttagtatgtcacgtacgtcttgataaaattttcaagtttatttgctctgcataatgattaataatctgaggaacaattttaagaatcgttagtatttggttttaaaatgaactatacataactcaactctaaaatctaaattatagagaggagatgattagtgagttttgagtagaaagggattaaaatagtttaattcatttgatttgcgcagttttttataaaaaggaagaaaaaaaagagagagaatttcatgattttaggttgaagaaaaggaatagctggaaaatttacttaatttcgtttacaaatagatagattagaagactcaaaaataacttgaggacctaatttttgcactgtttaaattaaagaaattaaaattgttattaaatctaataaaaaatgtacttgcagtaaaaaaaagaagatatacttactagctagttcatatatatagggtttgaggtaatttatgtaaaaaaaaatctgtaaatttttttaatttaggataaaattgaattgagaatttaagaaaacttgcctaaattaataaactcttatttttaataaatgagaagtgtggttaaaaaaaacaaataagaagggtcaatagcatactttttaatacttttttcttattgattaaaatttattaaaaattctaaaatcataagaccccttaaataaaaaatgatatttacaaaaaaaaatctaataaattttgaatgataataaagagaatattaaaaagaattttgcaagcattatttttctcattaaatacttggttagagtgtcttcagcggaaacacttgcataagttgtttaacttactctttttttttaccaattgagtatatgatatggaattactaatataaacataattgtttatataagtaattattgcttaacaagattataccataaataatatatttttaaacattgtaggacatataaaattaatttaaatatttattttaataattttaacatttgagtgaattttttatagaatatttaaatttatgtgaaattataaaactcataaaattaaagataaaacaattcatccgaataacttttatattgtaaatgtttctatgttgttgtttacttaaacatctctatgatatcatatataatctcacatgttaatatatcattaataaataaataagattaacccatacatgaaaatatttgaattttctattatttgtatatatgtattttttacagcttatttgtatatatttatataatacaggcttttaga

SEQ ID NO: 1286 - DNA, 1567 bp, Glycine max
  Soy_ogl_5025 Gm15:12891944..12893510 Cluster 5
caacaattggataataaaaaatgatcaaatgtgttattttactaaatttgataatttttttaaagattttgctaaccatcagtactcctaggatattgaagaactaaaagaaaaaaaatattgaaaaaaaaatcataaacaacacaatttttttttccttttaataaaaatatttcaactttaaatttttaacaacacttgattagcatttgtctttttttattacaatagccttaatgatatttaaacttataaccatatactaactcaagatcattaggccaactctactaagttaactaaaattaatacttaatgtcatttgatattgtttacactttatagcaaaatgacctatattttaagtttttcacataaattaagaaaataagtattcctagataattagtatttaattattattaggggatttgagtgtgataaaattctagtacacttatactagtacatttatacacttaaacactcaaggtatactaagggatgaaattcagttgatttgagtgtgataaattcctggataatattttcaattcttatgaatagttaatacactcaagatatatataatatttaatatgtatagttaatatgtcaaacaaataatgtgtatatattgggaagatatataatcttaaatgtatctgataaagtaaactaatacccgtaacaatgacatttctgagcattctgaaataattagactcagacacaacttgtggtaatttttttattaatcatataaacattaatgtctatatttattatgtcaacaaaattaacgtttataaattggggaaatatataatcttaaatgcatctgagattgtggcctgctatttgaaataaatttattcatatattttttccactcaattttctttttacttttttttaaaaaatactcttcttaaaaaatacgtcacaaaacaaagagattattatcccattaccaaacattttccttaatgataattcggattacgtacgtttaaaactctattatccttacaacatatattactggtaattcattgttttttttatcatcgataacaaaacacatacacaagaaacggaaagctagtagtcccttgggaaaaaaaaatacccaagacatcagtatttgaaagttgaaacgggagttctctgtgttttgactgtttttttaactgaatttattctaacttttatccttactgataaataatatttatttgagaaaacgttctgccacttattcaattacaaactaatactactaggtatggtgcttctggtcaatcttcaaacttcaaagtatatctgaaatcttacctgtctttttacctttaacgtgcaaactcgtttcatattaggacgtagatctcaagtaatgcgtgtgtctttttttacttccttttcatcatcttttcttttttagtaaaaaaataatctctttttattccattttaaagtatttttgtaaaaaaaataaagatatttacattgcagatcgatttgatttttagacaaaaaaaatccttcaaaccaaacataaataaat

SEQ ID NO: 1287 - DNA, 1300 bp, Glycine max
  Soy_ogl_6957 Gm20:43554301..43555600 Cluster 5
caaagtttgttatttgattagacattgcttttgtagctttcttccctttccagagaatgctgaattatgattttaaaagattttttaaaagattgtaagaatttgtattgattttattttttttattcaaaatttatcatttatttgtaattaaaatttaaatattttctaaaaattcataaaagtgtttagaatcttgtaagtcctttcaaattttataaatttatttgttgtaaatctattaaaatccaaattacaaaattctaatgatagtatataatgatttgtgattaaataataatataaattattttatatgcataaattatttttttttatttttctaataaaaaattttgatgcaaatttgatactcaactcaattaaatcggatttaacataattcaatttgatgtaaaaccctaacttgtgtgcacccttactcattattaacaatagagacatgctcattatatttttttaatagataacatgtatttttcatggaagataattactatttctatatctcaaataacacacaaactcctactttatcttttaacaataccaataagaagtaaaatacttataagaaaaaaaaaatatcaataaaaagccaagcacatgtttgattgttttttaatattacggtggaatttaaaataattaattataatagaatttttattttgtaatttttcattttcaaatttaatgaatggagtgagtaaaattaattttgaaaaaagtaaaaaaaaatatagttttgtctttgacaaaaaatgattatgaatttgagacttgtaaaatatatgttggtatttataaattaaaaataataatatctatggtcctatatatatttaataaaagtggttaaattagttaatttaattaatattatcataaatttaatttttatttcaaaattaaaaataaaattaatggtttaaatagtgattagatataatgatattactcataattcaaataatattttttcaaccaatgtatatgagttatattgttaataattcaataaatatatttattttcatagaaaatgagtggtatctcattaataggcttcataataaattctgtaaaaaaaatacttcatactaataaattaaggatataaaaaaattagtaattaatatattttttacttcaataattaatacatttaaaaattgtcatatgtttcttatttttaggacaaaagaaggttatcatttatttcttatatacagataaaataatattattattttatcatttaaataaaaaaatttaa

SEQ ID NO: 1288 - DNA, 1320 bp, Glycine max
  Soy_ogl_242 Gm01:49980201..49981520 Cluster 5
ggctgtctaggaacaaactgatttttgatttttgaagattatcaattttctgtaatagaggttattagcaaaattaaatttcttatgtatagacaagcgcacctgttgcatttgttttaacatcttgatatatgtcttcttgtattagggagacttttaattttctttaacagcggggtatgccccatttattattgtatcatttttggttcgtttaggccgctgaacatacgcgtaaacttggcaagcacgcacacccgcccacagggaaagcaaacgatttcgttcgttgattcatgattcatgttatagtaataacttttacaatttcttctataaattttcttaatatttttatatagaaactattaaatgataatataaatatatatatagccttttctgagaaatataaaaagtaatatatctattgatagtgtaaagatctttttcactttccaatatgtcatttatttataaatcaaaccataaatttattaatttttataataaatattttaaaagttatataaggaatactataggaccctatttaaatcttgatcattgtcattcctatttatgtatagctgtcatttcatttctgcaaaagaaaaatagaaatattagatttttgaaataacacgtaaagtaaaagatttgactttttcaatttcatacagggtaattttttttaaaaaaaattgaaaatgattttatcattttagaataaatatttattttgatttttggaagattttattcatattaaagcttaaaacaagtaatattaattaggtttttctatttttaaaacatgagattaaataaataatattaatgaaattaaaaatttaccaaaataattgttattatcttatctatacatatatttactactactaaataaacaatacaaactgtaaaaaaaaacaatatatactgtatatactaatatcattaaaattaatattgataatttaaaaattaattacacattttatctcctagctttcttttataattttgaaaaatttgccatcttattttcaatattttgcaaaaaaaaaatttacccattagttgaatatccattgtcattaattgtcattaagtagtgcaccttatttgacactaacattggattgcggacacgagcacttaggtgcaagtagaaacaatatatgcaaaactttgaaagtaggaggtataagcaacgtaattaaacaatttttttgttgattagattaaagtaatgtcttagaatcatctctgtagatgaaaaaagaagtgattaatataagaaatctcattaaaaag

SEQ ID NO: 1289 - DNA, 1204 bp, Glycine max
  Soy_ogl_1174 Gm04:2091502..2092705 Cluster 5
ctagtacctttagttaatttaagcatattaaataatgatgtgacagtttattaacttataatgttattatttaatagatggaaactaattaggtatctaaattaaaagtttgtaaatgtcatgtaataaaataaaataaaatatctttaggtaatagattaaaaaataaatatattacatatataaaaaatatatggacatgaaatagtaatttgaggtattactttaatccaaaataagctgacgtgaaaagaaatgattaattgagtgtgaaataaaaagtttgatatttcttttgttagaaaaaaaaaggtacgaatttactttttgatacatttatttatatatttactgttactataataattagtattgtaggatgaaaataaaagtgtatatgttttagattatatttgaagtcagatttattatgtaaaatttgaactgtttaattttttttggagacgaactacttaatctttatccaacgatttgagagttattaataatattcttttgcatataaaaaaaactgtttcaaaagtgcatgtttaaatctttcatactcttttttaaaaaaagaaatacacgttattttttttaaaaaaattaattaattttttttatcatgcacatttattttataattttaattttttaatgtaaaattaaaaatatcggaataatgaatgagatgattgctagttcttacatgctctgattttagaaaaagataatcttctatcttttactgcatcaaaacgattttgggaattaagcttgcgtggtctagagtatttcatatcattcgtgttgattctgattcggcaaatactgttagcttctagctggtagtaattttcaccgttgctttcagcctgttacagagatacatgttgtgcatgcttacacatgcaacttttattgaaatcatgtcttgagagaagcaaaatcaactcacagacagtttgactaaacttgcttctggtcttagtaattgttatcatgttttttatttaaaaaaagaattatacattaataatatacaaaattctatataataatttataattaaatgaagatgtaaaatcgtcttcaagtgaatattcattaaactcttttggttttgttcctaattgtattgttaatgctttgagagctaattcagctcatgttttgttacttagaggcttctagtcctctt

SEQ ID NO: 1290 - DNA, 1430 bp, Glycine max
  Soy_ogl_2911 Gm09:618871..620300 Cluster 5
ggtatgatcgattctacttaaatttgtattttcaattaaaatcatatttaaggttttttatttatttatcaaaatcagatttaattaagttctactttttattttgggttactaattcttacattcaaaaatcgttttaggaaacatgagaataatgaacattaaattttaagttgcaaaggaaggtttaattggaactttatttataaatgctgtaataataacgaaggaggatttgcaacttgatcaattttcattaatgaacatatttacacttgtaagagaaaaagtgacaatccctttaataagatccctaatcagtacgaaattaaactaagagatactgttattacaagtagaatagtgaccaagcgatcggataacaagtagcatctcagtttattaattagttggctatccatagaaacatcggcaacattaagtagttgaatcgattcgtttaaaatattgttttaaatgtctaattatcatcatcactgaaaaaattcaactttttatcctatacacagtttaatttaatctaatgtaacaaatccgatggaattttttattctaggaattaaaacctccttttctctttttcaactttttttcacaataaaaaacatgtacaaacggaaagaaaatgagaatttaacttaattaattgaatatgatatttgaatattataaattctttgatatcttatttaattagtacggataataaaaatcacatgtaaaagaattttcatatatccataaacataagtaaacatttgttggaagtacacaattttttataacaaattttagtagttaatttattagtttttgttagtaaaaagagttgaatcataacctctcctccttttcttttttttttgtcacgaaatctcatattaaataaaatgaactatttaatgtgatattcttttaaattgatactctttcacctattggattaatcttttaaattgaattctcctctcgagcaaaccaaatactaatagatgatttaaatctttccaagaaaaaatgattactataaagttggtgtcactctaaaataaataaagtgatatccacttctacatattttgtttggactattttaccttttaactgacattataagctatactctattacgttttaatttcatataaaaacaaactaccccactaactatatataaattaagtcttatttcaaaatagttgcatcactaattttccattaacctctttaaaaagaaattatatagtaaagcacaaaatttccctctcttttttttaatcagcaaaaacgtctcttttccggtagtgatatgtaaattaaaagcagttctgtattttttttttttatctaatacattactttcctaatcaaaagtttgggtttgatctcctaaagtaagtcatcttcct

SEQ ID NO: 1291 - DNA, 1027 bp, Glycine max
  Soy_ogl_3224 Gm09:40246401..40247427 Cluster 5
atttatgccaccgttaacctccttattcatttttaatttagtctccatacatataaaacattcttaatttaattcatgtatatggagcacattactaatttgatttcttacatttaaggatagaattaagaatgcactacgtgttcaaattaagaatatgttgcaggtataaaaattaaattacactatatgtatatatgtatatgaaccaaatttaaaaagtttaagaaagttagccatcattgtataacgtacggtagagactaaactgctaacatttgtagatataaaaagttacaaaccaatttaaaagaacaaactgagaatctgcaacacagcacatcatgcaggaactaaattatatgtttaactttttagcttaaaataattttaagaaaaaataaaatcaagcacacccataatacaatttgaattcaacatttcttttttctgtacacgtacgctaggtaataagatttatgtgatcgtatatcagtaataatgacaataatgataaaatccaaagaaaagagatccacagattcataggcggtttcaaggcccggctaccctgggcaattgcccaggctctggcataacccttttaattttatgttactaatatttttctttttttttttggtgctgtattattatttttctttattaatgaattaaacgggcaactatcatgtttagcacgcagattcaacaaaaagtatcttgatattaaatagttagttgaactagctggcataaccctttttgtggactgtgtattcttatccttcactcttttttttttttttggtagaattttccttcttatttatttaccctttgtaaacaataattacgataattcatgcaatagggtaataacaactatagaaacaccaatcacatgaattcattattattggtcagctttttcacaaatttactatgagcttaaagcaaatatcatgtgatgttgttctataaatctaagttgtacatttatcaattactagtattttagtgaatg

SEQ ID NO: 1292 - DNA, 1383 bp, Glycine max
  Soy_ogl_5291 Gm16:4378293..4379675 Cluster 5
agtctctcaaccttgtttgctgatttggaaaaaaaatgtgtcacctgatgcaagagtattgagttggacctctattaattacctaaagatttaacacccactatataattaaccaggggatcaaatgctatatatatatatgagaaaaaattaataaagtcttaaatttaaaaactcttacattacaagaattacaaatcaattaaatcaaatataaaataagaaaaacaaggctagctctaaataataaatgaattttgagcataactattaattttggtcaaaatagcattataagctactaaatgaccttattaaacatacttcctagggcctttttcttataatatcttctttctgttcgtcaactttgcatgaagttgttttggactacttttggttccttattagttggagggtctattgggcatcattaaagtcatatgaaatgtccacttattcattaaggtctctgttcgcatgattaaaacaaatcatcatttttttttgcgtttttaaatatatttgttgggtacgtagaacgaattttccaccccaataatacaaaaaaaaattaaaaattattctaataatatgatccaaaaattattatacaaataataaaaaaaaattagaaattattctaataatatgatccaaaaattattatttaagatgcaaaaatcagtttggagaatcgatttcataatatgatattttggatcatggagtttagccaacgcaaaatactttagattagattataaaaaaaaacaaaaaaaatgtttattctattaaaaaaatactttaaaaaacattagttttttcatgtactttattaatttttatttcaaatttttgataaaattatataatataagtacaaaatgaagagtgtattataactataaagtttactataaatgaaaaaattaaataataattaaaacagttggatttacatttgtaatttttttattttattttatatcagcttaactcatgctaaacaataaaaattatacttgtaaatataattattaaacatgtatttaatgtcagtttgattgaccttaaattaaaaaataacactgatttcataacaaaaaaaatgaaagtgatttgtattgtgatattatttggatgattttttaattttttttaattactggattgaaaattcttcatacaactagatagtttaaattaagttttataaaatctcttatttcttgaatttaacgtttgagtttaatttaagtattctagcattttctaaaaaaaatccgacttaagaaaaatgtgacataacttgaaaacctattttttcaataatttaccgtctataaacttacatttattaggttaatgaatttagacctt

SEQ ID NO: 1293 - DNA, 1100 bp, Glycine max
  Soy_ogl_5787 Gm17:39608501..39609600 Cluster 5
ttataatatacttttaatttaaacttatagttgtaaattttaatccaaatatacacttaaccaaatcatttgccacagaagtgaagagagctagagaagctaatgctcatgagtcatgagtgaaataattatcattgtacttaatgctagttaaaagattttgtacattgaccattggggtttgataaaaatagcgtaatcgatggtctagaatctggatccagtgcaataaatattatattaatgaatttaaagtatgaaaccatgaataactaaggctaattatcagcatgttagtggtgcaagcgttataggtaatttggtttggtcataaaatttaattgtatgggattgctgttgtaagtttgaaacttaaagttattaaaattaaactttattatattaaaatataagttatttaacatttattttaggcaatttaaaatagttaatagtatatatttaacttctttatatgatcatatgtttaattacagaatataaaaaaaaatctttatatcatatactatataatagaacctttctttaaatgtatatagcattaccattaatgacaccgttgagaaataatgaaagaaaaatagaataagagtatggaataagaaaacaaaattacaaaaaaaatattaaaagcgaaacaattaaagaattaataaataatttttaagaaaatcatggtgaactatattaatgatactaaaaattataattttaatattttttcttatttttcagtcataattttgaagtagtcatataagatagttaatattcttttatcatataccagagacacgattaaaaaacaacaacagctgtacatgcataagcaacaagtctgattcttcgtgatagggactgtccatgataatacattatacatgcatattgcataagcaacaaagccaacaagtctcgtcgccgaaaaataatattgaatgcaaagtgatgtgcattgaaatttggccgtgcgatatgagtggtattatgagattgtatacaaaaagaattagaaaatttgtgtaataagatatatgactttaactttaattactcctaaaaggtggatccaatgaaaa

SEQ ID NO: 1294 - DNA, 1200 bp, Glycine max
  Soy_ogl_5813 Gm17:40270601..40271800 Cluster 5
agattaattttatcatggtttttcttaaaactcccttttcatgatttcttcacaaaaattaagctctttattttttaagagcttttataaaaaacaaaaaatactgtttggttcaactttttcttttaaaagaaaaaagttaaaaataagttgagtcaaactttatatgtaagatatatgtctaatgaatttaatgtacctataaaatataacattgctttcgtagttttaattttaattttttttaattaggtattagttggtgtacatataatggaaaagtaaattaataaatagagtagattaataaatatttaattactactatttacagtgtatatttgacatgtttaatgaatctgcatgtattcgaaatatattactttattttatgatatacagtacagtggaaattgtattttcttaaaaattttgaaagaaaataaaaaatggtagttcacatataaaaaaactaactatgcattaattgatgttcttctagctatctaatttcattaacgttgttggtatcaatttggacgaggacaacattggattttattttataattagataaccaaattaaacatttttaaaatagaaccaaaatgaataatgtaaataaaagaggaaaaaacaatttaatttcttatttattactttttcatgtaactgatttattattttttgcatttaaattttcttttacctacttaatattttcttttattgcataaccatttcttcttccttttaggatcatttttttttattccaggtacttaataaatttgtcgtacgtcgtgatctttttaagataattaattttttttatgactccttttcaattttaatcattgtacgtattaaaaactagactatacgtaccgacagtctgaaaaaatcaatcccattaatgaagggattttgattacaagataattacagcagaatatctcaagatatttgttccatatttgtatgggtaagatttgattggatatacaaatgtataaaaaaaatactgaaaatgcaaatgtataaaaaattcttaataagtttaaaatatttgcttatttatttatatattgcattttttttaacgcgcatttaataattatacttttttcgtacatacaagaaactccatttggtacgtgtttcaaactttcaattaatcccactgccgttgttttccat

SEQ ID NO: 1295 - DNA, 1132 bp, Glycine max
  Soy_ogl_6964 Gm20:43796901..43798032 Cluster 5
tcaaattaattaaaacaatcacaaaaataaaattaatactttttaaaattttataagtatcttaaacatattttaacctaaagaatatatcataacatgatgttacaaggaattgaaaaattattataatagaaccttctgaaaattatattaactattgtataaatcatatttagtaacaattgtactaatttatttcaaatttcaattggttatttaaagtggtataattttagtgagttacatagaccgtgagatttgtaggtgacaggtgtcccactattttacggtaaaaaatgatcctccactcacaaccgttcgatctactccttccctcactctctcaattcaggctacagaagcacagtccaacatgagtcgttatcggctcagatcgatgacatgaaagaaaaggaaaggaaataaaaaaaaaacacattaatttcttcaagttgtgggctgtggttaaaactttcaggcacaaaaggatatatattttcttctattaataaatattaattattaatttattaatttttatcagtaaagagatcgaactttccatttatttatttttttctctcccccttttattaccatatcaatcttatatcttgtaaaataatgtttgttactttaactaattttgtaatctcataattgtatactaattacgaacccattcatctaatgcatatggtaacgttagtctacttaatttttagaagaataggttaataaataataactgaatgtattttaaaattaattgtaattatataaaaaatatgtaagccgttgatgtattctaattaaattctaagaatcatagtgaatatttagtaagaaaattaatttattttgagagataaaaaagtgtacgcactttaacttttaaattatataaaataaaacgtactttgattattcttaaaagtttcatactttatcttgatcgactatatataatctaaaaagacagtatttatatatgcaatatcaaattgttgatatttgttcttaatattggtctcataaattaatgttgtttcttgatttgtttcgatgataatgatataagaaaagagacctgttaataacacttttaaaaatatatttttaatacactttt

SEQ ID NO: 1296 - DNA, 1243 bp, Glycine max
  Soy_ogl_3939 Gm11:37101601..37102843 Cluster 5
accgtattgaatactaattaactttctaagtgagcagtctaatccatcgcaaatcatcagcatcaaaagtctaataacaaatatttattatcatatcaaaataatacaatattgattttcataattaatattattaataatttgaaatattttaataaccaaatattaccaattcacagcataattaaaaaaattctgcagatttaggacgatgcctgaccaaattgggaggtaacaactaacaacatatgatttaggttaggacttgggacgcctcagaaacttggcagcttgtcagttcgcccctataatccgtcacatcaccttataaactgtaattccattgtactgtcatgaataaaagttaatgaatcaattattatttttttatcattcaaaagttcttaaaatttaaataaatgtatgatttaatttgaagaattaattgtttttatatattttaaagatttcttttaaaaaaatatttagtaaattaaaataaatatgcatttagattctctcacatgttgactttgacatatagccacacaaaattataatcatttcaactaaaatatatttttttaattcataaatatacatgctattttaaaaaattagtatgattgtgaagcatccatcggttggccaatcatttttaattaattattttttaatcatatttttttattataaaattcgaacccaagactttaattaaaaaatatgaattcagttttgtttgaactaacaacacgttaatataatattatattttatcataatttaaaaaaaatactacatggataaatatattttgaataataataattcaaaatataaatttaaattaatactcatacatattatattaaaatttgaaatttctctatcgatggaacacctgggaacttgttgtcatagaacaaactacaggttttatatgagaagtactataacaagcttttttttaaacacaattttattatttattaaaatttattgaaaattataaattaagataaagactcgttaaatgtaaaatgagactaggctcattaaaaaaatatttttaataaataataaaattatgtttataagaggatgttgatagcttttttcacaatattttatatttacattttcgtaacgaattaaaccttaaacaaaatgaaatcggcagtaaagaattcgtggattatggtgttcgaggaggttgaaagaccctctgaagccttcacta

SEQ ID NO: 1297 - DNA, 1117 bp, Glycine max
  Soy_ogl_2123 Gm07:2106601..2107717 Cluster 5
gatatcattaattcatttattctattgtatgtattatatgcatagaaaaaaaaaacaaataaaaagggagcagaggaggtgggcataatggcctagccttggacatgatcttattgtccatcaataaaaaattatcattgacataatttttttataaatcattaatataatttttagagtaatgttatattacatgaaaatctttgtacgaaatcacacaaattttaaataaatcaatgagaatatgtataacattcgaaggggaagataataaagtatattctccaacaaaataaaaaatacgcaactgttggtaactttgtattatttaacaatttcctcatttttaagatgtgtttttgatagaagaaatatttttttatgctcagaagtcatgatgttaatgactcacgaattttaagaatcacgatttttaaaaaacactaaattatgtttggttggtaataaatatactttgatatatttatataagttttattatgagactaaaaaaataacatgataatttactctaaattttaattattgaccacattaaataatttaataaataatttaataaaagtaacataaaactttgactacaataaaaaattttaactcaataaattaggtttcctcttttttaactcgggaaattagttccacctctcgtgatttttttgttgttgtgagaaacaactaaaatttattctcagaaaacattatttcttgaaaatattaatttttaaaaaagaaactgaaaatgaaaaacaaacattctaaacttcagattctaagaaaattaaaaaaattctttgtaccggatgtttcttaaaaataattattgtaaataaatatacataatttaaaaattaataaacttaatataaataatgatgtgataaaataacactataaaatattaatattttacattgtaaataaatatacctttttttaatgtaagatctgtataactttttaaatgaaagaattacgtaattcatataaaaaaaaaaaagtgctgttaccccccacataatttaaaaaacgctgctgctttgaatataaaagacccaaaccaatagacctgttttctttctccaaacagtaa

SEQ ID NO: 1298 - DNA, 1200 bp, Glycine max
  Soy_ogl_2955 Gm09:2820901..2822100 Cluster 5
gggtatataacattggcacatttctaacacatgctttttgtccgacatattcttaaacttacaaagcaagtaaagaataaagaaattgttgaacgaattacctaacgaaatttccactatttcttaaacttataagaattgctctcatgaaaatttaattaggaataagaaacctgtattcatatatatttaagtatatttaaacacgctgatacgaatacgattgtagtttattggatatatatataaaaggagaggtcaagttactctttatttatcatttatttttttaaaaatttaataattaaaattagctattcatcacaataaaattgctatatatgtttcttaatataatatagatttttcacaaggcgtatttctaacaaaaataaggaacaacttttcctaggacctataaaaataatagttactttttatattgtcattgtcatataatataaaactatcgtgtatgcatgatattttttatacttttacaataattatatcaaaaatcaaatatatcataatttttaattaattaataaaagtgtaatagtttaccctgacaatatatggaaattaaactataatatattacaagattattttaagatgttgcatatatggtcaatattacgtttacaatataatttaaacatttctttcaattcgtaactgaaagtgtaacattttaactattcttatgtttactaattatgaaaaaaattaacattcaacattcggcttctcatatttgttatgactagatatcaaacaaaaatagttctaaatatatatactttttcatattttacatcaaatattcttttgacaactaatttttttttattttttatttttaaatccaaacagttttcacttgttttaaactttgtcaaatcaaatatgcatttatcgtttgtacatctacatattttaatttatttttatattattcttgaattaataatcatgtatatatttttcctaaaaaaaatatgtataaaagatacaatatatgagatttatggtaactcttcttcttactggaatttggattcagtgcctccaattaagaatcatttgcctccaatcaagacgtcctatcctttctcggttcgttttttctttaagcatcaaactaattgctatcaattctacttggattacatgaagatacgacttttctggcag

SEQ ID NO: 1299 - DNA, 1280 bp, Glycine max
  Soy_ogl_250 Gm01:262266..263545 Cluster 5
tcttatttaaataaatcttccaactgattttatacgtaaattgtacttgttaaatataattttttaaatttcttaacagtattttatataattatatacttcaaatactattaaataaatttcattatattttgtgagttgtatttcataaatacgacttagcttatacaatttttcataaaaagaaatagataaatgacaatttcttaaatataatttaatgtatttttataagtaaaaatatgtaattaaattctatcttacgtattagaaagattttaaatatattttcataaatttataacataaacttttatataataaaaaattattaatgaatattgaattaatttatttatttatccaaactctcctccttaagggacagttgaccgtttacccagtattatttatttatttttataagtttttcaactggttggagtacctgggaacgagataattcaaccacatatcttatccgcttttaaataaattagttacgatttgacaggtgaaagtgaaactatgttttttgggcaacaaagtcacctaaacattaaaaagtcaaaacgtcccgtaaccataatttataaatgaagttgacacgtatcatatacaaaagttcctccttgaattccacggtgtttaatctatttacccagtccagtcaatgtttctccataatgaaacatctatttgtattgaccggtagccatgctaaaaaataataattatttaatgaaaaatattgaatcttagaaccatttttattgatataacttttatccaataaaatttaacggcttaaattacaacttattctctagtatcttatttttagttttagttcttctgttattttttttgtaagtccttgtaaaaatttaaaaaattataattttagtttcgactaataacattaattgatataatagttacaataacatcttatttattgatttgtcagtcatcaacaaatcaaaccagtaatcacatgtaatttttctgtttttaatataatttttaattcttcatcatttgattagtatcacatttttgaataaatgaagatttggaatcatgatttacaaaataaattactcctaattatcctattaagtttcttaataacacaataaattaatgaattgtcaatgtcattaatcaatattattacttaacagcaaaattaaaaaaattcaataactaaaattaaataaatctttaaaagactaaaaatataatattttataagaaccaaattattataaaaagta

SEQ ID NO: 1300 - DNA, 1290 bp, Glycine max
  Soy_ogl_4482 Gm13:36286157..361246 Cluster 5
ccttaaatttttacaaatatggcaaatcttaactcgtctttacatttttaattcataaatttatgttttttagaataattcttattaccatttaatggtaacataaaattatctagatatgttttgtcaattattgttctgaaataacatatattttatttattttaaatatatattttatttgtttaaaaatatatcttgtcatcaataaattgcgataaaaaaatttaaaatctataaaattattttacaaaatgctaacctaaaatttattatatttacacaaaataaaaattatattaaatctataaaaattaattcctcttaggttaatttttttccttaatttatttaattggtataattgggttcttttatttttaaaatattaattaaggtctcttattttttttttaaatggattcaatttgattttttttctatggaaccaaattgaattcattttaaagaagtaaaaagtctaattaaaattttcaaagaaaaactaaatgaatctaatctaataaataaattaaggaaaaatgacataatttaaccttctacttttaaggtttcgaatggtccgagtgttctatggcgtatcatttgtcatctttaagtgattatttgctggaaaagctgtcacattttgtggtccacaattttttttttatatatgtgtttcacaatatctcaagtacatatatattattgatcattgagtactcatgttgattacaaaataaattcaattgatttaagtatgtatacattacgtgatcattaattggaagttttagtaatactgtaaaaaaaaaaagaagttttagtaatcttgtcaaaaaacgaagaagttttagtaataacaaaaataaatttaagatatgcattttgaaattatattaaaaatagtaaagggccaaccatcgtattcctaaatggtaaattacacattcatcaattaatcatttttgttttataataaatctttgaccacttatttaaccatcagaaaattgatatgattaattaatgtccatttagattaactatagctttagtcacatcatttggaagtttcaaaacctctcgcatcgatgtccaaaatctttaaaaatggggtatgattaattaatgtccatttaaattaactatagctttagtcatatcatatcttgggtttgaaatgtcaaaatagagagaataatttgattttttcttagaaatcatgatttcttgtttttattttacaaatcttatcaaatccagtaggtaggttttgtgtgtgtg

SEQ ID NO: 1301 - DNA, 1500 bp, Glycine max
  Soy_ogl_4503 Gm13:37097001..37098500 Cluster 5
aaatcagtctttcgcggaaatattctattttatttatgcattacaggttgtaagtctgctgtcccttgccggttcttttaagaccaagtatttttcatttagtttggtcatttttttttattcttaggaattaaatatgatacaaagatttgtaacaatcacatacattattcaaccgaactagatctccttaatttttattcaatatgccttatcaaataactagaaagattagaagaaaaaatatatttaaaaaaataattcagaatgattctatccgaaaatccccaaaaatttcatcttaatatgcccaactgtatcctataaatgcaaacatgtctccactaaggatacaagtttactagatttggaatcttgttcctaatattttgataactcacaatgttatcgaaaaagtatgatttatcatatataaaacctgatataatatgacttagtaagaatgtaaacacgtcaaattgatcattaaaaaaacgttagattgattcaattttttaaaaaataaaataagttatagatatagaatttccaaagttttagaatgaaaaaaaatgggacattagaatttatcaatattgtgtataccccatattgttaaaggttttttgtaatattttttcatactaataacaacatttataaaaatattactaaaaactcagtaatattatttttcattactaataacatttctaaaattgttactaaagacttttaaaaatatttttcaatacataagtaacactctaaaaatgttattaaagatttttaacaatattttttcaatacatagacaacattttaaaaatgttgctaatatatatgctttgtaacatttgtttacaaatgttgctaatattttattttatcaaaaaatcatttaactaaacataaaaatttatgtgatctgatttaaatttaatataaaatctgaaccaaattaaatcaattttttgaattgatttggatcaatttttatagtttatattatactacaacaaagtatgtttttttaacattaaaaaaatgtccccaaaacatgaacaaatattacttaaacattttcggaatattttatgaaatgttgtgtatacttcatattgttaaaggctttttgcaatatttttttatactaataacaaaatttataaaaatgttactaaaattttttagcaacatttttttttcatactaataacaagatttctaaaaatgttactaaaggctttttagcaatatttttttcaacacataggcaacattttaaaaatgttggtaatatatatgtttcgtaacatttaacaaatgttactaattttcttttttaaaaatacaatataatgtcaattttgtagtattttaaaattttacactttgatacatgtatgaagagtttgatattaaagaatctagtgttaattgccaaaatggatagagtattgagcaagtggaacggataaaagacaaaatattacacca

SEQ ID NO: 1302 - DNA, 1312 bp, Glycine max
  Soy_ogl_15 Gm01:1176989..1178300 Cluster 5
gctccaccttcgatacatttctagatctattcttgtcaataaaacagctttcgacttgagagagaaaaatgaaaatagagatatcacaatcaaaaattggagtaatttagcataagtgaaatatagaagaaaataaatgtaaaagtggtaaattatccttaaaaggatttcaagtttaattattatacattgtcattgtaaacatgtaaacacaattaatccattataattcatagtatgcatgacttataagataattatataagtctaagactccaactttttgaagatatgacatcttataataggttaatggtgtaaaaaatctttatactattagtgtgtatcaattaaatcttaatttggtaatcagttgttacattttaataatcggttgtgctgcaaaaatataccgagcgtactcatcgatatagttgggtttatatttcataacagattataatgtatggtttctatttgataaatggttgtcctatatttgataatcgactgtttcaggttaaatgttgtaaataagaataaaataagatttttatttttaaattaatttctttcgtctcctttcatctaaactaaacaacctcacagtattgtttctttcaatttcacttttatttctctcaaacacaaaaatatgaaaccatacataaggacaaaaaactaaacttccaaaatataggaattaaaacataaaatgaagaaataacattaataaaaaaatatatttaaccctattttttcagtgtattgtataaatgttcttcaaatttagataaaaataaaaaaatattaataacagttgttgttattgtaagaaatgagaactacaattattgatcattagattatatttgaatggtcaagattaaaaaatcaaggaaaatactagtagtatactatttactattacagaattatataggtttaattccttatagaatgaatttcactcgtaatttatcatttttaataaatttaacatcttagaaagaatgagttaggagatgtgttgctcatacttctcaaagataaatacatggtttttaaaataatcatgtatgactattaactaaaatttaatcttaattattcatatatgattatagataaagatgtgtatttatcatttttcacaacaataaaaattgtcaattaatatgttctttttttatacatgttttttttactgctttctctgcacatttacatttatctatctatatatgtgtgtataactaaaaaataaaataaaattgaggatattgccctttcgtgtgtctcttgggataaa

SEQ ID NO: 1303 - DNA, 1271 bp, Glycine max
  Soy_ogl_206 Gm01:48545130..48546400 Cluster 5
gattgtaaaataagtcagtatttatttagcttaaataaaaaaaaattagaatgtcttataacaatttaattaaattttatattatatgatcaaatatattatttgaaattaactcaattcaagtttaatcacataaacaaggtaaatgtgagccaaacccaaatactccaagaagattttaaacaagtaagtgttaactcgatattacattataatatttttttaaaaaaacatcttatggtaatacttaacatatcataacacgctataaaaaaattaaaataattataataaattattattattataatttgtatggaacttgacttttgcatctttatatctcatatttatcatattctttactaatataagaaaattttagtccctttaaatccacatcatgcagttctgcctaattaggttgaatttataatttgtcaatctcaatttgagttgttgcatttcaatctcattcgtccaagaatacaacaagttgtcccaaattaacaagaatgaactgtaatcatatgtacctttttttcaacaagatttataccttggaaggttttatactcttcttcaactagcgaattatttttatgtattatatctatactattaataaaaaaaatatttttttaatgtccataaattttagactaatttatcttatcagtttttaaacttttattattcttttctaataactatccattacttttatgttattagttactttttttaactattaatatatttctttttcttttttattttaaaatatgtaaagagtcacatagtgcctctcccccctagtgattataattagaatacaatatgtaataaaaaagctaaattcaagattatattttctataaaaaaagcttgaaagaaaaaaaaatgtcaacatatataaagaaaataagttaggaatgacatgtgataatttgaagatataataaattaaaacttctctgaatttatactttaatttattaactataggtagattgatatattattcttagctaataaaaaaacgaactgtttgtcaacactaaaaaatgtcatatacgaacactgtaattagttagtattaaatgcttaaattaataacaagatttatagtgtatgctaaataatcgatgaaatttaggtggaaaataataaatggggatctgacgtgacaaaattttctttaacaatatataattttatttaatatttattattattattatttaggaaataataaaaaacctacaaga

SEQ ID NO: 1304 - DNA, 1300 bp, Glycine max
  Soy_ogl_208 Gm01:48670701..48672000 Cluster 5
ataaccatttttttatatatattttaacatttttaaagaaaaataaaaataaaaaacatgaaagtgaaattgtggtgatttttttaatatattttgatgattttaaaatgacacaaattaattttcaagaaattaaattttaaaaaaacatttttaacaacaaaaaattgctataaattatgatatcattaatgtaaagaatgaaagaaactaaaagtaatttttctaagggattaataaaaataatttttaagaactaaaaaaataattatccaaatttaaaagactaaaaatatatttaagcctaaaaaaatactaatatcattttttccattttaacacttaatttccatcctattagtacctgtatacttataacattggactaattaccaacattatgtagttaaataaattatattattatgtcttcttttcatacaaattaatattgtaatactcgtactccctcacaaaatttggtaaataatttaaatatgaactcaaatatgttttataagtaactacattacttattatcaatatatttttttgtcgataactattaaatttataactaattaccatccttacttttgaccctaaatttgtatattatgtcaacaattaaagaagctatgcaaagcatctgttcactttataatttcaataagtcagaactcctatatttgcagtagtttagtatcttacgactctttgatataatgctttgtagaatttaattggattatattaatagtataaaaaactaataatcactatttaatcataaatggttgtgtatgatgaaattattatttttaaataattaatttaaaagtcagatttgaattaattttaattatttgacaatgtggaaaattttataccaacagcgtataaaaattaaattatttttcatatatggattttctccttgaaaatgtgtaaggcatgataaatagtaatacttgtcatttgaatcaaaggtatatgctaaactgatcaattttatgcatttttattaattggtttatttaactaattaaacaaaggtgcaatgggaattttttttataaaaaacttaacataccactttagtttttattttaacataccactttagtttatatttttttcttctagagtttattcttaacatctaaaaaaattaaacttatttttttagtcttgacttaaaaaagacttgtctaattattataaaaaaccctaatgtttaatcaaaactatttttagaaaaataatatataaacaaatggaccaaaattaatcatttgaa

SEQ ID NO: 1305 - DNA, 1400 bp, Glycine max
  Soy_ogl_1210 Gm04:4038201..4039600 Cluster 5
ttcatactttatgataatttttaactattataaattaatttttatttttagctactagagttaatattttaaaattgtcacaaaatgttaaaattatttaaaagtgacaatttattgcgtgatgtgctaaaaagataatttgtcaaaatcgaagattaaaaaaaaaacacactctttatgtttaaagactaaaatagtaattgacctaacagaaaatattcactgtagttagttttctaggaaccacgtataaaagaaaggaaagaaatatttcatgtggaatctgtttaccgtagttgattgctcaatttggatggaaaaactataatcacaaaaatatccttatttattttttatttacgttatttatgtcaattaacacacatacttgttttgtttttatttttaactaaataatataaaaatcatttcacttttcattgattgttttattcctttatttcattatcttctctaatatccttaagtaaacgaagtcaaattctagaacgtagcccatcaacatcgtatatatgaataagtttggatcacatacatatgaaatgaatgaatggattgcagaaggggtccatgccctttgtctccggcacgccgaagccaccgctccaaagacggaaaagtactgtcaaaacaacaaatggagaaaagtactgtcagtattgtaaatccacaactcacaactcgtttcttcaaattgcttcaatatcccacggatcacggttacaggaatatggtcttttagattttttttattttatacacagaataaataaaactcatcattacatcaattagccttcactgcttaagattatttatcaaatatttcatgtatgattttttagattaagtatacatatattcaatcaaaacttaaataaaaaaatcagttaaattattctctcagcacatatgaataaattttattattttcttattttaaaatgtacactccattatctaaaaaataatatgggtttgatattaatcttttcactatgaacaaaaaatctcttaataataatgaataattattaatgtgtttttaataatattttgtctattttttacaactttgaatgtcactaatagttaccttgatacatttagttattcattttaatgttttagaaagtggattgaattttatatgataaaatatattatgtattaatagtttaaagtaattttatgttgttattaaattatgtatgataaatttatttatttatttaataattattttaaaagttatattaataataatttttgattgatccatcgacaattctacagtataaaagtttttatattaacaatatataatcattaaacttattttaaatagtatctttgttttcagctttaattttttcaaa

SEQ ID NO: 1306 - DNA, 1421 bp, Glycine max
  Soy_ogl_1436 Gm04:46299496..46300916 Cluster 5
accaaaagtgaaaaaaaatactaatttacaggatcgaaaatatatttaaatcaaaataaattaacaagaaagtgtttggtgctgacatattttcatgttttgtactttttttttatttgaagaaatcaaatataatacaaaaatttacaatgtctcacattttagttaatcactaaattagacgtttttcactttcatgttcacacaaaataatatccgtgagaaagaaaaaaaaggaaaaaatagaaatagataaccaaagaagaataaattattgctatactttaagtaaaacacagcattatcttatatttaatgttggtataaaaattaaaagcaaatgagttttattctaaataaaaaagtggactgtgcgtaagtgagcaaacaataaaaatattataatattttatttttaaaaaataataataacaataaatgaatcttaagtgacttaattattttatgttaaaaactagatttaactggtataaaaagacaaaatataatagttattaattataaatttggtaattaagatttttataaatttataatttgtattgcgcgttgatatgttgcattataatttaaaacattaatcaatagttcttgtttatagagcattaatcagtcattattttattttacgtacgatgatgacaaactaccgagatttcataccactaattattattattattcaatatgtattactatactttattatttaaaatacatgacactgttttagaaaaaattaatccttaaaaaattaactatctgtattcaattgtaatagttttcggaagacttattattttatttttgttattatgaatcaactctccgtcccaaacaaatatttgactacacctctggctatatagggatcaaattcaaaccattaatgtcctatgttttataaggaagaactggaaggtcaaacacttggaaccattgagagttcgaaatgcttattattagatacgtgtgctatcggattggattaattggatcagattaacaatttaaaataaaatcaattaaatttatttgattagtaaataaaagatattttttatcatattaaaatcaattaaatttatttgattagtaaataaaatatatttttattatattactgatatagaatatttattgatgtttttatttatttataagatttgaatatgttgctcaagagaatccaaactcaatattacttaaaccaataattttgtgataaaaaataataatttttgttctgttttttgctttacatataatctgaattattgataaaaacactaatctgaattaatttttgaattctttttttaatttaattagaataatgatgtgataaattatttttaatttagattaatatattttagactttaaaacttcaatttttc

SEQ ID NO: 1307 - DNA, 1070 bp, Glycine max
  Soy_ogl_1534 Gm05:1930220..1931289 Cluster 5
gtccatggaaaagtgtgagaaatgtttttttttagttaatggctaaaatggtcttgaatttatatatggaaatttaatcctcaaaattatattaattttaaaagatatttatcatgtattttttagtcaaaattattcaaaggttatttcatattatataacgataattaagaaacttaatgggcagtttatgttctatgttaactttcagaatggaacatctatcagttatatataaattagaatatatccaggttgagagtaacattttttttcttcactttttcaattagtaaaggattaaatagcaatttggtccttttttgttaacaacaaataataatttgatcctgtaaaatattttatttttggtttttggtcttttaaagtttttttagttttaattcccgtaaattttaattttttatttattttagttcttacttattacgttatcaaggggtttaccttcataaccatgtatatttttttataatttgagttttaattcctcattaactggttaaatgtaatcaagtatcaactattttaaatgaatgaggattaaaatatataatttatcaaaaaaaaaaagatacacatgattattctgttatatttctttatgacatgacaaatcaattaattgttgatatcattgttatgttatcaattaatgttattacttaataatatgaacctataacaaaaaataaacaaggactataaaaaaaataagatattttataaggattaaaattgttatttaaggcattgggaaattatgtattttttttcttctctttttaagtgtctttctcactcataattattgaaagtataaaatttttatctctctttatcattatttttcttttcaattttaatttaattttaaattataaaatttaaattaaaaaatataataatttatccttatttggtgttaatcatgtcacttttaacttatttataatatattaaaataataataataaaattcttagcggcaaaaaagcttaaatttattcttttctaatactattaacacaactttttatgttatttta

SEQ ID NO: 1308 - DNA, 1069 bp, Glycine max
  Soy_ogl_1543 Gm05:2128201..2129269 Cluster 5
aattaatattatattgaaaagatgaatgagatacttatgattatgtctccaactttaatataatatgagtaaaaataaatattttattatataaaacattttattaaaaaattacaaatatataatacttatgatacattacatatccttaaaaagtatacattttatatctttaaagtatatattgtaaattaaccttttcataaaggtggatcaatacaatttatattactatcccttataccattaattgttatgtgtttttaataataataataataaattctctataaagatattaatactatacgtcacttataatagtaaaaataatttccttgtgattaaagattattttgataataaataagttggttatttgtttaattatttcgtaataataattcttatatgaattaatttatattttacttaaaatatttttatttaacaatttcatttgaatattttttttttgttaaatttgcaattacatgtaattaacaatatctcccatgtttagctccatcttatttgaatgtaaagtgcaaaaaaaatggtacaagtcaaggatgtagtactagaggaaaaacataaaaagtttgtaacaggaatttaattttctgaaggctcaaaaattaacttttgtgaaaatcttgaaaggtttgataatgtttttaaaggtcaaaataagaaaaaatttagcaaaaaaaatacctgatgaatttgatgaagagtgatagtcatgtttaaaacaattgataaatgtaattttcactataaattcaaaagggcttaaacaattattttattttattttatacttcctctatgatatgaaaaaatattttttatataatcaattagaattttttcagcttaatatttttaaaataaaacaaaagtagtattatatatatgtgtatcatatattaattcgattaagaaattataattatttagctgagaaatatatatttcactcgattaaagatagtcaatttaaataattaaatatttctaagaatataaaaaatctaaagaatgatttctgtaactttcatcgatg

SEQ ID NO: 1309 - DNA, 1017 bp, Glycine max
  Soy_ogl_3298 Gm10:1084201..1085217 Cluster 5
tttaaaagttaaatttgtttaacacgtggacagtagtatgaacattttttttcattgtacattttaactttgactcttaattaattgtgtttttaatcttatgtatatgaaataaattttattagaagaaaaatatttattttgtatgtatttatggtttttaacaaagattaattatcacgtttgacaagaattattttatatcaatatgtaaaaaaaatatttttagtccataaattaaaatgttttttaatcttttaaataaaaaatatatactttatatttctttaaattcaaaaggttttcttctagtctctcttcaaatgaaaaattatatattttttagttagtcaaattttggggaaatgaataaaaatattattttttaaatttgagagattaaaatacaaaatttatttggaggattaaaaaaatacactccttaatttaagggactaaaaatataattcagcttacattttaaacaaatcattttcttgaatgacatatttttaaagtatattaaatgaattttataaattatttacatttcataaatatgtccattgtaatttaaaattattggcttgttttttatttttatttggagataataaaataaaaatattaaaaaaatttaactatgttttggataaaataatattttggaaactatatgtagtaattttggttgggacaaaagtcacaaaaaaatcattttatttgcacaattcattttttcatttccgttgaaaaaaatgatttcaaattattattatacatatactagttcatgttgctgtataaaatactactactactactatgtatttgtgtccgtttcatttcccaaaatggaataaaatgatggcgtcattgctgagcctacgataacaatcaaacggctagaatgaactattggtggcgtgagaacctcgagaagcttcgagatgtaagttgtaacgtaacgttccttcctattgcattcaaatactagataggctttttagttgtaca

SEQ ID NO: 1310 - DNA, 1000 bp, Glycine max
  Soy_ogl_3568 Gm10:46215501..46216500 Cluster 5
aaaataattaatatttcaacaaataaaaaagtactcattagataattgtcacatttataaaataataaaaataatatacaattatacctgtaacatatctcaaatatacaacataagcacctattacataaaaaaataaacaccactttcgtatttcaaataaaaaaagaaaagaaaaaaaaaagactaaagttgtgtttgttattacgactttattatttcttaaaaaaacaaaagaaaaaaatactaaagtcatttatgataatatggtttttataaaaaaatgttaaatatttaaagtcgtattttaaaatatgacttcgatatttaaaaaaaaaataaaattctaactttctaaaatcgtattttaaaacacaatttatctataaaattctaactttctaaaatcgtattttaaaacacaatttatctatatcttataatattttcaaaatttacccattcttatattttttttttctaacccatttgtgtaaattttaacattctacctttggagaagttgacagagtacatcagaattagagagtgagaagctacgtactgaagcaatattttaagagtattatatattatatttcccttatcttttcattgaaaatcaagctagctttgaaagatgctgattgttgaaggttacactcttacacagagacaaaaatttgtgctccaaagagaattgcagttataattgtaaccccttcaatccgccgttacacttttagttagaattttttattattgaaaattcttcctagttattatttttcaaaacctcaaaaatcaattcttcccaagatcaattactaattccacaaatgaatataaaacttgttagtgtattttattttcattcacatctttttggaaatttttttaaaatattacttatctcataattattttaagtcaaacacatttaaatataaattatttaagtgataaactattaaaaaataaatcttatttatataaatag

SEQ ID NO: 1311 - DNA, 1083 bp, Glycine max
  Soy_ogl_4523 Gm13:37629118..37630200 Cluster 5
cgcaagctcattgctatcataactgttgcctttcttataatgtatgtctcttgctattatatatcaccccatcatctaaatcaataatttgaattaagaactataaaggaatttgtatgatttaaatttaaaatttgacataaaagtttgtttttacaaatttcaatttttttagtattttaaactaacacggtggaagatgcattgtgtaagacattttttctatatgatttaatagtaaaaataaattactgaatataatttatatagtcaaacttttattgcaactaaaatttgaaatatatttttttaaaataggttagttttgctacatatataaacatatgtgtttttaaccgattctacagtatatcaacttttaattttctatttcttatatattctgatatatgtatacattctataaagcaaaaaaaaaatatataaacacaaaattcatgtagtatataaattttaattttaaacacacacactaattaatttatattttttaaataatcttaaatataaaaaaacattcatgtaatatatgaaaatattaatcaatataattatatgttatattaaaatgtatttattttttattcatccctcctttattacattatttctagattcatccacataatgttttttttaagatatttttaattcataaaatttacattatgttgtttttctttttttagattaaaatgtaatttttatcttattattttcataaatttgtacttttaatctctctattttttaaataagatatttcgtctcctactttttaaaagttagtaattttaatttttatgaccaattttaaatattaatttttgtactttgtaaatgttatagataattatttatttcttatacagacgacaaatgattttttaaaaatatttaattgttaacaagtttaatttattaaaaagaattaaaaaatatataatcaactgatccatgaagggagaactaaaattacatatttttgaaaattagaaatacaatgtttcaattaaaaaaaaaaaaaagaggattaaaattatgaatttggaggagggtgca

SEQ ID NO: 1312 - DNA, 1100 bp, Glycine max
  Soy_ogl_4691 Gm14:5729001..5730100 Cluster 5
gattcacacaaaaaaatatcaatctaaacattatatataaaatcataaagttaaagaagtataaactatcattgaagtatattttatgatatttatttcaagataaataatatcaatattatcatgttatataaatattatccattaaatataagagctttattaataaataattattttaaaaattatacttttaaaagatataattaagacaacagacttaattgagacaaaccgaaatatatatatatataagtattaattgggtcattctaaaactaaaagttattatatatcaagattaactctgggcaaagtcaagttaatggaatgcgacgagtaataaacactcctgggggcgggggaaatgaggcaaattgcactattcttgatttgttttgtaaaaaaaataaaaaatataaggcttgatttgtttttaaacaaaggggtctaggcccaacagaaagaaagtagtttacttaagctttattggaattgaaggcttagtttaatctcttctaaaatctttttatttatattatattatacattatagatgtaaaatatttactgagttcgtaaattattttttacaaaaaaaaaattaatcatccatctttaatgaaatttcttctctttaagtctcaactattttattttttttgttcaattcatccagaatatttgaatctaaaaccttccttaaaatatatttaaactcaatttcatttgagctaacacaacattggttttgaaatctatttaatttttaaaaaatcatttcataataaagtctattaaatcaaattataaatatatctaaatagactaatagcgtgcatttataagtcaataagtttaagtttttaaataaattaacaagcagtaaaaaaaattaacaagttctgtaaaaaaaaattaacaagtaaataatttcaaaatattatcataaaagttcaacccattaattactattatatttgtatttatttaaacaaactgacttcttaaacttaaaatatatttttttcattaaacggtatgtataactcctttaactaaattaaacggttcaaaccctaactcttttaactaaatat

SEQ ID NO: 1313 - DNA, 1543 bp, Glycine max
  Soy_ogl_5495 Gm17:3882353..3883895 Cluster 5
accaatttcacccacatggcctctctattcgtacataagccccaactatttttcatcatctcgggaccccttcaaccccaatccgccagacatttttggcttgcttatattctaccaaacacatactaatgaaattaaagaaaaaaaaaatctaaccttcaaatataaatttaatacaataactttcttcaatcaaattctttgtatgacttttcttgtagtaacaacaattgtcaataactcatggaagaaaaacaattatactattaatgtattaaatataatataacttggagaaaaatactaagagagaaataaagtagtggagaagagagtttagagagaataataattatgtgtattttttttaagagaaataatttatttatagatacaaaaagatatttaaaaaattacaaaaaataaataaaaataaagaaatacaatcacaaacaaattgtttataaaagatattaatatattaagttgcgttttaggtgtgtaaaaaaaggttgcgttttaggaacggttcggtcaaatcatgcctataatttccattcctaagtataaatttcgtgaaaaaatatatattacgcaggatgatattttaaaggttaaaatatatttttaatttttactttttactaaagatatttttttaaaaattattttgattccttgactctcaaatttgagttaatattgtttttccaatacaacattcttttttaattttaggacatgattttaaattattttttatttaagatgtaaaaattgtctcatcaaattcatttacatgaaaattatataaataaaaagaagaaattgcattaaaaaatttataataacttcctcttaaaagtgtgaagaagaaaaaaaaaagacaggtagatgatatatattttttataagcaaatataattttattaatgataatcgtctcaacaatacaagatatgttgtatacttgaaattacaaaacatgaaaacaatcaaaattgataatgcacaatatgcacgaactcttctatatgtttttctcatggttcagcatgcaatattgatttattaatctccattggtttgatattccaaatttgtaaatctgtcatttctgaatgaagttcaatattaatgagattagtgtgaatgttataaatgtcttaatattgtgttcaatttatacgaatgaaaaaaatcaatgactaaaataaagaaaaaatataattttaaaaactaaaatatctacaggtattgatttataaatcaatgactaaaattgtcgctaacttaaatattagttctacacatttaaaactttattaatgttaatcaacatgtaaagtacgccttacttttttaaatttgagactccaaaaatatattcatattaaaaatatataaaaaaaaaatctttatacgaacaatgcatactttattttgaatgataaggactaatttcagtcttatctttgtcttaaaagatgattagcttcatcttttccgaacaaatgccaagggttttattttcacttccccg

SEQ ID NO: 1314 - DNA, 1041 bp, Glycine max
  Soy_ogl_5884 Gm18:2081716..2082756 Cluster 5
tttaatttatttttgctattactttttatatttttttattttaaccatatattgtttacactatttattttattgttgtatttcaagatattgataattgattagtatgaaaatactaatttgcaattgtttataaaagtacccaatggtattaccatattaatcaatatagtggaagtataatatctactcaattttatgttttttttttatattttaaacttgacagagaatattttgtataaataatataagattaacaatataataaacgatataaaacacataacaattgaaactaaaaaattataaaagttaaaaattaatttaaaaacttgaaatgataattttccacaaatatttttatttataaaattaaattaaatttcgtataaaatatgatataaatatatttatttttatcaatttatgcttattagctaccttaatagataactttttaaagtttaagctagctaacaactttcagccagtttttttacctttaactagtttttcaagtattttttatcaaacaaacccctagtcaatactcctttaattaatatttttcctaataccataatatatcatatttgcatcaatattaattaatgtcaaatatatattatttttaattttatacttctttaattagtataagatttaatcacatagtattaaaatgtatatattatttcaaatatttgtctgactaacttataaattaatttgatgaaaacaaatttatttgatatgagtttatttaatagcttctaatttattttagaagttaactattaacttataagttactattttttttatttgtattctcattaatataatttaaattacttttaatcgtgaatcatatagagtgtcaaaaagaatgaggtcaacatttttcattttttaaactataatgaatctacatctcagcttaaaatttaaataaaatcataaaatttaaactttctcaccctacgtattatggttagatataagaaggatgtttgtgaaccagtgtttagttgaggc

SEQ ID NO: 1315 - DNA, 1469 bp, Glycine max
  Soy_ogl_6233 Gm18:57867687..57869155 Cluster 5
tgtacgctctaataattgtccttattttttttaaaaaaaatatacattaatttaaaatgataaatatgttggattgaaatgaaatttcattttttttttttgtattatataattcgataataaaactttgtgagaaatttggactaaacttttaatttttatatataaaatcgacggtaatcttttagtatataagtaatttaaggggtaattgcattgaacctacatacatgagctttgtgcttatcacattagacatacgtgtttattaattataacatatactgtattttactttatgcatcgttattaaatctcagcattaaggaattatataaatatctaccacccatatttaatgtgaatttttcattaccgcatataatgtgaattaattacactattttcccttgtacatagagtagaaacctgaatgtatttaaacatgtcaagaaaatttaattgtttcaattataaattgatgtagtataattcaaaatttatatatcgtcagtgctaactattttatgtatgttttaaagtaatttcaagtatgacattttgagtaattattacaagaataaataatttttaatcatgatataataatctataattagatgatggtttaaagtaactttatactgtattttaattaaatccattgatatatttcataattttattatcttatagtagtatatataaataatacgtagtcattataagtattgtaatcaattattatatattaaaatggtatataataatatagctataaattgtagccaatcttgtttatatattattttaataatatagtttttatttaattttttttactatttctagggttatttatcatgataatattttatggatacaaaacaaataactgttgtaaaaaagtgaaatatttttgttaattttgtgttatatacttatattcattcatttgttttgtttatttattgatcgagtgaagatcaattatggtcttccgaagactatttatcaatagtccaccatgttaaattttttaaaaaataaataaataaatcaccaaaggtaaaatttatgaatatgaggagtttttaatctatatattaatatgcacttttttaccctgttatttaattgtaaattatacaataagtcagtaaacttttattgataactacttttaagagttatatgaaagatgaattgatttctaattaacttacaagtgggtgcttattaaactgatattaaaaattacaagtctaaggtcaacagtaccgtctgaaattaaataatctcattttaaagtaattatgtatattaattatccaataatggcaagccatcccaattcaagtctttttccttataccataccgcaaatgattgctaaattttaaaggaatctgagcacaacagaaaactccaacgaatataatcatagaatatagagagaggtcaaattt

SEQ ID NO: 1316 - DNA, 1488 bp, Glycine max
  Soy_ogl_6292 Gm18:60105701..60107188 Cluster 5
catacataggacagcaagcaacccattgatggagtgatttatttggatttaatttctgtgtaattaagctatactccttccaaacaaaatctcgtaatagttagaaattgcagaattattggagacagtaaaatcgttaaaatatttcatcacatattggtatatattaggatctttaattatattatcgtggatatttaattgaaaaaatcagctgagattagttataattaaatccacaatctaaatagttaattttaatctaataattataattaaatatttttatcgatctatctatccatatattttaattgatgagtgtcatttttttctaatttcaaaatataaatgatttatactttaaatgaaaaaatatgcctataatatttttcatttctttgtattagattatattgatgggttaatttagaccttcaatttagagtttcctaaaaagtttgtcaatggcacttaatacttcaatatatataaaaacacatttcaaaatatgattcatgactttaagtttgtaaaatatatggacatgacccaagtgatatcttttttatactgatcttaatttgaaacaagctttacgaaatcctgcgttgatcagcttttttctgtaagaaataagcaataatttatttagatttaaatgtgtttttgatatctataaaatagcttttttatcatattactatttaatttttgtttttgttttagtaccttatatattgtttttgtttggttttcatattactattagtttcattttattaagtaatatatgataaatataatgtgatatcatcattatatcactatgatgttatatttaaattttttttatatcattaattaaaaaaaaaaaaaaaacacccactaaactcgactctaacaaattgtctattttttattattatttatgttagcctcactctaattgcagtttttattaagccgactctaacagaagtaattgcagttttcggtaagctaactctaatttttttgttgttgcagtagtcatataatttctagttgtaaaaattatggattgaaacattcttttttattcttacaaatttatatgatgtttttcggaaaaatactaataaataaattagagtcagcttggctgactctaacaacagtaataacaaattgctagcacaatttatttactttcaaataagaaacaaacaggtacgaggacgactgaagtatgaaaaaatgaaataaagaatcagaaataatataaaactatatatttaaattgcagttttcattatttggttcagatttgaatgcatatatttggttcagtatgaaaaaatgaaataaagaatcagaaataatatgctttaaaaaattaaaaaaataagatcagatttggttttaaataggaccaaattaaatttatttaaaaaataagatatctaattgaaacttttaaaaataaaagaattaaaaattaaagga

SEQ ID NO: 1317 - DNA, 1141 bp, Glycine max
  Soy_ogl_6829 Gm20:38053001..38054141 Cluster 5
tgtttgctttctttaactaggggtcgagagatattcatgtactattttgaagtaaaatatatgtacctaaaatgtttaatttgtaatacaatgctgctaattatgttgatgttcaatgttgtcaatgggataaataagttttgaaggtactatcatgttactgatcaaaatattcttttaaaaaattaatgttttcataattagtacaacatatttttttatattatcatctaattatgtatgcgtgtttgtaatcaagatgatatcatactctactattgatgtattattattaacggttaagatgtgcacactttattttctaaagtgcagtaatataaagtaataaaatccataagtttattatatacacttttacgtattagtgattagtgattatctttaaaatttaataagagatattttgatctgtcaaaacaaaaaataaaagagatattttggtgatgaatttaatgagaggtttatagtaaaatcttataaaaggaaagagaaaaaaaaatgcaatatgaggtatccaatttgcacactcacaattcatatattaagcaaatgagatgacttgaaattgaaggctctaatggttatttttaaatttcgttagcaaataattataaatatataatcattatacaaaaagtttaactataactttagattcaataatatgattaatttttgttttaatcttttaaaagttattttgtttgtgttgatctctctatatttttaaatccttttaattagtccatatcgttaattacttaataataataacatgccatatgtattatttaattatatgcttttaaggtttaattatatgttacttcaactattatttttaaccaattttacttcaactattattctacatacatattatgttatgagaagttgtaatgaaaaccatttttaaaaaaaataaaatttatgaggaaaaaactcaattaaaatattttttgaagattaaaaataaatttatttatatttatataaacaaaaataaattaccctaaaaaatgtattcatgtaaatatgtatatttcaactcagatatttcagtaacataactgaaaattcaatgactcaacaattaattatacatgaattataaaagagg

SEQ ID NO: 1318 - DNA, 1276 bp, Glycine max
  Soy_ogl_6955 Gm20:43504225..43505500 Cluster 5
ataacattttaaaaaatactaaaaattattaaaaaaacttgtttatcagtcaaacaggtatttgagttagtaaaattaaaacatataccttgtaaaacataaacttacaactactaagcattatcttcagtcactttttaaaaatgtttaaatgtctatttgatatatttgtatgaattaaaatatatttttaattcttataaaatatttgaagatcggttctagttatcaaagtggtttagcactttataagctgttatatagcgcttctggtcttcataaaaaaaaaaaaaaataacttcataagaaaaaaagatagcgcttttgtgcattcaaatttagaaagacaaaaaaatgaacaaaaaatttagaaagactaataccgaacttatgaaaattttcaaaaaaactacaaatattttacccatttgtatttttttaattcatttaaatatctctttaaaatatttatttactcattttaattaataatttcaatttttaataaattttaatttaaatatttcaataagttaatcaaaatttcccccatgaatttgcataacggtaaaagaaaaaagaaataaataaaatttaaacaagttttttatccctataattatagagaaaatagtatatacaagtatggtattatcgacttttataataatcatttaaaagtcatacaaatatttatttctaattaattgaaacctatagtctttaaactcatgataatatatgatttgtttttgttttgttctacttaagtttttttcccctcaagttagtcttttttttttatcttagtcctagatgttactatttcagtctataaaattgataaactttaaaatattgaggtgtgatttttttcaaaacataaaaaggtaaatagttaatttggtcctcaaaagattgagatattgtaattttagtcacttgaaaataaataaataaaataaaaagtgtaattttcactcactttggtccaaaattcaaaaaaaaaatatttgacttaaataataacattaatatatactatttaaaaactaaattgacaataaataattaaatttaagaacttattttacaactttttttaacttacttattttacaacatagaaacttttttgaatttttatattttttatgtttttttgaaatgatgatttactaaaatataaaattcaacatcatagttggagctgatgcacattatgagatatgggggacaattgtctttttttatttatttaaacatattgataaaa

SEQ ID NO: 1319 - DNA, 1034 bp, Glycine max
  Soy_ogl_6972 Gm20:44021053..44022086 Cluster 5
agtttaagtttttttttaaatattaacttgtaactttttatatattttttttatttttaaaaaatatttattattttttcttattatccttctaaaataaaacaaaattttattatttatttgttttctttcactcaattctcctacacatttttatattacactatttattttaaccattatactatttataatatttttattattattttagtattattcttcacaaaatttacaatgatagatattagatttattttattttgttattatttttttaataattttatattaaacagtattttaactattatgttaacataataaaattataatgtgtagttaactgtttttttttttagttgattttaaaattgaaagtattttaaaatatagtataagattagtagaagaatacataatataaagaatgtaataattgaaactaaaaaatgaacgaaaataatttatctataaataaaaattacaatattttaaaattaattgaaaaaaaaataaattataacacctctaaatatatttttatcaataaataaaattaaaaattatatacaaatatcatataaatatatttatttttattattttatatttttcaacttctttaatagataagttcatccaacatccttatcatttaataagttagtttaaaagttatcaactactaattaactttttagcttttatctacattttcagctttatagtttttcagctaattttctccaacataatttcatttattttttattaaaaatcttgttaattaattacgtatatattttagaaaaataattaatataaaatgacttataaaaaagggttaacggtgattgtgactccaattaatctagaaagtttaactttttagatcacttatgattataatatttttttgtgtaatgatcacactgagattcatatttatatactgtcaaaccctctccacttgatcgatcctagtgtttcttactattgcaatgtagagagtcattttggcattaatttta

SEQ ID NO: 1320 - DNA, 1100 bp, Glycine max
  Soy_ogl_6984 Gm20:44353201..44354300 Cluster 5
tcctatattttattagagtaaattatataaatttctttaaaagtttttttttattacatttgatactttttcattttttaacgtatagaacatcctttaatttttggggttttgttacatcaactctctcttgggtgtaaaaagtattatgtgacccctcttaagtgagcttaaactaatggaaaaaatgaaaaaaatatcaagataataagagcaagtctcagaagatttgtgtcatttagtttatattatataaaagaaaaatatattatattatataaaagaaaaaacttaacttattaaattcaactttgtaagttatttttaatatcttctaattcatgaagtgacatgttttgaatttttaatttttatatttttatatttttgatatatttattaaattttttatatcttttttaaataaatcataattttattatttaaaaaaaggtgacctttaatttgctatcataaactctttatgctaataataataggtgtgttagctttttggtatctacttttcaattgttgattggtataaattgtgtttgataatcctttgcaaaattaatattatatgaagctgattatatgaaattgttttgggttgaaattgattttaaaggaaaataatttatgttttgatttttttattttaaaagtaaattagttgtaaaagttagtgtattttttttattcgatacaaaaatactaagttgattcattttaaattaaaatcaattttaaacttaaattcaatttcttaatatgggatcaaatatataaatctttgactaaaatcactttatttatttcttgtatttatattcaataaaatgatgtgattttagttctttattaattacacatattttttagttcttaacaagagactaaaattaatcattttattaaatgtagagaaaaaaaataaacaattgctataggaattatatataacaaaagttgtgatatttttttggaaagttgaaatatgtttttagttcatataataatcttatttttttattttagttctcttagagttagtttttttttaataatctccgtaatattcaatttttttttagctt

SEQ ID NO: 1321 - DNA, 1502 bp, Glycine max
  Soy_ogl_398 Gm02:5313401..5314902 Cluster 5
gaatcaacttaatggtgtaaatttttattgcattcatatgcggaaaacacatgagaaaaaaaaaagactattttctttctcaaaataattatcgattcaaagtttgtactcccactaaattatatggtcacatgctcagatagactggtacatacacatgggattagggtcgtgtcaaggtagggcctaagactatttttttttataaaattttaaaataatataaattatttattttttattaactttctagatttttaacctacaacattatttattaatgttttaaattattctaatgtgtgcatatgtgcactgtatttgttgttatctatagttctactcctttcacttttaattatttgtttttctcacattaattattaaaatattaaaacacaacacaattattttattgtgatgtacaattatattttcattctcaataggcctaagacaaatgtctggatggtcttgttatctatagatcatgcatgggataatctgtattcacttgaagaggtacaaaagaattgtttttttataagggtaaaaaagaattgttattttcacatttcgatgccatgtgtatatcttcgtaatcttgagtgatagaaagaataaatattattaagatatggagaatttaaaaatataattttcaatgttttatttatcgtgataaagagaaattattatattagtcctcaagaaaattaatagatattccacattaatatgataataaaaaaacataattaaaatcattagataaagaatacttaaataaaaattcctatttaatcaacactagtagctgattctataggagttgtttcaatccgtctttagtttttctttaattttcatacaaatagaaaaatgttctaacctcaaaattttctaaaaccatgataattacataattgataactcaaaatacattatatagtcgttgatatgtagaacttgatatataaaaatggcaatttacacttcaaattttcaagtataaatagaaaattttgcttttggcattataacatatatgcatatatgtgtcatacatcctctcaattaatatttaacttttaagaaaatataaaatgtttttagcatcttaaatataattcgtaaactttgtaccaaaaataattaatttgtaaactaaattgtattcattgtctatgtggtacatgaatatgaaacgttgataaaaacaagagttagtctcataaaaaataaaataaaaacacagaaattgttataagtttcttccttttgagtcacataaacacccgtgcaaatacttattttagaaaaattgttttcttttgtaataaaatattttttgtttttataataaaaatatttaaaatttgaaatataaattaaataaatatatacaaaaaatagatattagaaattaaactaaagagatataattaactgtaaaaggtaaataaaatcaataaaaataactagtgaaattcatcaaatga

SEQ ID NO: 1322 - DNA, 1100 bp, Glycine max
  Soy_ogl_1371 Gm04:43799401..43800500 Cluster 5
gagccaaccctagctaggcattttgttcggtgagttgatggtccacaagcctatggatagagtaggggacccaaaaaagaaactttatataataatataatattttttatatgttattttatattattttcataaataaattttaatctttctctaattttattccctttttatccaaattaaaatgcagacagataataagaaaatatatttctcttggttattagtttctttttcaaatgagatatccacgtgtaaagaatatgtatagaattaaagtgtttattttctttacaggacaagaaacacaaaccaaattttaaattataaaaaagactaaaagttaatatattaataaataaataaaaaatatatgtatgatttactatgacatgattgatgagaaaaaaatggttgtctgctttttgggaagtgtgtgcttaatttttttttggaattgaatcatacatgataatatggagcaatttgaatgaaaatgtgatatctttttaatgtttgttaaaactgtgttattcagttattgataaaaaaaattgtgttattccattgaggaatattatgaatatattttttaatatattctttttaatttattaaaaaattataaaattaagaaaaaattattaaatataatgtgaaacctataaaattttattatttttaataaattttaataaataagaaaaaatatattcaaaaaatgtgtaaaaaaatatgtttttaacatttctttattcaattaatgtcataaatcatgttttttttaatgaaatctagtacttatttttttatgcaaaatatatacattttttatactcatatagaagagggtccttattaatagatggtcctaaactcataaaaaataaaaatacttgtttatttttgtttgacaaactttaaataataacatgaacttttaaatactgatgaattaactcatttattaaattaagatacattgtaaatagaatatttctaaagtattgaattgcaaatattatttaatttgatctatttttaaatcttctcatatgagtttgagtttgaagtaatgaagaaaataaaagaaatgcaaa

SEQ ID NO: 1323 - DNA, 1116 bp, Glycine max
  Soy_ogl_1857 Gm06:8389585..8390700 Cluster 5
gttgtacaagttttcttttggtatattagttgtagaagtttagtgggatttcaactttcaatttactttttttccctcacatattcccatatctagaaagaataaatgcggcatagtccacttttctactgaaggctaaattagatagattcctttcatatttatcatgcttgtgtattagtttaaatggagttagagataataggtaagtttgtttaaattaaaataataataattttaattaagggagtatagtctagagggtgagaaagttataaattttgtgatattgtattcaatttttactggtatttttttaaaataaatgtttttatgcaaatatttttaagggaacaaataaaatttactttttaaaataaacaaaaaaactattttttacgtaaaaataatttaaacaaacatacttaaaaataaaaaaaaatcttattttattaaaataagcgtttattttaataaataattttagataaactgattcaataattagaatgattagcttgttttgttagttgttcaccggtagaaaataatttcgggggccaaaaaagtatagtatatatttttgattgataatatttcgagcttgaataaacctaatttttaaattaatacaatcacattacaagctaatgattgtaaaatcattttcttcaaattaacaggaaattttgaaaataccgttagacggagtttttaaacttaattaaatatgagagtttttttaatcaaaatagggcgattttcaaataaataattaaaatgagtagatttccaaaaaaaaaaaaatgaaatggacaaatcggatttcatataaaaaaagtgttttgaaacacgattttacttttcagttttctatatttttttattttaaaaaaattctgtggcagatgataagctgccacaaattgtttcgaagcagccacaaattgttttcttttcgtatgtatacttattttattctatagaagaagaaattaagaagataaataaaataagtttagagaaactatctattttcttatcatataaatactcatgagaaaaatatcaaagttgaacttaattatatgtatatcgtctgtctccaaaatcact

SEQ ID NO: 1324 - DNA, 1100 bp, Glycine max
  Soy_ogl_2187 Gm07:4505201..42300 Cluster 5
aacacggtgctaattgtgtaaaacttggttatctaattaactagcgtgattctttattgcttcccttcattcacacaaactttgtctctaacacgagtgcttacttagttgtttaacaatttttatcattagagtactaacttaggtggattaaaattataaaaataaacttatatgaaccaaaaatgaaaaaaacactaacttagaaagactaaaattaacacaaataaacttacattgaccaaaataaaaataaaaattctaatttataaaaataaaaagtatatttaaacaaattttaaatttacgcaatattataaaactcacgaattttagataaacaattaatttaaacaatcatacattatacattatgaaatgaattttcttgattctaacaggctttcatcactaggaaaggcacatttgattagcattctatatcctttcttcgtcaatgtttataggtctattattttataagatcgtggagtctgttattttggaaagttcaattaaaagaaaaaatattttaattaaacaataattagattgaaatatataataaagttgctactaaatatcaaaataaagacatgtcagcataactaaatagctatcgatttaaaatccaagtgtaccaaaattccaaaatttatggggtacaaaaaaatttctcttattttgtttacaatttaatattataaatataaaaattaacgataatcatcgtaaaagtgagtctaatgaataattagaaaagtaataagtttcatatttaattttttagttattcatatgacttactttttatacaatttttattttgtttatattttttttatctgaacattaatatgtttacataatttttatataagtgaatttaagagaataaattttacatcttatatcaataaacaaaattcacaatcatacctaaaagtgaaagaagataaattttaaggactaagatgtcatacattattattaaaataattatcatgtagtttgtattttattgaaaaggaaaatttaattaaaaaatatgtcaaaagtcgttattatttatttttatgaatattatttattgttaagaa

SEQ ID NO: 1325 - DNA, 1418 bp, Glycine max
  Soy_ogl_2405 Gm07:37990283..37991700 Cluster 5
aagtcgcttgattgacatgatgtatactttttgtaaattaaatgtaatatttttttggaagggacatgtaatatgttaatataaaatataataattattattatttgtaatgatattctgagctaatttttaaaatatcattataattaaatttactgatactgaattatatatgcacacaaacatattccacatatgtttattatctttatttttatatacattaaagttaacatgttaattcttattaatcatgaatacttgtcaaattttatatttttattattaaaacaattataaacctaaaaaaaatttaaaatttaaaaacaaacaacttgattcacataagccacaaactaaaaatatttgactgcaattcaactagactccacagaaggtaaatgagcgcgatgcacacactattaataatatataaaactcactcgtcgtttcaagtttgtatttcttctcttaaatttttacggacaacaataagaataagagtttacagcagcaaaatagaaaagaaaaaccctaatttacatcaaaactactcaagttcaaatagaagagaaaaaccctttagcattcactcattgttattcagtccactaatttatggggaacaatacgttatatttatgggaaaaatatgactcacgaatgtcatttaataaattccactaatttagcttgaaatgtaaatcacacgtaatgttaattacaaattacaaatattttacatgagttgtaatatgttagagtagtgaagttataggaataggaatgagaacacgagatatcatataaataaagacatcatataaataaaggtaaaatttataaatctgaagtttaatattttaaattaagtggggatgtgagattcacttatgattataaaattatttatcttctttgttatccgaccattgatatcacaattgtgattattggatactcctctttatcccctcgttctccaacatattcaactattttaattttttttttatagaatctttcaactaatcctacttcggttttcacgttgactgattcagaaacattaacaataatagtaaaataaaagggactaaataaacaataataaaatgtttttgaatttcttattgacataaaataaaaatgcaaaaatgtttctgttttgggcggaaaaacattttctatttgagattccaacactctaattttgtgttatatcaaacactattactttttgtttttatatttataaaataaatataaagatataatttcaataataaaaatattctattatatattttttagtatcttttgcaaaatacagtattgattaaaaaaatatacttaataataaatataagattgggaaactttgatgacaaaattaattaaaaataagtgacgcaaca

SEQ ID NO: 1326 - DNA, 1000 bp, Glycine max
  Soy_ogl_3122 Gm09:36240601..36241600 Cluster 5
gttttaaaattaaaaattacttaaaattttaactgttaagtacttaataaaaaaattattgaataaattatcgaatttattttttattatttaaaaagaatataatatgtaacagtcaagtgttaataagtcaaaattttaacgtaaaaagttttaaaattaaaaattacttaaacttataactgttaaggatttaatacagttttttctcaaaaaaaaattatataaattctcaaatttatttttatgtaaaacagaatataatatgtaacagtctgcaagtgttaataagtcaaatttttcaacgttaaaaagttttaaaactaaaattatttaaatttgaaactgttaagtactcaaaataaacagtttttttctcaaaacaaaaagtattgaataaattatcaaatttatttttatttagaaccagaatataatatgtaacagtcaagtgttaaatgaatttcaagtagctacataaattttaactttcaaatttcttttaataatcaatttccgaagttaagtttcaaatttaaaaattacttcaatatgtaacaattaaatgttaaataaattttcaagattattttttcaaagccagaactcaatatgtaatattcaagtgttaaataatttttcaaaaattattttattgaaaccatcaatgaacttaattatcaaaactaaaagcataaagtagctatatgggttcaagaatttaaaaatgattccatttatacacttaaattaaacaaataattaaaatgatattataatcctttttgataaataaatttaaaaattaacaaaataatcataatataattatggtttgaatagtaatagttataatattaatactgataaatttaaataacatttaaatttgaagtagctgtataaactataaagttaaattttcaaagttaaaaatcactaaaatttgtaatatttgaatattaaataaaatttcaaagttattttagtaaaaccttca

SEQ ID NO: 1327 - DNA, 1110 bp, Glycine max
  Soy_ogl_4861 Gm15:1988001..1989110 Cluster 5
agtttttaatttaattgaaggtcaagagaaagaaaagtagtaaaccttcatttttggtagataaaaaagggaagaaaaaaaatgatatttgtgaatataactactatcttttaatttatttatagggtaggtggataaaaataatgaaagaaagaaaatgaagagtatttttagatattttaatataaacatatttcttaagagtataatttcttatgagaatatgtttttttaacaagataattattttattgtaattcgttctttattatgcttaatataaaggtaacaaatttataatataaattcattttcatttaataaatatattttgaaataaaaaataatatactaaattaatatctacaattacaagcatcaatcaatttaaactgtaaatattatatagagaagcaaatttagtatgtgagttaaattgagcttaaatatcttaaagtaaagtacggtcttaaatttaaatattatgaataaaatatattattaaaaggagaacctttactgattaaggtaatgaccaaattcttttatcaaaatgattagttgttaataaaacttgtaaatattacattaataacacgataaacaaattatccattatattttctatttgagcttttgaatttatgaactattgaatttaaagtatttcatttatagtaattaattgaattcaaatataaacaaatataaaatagatatgcatgtataaaaaaatagtccttaaatttcccaagtatcatatctagtccttaaatctagcaccatcaatctagttggtccctattccataacattacaaaattaattatttaaccaaaacttctgactattattatcgatttgatccctaaaattgacaatcataactcaatttaattggtccttcgtatagaaactaagttaattaattgatgtgcagtaaaattatgaattaaatttattgatgcacgcgccaaagtcaaggcctaaaataattgataggtgacaaaattagagatcaaattgtctaatttcaacgtttaagactaaataattgatagttactaatttcaaaattgattttttattataatttcagaaaccaaaata

SEQ ID NO: 1328 - DNA, 1238 bp, Glycine max
  Soy_ogl_4909 Gm15:8290563..8291800 Cluster 5
taacaattaatatatgggtaaaaaaataaatatatacaaaattcttttatttgaccatcacacttgctatttttatgcaatcacactttgcatccagaccttttttaattttgatctaaaaataagagtttaatacttatacatttgattacaatgttatttaattataaatcatcatttgaattattttaatataattattttaaaaataaacatacattatcaattataattaaatgattatataaaaaattttacactatcattaaataacattttttctctaaaaaaattcagatctttaaaaatgtgatgaattattctcttaattaatcatgacatttttttggtgacccttaattaatcatgactattatcatttaattcatgcttagaacatttattatgtgtgattatttaaataaattatttatgttaaatttgtgaatcatataatgtcatataaatttaaaaactttacaaaaaaaatatttaaaaattaaagttagagtaaattcttaacttaaagtcacattaaattttataattaaaaaataattatttaattaataagaatgaattaagaaacaatcacttaagcaacacgttgtcaagtatttttcatgataagaacttgttaagtaatatttcttaattttaaacaactcataaaacatccacatccaccttaaagatactctcatatttcatactttggtgatttaaatttgatgtgaaataatttactactacgtgttaggaccatcacataaaagcgttagtatggaagaaaaaaaaaagaaaaaatatttaaattaaagtagagaaaaataagtgtgaggtccacactatttttttaaaattttgtccttaaatagtaacctcttccccacaatcaaaccaacactacttaaaggacacgttgattctattcacatatcgttttcttctacctttacaattggcaagttatttttttctttcactcttattttttacttttgttttaaatataattttagtctaagaaaatttttaattgtttagtaaaattatatggttttagtctttagaaagtaaaccaaatgaaagaactaaaattaaatatttttttaagaaaaaataaataaataatttttgtatggaaatcaaaataaaatattgtgattgttttagagattagattgttatcgaattgttttctttctattttacttttctctattttttttttcttc

SEQ ID NO: 1329 - DNA, 1100 bp, Glycine max
  Soy_ogl_4948 Gm15:9332301..9333400 Cluster 5
tacgtcgccttctccttgatattatgcctaacccgctcaaccatgtttacttattattgtttgactaattattttaattaagtatctacttattaatataatttttttaatataaaaatatatcatttagtgtaattaatacatttctagtgtaatttttaataaaattttctatttattgattctgtgattattaatttgtaaacaaaaaaattatcatatatatactttttattttttttaaaaaaatatggaaaaaatatttctatttctttatctatttaaaaatccaagataacatgaattatttatttttgatatctctacttaattttatattttatacacttattataaatgagataaataattataaaagtcctattagaaatttaaaaataattttgaatgcaaaaatattaactatatctttatatacatatattacaaaatgcataagtaataaatgaggcaagagtttgttcttaaacttaattacaacaattgttaaaataattttcaaaattttaaatatacatttggttcttataatttgcttgattttttttttattttggttgtccttttgtaaatattttaaaaaaaaacatccgtgaaatatttttttttatcacttttagtccttgttattagaagttgatgagaataacaattgttaactttagcaattactatgccaacaaatgatgacattagcaagtattatgtcaactaaaatgttatgtaaagccacgttagcaaaacaaccatattccattaaaaaggtaaaagcaaaaaataataatttataaatactaaaaacaaaaagaatataatatttacaggaactaaaaaaaaaaaaaacacatatacgggtgaacgtaaaagatattttatttttaaattaaacattactacgtacggtaaatggcctgaaaaatcccaacgagtaactaacaatcctcttatacaaaaaaaaaaaaaaaaaaagttattatcatgcacaaaaaaaaaattcaagttttgttaggcctaagcgatacatggttcgtaattacaaagcttaaatcataaggttgaaaagaatggccgtggcagta

SEQ ID NO: 1330 - DNA, 1035 bp, Glycine max
  Soy_ogl_4955 Gm15:9521501..9522535 Cluster 5
agactgatccaatctttgtacaacttgttaaaaggatagaataatttgcatgagcataggataaataatcttaatgctacgttggacatgctttatcagaagatgaggaaatgacaccaaacaataaaaagaaaagaaaaaaattaaaagaggagacacaattttttttatattttatttctaataacggaactgaaccagtatttgtttttcttaatttcatccctgctatgtgattccttattgcttaatttcaagatattctttcaatagacataaaacgttgtctcaaacagataaatctattagagtattattagataaacttctctataaattatagaagaaaataaaaaatattaaatgatttttttttactaaaattagcttacttaaaatcattttttggagaagttcatataatagaatttttaccaattaatttatgtataaattaattttagttgataaaaaagcttattttaacttttgtttttatttgctcatttcaatgattagagaaatatgagtgttgctaagagaaatgaggaagtaacgtttttgagaaagtgtatgtatttgtgtttcctgtttttatttattccttcaataaaactaaatgaaagtaataaaagaagctaacaattgattattttaaacgcttaaatataaattttttgtttttatgttgttagatttatacttctaatttctccattttaaaatagaaatatttaattttcctatttttaaaaattatgattttatttaagttttcaatcttttctatattttatttcttttattttgatccaattaaattctagatctatcatatttatttaagatatcatcaaaacgtgatttaattaattataatgtaagaaataaatgaaatgaaattaaaaatgataccaaaattattatttttttaaaatgagaattaaaattgtaaattttctaaaataaaaaatcaaatgtctttattttaaaatatgatgactaaaattatagattttttaaaacaaaataatc

SEQ ID NO: 1331 - DNA, 1028 bp, Glycine max
  Soy_ogl_6204 Gm18:56489848..56490875 Cluster 5
aattgagtgattagtctacaagaaaaaaaatgatttgacaatacaaaatattaaagtttatattgaccgagtaacttcgataacttgtggtttatatatcattcaaaaagacctgtacactttaataatttatgcactaatggtgtgtaaatttttttatattattgctattatgtaatcataaatggtcacatataatatatttattaagttttatagtaattttcttaaaagtgatactttatttataattggttgatctagtaaagtttttaacaccaactataaaagtaaattcttagaaatatagaataatgtattatatgtcagcaatataatttttttgaatattttatttatcatgataatataatttaaattaaattattatagatttttattccattcaatatcccttgattgtaattaaaataaaaaacaaatgatgaatgatactatggtgaagacttttttttttcttaagttactacgctgaagagacgtcaaacattgaattgttgaatataatcatttattgtaactaaatatattgtttatgaaagatattgtataatacattttgtctatttttagtaacttataagtctagtgatacaaaatatttttgaaaaataattttgtttattctgttcatataatcatgaggggaacattttgagtataaattttattttattattttctatataaaaaaacatcaaagaaaaaaagtgaaaaaacataataggtttaattatgttttttctccttacttatgctgattatatgagtgtgaaatcacataattataaaactagactcatatgtgataaaaatgaaatatatagtttataagaaaaatacttaatgagttaccttaataaaacataatatttaatatattttattttataatgataaactcatgcaacatacatctaataattgtgaagattcacactagtgcatcttacttttttttttttcgttttacatttatattttgtcactttatacacaaccatgaa

SEQ ID NO: 1332 - DNA, 1100 bp, Glycine max
  Soy_ogl_6792 Gm20:36621601..36622700 Cluster 5
ttactttttataatcaatgattattcctacaaaaattaaactaataagagacttgttagtgcatttttttttctccctcacatactttatgaaaaacttcataaaaaatcactaatttcatatttattgaaacatgtataattatagagttcttacgtaataaattatatataaatatatatagactctgtgatttaattgttacaaattaaatatttaaacaaatacaataacaaattttattgagcatgtaaaaaaggctaatgaggtagaatatattttatattatttctacacttcaattatttgtagaatcaaaagtgtaaacatgtttatggtaaattaaagtagtgtaaacttagtggtttttctatattttttatcataaaaactgctttaagtttgaaaaaatacttctgtgcaataaggtcgtgtattcataagtttgcttaagctcctgagaaaatttatttacttcttattttctttttctgcatgtatttatttaatttgatttatctaaacaaggcctactattcaactttttaaacgtaagtgctttactttaaaatctataacttttgtgatcactagttcttttttatatcaatattttttttttaatttttctctttaaatcaaccattaataacgtatacactaactaaaattcacgaaattattaaaatgagtgatccatctatgttgccgatgatgtgaaattattcctcctcattaattaaacttatcttatagtatttatttaaatatttaatttcttagcaattaaatccctttgttttttttttttactaacgacgctaaaatcacccttactaggtaaataatttcaaacaacactagtttcatatattgttttatgagataacctaatttggtaaaaaaaaaagtctaaatatacgagtatttaagaattttaaatggaaaattttaaattataataaaaaagtgaataaaataaatttgaatactatatattatatttaataattttaaaattttgttaagattttttagtgggttctttatagtcatttttatttgtgtttttatctttttagtagcttataggagtagat

SEQ ID NO: 1333 - DNA, 1100 bp, Glycine max
  Soy_ogl_6981 Gm20:44205201..44206300 Cluster 5
ttaaattatttaagtttttataaattataattgttcttcacgtaatttcatattttggaaatattttataattttttcattgtaaatattataaaaataaagagaataaagtagtgaaattcgtgtcaatttatcatttttttcccttatatcatttaaaaatgattatcttatatgagtaatatttattttttgggagataatttttttattacacatatataaattaaaaaaaagttgtggagataaaaatgtaattaaatttaaacaaaatttaatttatatgcacttttaattgttttatatatacatagttttaatatggattcacttcattatatagagagggaaagcatatactgttgtcccgttcatagttgtcattggacaaaattatcttttataaaaaaaaaaacatgtgacctcattccaaagtaaaaggcattcactgtatttatatttgtcttattcattagggcaaattcttatcaaacgtttgtgaaaaatgttttacactaacggtaaatgtaaattgaactcaattaaattagacagaaaaaaatatttaacccccctaatttttactttttttttcaaacagattccgtaaattttagttttatcttaattgatccttaaactttattcccatttgcaaataaaccccatattaaacattaattttgttctaattccttgattttaccatttttacaaaatagacacatttaactttaattgcattctaattaaatcttaaaatttatctttttttataaacaattctttctatatagttagagttaaataagacctctcatattcagaaaaaaaaaaccctctcatttgaacaccacttgaaagtttaactctttttttttttttacaaattcacattataatcttgaataacgattttttttttgttgttaaaattttaacaactttttgactatgctagctgccttggaattaacgaagtacgaagtccacgtacatgcaggaatctccatctaaagaaaaggacgtataattagtcctaatctataagatagctataattgtccagtgtgaaataatatacttataagcttgtattt

SEQ ID NO: 1334 - DNA, 1156 bp, Glycine max
  Soy_ogl_1517 Gm05:1509801..1510956 Cluster 5
tactgtcgctctcacactccttctagggtgtcatgagattttgttagttactaaaatattagtcccatttgtagtcacttattttatttggaatgaaattatataagttttccttttgtaaagtgttatgtcaaatgtgtaatttgcatactttaatgcctaatcaatgggaattgatcttatatatcctattacttcctaattttttttatttaagttataactcataagttaagaaaagtaaccaatcccccatttcatgtatacaatatcatttttctctcttatttattacttccacatttcatgacatgaattgtatataattttattttctgtgaaaatatatacatcttttatctctcttatttattacttccacatttcatgcattcactatcatttttctcttttacgataagagcttaatcaagacaataataattcatgtcacttagaattttaaaataacaaatttttttttcccgaaaatatggagtatctatacaaaaaataactcgatatctgcatttttttaagaataattaagggttcaacggccagtccttacccggtttcgtaccccttgaatccattcctaattattaataattagtgaattatctgctaagaaattttggataaaattatatttcataaaacataaatctgattatttttttcattttgggataagaagattaacattgtgcgttatggtagaagacgaaagtaacttagaactgaagtaaatattattattttattgttttaatagtaattccatcgtgaaacaaaattttcattattactcataatgatagcaactaatattccattattaagttcgatcattcacactcactcatggcccccttccttcacactttcgggatagcaagtttagagttcaactgttattagggataatcactttttttaaggtatatcactttttgtttctataaagttatttaaaatatttttaaaagttgtagattattttttattctcttgtcttttcagtttactgatattaatccctcaaatattattactttgaataattttatattagatgatttattttaactattatactaattaatattatataagtataaagttcttttttactttattttaaatttgatta

SEQ ID NO: 1335 - DNA, 1500 bp, Glycine max
  Soy_ogl_965 Gm03:39372401..39373900 Cluster 5
atatctatttaaacataaaaaaccaataataatttattacaaattgattatataaaattataaatatatctcaatttattataaattattagtaattaactacaagggataataaagttgaaaaatattttaagttttatttataaaatttttttacatcgtgtattatttcatataagaattaaaaagtctttatatatacatatcattttgttcttttatttctctactgaactaaactagcagagattcataaaaaaaaaattagcagagataaaaattaacttttatttatttttttcctttttctcaatattaataatctaaaaaactagttgctttattctcttacttctttttatgtcactgcttacgccttacttatttccgcatccaaacaaagcgtaactgctattgtgctgcatttcaatttgatttatacgcgttcgtgttacaaattacaatctttccactgttaggtctaggtgttgggttggtaggcgttaatcttgtgttatcttttcagtcttcaaaaaaggaaaaaaaaaatacttaatttaaaaatcgagtaaacttccacgtttgtcgatgaaacaatatttttttttggtgaattgatgaaacacaatatagtttttgagaatttaaagtttttttattatagagctgcaagtattagtagtatttaatttttatccagaattgcataatttattaggttataaacttggataaaacataacataatatttaggttttaatgttctacttcacatttaattttgtaattctagttaccatccttccctgctttctaccttattcctatctatctttttaaacaacaaatcccatctccgtaatattttgaatttgataaaagcaagggttcactaaataaatcaaaaggggtacttttcgagtcattttagatacaacattaaaatatttgattttatgaatttttaaacaatctttcgtttctttcttttatattttcgttaaacgatacctagctctttatttccattaaactataaaacaaattaatttcattctccgagaacaaatatggcccatgtcctttattttttattgtgccatataagtcatttaatgctttttttaacaacttatttatttatttaaattaaaacttgtttattgatttatagtataatcactattggaaaatagtaacgtggaaataatttacataaatgatatgacacttcagtttattagacacgttagcgacttaaattcatttaaatttccaatataaacaaattaagactaatattaataagtgtctttttgactaatgaattaaaagcaaaaaagttataaaaaaaattatcgttgatgtattattactgaaatttccaatacatcttaaacttgattttaatttaaacactagctaggacttgtgatttataaataaagaaataaaaagcttcttactattcatttattagctaacgtcttcgacaagtt

SEQ ID NO: 1336 - DNA, 1029 bp, Glycine max
  Soy_ogl_978 Gm03:39707201..39708229 Cluster 5
ctccattttttaattactctaaattaatttgtttttttcttaagtttttactaggtacttgttaaaaaatttagcgagtcgacaaaattactaagtaataaaatacaaaataaagtgtcaattgaatactactacttaatccctaatttagatttaagaaattaaaataaaataaaaccccataatttataggaattcaacgttatttaaaccttgttaaaaaaaaggtatttaaacccatataaaatagagagaattaatatgaataaaaaccatttcacttatggtctctaactcatgaccggaaaaaaccctaatttcttgttgtagacatctaacttttgttttcgtggctatggcacattattgttaaaggttatttttcaaatttgttgctcaagaaaggatcgttggatgaatatttaaataagttatatgataatgagttcaagtatcaccatatttttttttctagaaattaaagaaagatattaataaatttataatagctcatgtatttttattcaactaacagaattaaattcccttcaagtgagcatttagaaagtcataagataaacatagattaaaattaatatatacatatatataatataatcaaatatagattcaaggaatatttttataaaatgtacgtatatataataccctattcatacttatattatcaatgccattccaatttataaggtatttaaattttaattattgagtaatataattttatgagtaaattacaatttcatctttagtgttttatgcgaattacgtctgatacctttcattatttgattttattgttgcacgcgttgtcgtaacgtcattaacgatcataccgtcaataaagataccgctcacatttcatagaaaacaaaaatgatatgagtgtaatttaaccaataaatcatataatatatttatataaatattatataaataaaattaattaaatactaccttaatacttgtcttatcaccattatactaccggcccttatattaacatac

SEQ ID NO: 1337 - DNA, 1415 bp, Glycine max
  Soy_ogl_1209 Gm04:4034501..4035915 Cluster 5
catacttatgttaaggttatgttagttcaatttagtttatgatcaccctttacggaggaagttgtttttctcccatgtaaggatgtattaatctttcaactatttattgagatttttagtattaaaaaaatatattacgggcatgtttggatatcacaaaaaaatgcacatattattagatctcctcgtctaatttaccatttgtttagatataatgaaaattttcattgtttcgatgggttgataaaagaggaatatggaatttgtaatagtgaaatatatcaaaatcatttcctttctcaataggcaataaatatggtgtaaatggttgtggtgtttttttttcttatttattgagatttttagtaataaaaaactatatcaagtgtgtgtctgaatattgttaaaaagcatgcatattatcatgttttcacggctaatttatacaaattaatgttggacccgtgcacatgcacggttaaaaaaatcaaaaagaaagaaaatgactgactgagatagagagtaaatgtaaaaaaaaaatgaaaaaatattataaattttatgtccaaccaacacgtagcagttaattggacagattctgcaaaagttaatattattgattttaagttgacacgtgtcaatcttatattatgcataatgaaatagacacgataagtgtcaattagttaaataatacttcattcgtcttgtaacaatcattgtgtaacaaaaaaaagagtatcccaatattacttatcatatatgttctttttattttctattctttttatctttatctttcttcgcttcataaaccccaaaatggagtgaacttccaactcttttcaatgctacctcctaaattttttagaataacttgacttatcttgtattttgtttattttacttttcactcgatgattttttgttttgcatgataaaaacacatagtttaaggtacaaaaaattcaaagacaattttttacttgtcaaatttcattttgacaatcaatatatattttgataaaactaacttataagttagttaatataattaaaaatatttcacaaatttagctgataaattagttgataaatgttaataacttaaaaatatatatttaattatatatgtatgtatatatgtgttttaacattttaatttgtttctaataacgtgtcatcacaaaaactagggcaatattgtttttttttctaatttgtattataaaaaatggtaaaaaaaattatgattgcacttatattgtttaaaatcaaatttttaataaacttgtattgtttacaatcaaatttctctttcttttctttaaaaaggtacaatttaattataaaaaaaacttacattttttaaaataacttttagggtttcaatatctttaaaaaataatagtatt

SEQ ID NO: 1338 - DNA, 1505 bp, Glycine max
  Soy_ogl_1241 Gm04:52796..5610300 Cluster 5
aaaagttttattggtttatttgggccatttattgggccttcgtaatgcaatgtaggcttggacagttagaggcggggaacgttttacgattcggctgtaatatgggcatgtgtcttatactcttttctaaaatcagtaaatttatagcttataaaaaaatgtttgtatcatattattactttttaaagtagaagaaaataaattattactagttttcacatagttcattaacgacaataaaaatctaatagttaaatgcttaatcttacctacaaaagaaaaggtcaaatgatataatttaattttaacacattttttaactatttcttgcgagaaacaacttattttttttaccattaattaattaaagaagagaacgagtaagactttaatatttttttgccacattcttttagtactatattaattaaataaaaatgatagcaacacattctttaacaaaatttttctcacatacttttttactatagtcaaaatttgttagatattataaaattgtgggtgacttattaaatttgaagtgaaattcacaatttttttttatttctaacaatcatgaatagtgtgttaaaaaatgtactttttttttactgcaaaaaagaattgtactatagaatatgttattaacattattttagttaaaatttattggattgagtttattaaataaaaaatgagacccaaatttttccacgacttttagtaaattttaagtaacaataaaatatatttttttaaaaaaatatatatttaatgatatattttttatttgaatatttgagagtatattactaacattaaaaaaagagcaagtacctaacttctcagcccaccaagaggcagctgcactaaacaaaaaacaaaaacaaaagcaaacaaacaaaacgaatttatatattgttatagttaatgtaagagtatggctccttgtttagatcttcttgggcaggatttagccaaagttgtgtagtttgtttttttattttcctttctcaccagaaaagtagaggagaagggatacagcacacaaaacatattcaaaataataatttatatttattaattatttgagagaaattaaaaaaaataaacgtatttattttaaaattaatcaatcgtgcttaaatactaatagcagaagcattataagaaataagaaataatctataaaaaaagcgtaataagaaataataaaaccactctgaacacataagagccttttttttatagcaatagtaacaataagaatttaaataaacataatattggagaaaaatagattaatataacatgatgtataaagacaaaataaaaacataaaaaaaactactttttaaaaaatacaaccgttgttataaaaaaagaataggaattacagagtggatcctacgatttaatttaataggcccaggatgaaacaattatacatgcacctttttttaataaatgtatgaatccttttatatttaaatatttaaaaatat

SEQ ID NO: 1339 - DNA, 1100 bp, Glycine max
  Soy_ogl_2143 Gm07:3019401..3020500 Cluster 5
agaaacgtgcagatttaaaatgagagaataatacttttaaataatcaaattagcaatttattcaataaattatacaaaaaaatacgggaataaattatacacaattagatagtgaaagaaatgagaaaaaaatagttggcaaataactttctcctgactatctagggtttaatttacttcacgagagatctatactaataaaaaaattaatcccttgattaaatttcaatatccaaaacaattagttattaactcataattaaaagataattagattcataaccttgtttgtttgaaacgaggaagagagaaaaaagaatgagagaaatatttaaattttgaattaaaaacagattattatttctagaattttattttatttttacttcatccaactaaaaaatagatatatcattatctatattttctttttcttttctctatttttttcctcctcatcaagcatgctatatctatttttaatagtcaggaggcatttcaagtgaattgatgacctgatgttattaattattgataattttttagatttatattagacaagaaatgccgaggcatgcattttcataattggtgatgattaaataaaataaaataaaaatatttatttattataaatttaatttttttttcaatttattataaatgtaattatatgaagtaaatatttattatgtatattatacaaactaaaatactagtagaatatataaaataaatcactgcagaagaagtgacagaaaacgcgtaggtcggagacgacttgaccaaaaatgcaaccaatatatctttgaatagtcaattattttttctatttgttttaaaatcactagttgcagtaaaaaaaaaaaaaaaacccttgttataaccatgcaatgcatgggttatccttttttatataaaaagataatattagttaattctttaaattatattttacaaagaataattaataaagattaaggaaaatcttaatgaaaaaaaaccaagagaggaagaacctaattgggttatgaggtacaacaactagagcaagagttaagaaaacgaaggagatcttgcttaaaaaaaattaacaatta

SEQ ID NO: 1340 - DNA, 1217 bp, Glycine max
  Soy_ogl_2292 Gm07:8461084..8462300 Cluster 5
atgtaactcaataaagcctttacgagaagaaggatgaatttaaagttttaatcctacttatataaattttggacattgaacttgtctccctttttaacggggatggtgaacaatacagtttaaaaaaaatttacacttcatcccatttttatgctcaattataatatttttttttacaagattatcatatcttacacttatcactggttaaatagttacatatttatttattatcaacttgcagtataatttttactatttaattaaaaaaacacttaaataatatggatggatttacttaaatattttatatcccacgtctttatacaaaatttactaaagacgtacgtcaagtaaacaaattaatttaaatcctcattttcataaataatttttgcctaacactctaataatttatacttttaattattcccattatcctcgttactttcataaccttttcatttcaagatatcactttaaaacataactggttttgctccttcggactctccaatattggtctatgcaaaccttacaaccaatgtttcccactttcccgtcacaaatcagaatgcaaagcacccacttttttcctcttttgagcttttcttagtagccacccataagtagctccatcagataaattgagttatatatttaacattatttcattcagttttattttaaattataaattattgtttatttttaaaaatattaaaaattatcaatttattagataatattagtagatcttactataaatactcaaaattaaaatgcacaagttaggtgagattttaaaatttacatgaactttttaagtgtttatatatcacattaaattttatcatttatatattattgtataattaagatttacttttttttttacttttatacaaaaatgtcacttttattagatatactacctattaaagagaatatttagtgaaagtgtcatttttttaacgtgaaagtgagaaaaagcaaataataaatattacaacatataactatctaattataatttttcttttgaaatcaaagagtgttagtaacatattatttaatatatatttttcagcacacattctattattagttgattttttaaaaactataaaatcaaatcatgagagatagttatttaagatgtgagactattttttttcttttagtaattttcaatcgctaacatttttctttaaaat

SEQ ID NO: 1341 - DNA, 1270 bp, Glycine max
  Soy_ogl_2293 Gm07:8525431..8526700 Cluster 5
aaaaaattatgagttttaattttttatttgttcaatgttcagtttttatcagtgcaaacacattataccgcgcgcgattgacacaaactaacgcagacggtttcaacaaatttaaatttggaggatctggataaaaagtaactcaaatttaagaaatctaaaacatatttagagatttattaatttttaagtgtgagaaaataacagtaaaattaggagctttaaaaaaaattaaaaatatttttttattcataaaaccatatttaaagctaattgtttaataagttgtttattttaaaatatttttacttaatcttttttaccattgaagggggtatatttgtcatattgaattgcttaaaattaaattttggttgcttagaagtaaaaaaataattttttttatcaagaatcatttaaagaaataatttaaaagtggtttaaaactatatcattaaagcaaaatatatgagctagttaactgtaatgtgatattgtatgaagcaatatatgataaagtactcagaataaattggttaaattgtaccgttggagatattctaggaacacgagttacccctttattagaatacttaataataaaagttgtataaatattaatactaaataattttttcttctagagagtcactgccttatgtttacttcatccctggatgcataaatattttttgaggataaccattgtaaaatttcaatgcggacaagaattactcgataatataaattgtaataatttaagtgttcatgattacatattacataaatcattatttaagaaatagtatctgttcatattacatattacatattacatttttcttcctcaataattgttaatactttcataaatgtataaaataaaatagttaagtagttagagggttcttttgaggctattacaaatccgtatctgttcatatttaagaaaagtgaaagatgtcaaaaactcaaaagcaataaagaaaaattaatgatcgaagaggagaacaagtttaaaaatatggtgtcagatttttcaattaagtagtatcgggttagttttaaatgctgtcttctatttttaaaaaaaatccttattttttatacaacattatctatttgtctcaatgttattaatatcttggatgaaatatgtttgagtgcggttaaaatttaaaaaatatcaattccgttttgataaaaaaaattcacattaatttagtttctacaaaaataaaacatatttttgttaattttaagtgataat

SEQ ID NO: 1342 - DNA, 1188 bp, Glycine max
  Soy_ogl_3202 Gm09:39765101..39766288 Cluster 5
atagtttaacaatttttaatgaaaatttaaagatgtttattttttacgtatttgagacaggtagacttttaatcaaaacattatttcgtcatcgataagcatatgtcctttttattttttgacccaaaaaatgccctttttatatacattaaacaaacaaccgtctcaaaggtatgttaattgatcaatggacaactatagatgtctctcaataataaatagtagtatatttccaacaaatagatttgttatctatgtaaaaaataaatatattaaaaattggaaggcatgcttaattttgaataactaaaaagacaatgtgtctagggtaaaatacttaagattgcaatttttcttttgtttgtgtttacctttctttatcctactcctcccaaaaaaattatgacgaaaagattaccataaaaattgaaagtcacactattaatcaactagggtaataaatgaacttaaattttatccgactaaaatttcactacaaatacgtacttgcatatttaattttatacaaaaaaataattataaaatgagaaacattataacaacacatccttgtcaacatatacttttatttgaaatttattaagacttacaaaattttatgactctcactttttatttaacaagccttatgcatattgctaacacgtataagaataatataatatttcagtttttgtaatatacttacagtttgattttaatccctttaaaattattattttttaaatagtaaatgttatatcgatcttggagttaatccttgtcgttacttaatcaccattaattgctaaagtgtctaaagagtgagggactaatataaaaaataaaaaaaaaataccagagtatatgttagggggagctaaaatgtaaacaataaatatttataagaactagcctaaaattaatttgcatatattaaaaaaaccaaaaaaaataattattgcaaagactaatttttaaaagaattaaaataaaaattgaatatattaaaaaactaaaaacacatttaaacttatactgaccggcagtgaataatttctgaaaaatataaaatactcccgcctttataatttatacttgatgatactctgtctatacttatttataatacataattttgaaaataattttcctttttttataaattgtcatttcagttatcttgtg

SEQ ID NO: 1343 - DNA, 1173 bp, Glycine max
  Soy_ogl_3244 Gm09:40630323..40631495 Cluster 5
aaaaatcatttataattagtgaaaattaaatcaaaattcacatatttaccatagaaacaaacataaaattcaataatttacctagattagaaaaataattataaaaaataaaattattattttattaaaaaatgaacacaaaataaaaaattattaaagaagaaagataaaaattgatttttttatcaaagataaaaatatatatttaaacattaataatttgatatttgatgcctgcgctactatagtaattgatattaaataaggatatatttaaaatattaattaaattagatattataaaacaccaataatttgaaaaaatattataataatagtaattattaagaatttcccccctttaattataaggggtaatttcaatttcgatatgtattcttgaacgacacacatttaagattcttttcagcaagttccgtgttaggtgagttacattataatctgtacggcttattaaatgaatgtaggatagcatttaaaaagtttgaatcgttactcgttttatatggttaaagtaattgctcaccaccaacctttcagctatgaaataacttcaaagagacagctattttaaatattactcagaatggactctaaggccgtgttcagttcagtttaaatattttaaattgagtactatttggctaaataatttaattaaggatttattaaataaattttgtttagattaaaaacaatcatgaatacattttttttgtttgtttatgaacactttctatcaaacaaaaatcatgacttattttgttgctttcggagaaattagacaagagagttagcctttataaaaattaagagcacaaattaattttaatttacgaaagaagctcaatatatttcacttttttattttataaaataagttcttaaggccgcgtttattttgtaaaatacgttcaaaataagctacaaataaattcttcagaatggttcagttctgtctgcatgacgaattaactaacggaagatagaaatagaacgtttgagcttagttgcactgcaacgatgttgaagagaaacaacataaaatttgcagtaaaaaagacatacaatttgtgtggcccacaacttaaaatttatgtatttctagttacaatgaaaccaaaaaattggtctttctacctcaaaatatca

SEQ ID NO: 1344 - DNA, 1081 bp, Glycine max
  Soy_ogl_3823 Gm11:10340539..10341619 Cluster 5
ccaattaccgattagatcagccactagaacaacctgtgccactttttaagcacaaaggaaaattaatgacaatattaagattaagaaaaatatcttgcaaaccaacgtctgtacagcatctccaatattgatatttcgtaagttacttcaaattaaacaaccttgtttaataaatttttttattgagacagatgatttgataatgtttaagtgaattgtttatatgaataataataatttattcttatcgatttaaaatttattttttaattacaaaatttaatgtgactcaagttaagtatttattttaataactttaatattgaaataaatttttcagtaaaaattttaaatctatttaacatcgtaagattcacaaattttaaataaacacaactcatcaaaataataatagattataaatgctattaggatattagttaataaactaaaattaaaaaatattaattgtgaagacgagagcattaaaaaattatgaacaacataattttatatatctcaataaaatatatctttttaattttttaaccaatagaccaagaacacacgctttgtttgatttgtaaaaaaagaaaagtaaagaaacgaattgtagcaccatagtcaaaaagtgtatgacttagccttttgaaattccatatcctacgtattacttagccaatccgagattacagttttttaatattcatactactagtttattaaaattgaaatcaaattgcataaattatatttcacaaactaaaaatttagctagaagttaaaagattagtccataacgagaaactaaaagctgatatgtgagaagcttttaaactaacttatagtaaaactaaactattgaagtaattggaaactatataaaatgacataaatcacatatttaaaaaatgtcataagaaaattaaataaatattttaacaataaaaatataataaaatataaaaaaattataagttagaaactagcatttaaaaaaaattatttcaaataatgtttaaaaaatattaaaaactacttaaaaaatttatctaccaaatagtcaaacaattttttttaa

SEQ ID NO: 1345 - DNA, 1218 bp, Glycine max
  Soy_ogl_4509 Gm13:37243083..37244300 Cluster 5
ttcctttaatttaattgtttcacgtcaaaagtgcaactgggagataactgcccatttcaaatttcatataacatatttttagtacttgtaacacaattttattctttacttcacaatacttttttatagtacttattttattctaaaaaagttcaccttttatagtgctgctgtaaacataaatttaaatttttcacgagtatttttttaggatttaattttgttaagacaagtacacggtattaaataccagtctttttttaaccagatctattaaactctttttttattttatgatgaaataatttattctgtagaccttttaaaaattgatgttaattatttgataaaattttattttaatatcattaaaaaatagatttaaattatttattacaattacattttgtcaacattaactcaaagaaatgatgttaaggactaaaaaatgataatttttttatttgatatcagaaaataaactaaatttgtgtttttaataaaatgaacgttatcttaataaaatattttttattttttaaatttgaaattaacacttaatgttaacaaaattgtttaaattaatataaagttccattaaataataaaaatattgaaattattgcataaaaaaaatactaaatcaatcaacaattttttcacctatcctttatcaatctgttaccataaataaacgcaactaatgaatctcaaccatccaaaaaaaaatttgccccttgcctgataaaaataaaggtaaatgacgcgtccatttctaagagaaatggaaaggatccacacttataatcatcatctttttaaaggacgtaatcaagtgttcactatatgtgtgtacgtactttttccttctttgttttttttttttacagcatgtatatatgctggtaattgagaagacctgacgtaagtagggttttattcagaattgattgatctttgatgtattgatttcattttttatattagtctacccccccttcctctaaataacttaactatggccacatatgatgatatacatgtcgaacgtatgaatttgactcaatgttgcattattgcgtacacatgtaagcgaaaggcatgatgaggttgtctcaaaaatgattctcttgtgtaacttactatgtcattatctaaatatgggtgaaaggataattagtccatgtgagttgttgccgtggagctagcttatcctca

SEQ ID NO: 1346 - DNA, 1074 bp, Glycine max
  Soy_ogl_4938 Gm15:9147101..9148174 Cluster 5
ttgcgcaattcacgatgcttgaaaaagttaaggggcgttttgatgttataaaagagtaaatagttaatgtattactttttatatttttatccgaatcgaaattatggtaaatttattaatttgtatgtataatagttattttaaatgttatatttattatatgtgcttaaatatttttatactgatatatagagatcaatctattaaaaaaattctttttttctgaaattataattaaaaatttcaatatattaaataaaaaacttactttttgtgttttctatacaaataagaaataaaaaaatattttctcaaattaaataattctcaaataaattaagatgtgacatatccaattcaagtaatgtagtataaaatacatttgtgcatgtgaagtataattggttaaacttgaaatctcatcaatttctcttgcaccccaaagaaaaaaagagggagggggttattttcttttttggaaaaaaaaaacagtgaaatttcaaacactgaaaaacaggcttcaagaatagtattctctcttgaatgaaaattattaatatttaaggttaatgtatatagttttaaaaatatttgatattattcacaaactatatatttagtttaaaatatcttcatttatttaatatttatgatgagagtgattatgaaataaatcataatttttaaatagaaaatttatgtggagaaaaataattaatgagacttaaatactataaaacaccaatgtcttgtgtgtagatagtttctttttctgtttttgcttttactttgtgaatgataagtttctacactaattcccttttatgaataaaaaatattacactaagaccctcatataagaaaagtgaatatgattaaaaaaaactgaatatatttgtataattacacgaaatttcaaaagatgttgttgtaatttgttaaactataaaacatcaatagtttttggaaaaaaaacattaatagttttaattcggatggaatagaagctaaggtttagagggttcaggggtaagaataacccggaaaaaaaataatacttgtcttagtgacaaa

SEQ ID NO: 1347 - DNA, 1024 bp, Glycine max
  Soy_ogl_5801 Gm17:39747777..393800 Cluster 5
aattatcaacataaaattggatgttggccgtcgttaaatgttgaagtggttaaaagaaatatgtcttaacacattatctcatataattttatttttagttcctctaaatgtatcttatttacattttagttattgtaaatgtatctcatttttattccggtgcttgactctttagctttaactcttcccttccctttttcattttttgatacgttaaatcctatcaaaactttgggttgacaaccatcaatcaccaccatttatcccaacaccaagacttctccatcatacttcaaaagtttaattattaattttcatattattttaaaaaatttaatttaatctctagatttttaatagattcaatttgatcatcaattttttttaaaatgcaccaatctataacttctttaattctctctatgcacataggaagaaagaaaatcatttctaaatacaaaaaaaatctgatcattttttttaattcttatttcctttgttttgtatttatacaaatagattgttgtatttaccatttcatacattttagtgtcaaattccaaattttcagataaattaatgtctcgtgattctttttaatgaataattatattttatgattatttaagaaaagtcacataagaatcacatttatttatacttatatttttatatgaacagacaaataatttcatgaaaacataatcttttcttagttttacattttctaattaataaaaaagataatttttaaagagatataaaagattaactgaaacaaaaagataaaaaaagccaaaataataatataaaaaagatttaaacgaataaagtatatattgattttttactttggcaattcatgttcttagtattgactactgttttaataaatattgcttaaaaaagtatatattaattttatcctgataattaattttcaagctgttaattagaaaattagaataaaaagaaattacaggaaactggatctaatattccattcacggaatcacttttttaa

SEQ ID NO: 1348 - DNA, 1000 bp, Glycine max
  Soy_ogl_6953 Gm20:43464101..43465100 Cluster 5
actatgagtcaaatattttagcactttaaaatcatcaaaagttattttatataaaattaaattaaaaataaataaattttggccgttacaaatcatcacaaatcctagaaacatgtacttaataaagaagaattaaaaataactttttgaaaatttgagagatcaataaaaaaaattgaaggattaaaaaaatattttttgtttttttaattcatttcatagttttacctggagattgatttgatgtatttataaaaagaaaaatagtgcatttcgttaattgactatgtattatatattaatctatatccatcaaaacttagaatttaaagcacgcttacttggggcagcgaggaataacgtgacatgcgtttcagagttttactaattgcaggttgaatatataatttcatatccatatccatttcaatatttgctttcatcaaaagtgtatacatataagaaatcgtgcattaagtatgttttgtacaacaacaacaaaaatatactagtaagaaataagaattcgtgcagacgtgcattaatttattgtaagtttgtgtttgattttacgttaaaaaattaattaattaattttgagtttataattagttttagataattagataaaatttcatatatttaatttcatgttgataataacttataattgattatgaatttaaacaactttgagtaattaacttttgtacttagataaaaaaaaaatttacgttaattttatatatataaacctgatcgagtttgtaggttaaatgaatgattttaatgtattgattggataacatttttcacatcgattaattaaaaattattttattgtaaaacttaatattatcctatatatatatagtaatttataattaaataataatataaaattacacaacaataagtacattgacagggtaaaactgtaaatgaaacaatcaaattctaaatgaattaatctccactagttcacatttaatttaaatgt

SEQ ID NO: 1349 - DNA, 1000 bp, Glycine max
  Soy_ogl_970 Gm03:39566501..39567500 Cluster 5
gtttgagttttgattgacaaattagtaacgaattattctaaatttttaatcaatcttttttaggtatttttcatattaatctaatcgatcgaacttaaaagataaccacagaagaattttcatatgagacagacgggagaaattattggtgcgtttatagaaatatatatttttattttcaataataacaataataattataaaaatcactgaattatttttattttattttaaaatattatttgtatatgtgtgggtatttaaatatttaaattagcgttctaaaaaaatatttaaactagtgatatattttcaccatttaattttaatttatccattttattttttttctttaaataagagcaattcacttttcctatattcaccgaggtttttagaaagtataggctaacttttgtatacacgaaaggaaaaaataagcaaacaataaaggaaacaacaaatcaaagaaattcatctaaaaaaataccatttgattaatttgtgttagtttaaatagaatgcatacgtttttgctgtaattgtattttttttaagagaatgctgcttattttttattgtgttgtcaaccataaatgatatattttcctatcaatttgaataactttgttttttttgctttgtgacattgttttaaaaataagatataatatatttaaaaaaactgtttaaaattaacaagtgtttgaataattgcaaatgtaggtgttatatataaggagaatgaaatatatttaataggaaatgtcctcaatgttcaagactaaaagatatttctatcactagaataacatccaattaccttgcgtgtcttggctataaaaaatagctagaagggacattacagtaaatatggaaactaaaatcttgaaactgaacctagattctacaaaaactaaaaattactgtactttttaagatcaataaccatacataatttcccgtcccttaaataattaatatcagcaaggaaaaagac

SEQ ID NO: 1350 - DNA, 1549 bp, Glycine max
  Soy_ogl_2513 Gm08:5038452..5040000 Cluster 5
ttaagggtattgatcatggacatggacttaaaagtgatgactttttataataaaattcagattttttttatattctgaaaccggaaaaatatattaataatatgctttcatcataaatttttgatagtacattattaatacaattttttaataaatgttttatttttaatttttgaacctgtaggtttagcaagatccctaataaaaggaaattctatttactttagtagttagctcagcaacagatcatattccaggtggaactcaaatgaaggtgggtgtcgtatattcagctgcaactgagtctgagattataatgttaaagaacacaagaaaagaatcaagccgacatttcacatgcgaatgcgatggagtgtgcaactttttgttagactgcaacaaagactaaccaattacttgtttcggattcattaaggtttcccatattggaaatagttaatgacgagtaaagtacgtactattagtactaatatttatttagtaatagtatatacaaagaccatttccaatgcctccatccttccaatttcttcttcccatagttggtgttggaaatggaagtcactttttaatctaatcatcctagcatttcaaattcattaatctaccatcccatttaggattaaagtcactttttcttttacgtgttctagtaacaggaggaaaaaaaaaagaaacgatatgatttatttttttatttcctttaatgtgttgcttaattaaggtaatgttagataaataaaggagtaatcaccaccaccccagttctgatcgtcttcgctaaataatcagtgcactaattcccttctctaaatgagtgaaagagagagaccaaacagattaaaaagccaacatgacattgttatattattttttttaaataaatacttaaaataatattcagcataaaaaatagaaaaattatatactttatgtgacttagtaaattaatgtgttatacataataattctaacttttgagataaatattttttttttcaattttatgatttataacttaattcttattttttgtattttttattttaataataaactcaatgaatagctaattgattgggttggcatataaaattgtcccaaatctaacttgaccatttttattatcaaactgaatccatttttccccccataatctattcatttcaatctatgatatacttgagtgaattagaactattataagttacaaacttcagcatatggacatttaaaatacatatcaaaaatttgaatctgaaatatctaattaagttgggattcaacaaccttgatcctctactagttaattcacgtgtttggtagtgacctataatgatttctaatcatgttatgtaatattttatctaacattttcttttcttatcattttcataattataaagaattaaattattataaaaaaaagcattttttctgttgcaaattagattttgaaaagaatacatgaccttcttgaagttgtagtatttattaacaattatcaaatatatattcattagaaaaa

SEQ ID NO: 1351 - DNA, 1211 bp, Glycine max
  Soy_ogl_14 Gm01:1155190..1156400 Cluster 5
gtatttggtttcttattcaaaattcatgtttaatataaaatcacgtcaaaaataattcttaactatattgcgttgaaaaaaaaacatctaacaatatatttacaatgtttccaaacacactaaaaaaaaagacaatgatatttgaaaaatctaatatttctaacgcccaattgatatccttatttttctttatttttttattacatcatataattaatcatatttattgtttatctcttatttctttcttaaggtgtcgacatctaagagggattcctaatataaaatttttaatatcttataaaaatagtagctccattacatttattggctaacggagcccaatatccaatagtgatcgatgacatgacaaaaataaatttctacgcataaatgaaaacaagtcgtcttcattcaattataacttttagtgtgtttgacatctgaggtgattttgtgagtaactaaagtgaaagaaacagaaaggagtgaaagcaagtggttttcattgcattacagtgtgtttggttcgggcattgaagtcaaggcacgaacatggagatgatagtaggggccacaagaaaattaaatgctctatctgcagccatctatgtaataccatattgttatatttttcggtttcaaatataaaccaaaaaaatgtcttgttaattgtctttgaatataaataaattttagttaattttaattattgaattaaagttttattttcagaatctcttttattcttgatactttatccagattcaagaaatgatagttttaaaaaaattaatgagaaatatttaaataatactctctcttttccaatttttttatgtttaaagttcttttacacatagattaagaaatatttaataaatgtatatttgaactaaaaaatctttattaaaagcacatttcttaatcattagttgtaataaattatacaccaaataactacatttcttgactaataaaaataaattttctatgtacacactctacttagtttactaaaggagtctagttcaagtagttgattaaataagtaagtaggttattctaaattttctagtacttgtatttaattcctattaataaaaaaatatttcacttaatttgattttaaaagtagtataattaattttggtgtggtctttgcattatactctctcatttaatgcatgtctttttttgttaaggataat

SEQ ID NO: 1352 - DNA, 1000 bp, Glycine max
  Soy_ogl_1424 Gm04:45823701..45824700 Cluster 5
ttttatcactaaactaaaaatcactatgtttttttttccattcaaagttactaagttatattgcttattaaacacatgtataaaagtatgttttgtataacattactgcgtgtgagagaccaaaagtgtacatatatttttaaggtactaaataaacaatattatataaaaaatatacttttcaatactatatattttaattactactataacttatttgctctatattaaataactttttatatagaattttgtcattatagtgttttatttttttgagtaaatgtattgacaatgtaaagagattttacatcacgtcatttaatcatatgtataataaattaataataatttttaattgattcataatataaaaaaatccacataacaatgcatagaaattaaagtcttgttttttgtgtcattaatgaaatattgttttgtactttgcgattttttttgttaaatataatgatatttttataattaattttatgcaataacctttttaatttaatactaaaaggttatataattttaaaattaaaagaaaatattttactgacaaataggatattattataacattattgatgtgatactgttttagtgaaatataaaataaaagagtttaatttttataaactatatcgatgtcaaaaacttaccttgttaatcaataaaaaattattgtaagtgtgagttttatgatgattgttgcaaaagttacaaaatttatcatacaagttaaatttttcctttcaaatcacaagtattcttaactaaagtcaattaccttcaaggcaggtaggataattataaacaaaaaaaaaaatcctttctctacatatttaacataaatacatactcaagaatcaatattcgaatttgaagttattagttaaactcaattgattgacacgttttatggttcatacatgttatagtgctaatttgtgattgactaatggtatataaactttaatattgtcggtgcaga

SEQ ID NO: 1353 - DNA, 1625 bp, Glycine max
  Soy_ogl_5405 Gm16:32103001..32104625 Cluster 5
tgtccaaaagtcaatctcaagatgattttgtatcgagtaattgaaagaagttttactgtagatatgaattatagcatatttaatattaagagaactttataaataaaaaaaatctatgtatttgatgtcgaatgaagaagaatatatctttgctaatcatctttaaatttgaaaaaatactaaagaatgtgaaaataattatctctaattacttgaaaattaagactttttcatatacatgaaaaattatctagacaaaagtaattttataacataagagaaatttttcaacagacattatagttgaactgttactgatcgtccaaaataaaagtctaattattacaaatattctatcaatcacataagtgttataattaaataataattttcaaaattgatatatttaataaatcgaaaattattttaatcaattgattaatactaatctccagattaatagttaaagagttgttttactttaatttattaaatttatcattctattttttgtttcatgtgcgtttaatactacaatggtaaaataagggaagattaattgaataaaataaatatgggaaattcgatatgcttattaggaatagctcaaattaactctagaaaatatttatttatttttaattaaaaaatttctaaaaatttggcaagcattagtgattaattttcttcaaaatatgttaacatatatggaaaaatgtcgttataaaattattaattaagttatcaacttatctaatgaacctatcaaattgttaattagcatatgaaattaacttgttagagaataaaaacttatcatttatttaattttcttaatttattattaattaagttatcaatttatttgtttaaattgacgttatttttagctttatgattgagtaaaacaagtttcaagaagcactaagaatgattatttactatttagtttgaaaggatgtaaaaaagtttaaatttttaaaaaggactgtacatcaaatgtgttaataagatatttgtaatatgaggatattttaaatatctctattcttttttaaaagaaaaatgtttgatggaaattggacactaacaaaataaaagagaaaaatgataaatttataggaggtaagatatgaaaaaagagaaagatagaaaaaaagtgtcaagtatattttttttattataaaatgatattatgtatcttcacccttgtcaaaataacatgttagagaatggagcaacaacacagacttaaaaaaaaaaacaaatatgttcaaatacacaaaagtcaagatgaaatgacattttgccgacatatatgattggtacgcatgatattggtaaattatagcaaaatcacgtaataccatatgccgcaagtggtggataaaagtgtggttcaatgagaattagtcgctagggcaacatgaatactaatgaaaaagttgaatacttgaaagcactataataaaccttcctcctttaaaaagcaatgataaacatatataatacgaaggttacggtacaatatttatgtagatggtttgtcgtggatcattttttaacaccgcctgattaatcttatccatacgattaaaaaacaatatgaaaaaaattataaaaga

SEQ ID NO: 1354 - DNA, 1092 bp, Glycine max
  Soy_ogl_2194 Gm07:4767601..4768692 Cluster 5
gcatccttgtaagaaaaaaaaaatgtcttgtttataaagttactaaatatttcatcgttataagtgcaggacattataatcctttcattcattatatacaagaaataaatattctatatttacaatcttttttttttaatttgactgcctatatttacaatcttaagagactacatggttaatatatttttctggaatcaaagcgtctctaacattgttttatgcactaatttgggttttcacccattacatcgatttttttttttctatacaagggaaccaattacattgaatgtgagaaaaactaaaatgttatagtatgtatgaatataaggagtcactacagaatcaattttgtttattagtattaagaagacatctccataaagacttttttttttctgtattcatatgtccataaagactatattgccaattaccaaatacttgtaaattaattatttaaatgcagtaaaatgaattaaagaaagatatatagagcacaaaagagaaagaattatagagaagaccaggatttaaataaatcaagatcaaaattgataacttctagaaattaattaatttcaccacagtaagcaaacgaatatgtaaaaatttgctacttgtcaaatcttaatttattttgaacgttaattatcctcaagtgattttttttcctttaagaattcaattttactttttgcagtaattatatcaaactagacacattattaagtttcatggccataatttagtaattcctcgagagatctaaattatttccttgatttagagtctcaagttgaaattttcattttcgttaagacttatgtttaccttttagcgtgcagtgtggttaactttaatcattgcttaaaattattcgaatctaatataaaacttatatgcaattggattctgaatttaatatcaaattcaaatccatctttagaggttcaaacctaataattcaacacgacttactgtccacaaatgtcatgaactagatacatagacgattgtcacttgtaatatagccttttttaatagtattaaattaataatatcaatattcagtgtgagtattggtgg

SEQ ID NO: 1355 - DNA, 1336 bp, Glycine max
  Soy_ogl_243 Gm01:50104590..50105925 Cluster 5
tagtaaattataaactaattcattttctataagttaattcaagtaacttattttgataaactattttataaaaaataaaccaataaaataagtttatataccagacaaacaagcaagtttattttcatcaaagttagtaaaaaaaagcttatataaattactcaaaggtctgataaaacatagtcaaagaaagtgatcttttttataaaaaaaaataaaaaatactgcttatatgttatatgttatgcatatggccacatgcttttggtcagagaatgaattccaaagacacggtagaaactaaaggaatctaataataataatatattttcatttaatataaaaaaattatttattaaatattttatctttttcattctaattaaacagttatttttcattttttacaatcaaacaccacaaaaatttcacgtcaattaatttaccttatcgatgcttataagataggagtttgattcttgttaattagattaatttttattggttaaatacattgagtgcaatgggtcgttcaccccgaagtaaaagcaaagatataaaacgttattccaaagtctaaactaaattactttaacgaatttcatgcatttttcttgacataaaacatatactgaacatttgataattcagtttaaaacaataccgggcggaacagaccgattatatacatattgtaatgaagaaatttaattatcttaaattacttaaaaaataaatgtttaattattaataaaaagtaacgattaacatcacatttacatatataataaataatttacgaatttattcaaatttatttatttaattttatcagaattaagatataaaaaatactcttcattttaattgagccacatactcgaattaaaatttacacactttttttcttacagaaaaatttaaatatacgttagagcataaagcttattgaataagaagcccttggtttgaaaagcatgctatgctctcttttatctgcattgactggctttttttctttttaaggtttgactgactttgtttaatgttacataaaactgactgttttttcttctttctagatagacgataaaacaagggacaaactgatatctgcgttgaacaattgggggttttttttttttcgaattgaaagattttcattttaaatttattttagttttctcacttgcatcttttatataaaaatgataacatttttgagagaagagtctatattaaatgtgaatatatctcttctaatctactatatctatagtaatatatatgaagatatttttcaataggaatatttatacgtgatatcttcaagaac

SEQ ID NO: 1356 - DNA, 1149 bp, Glycine max
  Soy_ogl_658 Gm02:44856601..44857749 Cluster 5
ttacaatatgtatgatttgtttagtaattgtttttacaatcttactctccataaagatatatttttataagctttgctgtcattgatgacgtgccttctacagtcctcttattccagaagtcaaataaaataactgtatttgattgtgttgggtagcgtatatgctttaattatttatttaatttggaattatattttttaaaagagaatatttatagaaattgcgcaaagaggactatgttttgtacaattttaaaaaagttattagggtaacattaaaatactatgtttctaacaaaagaaaagttaaaatgttatacccaatgaaaccttgcacgcaaatctacgtatatgattatgattaaatttaatatatgataaatattattttctttactatcgatctataaattcggcttgtaaaaatatacctcatacaagtatatataacatttttgaatagtcatgggagtaccagtaattgttaaattttattatcaatcatctgtatatacttgtatgagctatatttataatcttcattacttattgatatgtttattattaatatgtaacacattatttgatgtgttactgttaaaatgtcattatattaccgtgtatgaagtttttttttttacacaatggtgtatgaagttaatcgtaagtttatctaacattttttttataaattatcaatctcttaaaaaaaaaaaaaccaatgtgtcatccgtctatgctctatagtaatgattaatgaaatcaataagatattggataagatattggtggcgtatgatcacaaagtgacggctctatttattattcatccctaacttgtatcacgggtcgattttgtctgagggatgccatttatatatcaagttagtataaagaattttaaataaagaagagtgataaaaaaatgaagtaatgttatatgaataatattatttttaatattatgattccaaaagggttaagattgtgaatatgtgatataggatccaatgatgcactatcctaaaacggaaatcttggcccagctggaaaaacaaaatcggtgtttatattttgtttccccaactcatcgtccaactttgcatgctgagtacattctcaatatgttctttcaaaattatagttgtc

SEQ ID NO: 1357 - DNA, 1125 bp, Glycine max
  Soy_ogl_1276 Gm04:7287380..7288504 Cluster 5
aagccttaggagtataaaaaatatttaatatgctttttatctaataactaagaagattattagaatattattaactataaaatttaaaagtacattattttaatacactattaatacaaaaaaaaaaactcttacatttaatgatatgtgttagtatattatttaatcaaacataattaaaaccattaaattaaataatatgtcaacaaaagattgaattaatggttttacatttactgtgcatcacttgtcaaaattcttttttacagtgcatcaaaattgaaatatgatatttcattgtgtagaaataaaataaaataaaaataacattgttattaaacataataaaagacattgaataatatgtaaacataagattgaattaattattttgtatttacagtacatcaaaattgaaatatgtcatttcatcgtatatcaaaattgggtttaaatttcaatagaaatttgtgttcaaaatattggtctaatgataatatgactaaaaaatatcatttgttttttctttttgatggaaaaaaatatgatttgttaactgataaaagtattaagcattaggattgaatttattggtatagttattgtaaatttacattatgtttatcataataccatttaatgtgttcataatatattgtttggaggaaatctgatacctccgagcatggtggacaaccgaggcgatcaagcgatctccggcgaggatgagacttgtaaatactaacacaaacactcaaatatgtatgagatgagtaataaaacatatatgtttatgccaaaactatacaattaaaataatgaaatgatcaaatataatagcacaaacatatatgtttatgccaaaactatacaattaaaataatgaaatgatcaaatatactagcacaaacactcaaatactagcacaaacatttatgtttatgccaataaatgtgtgagatgagtaataaaacttaaatatgtacctgtagacataaaaatgtcttatacagaggtactgtggtagaatggcgagaaaagcaattttttttatcagccagccagaaaagcaatttggtagttactgtgagccagtcactaatgaacattcacacataatttgag

SEQ ID NO: 1358 - DNA, 1100 bp, Glycine max
  Soy_ogl_1372 Gm04:43816801..43817900 Cluster 5
gtcatgaactgtgatgttttcgcaccctatatgctcttttacactcatcaatcaataacttgtatttattattctctcatcactttttatatagaaggaattgtctagctagaattttctagcatttgtcaattactgtagttttttacacacactttgatgcttgaaactttttttttaaaacaatttgtgactactaaggaaccgccgccaacaattgcttttaaggccacaaattactagttaaaaagtaattcatagtgattttttagctgtgacaaattatttaaaaattaaaaaataatttaataaagcaaagttatacgatttattcatttttgtaatttttttcaaaagctactcattttttgtaataatttcaaacaattatgccattttggtggaactgccctttttagcaacttatgcaaaacttatttacgcagtcccctctttgaatattgactcaacctaaaatatcatctttttaaaatttccattggtttctcaatttgagtatttcatccgctttctcaataaataattctcatgtatcttagtttatttaaaattatgtttatttattgtggagtattaattatttttaaattatttattttagaaagaaaaaaataattattttttatttttaaaatttccattgcataaaattaaaaaagtaaataaaatgaataaacaatatagttaaataaaattttgatatcttaaaatttataatttttattctttaaattgaatttaaatttcttattttaaaaaaattgtagttaagtttttaaaagtcttgattacatcaatatatttattaaatacttttgggattattaaagaaatactttttttgatttttatatattgacaataatggttatggaggtagagattgtggtgatttagggggatatattggtggtcttgtaatagatgcttataattaggttttaatcttagtcacaattttttttaattgtggtcaaggactttaaccaactactgaatcatcaataacccccaattatatgatatattcatgaatcagctgtaggtttgatgaagcaaaagatgttaattaattaagc

SEQ ID NO: 1359 - DNA, 1065 bp, Glycine max
  Soy_ogl_1464 Gm04:47311636..47312700 Cluster 5
tagtatttaagaagaatattatttcaagtagtcttttaaaaaatattaaaaatcattaaaataaatttatttattaaacaataaaataaattttttaattaataaaaaaattaaaaaataactgaaacctcctaccaaatataatatatatctaaaaaacattatccttatctattcaaataaaaatttgcactttatttttttataaaaacaaaaaaaaactatattttatagaatacatgcaccttacattatatatatattcaacgttcacacagatcggacaccgctttgtggtatgccctcgtccttttggagtagtacgtggatttttttatatattttatattacactgacagttaaaataaaatgtataacagaagtattttctttgtgaaaaatacttttttaacacaaaatttaaataagagattattctttaattataaatatatttttaatggaaataataaaagttagaaaagttatgcatctccatcatttccgaaaaaaataactaagggaaataaataagaaaacttatgcagctgcataatttctttttgttaaatttgatatgttaaattgtattttctctgttttataataaatgccgtgtaaaaaagaagtaatctgaaaacaagtatcaatttaacttttccatgtccctacataccttcttcacttgggatgtttgttcacttggatatagagatttatatattgttagctgatgtcctagggatttcctactgataattttttaaaactttttcatctaaaccaattacttttcaattcctatatacatccaataacattgtgtgtttttatcatataataacattttgtttgtttgagttgaaagtcagagggataaatgtaaaaaaaaaatgcttgaaaagagataaaaattgattttcattgttgtttgattggactaaatcacagatgaaaggtttaaaattttaatgacccacttaatttactttcattgcaaaggtgaactaaaaagaggtgaaatgcatagtgtgtccctttaatttcaaaacaatccctccttt

SEQ ID NO: 1360 - DNA, 1066 bp, Glycine max
  Soy_ogl_3179 Gm09:38890835..38891900 Cluster 5
ctaatttgttgcacggaaactattaatataatgattaaatttatataaaaaatttatacatttttatttcatcagatttagcatttgttaaatttatcaactgatttagcttttttatgtgtaacgtatcaaatgagagtttttgttattataaaaaataaaaaccgtaaatataattattaaatcatatttaaatgattaagattaaaaagattcgcaggattttttatgttattatgtaaccactaaattttaatcttaactatgtatgtataattgtataacacatttataatatttatttctgacaataagaaaatatttaacttaatacattgtctatgtatttatttttttattatcatattattactacagaatatcaacatttgttaaacctaatacttttgcactttgcttaagaagatttaacttaataccaagttcagacaaatctgattttcagtccaaattgtgaacttattcggctaccttatatatacaatcaacggcaacgcaacattttataacagcaaacattcgatcaacaacttcgttataaactaactatcttttacgaaaacaaaataaaaagcagaagaaaggtttaaaatctaaaaaatcaaaatgcaagaataataatattttatttcataattgttggaagtatgatagcaaaaagtttaaacaaattaaatccaaagagaaagttatatggagaacaacctgatgatgacaaactttatttgaacacaaatttcagagaggatattcctctaattttatattacataatactaatttaataaaagaaagcctgtcaacgaagtgattattaattaacttcgaatattgctggacctggaagcgatagctgttctactgtatccttgtaacatgtttaaaatatactcttttgaggtttaaataaaatttcaatcaatgtcattcttattagaataacatgtaagaaatattttttttatatgttttagtattttaattttacgttgtttcactaaataactcaaatttgtgatctttgttaacggagacaatataaaat

SEQ ID NO: 1361 - DNA, 1471 bp, Glycine max
  Soy_ogl_4158 Gm12:38677430..38678900 Cluster 5
tgcgcccccatctttcttgtgtctccaccttttccaactctttctttcttcttcgccttttccaactctgtgttgtgatgcctcctttttttactaacttttttaaattatcaaagaaaaaacctcactgtatcaataataatgctacatactactaataatgaaagaataacaccattccaactacactaacaactagtagtaataatcaatcaatttttgttttgcaaaaacgattttcctgcctgccttaaatttgttctggtgcatttttttaaatagttctcctccgtttttttttaataaaaatactcctccgttctactttataagacattaaaaatactgttttaaattagttatcattttatagactaaataaaacattaaatatatttttctatggaatttttttttttatcatcatatgctagttttgttcaaaataaaattccaactccgtaccctcttttctcttctttctccctaggatcataaatttcctattttcaaccattcgaccaattataaatcttccttcacccttatatttcgttgggctttcatattaataacaaaaaagacacattgtcagatttttgaagaaattttattttcatttacaaaattcaagactatacttttctcctaatatttaattaatttatacatgtgttatggagtgaaaagaataaaagaaaaaaaaatagaaaactcaataactattttattaaaataaaaaaatacttgaatttctataaatttatgcatattgtttaatcaacccaccaagttaaatcctttagttaataagtttatatttaactttttttaatcaacaaatattaattttcgttaaaagaaactctttcattttctcttaatcattggatctattttatatctcttaaccattcaatccaccttatatttattacgtttatatttgatttttcttaaaataatttaaaatatgattcaagtaataattttttacaattttgttcaagttcaactttgaaaaatgcacatagaaaacgagatacgctataaacagcaacaaatgtatagtatgcataacattttttttaaaataattagagaaatctgacagctatatatatgcatttataagacaaaacaaatatactaccaatattattttccaatattattaaccaaaaacaatgtacacatgtctcattgagaatttagtgggaaatacacaaatacagtttcttaagacaatgtttttttttttttggatttactctctctagaatgtggagttcaatctcgatacttgatgttttttttaatatttaaacttttttactaaattacaattttgtccctcttttaattttaatctatgattttgatttttctttttgaaaaatcctgtttttttgtccaaacctcaatttggtatatgttttattttttaaaattttgattcatttaaactcaa

SEQ ID NO: 1362 - DNA, 1100 bp, Glycine max
  Soy_ogl_5816 Gm17:40386101..40387200 Cluster 5
cttttacaacaaaacttttggtctaaattactcacagtattttaagtttgaatttatcagctgttgttacgaagtttacgaaattataatagcacattttttaataattcaataacacaaaatatttagagtttgaatgatagtgattactgaaactagaagttgttctgtcttaactaatatttttattctaaattttgaatatataattgtgttaaatatttagatagtcatcatttatgataatatttaattcgagaaatattgtctcatgcgagaaatatctataatttatacaaaaaatgagatatcaatttatggtattttttaaaatatttttaatcttaaatttcatttttaaatgctattttacctttcagtggcatgtggaacagaaaaaaataattcttaatttaatcaattgtctgagaatgaaattcttgataacaaagattcttaaaaaaatatatatgaaatatatttattcaatgcccacttttttttggaaataatatttttgtttctaataaaaaattattattgcgagacaaatttacttttactaatgaaagtaaaaaattaaagtttttttcacctgtttttaaattaacatttataaaaacctctagatttatattttaataatcatgaaacttttttattctaatgttacttcttgagaaatgttaaaacatttactatatcaaacgctatctcaaccttagtcatatttttttatatatattgaattctttcacaaatatatcctattataattttgagtatatttgagcattttgcttgtcagcatcttaaatatgcctataatatgatagatcaatttgaacttttttagctatacttttctcaaaagcatttttataatttgccttatgacaagtaattagacttggatcacttgagacaatgctgttaaaaaaaaagaactttttttataatgtaaaaaaaacttgagataatgaatatcataacttttcacttggtaacacttaatattaactcctctaaaaaaaacacttaatattaatttataatgaaagatgttgagtccttggaccaaaagtaaagaggtaaatcgt

SEQ ID NO: 1363 - DNA, 1146 bp, Glycine max
  Soy_ogl_6938 Gm20:42542655..42543800 Cluster 5
ttagagtggaaatcgcgcacgtgggtgttgtgttgccatttttatccttttaaataataaacaaataaaaataagggaagctgcgtctgttttttaatttttatgtaaaagttcttaaatgtgtgatgttttcgtaaaaaaaatgtatctatattgaaatgaagagcttcatcaatatttactaaattttattatttgatttaattcattttccgttacccagattatatttataggaaaggagtctaactcgctttgttagacaatgagtcttcaatcaattcctgtagacgacaaaaagtacgctatgaattttgttcacaaaaatgtataatataataataatgtgaaagggtaaaagttcatattaaaaaaaaacttaattaagcattataaaacatactttttttttcaaatacgtttttatataagtttgtataatgatataaaaatatttaataaaattttaatagtatggtataattcatatttatttacatattgtcaaacagtattttgtatacctattttatgtttattttatttgtataactatattcataaattattattttgttcttataattattctcacaaataatttactaacttataatactccctccgatcttatatctttctttttatttataaaaaaacagttagatacgcagtaactgtttcccctgctatacatacacataatacatttgtatactgtctaatacttatatatataaaatgtcggtcatgaagtcaaaagaagaaaaaaaaaaatgtcggcaataatgagtgacactagaagcttgcaggttattaatatccgaggaatctaaattctaccaaattaactgtgtatatccacaatcatacaagtaaaaaactagatatatattgattttaactttagttataaacttgacatgccgtgatttctaagcttaattattaatttgattcttaaatgatttaaaatatgttaatttgatcttcaaattttaacatttaatttttaaaagtgtctcaaataagttttttttttatccaattgagatggacgtcattaaaattacgaattttgacacgtatattcataaataatgatggcttttaattatcattatatttattattattgtaaagaaa

SEQ ID NO: 1364 - DNA, 1400 bp, Glycine max
  Soy_ogl_3621 Gm10:48499601..48501000 Cluster 5
tattgatttgattagtgtaacataatcgcgatggggtacatggtggcatttgccgcattgaatgccgtataaaatacctttttgaatctttgatcctgtcatattgatagaggatcgttattgctttaaaaagttctagcactttattacgtactattacaataagtaaaagatatgagtttaaggcgtatttattaatatggtcatttaattacaaattacaccgtttaattattttaagatacttttttggtttttatttataatttaagtttaaaataacctgtttctttttattagaaagatgtttcttctattaattatttttagattaaaaatatctaaaaaaataacccattaacaaatcattagaagagatattagtattgatcataaagataattttaaaaaattataactttaagataattttattattatcaattaaattaattatttttcttaatcttaatgaattaagtaattgaaacttatccaaactcatcataggtaacatattgtaattgaataatatcttttcataaaaatatatatcaacaaataaaaattaacataatacacagttcgtgtgtttttaacgaaaactgtttcatgccttttagcattttcctttttgtaacaatacaatataaaactataaggctaaaaacagttttttttttcctactttttcgtgactgtaaaaaaaaaactcgcattctcataatatttttctttctttctacagtggtcataataaatttcagatcatataaaatttatgtatttttatcattaaatctttaaactacaaataatgacatgttacaaatattcttttattaactaaaaattattataatttagtttcgagtttgattaaaaagagttacaaattttgtctaaatcttgtcaggcattaaaaaaacaaatgattattttgatctaaattggtgataatttaatttctgaaataaaaagaaaagttttttagtccattaatgtataaaaagtgcaccaattacgtttttagttttgtgaaattattttataaataaattataatattaaatgataaatttgacattaagttatatttggtaacactaaattgacattaaattataaaattaaaagatcaagtagtcataaaatttgacataggacaaaattgatgtattttatatatatatttgaggactaattaatttttaaaaaaatcaaattatcacgaatttatatattcgggaaccaaaatgtttatatagagagagagagacttgcaaaaacatcctacgttgtcacccatttaagccaagaggaacacaactaacatcccaacatgagtttgaatttaatatgttgtgtggatgtaaaggattttatatcattaaataatt

SEQ ID NO: 1365 - DNA, 1400 bp, Glycine max
  Soy_ogl_1698 Gm05:37286001..371200 Cluster 5
tccatctcttactctcctttttatgtttgttgcatctgaaagtgagattttctatttagaagtctctaaacagatttctaacaatatctttatgtagcgctcgatagaacaaaaagaaaataaaagaaatataattaaaaagaaagatttaaattaaaataatatatgaaaatgtgaaacccatgctaaaattttgaaacttttcacacaatttttccccctcaacaatcaaatatggccttagtattttatttttacaagtaaaagcatctttagtatgaacattataagtttacattatcattgaaatacattatactaataatatatgtattcataatatatattaatcattcgttaatatgaaacatcatattatcaataataatgtatcaatataactcgctaattatatcaacatatgaaaacttacacatggtttggtttaattgattttaagcggtgagaaaataaggataaaagtagaagagaaaaagtaattttacattatttggacaggaaagagaagtaagaaagagagaaaatgaacgagactcgcttaaaaataaaatctcttctccaatgaaaataaaactgataagataggaaaaagattgcttaaatttacgataatagccctgttaataaaccacagtgctgccttgtgtttttttatacataaagtgcttccgtcttagaacctttgataaaaaaaatattatttccctatttacacttttgggtgggaaacaagttacttgtttttaagataatatttcttttttaaaatattatattatattatttttaaaaagtattattattattatatatatatacacactagggcaaacatgtcttttaaaaaatcattttttctctctttaattttctattcaaccaaacatgtagaggaaaaacttaacttttctttctcttatacttcttacttttagtctaaacatttttaaaatctattatttttttactcattttctcttctattccatattttttcttattctatttctttgctctctacttttctccctgtaaatctttactcttatactaactttagttggatggaaaaaaaatgaagaaagaaaaaattttaaaatttaaagtaagaaaaagtaaaagcgaataaaattttaattttttgtttttagaagttatctctcccctctctcttttcctttttcttccattaaacagaatatttttttttttttttgttatttgtatgttttttctgtactttatttccatgcaaccaaacataccattaacatatatttttgtttctgttgtaacgagtggtacaagtttttttttttatacctcaccaagtgaaatacaagacaaagtgggccggatttaaaagacaagagatggag

SEQ ID NO: 1366 - DNA, 1320 bp, Glycine max
  Soy_ogl_6630 Gm19:49767001..49768320 Cluster 5
ttttaaaaaaaaagccacccaacaatatatgggtcaatatcaacaatgtagagaccaatagcaataccccatacatttttggactcggttacattgaatccagatccaagtccgagaattgcgatacatatctcactttggaaattcacatccccacgagatttaaacaaaaatttatttccaaaatacctttttaataaaagcacgtttccgttttattatattttaagaaagaactttataattaattgtagatataagttattttctttcattaacagtatatgttgtatttttctaattattcttcaattaattatgatacaaattatcttaacgacacacattatttttttaagcaccaaaaacatatttcttttaatagtagaaatgattgtgatataaattatattttaaatttaaatatgaattaattatgatacaaattagtatcataattaatttgtttacgattaataaacatgattaatctaataattaattttattaaaggtaacttttatccaattaattaagttttaatttaaaagacaatttcaatgatactcaccattaataaaaaaataccgctacattataccttaattaatttaattttaattttaaaatagtttatagtacaattaatttgattactttaaaaaaatgagactgacaatattttttagaataattttttcagaattatctttttaagttcttcaggcaaagaatgattaaaaaataaatataaataagttaatcaaaacatgcgctaaattgtgattcaagaaagtcgcaattaaattttatacaagtcaaacatacactaacttgattgagaactctcaagcaatgaaaaatgtgctccgacagagttaggttatttcacagacgaaaaaacctataaaaaaagacgaacaagaaaagtaggagttaggctatttatttattgggtgagatttttctttagctccttttcatattttatttactttaatatagtcgtcaaacttgtgttagatgtggcaattataaatttgtattagttccactgtccaagttcaatattgcttagaaaactataatttgtatacatatgatgaacgagtttataaaatacataatactttatttgctatgttattaataattcatttttattattcttaatattttatgtttaattaatggagcatttgaaatttagagttgttttaaaatacataattattagataattatcgtttaatatacaaatcaactcaagtgagattatttcagtttaataagagatattagatttgatgataataaata

SEQ ID NO: 1367 - DNA, 1000 bp, Glycine max
  Soy_ogl_1136 Gm04:502601..503600 Cluster 5
cttgattttattatttaagatcattaacttattgagaagaatgatatttaatactaaaaaaatcataagtcagtataattgaggtcaatatatttattttagtttttagtgttctttaaagtacatatttattactattgttagttaattttttaaaatccattcctctaatagaaagatttatatttaatctaaattatttatatactttatgttcttgattaaatttgtcaatttaagttactgtcgtgaattaagaagcttgaagtttactttttctatcttttttttcttctctttttgacggaccacactaggttgtcaattcactctgaattaaattgattaagactttaacaacactttggatgagttagtgacaaaacgggtcaaaacacactttgccacgcttgcttcctagtggtagaggttaagatagatgcacaaaatttaagtttgattttaatggtcatcattgtaaaaaaaatctaatctgacccatagaatttaatatattaaattaaaaaacattatacttataattttgcaactgtacagtcataataacttacaaaatagtatcttaatgacctaatgccaatttgtttaaataaacttggatgagattaaaaaaattattttaaaataagcattattttaagaagttggtagaatttgtttcttaaattaagtattaaatttttttttaaaaaaaataatttagacaaacatattaaaaaacaaaaagctaaataaaataagtacatatttcaacaaataaatttaaacaaaagggtccctatttgttgaaataaatacttattttaataaaataagtaattttttattttttttagtgtatttttctgaattctatttttaaaaaataattttttacttattttaaaaaataaatcctatttattaattaaaaaatacttattttaaagttggtttttttaaaatttaaacaaactcaaccttaatcttcttaactaaa

SEQ ID NO: 1368 - DNA, 1319 bp, Glycine max
  Soy_ogl_1701 Gm05:37299209..37300527 Cluster 5
aagaagtccaagataactacatgttggacaaaacatatataacaaaattgttatatattttctctgatttgttgaaggaatataagaacaagaggaattagagtaacattctttttctaaagctctttctatcattgactaaaatttatttgaaacttgaaaactatgagccttaattctcttttttacaagttttttctttcacatatgtatatcttcaattagttgtgccctaaaaaataaaaatgatatgttacttccctataaacaacgattactctaagaaagaaagggatggacaagatgacaagaaatatcacgataaaagtttatatatcatacaatttgaatataattttctatagtcagtaattttaactaattagaagctcttatctttcattattttttaagagaaattaaatcactattagaattattttttgaagaaaaattcactagatttataatttactagaaaagactttcataatgtaacgtcaatgttcctcaattaatataacataaaattgcaaattttttaatgttttaaatctttgatgcaaggaaattcaagtgagaaaatagaaatgcacattaaatgcaaggagtacatttcatattaaaaataataataaaattttaacactgctgtagttatttatttataatactactattataacattcttaaaatactattgtaagtaaactataatatggttgaaatatataaatacatgaatatatgtttttatttatatggccatgtaactaacatgaaattaaactcacaggaaaggttaaaatataagaggtaaaaaatatagtagtaaagataaggttaaaagtggttgttgaaattgaggtttttcatttacttctctaatggccaaagttgggacgtaaaaagtttcgatttttcgctttcgctccaacatactgtttgcggcataattgtgttgaacataatgatgagaagaacgccaaaccagatgaatcagtgtgtttgagaaacaaacttaacccacgtttggtggccaaacgccaaaacaagcatgttcctcttctccttgaaatcattaagtaaaattttactccaatattgtaaattaaaataataatttgaagatcagactcacactcttttcacttttttaattaaacgttttaaagatttttttttacttctctatttaaattcgtattttacatactactctcataattaaccaaaatattatatctcaatcattccaaactactgttgttttatctttatttgtattcttaaccatccatctctttaaatatactct

SEQ ID NO: 1369 - DNA, 1189 bp, Glycine max
  Soy_ogl_4567 Gm13:39347112..39348300 Cluster 5
tagtcttgatttaattagtagtaattcaatttataattaattttctttttaataataatttgtttaactcacaagtatattttttttctttcctatttttaatataaaattaagaaattcatgagttataacttcttatgcgagccttttttttcttaattttaaacaatttaaaatcgcatataacatattaaaataatatattttaccagcaacccattaactaactctcatcattatggatactcttaatcaactagcaatacttaattcaataagtgtttattaagaaaattattaacaaaaataaagtttatttaaatgatttatacattttgaaagatataaagtttagaactttaataaaaaaaaaatattgtatgaaaaaaactgttaacaaaagataaggtttatctgaatgatttttacgtcttgaaaaatattagttttgacttgccaccgatgagataaaaaaaaactgatatttaataaatttaatgatttaattattataaaatatttcagaatgctcaatgaaaataccaaatgtacaggtggagtgggggttgatataaaagaaagcatttgcggaagatattattattaggtatatatatgggtttaggagggttatttttgggattttaatttccaaaagtgaaatctatatatgtaataataatgaaaatgataaagacttgaatttaaaagatgataatgatagctaatttttattaagaaaattgtatttgacttttgtttgtatttactggtatgttttgtttaaaagtaattgcgattaattgtttacatgaaatttcatttcatttgttggtatgcatttctatctaagaagattgcatttcattcataacacttatgactctttattgttaattattcatttcattaattttttatacatcttttatagtaattaattacaattataaaattgacgttttaaatataatccatgcattgcacgggttacttgtatgttttgtttaaaacacatataattctttactgttaagtatgcatttcactaatttttttttatacatcttttataataattaattataattataaaatttactttttaaatataatccgtgcattacacgggtgaaaacaaaaaactagtatatatccaaggaataataaatgtaccaatctgtacggt

SEQ ID NO: 1370 - DNA, 1334 bp, Glycine max
  Soy_ogl_2557 Gm08:8269101..8270434 Cluster 5
ttctatgtttaagatttttattatttagaacaattaaattattattgttttaagagatagtattattttaagtttaaatgtatattttttattcataattatatctctatttaatctggtatactccttaaaattacttttatttaattatgtttttttttaaaataatcaaattattcaatcttattgataagtggtttgtatcaaatgctcacctaaaaaagataaatagactcccaaatattagacacctaacaagaaatcaagaatatttagctcatcaaataagatgagcacctgttataaattttgatattattttttatttctatcaataaaaaaaagacacctaacgagaaaaaaatataaatattattatcaaagacagatgcaggaattaggacaattgtgccccctagataacttttttacttgttatatttgataataaaaaatttgtccccatatagatgttgcatccaaaagataattaatttcttttaaatggatgtaggaagagactaaattattactaatcttattgctttatattttttatagttatctttccactcctacagtacgaaacacatgtaataaatcagtgccattaacatacaactcgacctaattgtaatttgtagtaacttagatagtttagattttttttttgttatggtattatgtatttcataaaaatttatattaattttcttttgaaaaatattatacttcatattgtcttcttgcctttgtaaaataaaagtgttaaaatatcaatactcatgtttatttgaacaagtgagatgcatgtaatcgctatcattatttaggaatgctaatgaacctacttgttgcactaattaagcctgtttcaacctgtaaaaaaaagtctgtttcaaaattattttttatgcattttacttaaaaaaattagacctaatgaattttgaatattgatttgatttttttaagagaatatatttttgagttatatatatatatattagtagtcctacctcgttctaatattttatatttttttaataaaatatacaaatttttaaacaattttgtattaaggaaaaattaatcattttattcttataattatacaaaatttagctttgaatgaccacatttaattagtccatgaagaattctttttggatctctttttgtccttgtcattacaaaatcaatatttaaaataattcgtactaaaaccacattgattttttttttttgcatagattgacaaaatgaaagtttgaatataaaaggttactttgtttaaacttaaaaaaaaattctaaaaaatattttttaagaag

SEQ ID NO: 1371 - DNA, 1138 bp, Glycine max
  Soy_ogl_5544 Gm17:6082663..6083800 Cluster 5
gcaaaaatacaaacgtaatagcgtttatacatccacatttctattttgttatttcatttttttacagtaagatttaatttctattttgatttcctcatcatcgattatgataacttttaaaaaataaatgatttttaaattataaaatgtcatttttttaaatagttttataattgtgttgtgtttccagagttttttttcttctgattttagttttctaaaatttattataatttttaaaaagaaattaatactttaaatttaatttttctcttaaaaatatttttcatttaaccaaaatggtgagttattcactttcacaatcgacatgcagttttaaaatttatttatttaaaaaaaaaaagaaaattttaaaacttgaaaactgaatcagatgaagaaaaagttttctgtttctgttttagttttaaaattaaaatcatgcttttcacgtttaaaataaaatttaaaaaatccattcttcatttaaccaaaatggtgagttacttttataattatcggcatgtagttcaaaaaaaatttaaaactaaaaaatagaaggaaaatttaaaacttgaaaactgaatcagatgaggatttagttttttttatccggttttatttttaaaattaaaatcataatttttacttttaaaataaaaataaaaatattcattcttaaaagttggtttaaaattaaaattcttaccttatatggtaatactggatcaccaaaatattttttcttctatgtaaattatggtagcggatgcaaatactttttgtagaaaataaaaaatgtgaatgaatgtggtagcaaacagggagaaaaattaattacagtacaattttgacaaactttaaaagaaaaaaaataggaagagatatgctgatttctctttctcaattcaaaagtgaatctacaaaataggaagaacacagaaatttaatgtggctttttgtaaagttatttgatttgaatccttgcagttatgataaatatacgcaaacagttattctatttctgcatttctattttaacttatttgcatttcaaaactgcatttctattttctagcagatgagtaaagcaacaaagagagaaaagtaaatcagattaagcaaaacaaaacaataa

SEQ ID NO: 1372 - DNA, 1500 bp, Glycine max
  Soy_ogl_5932 Gm18:5134301..5135800 Cluster 5
ttccttaatcaaagtcatagagtccttaccattatctttgtattgctatggttgagagttaagactgcatcaactcattccaaagggtcaaactaaatatgttgtgatacttaataaatacttaataaacaagatctaactttgaaaattgtttaagggaaataaaatatatgatgctacagtatgaaaagtataaacacttacagaatattttttttttggatgaatcaatatatttttcagttgagagttaatggctaatttcttaagatattaagatttatttaaaagattaattttttacaccaaatatttttcataacatagatctgaaaatcaatcctctaataatatatttaaagaataatattatttgacaactataccacatttatattggtagtagaacattagatctactactaaaaaaatgtcatatgccggaaaaaaaatattggatattaagattgtttctgttggttgagtatttgttattaatcgatttttattggtacggtagatataattacagaaagtattacctaaaagaaaattttaaaaaatttgctacaaccaatggttctagcaatttaagttttgattatagtcattatcatataagaaattaaatcactttttaaaatgtaccaataacacgaaaagaaaaggacacatatacagaacactacttaatgttttatgaagaagatgactcgttaaatattaatatagcattttttttatatacataaatatcactatagtgttttttttaggtttaaatattaacacagtgtttgacactatactcaatgtcgttcttaattaattctataatcttacgtagaatgtaatacatgcatgtattattttttaatgtcatatttttttaattattttattcaaacatatcacaaaacttatacattgtgtttatatattctaaaaatgattttctgtttattgtcaacatcttctgtgagttcaactttcttcttccccgcgccaccttgcaaagtagtgtccatctcatcttccatctttaaacactgatcatatatagtcgttgttggaaatcttagttaatgaatttatattttataatcgtatatagcaggaccaagacaacagtctcttattgtggctgtgagaggatctcgtagttttaatttgggtttttacacaccgacttccaaaaatgattgatgcaaaaatacacgtcaattgtatgaacttttaccaaaacaatctaggtagctcagttgaataaaatatgttaaatgttataaattctcttacaactatctttgattcttacaaaagaaaaatatgaacttttcaatacaatttcgaacacatcttacactaagggcaacattgattctttgcaaacctcctttaaagtttaaaatggcacaaagaattaaatatcttgagctggaagaattacagagttagatcaattaagagtattgctgccttgttaaagagctagagaag

SEQ ID NO: 1373 - DNA, 1448 bp, Glycine max
  Soy_ogl_3640 Gm10:49051053..49052500 Cluster 5
tattgtttggttagtttttactactatcatttaagttatagtagtaactactatacttaaattatgtttcttctataataaataaaattattttttccgtgtttaattttctcaaaaaatttctcaaaatttatacccactaagtcgatttcatggtaagagcttagcgagataatatgcatgagaatataagtttaatcttttataatactattataaaaataaaaattaaatctcaaaattttaactgtgcatttccttgccttggaaaaactagaactaactccaccctagagttgactagttgaataagtcttaattgaggtagtgaacatcgttaagacaattttaaaatgttgctaaaacttgtttgaacgttaagaaagaagtgttttcactacattaacgaatatttactataacttattagacacaacattttatttaaattatcattttttattcacaaataaagctcctttccgtagacattttgtattgataaaatacaatgtgaatgcattactagaatgttgaaaaagaaaaggacctcacacattaataacgagcaagccttttttgttttggtatggaaatggctctgttgcctatgacctagccaaactagctaaccattggagttgtgcagttcatattattttatatatattgattggataaattcaacaatccacatgatcaattgttattaattatattcataaatcataaaaaaaaactctctaaaccttggagtaattaaaacacaattttaagtaaatgattttcaacggaactagttaattactgcaatgcattcttttaggttttaaattgtgtgattaattaattgtcaagagacttagttatatttaataatatgcttcatgttatacatttacagttttgaatttaatatcatatacttttaaaataataaagataataaagaattttgtaaatcagttgattaattatgaataaaagttgtatgtacaaaatcttgtatgtcacaaataaataattaatattgttttatattttggactcaaaagggatggacctgatttctaatttataaataaatcattacaaaataaatcatgtattgacaatttactctgttatatatatattctctatatgaatttgtttgtgtataatattctcaatgaattgattccaaaacaaagtaaaaactaacaagcaaaataaatattatattagttatatttgtgagataatgcctaatttcctgccatattaaaaactttaaaagattcatggctattaagtatacttttttgtaagcaacataatattttaaaaaaatttatcagatgcatttaaattttttaaatcattattttttacgtggatttaagtttaaacttcaaatattatttttggtagaaaataagtcaactttctaattacaaatctaatcc

SEQ ID NO: 1374 - DNA, 1741 bp, Glycine max
  Soy_ogl_4870 Gm15:2308286..2310026 Cluster 5
taacagcgttaatacgtacactaactaatagtatagtagtacaatttataaaaactgttgagaattatataacattagcacattatatatttatttcaaataactgattgactgcagaattaatactatataattctcatcttaatagtttgatgtgtgtatatatataattataaatatattatatgtcatgccattggctttggatgccaggccaatcaggtatagtagcaacatggtccacactcataccatcttttctttttatttatttttctcctcttttttaccttgcttgctctttttggctaacatggtttcattatgtgtaatgtgtatgctaaattccatcatttgtcttttgtaaagtcccataatcttttagactatgataagttcaagttgaaaaagtataacaatttaagtagatgttaagcaaggattaacagtatatattcctttcatgatttttcacttcgctatatatatattacactttataaatcaacaaaaaaatataatgcactttaagttttttttaataacaattttatagattaattaattaatttcatgccatctatattattaaaatgttttttgcatttttcaaaccttattttttttatgaattttataacttcattctagagtaagaaagtttatacaatatgatttgcatctgcaggtttttcttgtgcaaattatgcatatatattttcattataaaatttgtgatttttttgaaaatctttccacatatttttcaacaaattttgctataattttgacaaaaatattatcttttccttgaatctattaaaaaattcatagattttttacatgttctcaaacaaaaattgtttttttttatatattttttactccagaagagaaggggaaataataattataaataaaacaaatgtgagaagtgctattattcaattgattgaacatagtaagtaaatgttataattttttttatattaactttaattcttacggataaaaaaataaaataaaataatattttgataccataaaacataattaatatttgaatattatcttaaacgtataaaacgatgcatgaaaaaattactattatcataatcttaattactatagttcttccatatatttttttcaagtttcaccactatgtgataacacgtatatcaatgtagagtataaggtgcgtttaggttaaataacttaattaaaggtgtaattctaaatctcattttatttgatgttttactagataaaacttgtctctattttattttcattttacaatatcaacgaaaaattaaatattttttcccattatactcttaataatgtgttgtgaagtgaaaaaataaaaagaagtataaataagaaaattttaattaatacgagggataaaatatatattaaaagatcacataataatttttatttacgatactttataccttaaatatcaaacaaaatgcttgttttccttattgttaaatcacaataaaaatttcccaagacgttgattgtcaaatatgagcaattttttacttaaactttcaacattcaaaagtcatattcaactccaatatcaattgtcaaatattaaaagattataaactaattaaaaccttgaccttataatgtatgaaatgagttacacattaaaattttatacaaaatttcaaattaaaaattaaatgtcacatgctcagtttaaataatcttgtagtct

SEQ ID NO: 1375 - DNA, 1300 bp, Glycine max
  Soy_ogl_6261 Gm18:58874201..58875500 Cluster 5
ggtggactgacaaaatgctactggacttttggatgaaatttttttttaatatttatgagattaaaagaggatagtgtcattcaatttagtgtgcctaaatatgagcgaagaaaaatacatgttattgttattaaaaattacacttaagtaataattttaaaattcatattgtcataacattaaatatatttatgtttcagtgctttgaacaaccctcgtgaaattcattgttgttgttaataaataatggttaaccattgttgttttcaataaattgtggtttatatcaatagaataagatttcttttgttgtatctgtttcatagtttaatattaaaagtagttctcttatgttgtcaataattcatttttattcaacaatattaaactattttttgaaaaaatatataatttaatttaatattaaaaaatcatatggataacttaactggttaaagaaagaaacaataaataaatagttacttcaaattttttattttcactataatttaggagtaagaattgattttaaaaaggtattcaaacacgttaataatctacgccgtttaattttgatgataccattttaaaatgatagtaaaatgcacgcactacaccatcgatggtcatattaagatattattctccagtttttgttaaaattttctaaattttacttgctaacttaatgttgatattgtttttttgttcttagtcaaagctctgatatcatgtaaaatactttggctaaagtaacaagtcatatcaaaacgcaaggttatgactggcaccatattcgagtgacatatacctatcttgcttgagtagcttgtttttatttttcacacttttttaactcaagttcatttacacctctgtttatagatatttatagagaagaaaaatgagtgagaaaagtctaaatatatatagtaaacaatacgacatgataaaaaaggaaagtttaattattatacaggtttctgaatttttatcaaatttttaattgggtttctaattttttttcttccaattgaatttttgaacttatgtttatttttaaattagctccagcaaagatcgaatatggacgtaattaaataataaacacaagtttagaaatccaattgaaaaaaaaaatcattcaaggatctatttaaaaatgacaaacatagttcaggaacatgcatgattaaaaatttgtcagcctattttcatctctgcaagcttatattttcacttctgcaaattctgaactcgatcagtattcttagattctatatctagtttgaacgtgcaa

SEQ ID NO: 1376 - DNA, 1638 bp, Glycine max
  Soy_ogl_262 Gm01:51061272..51062909 Cluster 5
taatgatcaggttatgtgatcaatatatgattttataatataaatttataatttttatttaccataataataaaatattttcacgagagaatgagtctattctttcaaacattactaaagtaaactttaagcatgtaccaaaaaaaaatagtaaattttgagtcattaaatatgactaaaattcatatgtttaaattaatttcactttcaattttttatacattaaaataatatatgccatagcatgtaaaattgactctacctataaactggacggacactaaatgttagagacaatttacttaattaataaaatccttccttaataaacattctaaataagatctcattaaaaagagaactgaagtggtaaatattagtagcatttttgtctgtctggtactatcatagaaatggatttgggcttgggcatatcatggattacgaatgacatttgattcttttgtcttttgtaacgtcgtgatctggtgacaaataggcgccttcacgtgcatttatttcactttttacttgtcatattccaatagtgcgagagagaaggtgaatgagccatggaacctcctccatcacaatccattgaagtttctggcaccggatgccaagctggggatgatacacaagacaagatcattaatgaatggtaatcttcttttcttttgtaaaatttgatgtgattgtgagatataatatgtctgattattgaaacttttgctttctgggtatgtaggttgtcttgctgctatgactgtacacagggtatcttcgatttcttgtgctgcaacttttgttagaagtctttagattaaatttcagtgttattactttatagcaatatgtaaaagtcattaggacataggtatatcgagatgttcttttcccctcccctttgttatcgtagaattgatggatgatcagaattaactaagaaaaagttgtgatttttaatcattattgtgactattagtaagaatattcttcgtttctctgtcttttggtatgcctttaccaactgaatttgagtttgattctatccaagccgcgttgggaatttcattattcttttttttactaaaagagaatccttttaccaaaaagtagtgtgggcatgcaaaactctttcttttctccttttacatgtttgatgaatgaagttattttatctgaatcacaatatacacgtttttctggattgagaaaatgaactagtaccaaagagtataataacaatatcaattgtgcatggtgctagtgggattcaagtaatgtaagtccaaacaaatttgaactatattcgaagaattaatcggttccctgtaacatttatgaataatgggcatttgacgtaatattaatattgtttaataatatactataaaaaataatcaatcagtttatttcattcttttttattattttctagttaacaatatatcttttttagaaaatatatatttagataaacatcatgtaactaaaaatcataagaatgaaatataaaaaagaaagtattaaattcatgaataatatttaaacattaattgataaaaatatgttaaaaagtaattgagcatttgaagtttcaataataacattcacctatttgaaataagtttttag

SEQ ID NO: 1377 - DNA, 1700 bp, Glycine max
  Soy_ogl_361 Gm02:3843501..3845200 Cluster 5
tgaagaatgacttggtgaaataagcatgtcggtgaaaatgcagattcacttggaaaaaaaaaatactctatgaagcttcattgttttctattattggctttaggcttttcatgggtagcttagttggaggacaaagaaggactctttttgaggggttaaagccatcaatgagatacacataggaagggttagaattttaactttatgtcgagcagcgggccaagggacaatcttagtaagcaacttctattgggcatagacctccccagatgtaatgaaggtgttcaaaggcttcctccagccaaacaaagattggtcctcaagtatcttaattacgatatccacccattaagtagggttgaaaatcaaccttagtgatctcgtgttgtcgagtggaaaaatcaacacttagtgggtaaaagttgctttaggaataaaaagttgatatttctttatagctcacatcaacataaattgtttgacacatcaatggccactctttgccaaatgagggattgtagtattttcaagggataccatattcgcccattatagcaatacataagttggattttgaatgtcgtgagataattcaaactatacttggtgtaagtatagacatgacaattgggtgagtgaaggccaagtttaactctccctatgttgtccttagaacagacaaggcgagttcatgtaaaagaggtgagtttgaaattttaatagtcaatctcatctacatcaatttttatcaagtttgaaaaaaattattaggaggaaatttaatagacggataaataatatcctatgataaggatatggtatattgaaattactatgactataagtcaaactggattctttcttgttcatacgttaatattcctctgaacaaggaaaatattttaatatctaaacttgcacttatatatatatattaactctttacgactaattcccaaattcggacctaaaagtcttatttatgataataatgactaatgaatttgtgcaagttatttattaataaacatacacattcttatatattacttattttttctctactttcagttttataataacttcatactttaaatttcttctactattttttttatcaagcttactattttcttttttatgttcaaattattataaaaatctttgaacttaatttgtaaacacgtaaagttttttttttcatcttttcatctaattagaaattacccacttttaaaataatggttaaaaatttgataattttattacacatgacaatttataactaaattattgtatatgtaaaaattctttacatgatgattgtattgtaattaaattaaaaatattttcaaaattaacattaatagttacgaaagataaatttcagtcgaaccatgcagtgtatgtttaaatttaagtttataaactaagtttgagttaaatttaaatttgttggttaagtttctaaaaataatctaaattttattttaaaaaattaaattttcagataaaattttaacatataaatatatataaagatagccaaatatatcacaaaactaaattttttttcttaaagaaggaggtttcataattcaaaggactgcattagaatgagttatgtgttgatggtaatagcaaaccaggagttaggtcaagtattgctcctctgacacctttcactctgtagaagcaac

SEQ ID NO: 1378 - DNA, 1200 bp, Glycine max
  Soy_ogl_3577 Gm10:46386101..46387300 Cluster 5
gcaaactactcgatcccctgaatagaataatgcatgtgattttctaacttgagatttcgatgagctttatggttgtgagatttccgtaatgattcttaagttgttcaaattcttttatattccgatgaatgcattgtagtctaggaataatagttagccagcggaaattttcatatcatatttgtatttaatttcttatctctgttctctcttgtccccaatctatattttgatatcttttacaaggtgaagtgcacttttcttttgagagtgtataaaaattaaactttatttttttctctgtatctgtcttattcagtggcaaattagcttacccatttcgagactgtataagcatttataatagtatatgttttttgtaattaacccgactgctcaagagacaagttcaacatagtatgatattaaaaagtctcatcaaatttattaaaatttattttttaaaaaaattattaaaatttatatattttttaatatcctaatagtcttgattgaatatcataatacttatttttattatttaaaaatcttaattgaatacctgaagacttttaaaaaaaatatattttaaaatcctaattaaatacatctctaatttgtattaacaactaaaaatattgatatattaattattaaagaaaataattaaaaatcatttatatgtgcataaaattttactatgttttcgtcgtaactattcctaaatctagttcggggtattttagttttttctcatctccactcctatgcaaaaaagaaaattctgaatttaattaagactcccaataatcatcacaaaaaaaaaaaacacactccgaataaggtaattcttgcgaggatgatcatctctattgagatttttctgaccctatattggttgctatacaataataagaagaggagagaagtaaaaaacactaatgctccaccttctttctccttccctattaacacagtaagtatttagacaataccgttcgggatcccaaccttatgcatttactaacactacatcataattaaaaaaataagtttttataccaagtaatttatactactaatcaagtcatttactcgttgtagtggtgctttcatgacgtggaaacctttcgccatgtttgcacttccttcatctgtagtctctctcaatatatagctgaaatcaacagagttgtctgt

SEQ ID NO: 1379 - DNA, 1400 bp, Glycine max
  Soy_ogl_3702 Gm11:3621001..3622400 Cluster 5
tagaaacttgttgagatgaaagaaattgcgtatgcattttttaaattataactattaacattgatcaatttgtcaatttgtccactcaagctatatgttcatcatttagaccccctaacatatgtagaaatttcgtttggttcatagggaatcccaaatgtttaatagtagcgggtttaaaaacttgttgagatgaaagaaattgcgtatgcattttttaaattataactatcaacttcttaaaattatgcatgaaatgtaaaaaatcacattttagatggagaaactagacacgttataaaacattaattaatcaaaactccaaatcattattgggttgagcagaagaacattgttgccataattcctaatcgtaatttgacaagttacgtcacgataaattgtgtgatcaattgagaatcaaaacaacccttgtgtgatatttgcatggctttagcaaatgatagacgcgtttgagcatgggagatccaagtgtttgatcattttagatgtttacgttaattagaggtgtagattgattggagctttttatatttttgtttcttggttaataatagtttctgggttagttgcttagcataaaatctctctagaacaatcaacaaagatcgttggttcttttagatgtttatgttacaagcataaattgattgaagtttcgacttcttttttttcttattttgatcaataatttataagatggttgattgacataatatatatatatattttaattataaagagctttgatttttaaccgtttagatacatgaaatttaatttttgtatactttccgacataaatgtattttcaaaataaaattagcctttttttttttgtctacatcctatatcgccgtagttaatgtcatagggtttttgttttgatccaaatgcaataggagtttatttgcccaaacttatttgttggtgtgtgtttttgggccttaggccttgttaagcatacatacgaacaaacaataatatcacaattgttttagaaaaagaatatatcaaggaattcgaaaatcatcccattgcatgatcctttatgtatcagacatgtagcttaaattttcataattttttttcagttttgtataaagttagaattagatagatcaatttaagtttataatgtcacaacaaattaagtttatgattataataataatagtagcattatattattaaacattatatataacaacaaagtttaataggcatacgtgataagttattattgtagatgtttttatgttgtcatgaataattttgttataatttttaaagaagttattataaaaattataaatatatcatttattataatattatgatatgtgattgaataattatataaaaaatatttatattat

SEQ ID NO: 1380 - DNA, 1400 bp, Glycine max
  Soy_ogl_6334 Gm19:2177564..2178963 Cluster 5
ggttatataaatctatagagataataattattttttgaccaagggaaaggtgtaagatattccctaataattaattgaccatttgaccagtaatatttgcttgaagttttgagtaagactgtttttataaaacttgatagttttgcataagggaaagagtaaaatagttgatgactgagtaagtgaatatttgacctccaatctaaaaaattctcagggccccaacaaacgcctagctttattaatttatatgtttaaggtgtatttagggcttcatatatatatatatatgacttttaccattgtccaaaatttgccagataaaattcatccaaagccaaagggtcagcctatggtaaattattaaggtaggtaacgaattagaaagttaagaatggtatctaatattttaatctcttcaagccaaaaagcccttgaattactttatggctagtgatacgaagataggtctttggagtcgataattatatatgcatgttctcatacgcaccattgattaattaattaatcaccgtacgtagtgacaccaacaggtgagtgtaattgtgtattataattcaacagtgatttcggaaagaggttttaaataggaaagttttcaaagggatgaggttgtgatgatacttttaacaaaaaaatttatgctatttttacacatggcttatataaagttgaatcgaaaaataagatgtatactagttcaaaagtgatgtaaacgtaatgttaataaaaattatatatacgcaatcatttttgtattattaatatgcctggatctaaagggtaatatacagtgtactcagaagtgagatcccaagacaaacattttggggcaggttaaaggcacataaaatttaaaaatattgagttaacctaacatatacatattttaaatatcttatctgttacatatattgaccaaagactagaagacctagctcgtttaatcggaatctacggtttgcaaacgtatgtgagttgtgacacttagaaggccaacgttaaagtgggaattcactaattaactcgctttgcaattaatcataacggttgaaaacttacaattgtttttttttttttttttctatgcgtaagaattgaaatagaccccctatttataattgttttatgttagagttaaaacaatttggagcttaagttttaatgatgataaataagaaaaatataacactgtatgttcatgataaaaaaaactaataattctttattgtactaattctcttaactaaaagtctttgctgtgtggttttcattcagattaaatataatatcaaaatcaaattaatcttttactgatcaatttaattttatttgacgttttttaatctattatcatcatataaacatgttaactaaac

SEQ ID NO: 1381 - DNA, 1354 bp, Glycine max
  Soy_ogl_4882 Gm15:2928701..2930054 Cluster 5
taacatgaaatagcaatttcgcaaccaacttatttatctaattaatttaatttaatgaatttttattttaaagatttaattgtatactttattaaaataagttaagaaactattatatagaatttattaaaatattaaaataaattaaaaaagtacgtgaagatcacaattttttataaaactaaataaaccttttaaaatgtttttttaagtgtgtcttcaggtgaaaaagatttacaaatttaatttaaaattaaatagattaatttataaaatcagttaaaaagaaaaaatataataaaattaatatagatttttaattcaataaattacacaaaagttactccctacggaccacaactattaatgtttaatattgatgtacacattttaagaaatgtttaatcctaaccataaattacatagtttttctaaataccctcatttagtatatatgttaaagaaagtaattaattaaattttaaaaatttgtaaaatatcaatagtttaaaaaaaacatcaatgattttacttttagaataaaaataagtagttaaaacatcaattactttttattaaaatcacatctaataatttattttgtcatgttataaatatgaagtatgcataagttatgttgataaataatttttgttagaaaatatgagaggtcattttaatgaggtttcattttttcatttataataattatttattttttggaaggaagatatctttatagtcaaatgtcatagggttaactttctagatgtagatatcaataaagtgagttttaactctcctaatagagttttttttcatacttacaattaggaaatcaaacaaacctctgtcatcatgcttaaagaacttagtcatttactaactatcttgattaggataattgaagttgatatcttatttaaaatattcaaattaatagttgataccttatttaaaatattcaaattaattttactcctaccaacacttttttcatccacgtttgatcacatttaatacaatggtcaaatattcttctaaacatgagtgtatatggaaacattttcttacacgttgtttgaatataaaaatataaacaaaagaaaagaaaaggaatgatataaactaaaaatagagaaaatgaataaattttacaaattatttggtttgattgtaaatagagaaaattacttaactcaatgtgttatttaaaagattttacctagtttcatttgcactaacacttttttcatccagatttaatcatatttaaaagaatggtcaaatatttttataaacacaagtgtaaatggaaacattttcctacacaccgtttgaatataaaaaggaa

SEQ ID NO: 1382 - DNA, 1241 bp, Glycine max
  Soy_ogl_641 Gm02:44294960..44296200 Cluster 5
cataaaatggtacttcataaatatttgattcagttacattaatgagttttatatagataaatttgaatttaaaattcaaaattcattatttctgcgcatgcaaatatttatgagactagaggaaatttaatttagcataaattgttgagaaagtataaaaatgtattatataaacgtatcaggttttattttctattcattatacaagattttgatttttttttcctctaaaaacattcccttttccttgcttctctataaattaaaaaatatggatggatgaagaattaggagaatagaataaatatggacaaacaatcgtattctcttttctttgcttctagttttttcatccaaaagttgtattggaacaaatttcttctaattcttcttcttccctgatactctttttttttttttttctctctctctcatttataaaggttttacattttactccaaagaaatcatttgtgtgattcattcacccaaaaatatattttttagccttacttctacatctttttctattttttgcttattaattttactcctataatagtatggtgacatcttctgtcacaacaagtttcaacaactgattcaaaagtttcaacaatattcacataaaaataaacatgatcattttttataaataattttttttacttaattttactaatattattaaaatttatagaccttttcttataataagcattaaaggaaataatttagaagcttacatattaataaaaatatatttatatcaacaaaagttaatattacatatcaattaaaataataataaaatactaattatccatgtattacacataaataatcaatttgtgacggttatatcatcggaggactataatgaatctaggtatttgaagtatatatagtaccagtcaaattaagaataaaaaaatacgtcacaataaaccatctagcttgtattgtgaaaacattctttataattgagaagaatattcacgcttgtgtactcatacgtggattttttttggatgaatacaaaaaatattatgtcatacattacatttataaacctaattaacaaactataaatttatgtttataaaatacgtcaacaattgtattacatagtacatactttttttaattactaaaagataaaagactaaaattaattataacaaaaaagttaaaagatcaagctggaaaaaatatatattaattttggctataatgcattt

SEQ ID NO: 1383 - DNA, 1600 bp, Glycine max
  Soy_ogl_4552 Gm13:38566001..38567600 Cluster 5
attaaattgtttatatacatgttaagggtttatactaacaaatatagttgttagagaaatgctagcgatgttctctctgacattttcttgttgatactctctttatgattgaaaatcactaattttgataaaatttgtttcccatttaatataaataaaaaaatagaaacattggtattatcatgaaaaatttgatatgggtttaatataaaatttgatatgtattgtcataaaaataactacaagaaattggttgagtaaaacaagacaagctctagcatctaatacatagcaagttcaaactctattcattttcttgaagtgaaataaatttaaatacatctataattgttattgagccttcgacttttcctatcttgaattggatatcattcagttttcctaaattttagtttcaacccaaaaaggaaaatcagtgcattaaaaattactatataatatttatattaacaatttatttttttatagacaaaatctatacggatataatttcgatatctaacatttttgtccattagtaaatgttttttttagtgacagaaaaaagtggatataaattaaaacaaaagaaaatttagaatgagggctgccccatctcaagattagaacacatgcatattgaaccagcaggatcccaaccaatttagttgacgcagtttacttctactaattgtggccaatcattgttggctgaaaaggtgaataatttagcaagatgtgttattaggccatgaatgttaaataatactacaaggtatccctgtctctttttccattattaattcctgtatgtagtggtaacgctgattttggaaataatttataatgtctggagcatattttgattaaacattttgatggctcttcctgcctttcgttattgtgagcttaaacacctgaattaacaatcccgcgcatataaaacaatgaggaatgctagtattcttttatattggttttgttttttaattaatgtttttttctgatttatattaaatgagaagtcaaatttattaaaattgataatttttaataaatttcaatcaattataaagagaatatccgaaagaaaggatcaaagacagggtcgctggcatttctctaaaataattaattaatcattgaaatctaacttaagcaaattaaatgggaaaaaattaatattaatctcttgtaacctgtgataatttattatgcaaagttgcttgtaatttgtggcttttgtaaatacattttttttttttatgttttgccgaaatgttttgcataactaaattaagttatgcctttgatgatattacatttaattttaaattaaattaaaaattatttcaattccatttttttcaaacatcaaaagcattttattttaaaaattaaaaatcacaaccacctcaaacttcgtttgattatactcacattaatactttattagattttttcataaagcgaaatgatcatattgttacaaatactgctgcacaaactcgtgtgatgatgtgggatatatatttttggtcatattctctaatgttatttatccattaattaatatgctgcatggtcactatcctataaa

SEQ ID NO: 1384 - DNA, 1595 bp, Glycine max
  Soy_ogl_7015 Gm20:46316246..46317840 Cluster 5
tatttaatatctttattaaatctttaataaattcatctttatgcttgtcatttgtctaaaaatcattatatatattatgattaatattgctgttactaagtttttatcaaatttctaaatacttcttataaaaatatacatgaggtgcaaaatatatatatataagtaatgtgtggtggaggaaaagctaagtcgtctacgctcctacatgatggcattatattgcgaacatcgtgcattagagagatcatcacggcatgactagtgacgtgccgacgggcatgcaggggtaattaaaatgataaattgagaaatatagctttatttagaatgttttaattaaaaatatgtttaaaatatcagacaaactttaaaacaaaaaaccatatctaatagaataccttccttaatagatagagtaagtattttaaaacaatagactttcaaaatatttataaaaaaaacgtagacgaatgagaaaaatattagaaaggtttgtattcatttaaacatgttaacatttacaattttttttttgttataaaaacacgaacggggctcggaatttttgaaaaaaaaaagtaatatttcttgttaaaaaaagtatttaaaaattcaagcctttttgttaaaaaatatttatgataaactaatcaaggttgattcaattaataataaataattcatatctaaaaagaatgtggttcaatttttaatgagtattttattgataaataatttataaatacttctataagacttgttccgactttgataacttttatgatgaaattaactcacctaaagttttagatataaaaaaaatatatttatgataaaaacaaacacagaaataaaacctaacaagtcaaaactaattgcatggtatgatttatattgagtctatatatcccatcccataactaaataaaaacacgtgtacatgactaaataataagatttttttggatatttttttcataaacacagagaaaaatataataaattcaatttatcctataaattaaaataattcatacctttaatttttacaaagtattttcatataatctcttaaataactaagatacatatattaattttaagttatgattttttattcatattatttttattttatcttccataagtatttacaaagaaatttatttaaataaaattatataatatccaaaacatccttaacccaatattaaaaatagctaagggtggatcattcaatttagttaggatggcaccctctttccaatattttccaatctttttttagaaatatacaagtgtatttgataaggcagtctaacaacttataagttgatttgattataagtatttatgatttatcccgtctcattaactcagtcaaccccaaagaaatttttgatggattaaggtttaagaaattaaatctgaggcatttgaataagagctcaagttatatttgcactttatttcaacttgatccaatgtcatatttttttataagaagtatagttttgacgcaacttcttgacttaaatgagtagcgttctgcttgacacaatattttatacaaattgatattatttatccta

SEQ ID NO: 1385 - DNA, 1100 bp, Glycine max
  Soy_ogl_1363 Gm04:43650096..43651195 Cluster 5
aacagaataagattttttactttagtatctttattttttgtgcattatttgcttctattaataaaaatcataggctttgtaaggaaaaaaattatattttctttcgtaatccttcaacatccaaaataactagtttctaattgttgaaccggaggataattctaatgcacacaaaaaaaaatctattattattattatcgcaatgtaattttatttacaatttattattaaatttgcttaattgcattttaacattaactttataaaagagtaaaatcagcgcaataatattagaatttacagtatgcaaataaatttgaaaaataaattaatttaaattataaaactagtcgttcaacgagctcgaagtgacaaatttcattttgtaattacgtattccattcatttagttgtataagctagctaacgcttacataactaaatctaattgaacaatcattcaattttaaataagtacatggatattattaataattaataacataataatgcaaggaggagtaagtgggccctctgctgtaacttcagtctatgtcatatttcaaattgatttatgaaaaaggataaagtggcatgcatacggtgcggttactggcatcataataaatagtacaacaattgatgtattattttttattagtgtaattttttatataacttaatttaaaaaataaatttaacctgtaattacgtaataaattattttgattttgttaattttcaaattttagagatattttttccaatgttcattagttagtgattttttttttcacgttaagtaaaatattaaaaacattttcatatattttaaattgttgaaatcaattttagaacgaaaaataaattgatacactatggatattaatcaaatttcaagtacctcttgaacaaattttattattttatcattatattttcatcaaatagatccgtggctctccaagaagctctctcttggttaaaagatatgcagctgcagaataatgtagttgttgaacatcctgtatccgttctttatgatattaagaatatgtttatcatatttttacaagagtttaatgcgtaagtaatcacac

SEQ ID NO: 1386 - DNA, 1300 bp, Glycine max
  Soy_ogl_4843 Gm15:857701..859000 Cluster 5
taatacaatttttcttgttgtgttgctgataatatctttcagtgggattttatggtacctctacaaataaattgttttcatgcgtataagaatggacctaacattagtcgtggggtcagctactttaatggcatcattctccagtaaagtcccttaattagaaaaaagttagcgtaagactatgtgctgcaatccatgtgacggttatttagcccttacttttcaattttccaatgaacccaaaacgcgtgtctttacttttcttgctagtattagccatgtagggggttaaaggatgagctgttgggaccagtttttttttatttttttcttcgtacggaaaaaaatactccagtacaggacgattataatattttggatttttaatatttttttagaattccgagagtccttctaaaatctgaaacttatgattaaattgaaataatttttacgatcattattaagctgtaacaagttcacgtgcttgtggtagaagaaattatagtttagtaacttcataataaattaaatcatttgcctctataagaagaatgaaaattaattttaaatctttaatcacttatatcaatttatatatacgagtttcaattttttttatatatacaagtttattttattttagtaataatcataaataaaatctttgactttttagtgaaattatgaaatatctctacaagtttttattttatgttgattatgggactaatctttaatcaaaacttaattatatcatatatcaattttaacatcatataaagttaaactatagaaataaaaattataaaattaaagaaatcgatagatattttatcaattttaattctatgacttttcagttggagtatacgacaaaaattaatgcatattttataaattatatttttgaaataataattagatataatatcatattgtataaaatatctattaaagcaaaagtgattaatgcataattatttaataaaatactaatgatactaattactataacaaagtaggtttttttaaaactaaaatattaattttgagaataaattaaaagtagtatttttttttcacacacaaacatgagatgaaatgcttgactacatgcttaagggacaaaaattaatttatgtcacaccattgttgaattgaatagtagttgtaaactacttattctatctattgcaaaataatagttaatttagagtattttataactatcctaaaatctagagaaaataaaagtagttataaaagtaaatgaggttattatttttaattaggtata

SEQ ID NO: 1387 - DNA, 1200 bp, Glycine max
  Soy_ogl_6498 Gm19:42169501..42170700 Cluster 5
tccagttgacactgaacatgtttgatttccagtccaacttattgtgtacgaatttcgagatcaaatttaatggttcgccgcaaactgagaaaagatgggatacttttgtaaattttattttgacaccaaagtttgcaacagatatccaaacatatacttaattcgaaggttgttttgccatttttttacttattgttgtatgatttgggccatcatttgaaactgagtccaagcacgtttaaaattctaaatgtgttgggcttggaaacaaagtccatgtttgccttgggttgttattcaaaatttagtccatgttctccttcctgttttcttttaaccagggttagattaaaaaaaaaaatattgacattgcattattaggcttgattcaaaatatcaaatgcgtaagaaattaatgatttggtaaaattaatgactagtagctttcccccctctttagaacatgcttatttaaatcaataaaccaattaagttagaattaggtaactaagtcaactatatctataatatttccccatgacaacaatttgtttaagaatcaaatattttaattaatagtattaatttcttattttatcaaaattaaatatttctgttaatgaataatccttgtcgtcaaagtcaaaataaatactttaaaaaattgtaaataaaaaaacaaataaagtttttatagatttttaaatttggaatgtgttgggcttgggtcttgaaacaaagtgcatgttttccttatttccttttaatctattttttagaggttatttccttttaatctattatgtttacattagaaataaaaaggtaaattgtaattttcattctttttgatttctcatctgcaattttaattttattatttttcttcatgactttagtgttcatattttaaaaaattcataattttagtttaatcctcaatttcttatatttttccattttaatcaattaaattattcttgatgataccttaaataaaaatgttagatctatgattcaattaaactaaaataaaagaaataaaatatataaaattaaagattgaatcagaattatgaaatttttaaaaatttgagaactaaaatagctagacaaaataagaaaactaaaactgtgtatcaagaattaaaaagatataaaattccaatttattcataaaaatatgagttgacatagtgt

SEQ ID NO: 1388 - DNA, 1000 bp, Glycine max
  Soy_ogl_1697 Gm05:37258701..37259700 Cluster 5
aaaattgcccccaaacaagagttatatttgacttttcaatgtaacattaattattttttctatcaatgttccctaataaatgcctctttagtttttgaatctaatattactattactctctttcaactatttaataagattaattttgttaagatattacttttttcatctatttattagcttttttttaatatgtaaaacaatctataatgatacttatcttaaaagggagagtattaaagaactaaaaatgaattttgctaaaaatttagagacccaaaacacaattacatatataaaaagaaaacttattatgcttttgttagtagttgggtcaaggggtgtggggcaaaaaaatgaaaaaaaaaaactggattagtatcttttcatgtttaattatcttattggtttctttgtattttttttctttttaatctcttatagctcaaaatatagatgaggtgtaagcgggttgtgtctaacacaattcaactcaattacatttttataagttgaattgggtgattgagttgtgtttgtctttacttagtaaacccaattagaataactttggataacatattcatgagtgatgagtttcaaataggataaaatccaaccaaactagaaaacaaatatatcataaaaactatcaattgtctaattctttttatgtgtccgtgtgaaagagtgtgggtaataacaagaaataaaaaaaaatcctaaattctcaccctcattcactcgcaagccgtaataatttattttagttttagtgattaacttaatcaaataattgtaagttgtaaaattaattttaatgatttgattgaatattaatattgagttgtaaaacaatgaaacaatatacactaactattgacttataagaattaagtagcaataaaaacaatattaaattgttgattttgtgatatcttttataagttaaagagatcaagacattttttaatctactaaacttgatgacccaattcaa

SEQ ID NO: 1389 - DNA, 1068 bp, Glycine max
  Soy_ogl_3563 Gm10:46090233..46091300 Cluster 5
ataatacttactgattaaattatctctgtaatttaaattaatagagtagctttctttttttgtgaacaattaatagattttctactttttctaagcaaattttatctaaaaaaattagatttcattttttttgtccattatattagttattttatatagcaaattttctcttctctttttatctctttctttattgtgaaacatgtgtaaaattttatgtacaaaataataataatattctttgtatatattttatacctgcaaaacacaccaaataattgttttttactattgatatatttccatgcctagtaatggttttaaacaaggtttattacaaaattagtataatttatatttaattaagttaattaaatcaaaatagggtaaaatatatttgtaaccttcaaaatattttaaaatattgattttaggttttatacgttttcaatccttaccgcattttaacagaatcacatattttaatttcagtcattaattgaaattatatcctcccttaaaaaaaattgaaattatatcttttttttagtaatatagggacttgaaaattaaatgtatttttttataaaaactaaaatcaatttaatttgattttttttaatgacaaaacatccactcccaaaacaaaaccctacctattgcgctcctgcttccgcgcttaccagagacacgtacatggcttcctccaacgcccaataaagggctatgcatgcaattacatgtttgcaatattttgcttctcagtgattaaataagtaataggaaacaaggtttgaatcaagatacaggcacactctcaaagcaccccttcaaaattgcattttattatttattttatgtttcattccgtaacgtgatgctttacttctgcctgagttttgagttcagaccagacattcctatttcaaaccaatactaaaatattttaaatcttcataaaatgtgtaatataactgtaaatacaacacgaacttaactactcaactatggatttgaattttgaagtgtccattcttgattcttcatatgagattataagctatggat

SEQ ID NO: 1390 - DNA, 1430 bp, Glycine max
  Soy_ogl_6323 Gm19:1765601..1767030 Cluster 5
aatggttaattaatattagatactaatgctagatattaatatctcttaaccactatcataaaagcaactatccactctctaccaatatcaatgactgtcctagctagctcaaatgttataaaataatatcacacctgtcacttttacatatgtcaactttataaattacaaattgaagaattctctacctagacatgaacctgtgccattaacacgatcttcctttgcacctgcgcatctgccccttctttgaatgcatgcattattttagtttctaatgcaatcatcagagcacgtacacgtaacactggtcatatgagtaatcaaaagaaacttccagatattttaaccaagtccatatatgaaaaaatgagtacgtttcttgaacaatcttttgcttgtcaaatagatctcctctgaagatgatattgttactagctttccacatacatagaccgcaccaaatcaatccaaaaacaaatccatttatcactagcttttttcctctcattaataagaacatgttgcaaaaagtgttttataatagaaccagggaatacaccttacaccaaaacgaagaatgtagtagagattgatcctcttccactttgcgaaggggacaaagccaaattccacaattattggtaatatttttctttttaaggttatttccagttgataaacaatctctaaaaagcctacatagaaaatattttatttttggggggatttttagagaccacgtgcctttaaaaaaattattttgagaatcaaagttatcagtgtgtaaataaaatgagaatttaattttaatactaattaaaattatgtatgaaaaactaataaaataaagactattgattaaaaatacatcaagagtaaatagtttatatactagaaaaagtaaaataaattatattatcattcaattataaactgccatattataaaaaatataaaaaaaaacatatatgataagtttgtactttaaatattataccaatcatattttctaattggtcgatagtataattttttttacactaataatgtatagaaattaaaattatttatataatctaattcaattttaaaaaatcttaaagatatttcaaatcttaattataaaattatagattaaataaattttggtccccataaaatttcagattttttggattacagtcctaatgattttttttgtaattttaatttcttgtttatttctattgcttataattaatccttgggagaaactaaaaatagaaaacaaaagaacgaaagtttaactccatggaaattaattatgagtgataaaaataaataaaggactaaaaatatttttttaattaactagaacctaaagtgtgaaattctacacggagcacaatttttgtttttcatttaacctataatagtttacttaaatc

SEQ ID NO: 1391 - DNA, 1056 bp, Glycine max
  Soy_ogl_6855 Gm20:39035245..39036300 Cluster 5
gtttacactcacattgcaccacagttaaacttattcaaatgcaagtaaattattttttttgttcgattttttcaggccgacaattttagagctcactctagcctttttaattggttgtttgggttgggataattttttttacatgtagactgaggcgagacatttgatattttaaatgatttatactcctccattctattgtaattgttgtgtaagagaaataaatttattccaaaataattgatatttctatttatatctcttataatattaatgataaataacaaaatttataaatgagttaatgatgatataaggttaattttataaaattattatttatttatttattattttttcttgctcttgttattttgggatcaggaaatattatgttttattgcatatttgtgtcattcaattaatactttacttaaaaataaaagtaggagtaaaatacaaaatcattataattcaaattactttatattagattgaattttattcaaattttaaattagatgttgaatttagaaaatttaattaattaattaagatatttttttctccttcaaaattgattgaattcaatccatttttgaagtattagcactttttgtaccttgactagattgagcatcgaagtaatttcttaagtatgttattgctcttctgtcatcatcactggaaaagtttactcccttaaacaatgacctatcacctaggaacttaacaaagacattaatttcaataacttaccaacagggacgtgggaaaaaacggaaaatgaaaaaaatgattaaatgtataaaataacttattaagatcccattttaaaatgccagagagaatgtttacccattggtttagcataaactatggctcgatctcttaggctataacaagtaatatcttctttgtgtttactttatgagtttgtttaattttgacttagaccccataagataattttttatttatttttgtttttgtaaaaaaaatattttataagaattaaaataaaaaataattacctgaacgaaaaagaaaaaatgt

SEQ ID NO: 1392 - DNA, 1500 bp, Glycine max
  Soy_ogl_4472 Gm13:36077201..36078700 Cluster 5
tgtttattttaaacctaaaaattggagaaaacaaaaactaaccatattcttaaaactagttttaaaatactttaaaactaaaactaaaaactagttattatttttttaaatttcaaaactataaactaaaaatcacccaaaggcccaaacagaacctataatactaaattgaatttttaaaagaaaaagaatcaaacttataaataaaataaaggactaaaagagaaatgttattctatacaataccaaacttgtaaacataataaattaaatttttatatttgttaaaaaaatatgacatgtaaatattagatttttgtttaactttactagtttgttagtaatcgattcacatatttttttttatgttttaacattgcgagcttttttatttattcagctatttatttttgccattacttattttatgagataaatttaatttacttagattattttgatgataaattatcataaaaaaccgtgtgaattaattattataagattattttaattgaaatttaagtcttaaatttataattatttaaaatatttagaaaagaaacgttacgtccatgttaatctaggataaaatcttttgtaaaattatttagtgatgaataaacgagaatctattatattatataacattctttattctttctgtataaaaaatataaaattattcattctttcttttgatttctacattaattagtctaaatatttcctcccttattagaatcttaaattaatgcaatttatatccttgacatatgacattatataatttattttttatattatttcatcaatttattatgttaaaagatattttcactcacaatacactttagactattgattttacgtttaccatatatgtatacattttgttactaaaaaaataaattaacttgacgtgacacacaagtttggaagagatttatgcatcatttttttaagaagttaaatctagtttgcatccattagttatttttgtcttgctttcttgaagtaggattgtctcgtgggaaaaaaaattgtgatctttgtagtgataaatctaaaaaaattatttagtggagacaaagaaataatccataatattttgaatgacaaaaattattataagattttacaaaatacacaatctcatgataaaaaaaattaaaatacctaaattcctataagtttaaaaagataaactggataaaaatagtataaatttattttttattttatttttaaaaaaatatcttatgggataacacctaattttatggggcaaaaatcataattatttaaaatactcaagtaaaaaaaattacaaggtgcatccgtctttggatctttgcataaaaaaaatataatgataaatttatttatttcaatttttttactatccaatgatgaacaaaggataacttggtttttctttgttttattagattacatttttcattatttctttcgatttctatattaattagtttgaat

SEQ ID NO: 1393 - DNA, 1636 bp, Glycine max
  Soy_ogl_5195 Gm15:50457220..50458855 Cluster 5
atgaacatttcaatcaaattaatatatttgaataatgttttatgtattttttttatttcaaaggaatttattttataaaacttctaaaaaagtcacgtgtacatttaaaaaaaaaatatttttgcatgtattattatagatagattacagatttcactttcaagttcaatttttttttaaaaaaaaaatatcttaatcagctttgtgtctgtgagaaccaaattttaaaattctatattttgaatgtttcataacatacataatatatattttaattaaagtaatttaaaattttactgatattaattcattcaattttagtaataatattacaacgtataatttctttaaaaatattatatttgttttacttaacgccaattaattaacgccaacttgtcaaagaagataaaaaaaaatcatggctcttccctctatttccataacaacatcattattttctgtagtgtctgtagatttattattgtaaaatctatgttggaacgaaattatataacatataatttttttaaaaaaaattgttatattttttagacattgaaaagagagaaatataataaaacaaaatcattcatcttattaaatataaaataacaagaaaataaataaaaatcttgaattattattattaccttctaatcaataaaacaataaaataagtttgaaaaaaaatatgttactcacttcaatttattctttttactgattaattttttaaatacgcttttaacatgacattctagggtcaaaggaaattaaaattgaagttttctaatttcgtattaacataaaaagttaaaacaaaatattatggatatctctttattaattttaaatatttaaaaaaattatgatttataattattaataaaggtaaaaataaaaatatcttcaaaacttaatattattatatattttttctttttccgtaagatagcatttttgtctgtttttgtctttttgtttaatttatcttatctatttatggattgaaaggtaataaaaacaataaaacatttttatttagttcttccaagaaaatgttaaataatatgaatgatttattttcttatattttccttcttttttttacaatatctcccccttttcaaattaagtataagaaatataataaaatttaagtaagtatcgagtttagtgtcatatacacatttatgcttccagcacatgttttatttacagtaaccgatcctatacaatacaaaacagaatttataatgttacataaatgaagggaaaaataatgagtttccttatttattttaatgttagatttctttattttgtgttaaatgtaattatgatcccctattttgttccgttcgtatttttgatctcttcattttaaaattgagacatttcatcctctaattttaaaaatatatgattttagttttcttattttagaaaatttgtaattttggttaaattcttaattttgtctatgtttttttttcttttgattcaattgaaccctaagtttaacattttcgtttaagatatcatcaaaaaataatttaattaattaaaaaataagaaataaaacgtaaataaaattaaatattaaatcaaaattatagattttttaaaatcg

SEQ ID NO: 1394 - DNA, 1701 bp, Glycine max
  Soy_ogl_6237 Gm18:58072500..58074200 Cluster 5
tacttgtaagttgttttaggtgtctatatatgagaaattactacacgattacaaagtattatagtttcaactaattgtgcataacacctaattaaatacaattaatttttttataaattaaaaatctaagtacacgttgtaagaaaaataatcaaaatcataataaatacataataattcatgatcatgtaataagttttcgtccactaaatataatataattctttcttataaatttataattcagtagcctacacattctgacacccctaagctaaaggcacctgttggcatgctacgaacgagtaggagtggctttaaactttatggttcacaaggttgtttgggacctagtctgtgcatgctacggtcatattcacatatatctggaagggattgcgtggtatgaaaaaatttgagttttagtcttaaatttttgttccaacggtaaaagttttttaactttttttattaaagttttaagaatatgtctaatcatcaaaacttaagatactcaatttgaatatcttaaaacatattaaattatttattattcttaagaaattttaaagataaattatttatataaaatattcatttcaaaatttaagaaacccacaatgttaattgaatttctctaacaacaaaagaaaataaaaaattattttttatcttaaaaaactcatcaaacatctttcattatagatgaacttaatctctaaatttttgtttgaccggttaatgttaaactttttttcattaaagtttttagtgcttacaattttaaaaaattcaatttttagttgttaacattatacaaaataaataaaaataataaatttaaaattttatttaaatttaaacggaaatttttaaaattttatgaaccttcatcaatcaaataagagtttagccactaaatgaatttaaaaaaatgtttaggtactcaaaacttagttaaacaaaaaaaaaattattttatctggttttcagattattatctaattctgtcataaaaagtttatctaactaatttagttttaaatttaaatacgacttaattatacaatttaggttaagttaattttaattattgtttttagaaaatcataaataagtctttaaacacttgagttggtttttaattttttaggttaagtatattgtttcatatgaaaattattacaaacgtaagactaatatatggcttattttatgtttaaaattaccgaaagatttgaaatttcatttaatattaaaaacaagttataaaagaatgagtaaaagatgttggctatgacattatatcatattttatcttttactcattcttttatagcttgtttttaatataaaatgaaaattttatctaataatagataacaagatagacacggaaaaattaacactaatccaaaaaaaattgaacattcaaataatcagacataaattttatggagaaaacaaacatgaatgataacattataaatatttatttatattaatacagctgttatgataattttataaaatgatatatatatatatagagagagagagagagatacatataaattaattttatttttatattagatttattttaaaattatgacctgaaaaccaaaatccaacaaaaagtgagttttattatttttctgtttttaacttttaatatttaatttagttgtttgtattgat

SEQ ID NO: 1395 - DNA, 1583 bp, Glycine max
  Soy_ogl_1364 Gm04:43736618..43738200 Cluster 5
tattatatatttaaatccttaaaataacatttttaaaattaattaatgaattaaaaggaataaatttataaatttggaagactacaaaaatttaccccaatataagagactaaaaatatatatatttaagtcttaaataaataaataaaaatgaaagtacattgttgataagaaagacttcaggtatggtatgcgatattaatataagtcaaaaatggtaagatcagttatcaagtggagttgaaggataaaagttgtaaaggaattattagtatatatagaattatagatatatttttatccgttattatttttaattattttgataatttcttttaaaaatataaaaatattgaaaatgatagattgataaagatataaaaaaagttaaattaaatcattcaattgatattaaaagtatgaaagattgtatcaaatgcatgctaggagtgtatttaaatttcaaaaggatatatcagttacagtttgttacttctcttagttattgatattatgttaaaatattaggattgtatttaattagtgatattaaaaccctatatcggatgaatattaggagcttatttgaatgttgaagataaaaaatatatattaaaatttagttttaaatattcagttacaacttgctaaatagttcagttagtattaaaattatatataagagactatttcatatacgtgttagaagagtgaaatccaccaattcataagtgaggagtgtggatgcctaagaaagcatataatcttacacttttatatatagtgaagcaaaaaaatacttttcaaagaaatttatttattataaattttaattataatataaattatatacttaaaatgcttatttactatgaaatagtattttagttagtatgcacaatataaatatttatttttacgtaattaaaatttattttaaataaataaattttattatgactaattttcatgataaataagattttaattgacttgcattttcaatgtaactaatcaaaatttatttttgatatgatttttaaggtaattaagtcaataatttttttttgtgaacattaaagtcaataatctatcatatatgaaaacttatgattcaatgataatgtaaaaaatattaacactactattatatttaaattaaatacattaaataactatatttaaaatataaaatatattttagatttacaattaataaattacgtgatgatatcaaattatttttaactaagaacagtgtataaaaagcgaaaaaccgaaagtaaaaaataataaaatctatatataaagataatgggggcaatttgaaatgactgaaatttaatataacaaaatatgaatatgaatagataataatgtaaaaaaatttcacttttactttctaatttccttttagagattatatatatctactaatgaagttatattattgtttgagtcaaattaaattattataattgagcaataattttacaaaaaagaataatacaactccatattcaaaattaaatgtgatataattagttattcacgtcggagaatacagaaaggactcaagattc

SEQ ID NO: 1396 - DNA, 1313 bp, Glycine max
  Soy_ogl_1381 Gm04:44070288..44071600 Cluster 5
ataaagatattaaactattataattaataatgttgcaacaaaacattagatgacgcgtgttagataggtttgttaaaaatatttgcgttgatttgatcataatataatatagttaaataagtttgtctgtaacataaattatttcaaaaactgtagtaatattattaaattataatataaaattattatgtcaataatataaaaattaataataaaattgtttactaatgaaaatcaattattttcttcacttttaattattttactaaacgtactcactgtttcaaattataggtttttgctttcaaggatttttaatacattccaaacatgctatagcgaatcttaacttaatttttattgcttctctcaaattttaaaattaggtttggttatgattttttttatataattttaacttttatgaattatatttctattgtcacatgcatacactttagttagttttaatttgtatactaaagattaactttcaataattttaaaattataagaactcaaaaatcaaaataaacttacaaaagactagaatttaaaatttaaaaacacaggaaataaaaatacatctaaccttctgtcaaaaaaaataaaaatctaacgttttatttattataggaactaaagattgtgcaagctaatttcacatggttagtgtctgactaatttttaatattgccatttttaatgattttctttatatattttttcatttttttaaataattaaatgctactagaataatagctttaaccaatattttaaacagatcctatataatcgctggaacaacaaatacataactttttaaagtattattataaaccctgttacattaatagaagtttaaaatttttgtatgcgaaatttcgcatgattatacataaatgttgtagcaatatatatacactcgttagtgataaattaatttagtgatcaatatcttatttaattatttttatggcaacttacttggcaagtaagtttttccagtcaaaaagttttatgaggagaaacttttatttttggataatagtcataatactgaaattcagttttggaaaaacattaaaataaatattttcgattatttaaatttttttataaaaaaaaatcttcacattggaagaaaaaaaatcaggtctatttttccttaattatttactctctttttttttctttctttttcttgttatctgtgtcataatcagaactttatttttaattaataattttgtcatgtattctcccaatcgtaaaagagccaaagaaaaatataaaagcatatatttccc

SEQ ID NO: 1397 - DNA, 1105 bp, Glycine max
  Soy_ogl_2255 Gm07:7658696..7659800 Cluster 5
gtaactttcttgatgtatatactttcaatataaaaattatttattaaataatatttttagttaaattgaaaatgttaacagcaagttttcctaaaaaattaattattaaaattttattaatttttataattagaataaaataatttacataatttttataaattacacaaaaaaattgcatattaattaatgcagttatattgatttatataattagagtaaaaaataagttatatattacagccaattatataaaataatttatgtaaataatttccattttaatttattaaattcaattattttttataatttgctgtcaatttttatataattagaataaaaaataatattttcatatattaaattaaatttttgtaattaaaataaaatatgtaaattgttcaaattaaaaatacgtaaaattatgtaaaacaaaaataatactcggatatattaaataaattgttttattttatgaattttataattagaaagaaaaattaattactcatgacatattgatacatagaaaatattcttttgcaagtcaaataaaacaaaacaagtgactcgatggctttattattattgcattaaaagttattggttgaaattctatgaaaatattttttatttttcatttcttttaactttgtcacataaacatcatatatcatttgtatacaaaacaatgaaatttattaatttaaaaaaataaaaagattaaatatgttgagttttaaaaataagagtattaaaattaagaattaaaaaatggaagaataaaattataatttaatttatattttattgattttgattaaaggtgggtttaaactttaatgatttatatttaaatatttttatcttaaaagtgattttgacacaaacaatagtaactaattgaactcacggcaaacttaagaaatctaaaaaaaaaaaaacctctcaccgcaaagtataagtttttttttctggtttcttgatattcaaactacataaagacgggcttcaaagttgcttgcacagctcatttaatacttgacttctttaaatatttaacttaaacataaattatcaattaaagatattattttatctc

SEQ ID NO: 1398 - DNA, 1527 bp, Glycine max
  Soy_ogl_3813 Gm11:9991174..9992700 Cluster 5
gatatttcatttattattagtatagataacatacagtataatattttgtgcggtttacctcaactccggcacaattttatgggatagcacgtgccttgtcacctagttttgcggctaaaaataattttgaaaggttaaattatttattcattctcttatttttaatttaacccttcagttaagatattaaaatggaaaattaaaaatattaataaaagatgtaatatttagtatatggaatatttaaattttatttttagtgggtatatatttttataataaatatcttaatatttaaagacgcgtgttagtatttttataataaatatcttaatatttaatgaggcgtgttattatttttttttattatatctatgttttattcttaatttaaattatcctcttatttttttccattaaaaaatatcgcgaaatattgtttaaacattgacattcagagggttttttaagatgtaccgaaaaagaggattttattccatatacatcacatttttttttttactgaatatcacatttgctatcattactataaattatatattatatattattcagtttcaaaaactataaatctcaaattacgttactttgtatatagaaagttgtttaaaggaaaacttgacccgtctaatggatgttacattattcggacaggattttgtttttggcaaaaaatgtatatgtgtggtttcctaaaaaaatttaatccccataaaaaagaaccaacatatgaaacaatttaacaagcataattttaaaaaatttctaaagaaactacgtactgtaaaattaagaatatacctaaaccacatcgtgtttttattagttttaatttgtaaccaggtgagttatatcaattataccaaattaccaatgaacacatttaaaaaatagttttttcttttcttctgaagacatttaaaaaaatagttaaaacctagataatcatatatcgaacaatataagatattggcattattttatttcttaaccatatattttgttcaagaaaatttaaatataacatttattatagagaaactagtcataattgatagtgtggtttattaaatgatttttaaacttctttaaaaaaaattaaaactatattctcaagttttattacatgactatttaaaggaaaagcatggcaggtgggtttgggtatttaataatataaaagtgggtctcactcgaagttgagatccacaatcacaagtaactttatttaaattgcaataattaattaatataactttactaaaaataaattctatcatgttaatcggtatatattgagagatagtttgtttaaatttgcaatatttagaatgtaatgaattttatgttttcaatgaagttttttttccttcatatatataataacttgaatctgaattaatcttaatcaaaagaaaaagtttaatgactacgtaatatacatataattaatttttaagatatttatgttactcgttaataaatttattatatatgatgcgtgaa

SEQ ID NO: 1399 - DNA, 1123 bp, Glycine max
  Soy_ogl_666 Gm02:45070201..45071323 Cluster 5
ctaataaactaataagtaatatttgtcaattaaaaaaattaatatatgaaataacaacttttggaagtttaaataacaatgaaagagtataaatagcaaagcccctcctcaaagacaagttcagcccagcaggttgtgaaatgaaagtacgttttaatatgtgaccgccatatataaaaaaataatattctacttatatttttatctatttgcacccttttattaaattctattacgaaaatttaatttccaaaataaagagatgtaataagaagaagaaaaatgaaatataaatagaattaccctttatataaaaatggcatgggcaggtcagagacgctttccctgcttcccaggtccagttgttttgtttcattcagtatatcgcatgcaatgtttgttggactatcaatatggttttgagttttgacagctaatatattccactaacacaaaaattacatacaacattttaggtatttttctgttattattaaaaattaacatttgaatttaataattaacataaatttttaaatcaacttatttcattagttaaatcttcagataccactaaaataactcttaaaatactactcataactttttatctatttaactattgtaatatatataaacaattttgaaattaatttaaatttttaattttaaattaaaattaattaatgactatcaactcaaattactaattgttagattttttttaactcaaattaaaattaattaatgactatcaactcaattttgaaattaatttaaactactcattgtgaattttaaattaaaattaagtaatgactatcagctcaaattactaattgttagatttttttttattatagatcaatttaattatatgtttaaacaattttcaattttattgataggatcctttgtatacctaattgatcaatttatatgtgatctaataaatttatgatccataaacaggtttggagtttaagtatatattattttaattttaataatataaaatatatgatgctaaataaaagaatgtgtataatattttcaaattatgaattaatttaagattatcatatttactaaatagtaattgaatgcatattttaataatcaa

SEQ ID NO: 1400 - DNA, 1800 bp, Glycine max
  Soy_ogl_1203 Gm04:3916801..3918600 Cluster 5
acccacgagcatgcttccactcttcccccctgtataccgcccccagttgtgatttttaaagtcctaattaaccatgacactaatacacataattaaaaagaaaaataggaagggtagaaataaaaaaagtgttacataaataaaattaaaaaataaagaaatacaaaagaaatctgtttatttgaataaacgaaaaaaagaatacaaaaaaattatataaaaaattagtattaattataaaataatttcttactctattaataaaaaatatactgaattaagaaattaagtataacttcaaaattggatttcattatatttttattataattttttttataatttttatattataaaaataaattatttttcagttccttaaatcagggagtctaagtttgaatcccaactaaaaatttgcattttccccctcaaatttgaattttttttctgtttagtcactctcctcaaataaaaatttatattttttctttccttcaaattctaggagagaaaataaaaagagcatttttttagaatttaagaaactaaaaaaaattatttagggaactaaaataaatagatctcctaatttaagagattaaaaacataattaaatcttactctttttatatatttcacaaaaggataaaaatatccctatcacacatttcttctcaaccgtacaatatttcatgtcattggatgagtaaaatttagaaaaatttccttttggacacccaaggatatagacacccatatatagggagataaaaaaatataaaatacaaattattcatataattgattatgtgatgtgataagaagataaagataaaaaaatgtcaatagaatatatgtactaattaaatgtccaaaaatcaaaactctaaaatatatcgagtgccattttattccttttctcccattttgattttaactttatgctcttattttacatttatttttgtgtcttttgttattttttctatcaaataccttattttttttatattaggaaaaaaagacactttgtatctttttattttttaaaaataaaataaaataatataggaagagagagaatggaagttatatataaaatgagagtgtattgtatactataaagacaaacatgattgacaaataatctttttctttaaacatatagtaaatgatttgattataagtttgtgcatatgaaaaaatatctataaaaaaatattaactccttaaataaatttcaatgtcatgagaaataagtcattgactttaatttgtttgagatatatcctagattctataaaaaaaaaatactataaactatagagtagtggagttgttgatgcactttaaaacaaaatagatgaatagtttaaagaataactgaaagattaaattatctaataaaatatgtacatcaaatatgggtgtttcctttaattattattaatgtaaacatgttaccttttaacattgggtatactgatcaattagcacacattgttataatttaaatttgacttttcaatatgtagttatattaaatgcttggatagaaaactcagtcatcccatatggaataacttttcatggaaattactagtgatctctgaaatatacatatcttttagggtgaaaaaaacatttttgtagccaaaatgggaaattataatttataccctatttggtagtaagggaataggaccaagatggtaaaataaagagaatgaaagtaatattgattgtttggtggaatgaaaataaaatatatatttaatcttatttttgatatatttt

SEQ ID NO: 1401 - DNA, 1100 bp, Glycine max
  Soy_ogl_1873 Gm06:8854801..8855900 Cluster 5
cttaaagaagtaacaaaaatcattcatatattctattatttaaaacatatatgacataaatgttagtataatttttttattaatcaatatattaccacgatttttatgctcttttttagtaaaaagtaaattttagaggaatactagtgaatactttaaagatgtgtagttaaaacataataaatatataatgaaatataataaatactctttgacttaaattaaattagtcatgctaataagaaatgactgggttttttcaaaaagggcttaaagtaaaaaaaaataaaaagtcacagatacaaatacttaactgccaaatcagccaaaaagtttaacaagtgttttaatgatactgataaagaaatatttaatatatctattagcaccttttaattcttgaaaagtataaatttacttatatgatattttttttttactttcattttcttcagaagtattttttaatgttagcattgtttaatatttttctaatttacatacaagattaatggttttatatattatccctattttgaatataaacattcgttcctgaaaatattatattttttcatgaaaagtatttgttaactcacatttaaatacgattttatttatgtgtaaatattcttgagataaaatttaccactttctacaagaaatatatcataaaacaatataacattttatcaactaaagaaagaatgtaattcttaatacactattgttatttaatatttttttaacttggcccactctattaagattcaaactatataaaattattgaaaacccgatctttctcaataaattttagttttattatatttgtaaaattcaaattcaaaatcaataatttaaaataccaaacatgttgatcaaatgatataaaatagatgaattcaatattaaataatttcagcttaatcaataattttgagtttgagacatgaaatacaatgacattaatattcaaagagataacattgttgctgatagacctctaaatacaatggaccatatagatattgaagaaaaaggcccaaaagccttattggctaaacaatttcattttgttagatattaatatcattatg

SEQ ID NO: 1402 - DNA, 1400 bp, Glycine max
  Soy_ogl_3482 Gm10:40807801..40809200 Cluster 5
gtaaacacacttatatttatgattacgaaataaataatataaattataaaacctaacaaataataatgtatataaatttacaattaaatttattttaatatatttatataatttccaatatattatgtttttgtagaggcatattaatatatactagtatacttattctacagaacatgaatataaatttattagtaaatatattaatatgcactagtttatatttattgaataaaaaatattagaattatttattaatcaatatattaatatatactatataatatattatatataaaatatattttcaatgtatttattttttcgaagaactatactaatatttattatacttctacaaaatataactatattggaattagtataaatatattaaaataagtttaatctaaaatatattatataaatattttttcttaagttaaataccaaaaaattataaaatcaataataatatcttattccagtcgttaaagtatacaaagaaaactaataaaaaaataaatttataaaaaaatatttaaaacaagtgatcggttaagttataattaaaatgtataaagtattaaaaatcttttattttttgtttaattttataatatcatattatttattttgtagtagtaaatatgtgtatcttttttttgttctccgtgcatttaagttatataaaaaatataattttcatacatacatacatacacttcaagtatttgacttggtctagtagttcttgtgttagagttggagcataagattgggattcaattcccaccttcaacacgatgaacttataacttatttttgtagagttatatcaacaaaatctatcaaattaatactaaacataatactaatggcataaggattaaaagtacaataaagactttattttttaaaaaaaataatgtaatcgcaacctctgtaaaaacacatggtcattattaaaaaaaaaacgtaaataaaaacattaaattaaatttgaacggcaaagattaaaagaaaaatgaacatttttttaaaaaaaattgtgattataaactaatttataatcttaattattcatgtatgattgtgtgttttagatttagagttctcacttttcacaataatcagattcacgatttttttttatcacaattagtttacaataaaaaaaattgacagagctcttttcagtatttttttagtgtgaaaccacaagtatcttttcagatacatggttactaactaggctttgacaattatattatatacttaactaaaatgttgtattaattttggtaaaaaaaaaatcttccactaattaagttataattgtgagttatgacttactttaaaatgaatttaatttaaatatatttgatagtgtaaaagtt

SEQ ID NO: 1403 - DNA, 1400 bp, Glycine max
  Soy_ogl_3550 Gm10:45368801..45370200 Cluster 5
attgaatatatgtataagctgtattccaaataatttgtgagaaatgagatcgaataatctccccatgggtggtaccgtaaagtatatcgatgcttaagtcaagaagaattttaatatagtaaaggaaaaagtgtgcatacctaaccttagtgtgactcctatatttatatggtgatccacagggcgttcacgatttttttttattagtaaaaaagatattagagaaatgttaacaaactcttttaaataaactctttattattggataaatcttttaaataaaatttttattattggataaaattgatctattgaaaattacaaatttagcagaattttttttaataaaatttagctgaatcttctcatttaatatttttcaataaattttaaccaataaaaaatatatatattagaatttttaaaaatgttattaatactcctcaacatattatagcagggttgcataattttcaaaaaacactttccggtccaattcaacaattgagataaagatgtagcataaatcttaaaaattagctttgaaatattcgaaatgcactcattaaatacaaccatcacttttttttctcagaaatataaccataacttaaatcatttaattatataggtctttcgggaataatttttttacgatattattaattaaaattaatcaacttaatatttttattagtattaataaattaggttttttatatataggaaaaaaagaattactaatttatattcgcattagatttcagtatataagtcaacaaagttaagttcaattattaaaagagaaatggcaatatataataaactggttataggaatatgtgatcaaatgctaatataaaattattttatattattagtatataacctttaaattcaattaaaaaaattgtttagagatgaaaaatttaattaatccaaattttatttacagtagcatttaatttcattagaaattaattattattttatgtcataaattttgtgaatataatcatctttatgtatattaattattaaagatgcatctctctcatttataatatatattttcttgaaattaatattaaagtaatattttttttcttaactagttatttaatttaagtttcaattttttgttttttaatcaatgcttaaattgttcagttaatattaaacataacaagatatttgtaaattactgataaaacaattttttaaggcttaattattatttttttaataataattgtttgatacatatagtgatagtaattttcataaagatatccataaatagttatagtaatgtcatataatggtttgtaagcaaaatttataataatattttaaatttaaaaagttatttccataatcattaaatttttatagtaatt

SEQ ID NO: 1404 - DNA, 1035 bp, Glycine max
  Soy_ogl_3730 Gm11:4697766..4698800 Cluster 5
gaaaaaaaacaaaggaaatacaacttgaatttgtgtgagtagtgatcttcttaggggcaatatagagaatttcaatcataagttgtgttaatgacaggcacgtgtttgaatttaatgattttattagaggcgtcggatggatggtaatagaatgaaatcagatttggtgttgtatttgttaaaaataagttggtgtaatttgatttctattctacctgtatatacatgggtataatttaattctttcactgatataacatatttttttctcataatatatgtttttatatatatagaagatatattatatgaaaagaaagtattttatataaaactgaaaaaattaaatctagactgtataaatgattaagatttaatgtgaagtgatcacttcaaaaaacatataaattgatattaaatctcaatcttttatatatgattatataatttaaatttaattctcttattcttatataaaatattttcttttaagatattatatatatatatatatagtgtggctaagaattagatttgaagttatagaaagtagaaacacaacacttataagaattaatttggataaacttttgattaaatatttataaaataaaaaatataataataaatgatactttttcaaaaatcaaaatcaacttgtatttttcagcttaaaaagaagctacatgaggattttaaaaaaaatgaattacataaactaattttaatttatgataaaaaaaatcagtttacatttatttattattattttattttcttgagtttttattcaaaagtttgtttaaactttaaaccacactcaaataaatttagttataagtcttgaaaaacttaattagacccaaatataaatgttaattaattcaacaatttgtaataagagatacatatggcactacaaacaagtatagtcaataatttatctcttaaaaatccttttagctaggattccaactattacaatcaaccaggcaaagagattttgtctttttttaaaaaattaaaattatacta

SEQ ID NO: 1405 - DNA, 1076 bp, Glycine max
  Soy_ogl_4985 Gm15:11146925..11148000 Cluster 5
actgatatatgatgttttagttaaaaaaaaaatcaatgttacattaaataccttttttcaagactattcttgatcaatatttagtaggaatagtggataaaaagagtaaatgagttataaattatatagataaatggtatattagaaagttatttaatattttttttgaaatttaataaattagttgtattttttaatacttgtgtcaaaaccttaatcgttgtatattttgaaacatattcaaaatatctaattgtgacttaggagcctactccaattataaaaaaaataaaaatatgttaacaaatccatatatattaaaaatacctcctaattatcatattgtattcattattatcataagtttcaaatcttcaagataaaaattattttaccaataaatattaattgttaatcatcaatttttcagtaggaatattggaactcatgaccttcctcactccttttagtttcttccttgaatactaaaccaatcttataatttcttcatgtaagaattatataagttaaataattttattaaataaaaaaattaaatgtaagtctgcgttgattggggacacaaaaatgattgaataactatattttgatgatttttattgaaatgattgattacaaaatatttttcatttactggggacagaaaagaaatgttaactgcaatattaaaaaattgttaacttgtaagttattaaaagttaaaaaatgcattataagatatttttcatgtacataagatttagttacaatgaatgattgtgtatattcaataattcaattaaagcaggagatctccccatagaccctttattatttattgttatttctagctgcaataaaaagagtgaatgaaacaaataattggtaatgatttaaatttaaatttatatgatcatgaataataaaatattatatcactaacaccaggtgtattattatatattttcttaagagtttattttcaagaaaaaaaaactttaccttattaagctggtatgtgtaatttttaaagtaattatcataaaatttaataaattaattttatatgataattt

SEQ ID NO: 1406 - DNA, 1200 bp, Glycine max
  Soy_ogl_6886 Gm20:40322401..40323600 Cluster 5
ataaatgaattaataatgatataaatttaattgtataaaattattattattttattaatttattgtttttatgtaaaataacctaaaataataataataatgagacagaatgaataacaattatacacataatcagcagaaaaaaaattgttagcaaataaaacgacaaccattcaaaatagagtattgattaattaaacactagactagagcacattatagacccattaagctgaaagtgatactgtgatagccattcgaactaccggtctatcacaaagaaacaacttactgcctgttgtttaaatagtgaattaatttatttgagtttttttattagtgaaaataaaaacaatattaaagatttataataattcatacaccttactcttactcatttaattaaagtatacttcactgattaatttatttgagtttaccgttggattatattttcttttccttttattttagatttatattgttttattttgtttaaactttcatatgataaatacactatttttgtttctatatttcagagaaatatactatttttttaataacctgaacaaatttacatgaaacgaagtaccaaattaattaaaatcaaggtagcttcttaacataacaataatgaagtacaaaattaataaattaaccactaacatttatccattaaaaattaataatgacaattttttcctttatataaaccacatttattcttcacaaaagataattatatttaaacaagagtatgactattatgaatgtatttaatataattttatattcatgacttaaactaaaaatcattagataaatcgaagtaatctcgatggttgatttacatacttaataataaaataaaactaatttaatttgatcgtattatttaactgtgttattttttaaatttgtgtaaattctataaaattgtttttaaatgagttatcttgctctggtagtttcatcaaataccttttcaattctataatatgttatttagaaaattattattcaaatgaaagcctcatacatttccttttttgggatcatgtttgaggttcaacaaataccaagatcaattctataatatgttatttagaaattattatacaaattaaacactaatgctttgtttggattgttcatttttatttgatgcatagttggttgaacacaaattctttaagc

SEQ ID NO: 1407 - DNA, 1387 bp, Glycine max
  Soy_ogl_3549 Gm10:45367101..45368487 Cluster 5
gtattgggatcagaatcagaatcccactacaagtagtaatttactaaagtaattgagtactgttaaaaataaaatgatgataaaaaaaaaaattaaagcaatgttgtaaattattaaaaacaaaaatgttgctaatcggtattttaaggattcaaagattaaaaaaatatatttagtataaaaattatagaaaaactcaaaaaaaaattatggacacgtaattttatgcattttaacaaaaaaatattttaatttcttaagaacatttattaatatttgcctaaaaataattatattcaaaatttcaacagttttaactgtaatttatttttttctaaaagaaaatttgtgctttaaaaaaagagaaaatataatatttaaatcactcataaaagagagcataaagaatacttttaacaaaaaaaataaaaaataaaagtgtaatatatttgcattcattaaaaaagattatatattttatttttaacacatgaaatggagaataatataatatttgcatctctcatgtgatgatagtataaaggatatttaggtaatatttttcttagcaaaaactagtagaaaagttaaaaaggaatatggtgttatatatttaaatttgtcaaggagaacaaaatgtataattttaatataatatagaagaacaccgtaatattcatgtttggtaagagaagaaagtgtaacttatcctactaacaaagatctataattaaactcttgtgtaaaaaataaaaaatttctacaaaaaaaaaaaaaaagctggctttccattatagtatgaattctccttgttcatttaaccaaaattatttttttaaagaatatacctatgtctttgagagagagagaaatggaaacataatgcattatatatcaattatattgtttttaggtgaaccatatatatgcacaaacatgagataaaattattcaccaaccatattatactatataggttgttgtagtacattaatatatgataagagaattttgactaattaaaaatacaattttaagaattttttgtgatatagaacaaataaggatgtattaagaaaaatacaaagaattatattctatgacaaaaaatggaatctcaatcctacatctctgtgcttctgggaacgagaattttgtaattaaatggaattgaaagtatgatactctgtttatcattaaaaaaatatgaaaattctcttgttccaaaattaaatataaaataaagttgattaaattgtgattttgatattcctaattttttaaatttaagattttgattttgctggattttaattataatatttgatcttctagttttataaattagtgattttgatcatcttaataaattattaacaaataatta

SEQ ID NO: 1408 - DNA, 1014 bp, Glycine max
  Soy_ogl_1426 Gm04:46010901..46011914 Cluster 5
actttattttcaattaagaaaatagtcattcttttttttttttttacatcaagaatataaaaatcattaaaatagattctagttttatcattatatacgatgtattaatgtttttttaaatcaattatttatcaattgtatcaaattctatttgtaactaataattgtcatttttttatgtgtagctaagtggaagtggatgttagtataattaacttaagtatactaaacaaacaagttattgtctggcttagtactcccgcaaactattctgctatatttgtagttttccttcagttgaactattttttgtcctcttcctctcttgttctacaatagtatataactattccatgataaaaatataaatattatatgatcatatatgcgatcaagaagttaggttaaaagagatgttaatatttatcatccggttttgcttaaaatagaattgctttcaaacaaagatatttgtggggaaaaaaaatagatttctgtcaaattacatcaatatgtcttatatacgacattttttcttttttaattttatataaatctccttccatttatgtaataacataataatgtgtattatattcttctcgttaatatatataaattaatattctctgatttcttatattattatataaaatgagaggttaagctgatataaaaaggagacatgatgtgtagttgtattaatttcaagagagatatttatccctataaactataattatatatcttattatattgttatatagagagagatattaaattacacctctataaattgtaccaattaatttacttgattgtatagtttaatatctctatagttgtattaattattgttatattgttatataaattgtacatagttgattcacttgattgtttgattgtataatttaaaatactaatttaattttgtaaatatttacttgatattgatttaacctaccaattttaatattaagtaattttttcaaatattaaaagaggaaaagc

SEQ ID NO: 1409 - DNA, 1200 bp, Glycine max
  Soy_ogl_6625 Gm19:49478901..49480100 Cluster 5
ttttatttacaattttctgtcaaacaaaaactttacttgtgattttatttttaaaatgagggggtgcactcaccctcgttacaacgtagattctcctatgatcgtagacatgatttaaaatcaaaattgatttagttaaatgttttttctttgattggtgttctaatcttgtaggttgtcttttttattcctaaaaactgatcttataagactttttgtgtatttatttcctcaaattcaaattcaaattaatcagacggcggtcaagctcgtgaacttacattactaaattagttaatgcaccactagaccattcgtccaacttatttattttagtcacgtgcctcgaaatagcaagcattaatgatatgcacttatgatgcaagcagaaaatgaaaatttcactacttaatatactagttaaaaaacaaaaatcaaaagaaaatttagaatatttaatactaaataagtacgtagtatatttgaaaatttcacaaagagattttagaaaagaaaaacagaagttaatttgtatttgtttataattataaaaaaaattcaaaagaatacgttgattttataagaagctattcaaaacaatttatgattttgtttagatttgtattcttttgattattttaaaaatttgaaacaagcacatgaagaatttataaaaaaaatgtttttttttaattagagttattttaatttattggaatcttttatcaataatttataaacatcttacttttgtccattgttggccgaagaaacttgagcattaattacaatataaataaaataaaataaatagtttaaatgaataaaacatattaaagaagaaaatattaatttaatcattacaaatagaaagagaataccataaaacgttttgacgtttaaaatgagaattcaaatttgtagtataatggttgatttttttttttcaaaattatatatatcggaaattagcaagaaaacgttaccaaatcatttataatttataaattttataaaagatatgatacaatcataacatttaagcatttttatttttcacatcatcaagatgaaacacatcttaaaatctcgtttaatgaatgatcattatggtcatacgctaattagtcttgggattatgtgaaatttcacaaactctctcgttatacacaaatctctcttaatttttgaaaaaatatt

SEQ ID NO: 1410 - DNA, 1600 bp, Glycine max
  Soy_ogl_983 Gm03:39781101..39782700 Cluster 5
agccagagatgcctgctatcttaaataggggcaattaaaaggaaggcttcagagattatgaatatgttcaattaattattactagtacttatctggaaataaacgatcctagtactctctacatgaaatactagtatacaaagggaatgacacgccacacatgtcataacacaattgtacttatcattgctctcctaaacaggggcaacaaaacggcatgccagtgatttttttttcttttatattaactaaaatatctattattatttttattgatgattaatttttataaaaaaatttaattcatcttttttagtggagtctcaaccatctcttaattatatttttttttatccataaaacatgaagataagatcttatttaaaattgaattcaatatgattcaaactaacgatttattagtatgctggaaatatttatgaaaatacccaattgtatttataattagtataaatctcgtgtaataaacgatacaacaaatataaaaacaaatgatgctaagtattgctagttcacattatttttatatttgtcaaacaaaatattttttttttttactttttctttatgataacacgaaggagatctaatttaagtcttcatatatccaatctagtcctccaccacttgattgactctagtgggttaaaaataaattttaccaaatatatttttaaaaagatcttattaactagtgttctaaaaatattgattaagaaattaaaagaaaaaaatatttactatgaaaagctaatgagaaggttcggattattgagaagagaatccttgccttagagaaggatgtgagaagctaatgagaaggctcttgtaatgaaagtaggctaggatgcttggacattattagcactattaaaatgacatgggcaatcaccttttagataatgagaaagtctaactaattaaaaaaatcatattttttgtttttctttttctcgtgtacattgtaaattagaatcaaatacataaaaaatgactaattccttaaaaatctcagttttaataataacaaatatattaaatttgatgagctaataagtttgaatgagttatgcaggacatgcatccaattatgatataagtattatctttctttacttagacacaaaaaattattttaattgcacctgcattcaatacctatcaaaatgcacctcgcccattgaatcatatatacatgaatataaagtgatgtgactttgagtatgcacgtaaaatattatctttttaaaagttatcctcctaccgtatttttaatatgaattttttctttcatacttattcacataaaataaaattaaaataagaagtttattacaaataaatattatcatataaaatttcatttaatgcaccgccttttaattatataaaatataagtttaattctattatgtaatagtaattagacgatgattttttaaaaaattatactatcaataaatttaattaaattatgaaaatattaaaaattgtatttaataattttcgaattttgtttacgtctgacttaaaactagaaagagacgcgtagtaaagtcaacgacaggtgttgcaaaaa

SEQ ID NO: 1411 - DNA, 1600 bp, Glycine max
  Soy_ogl_6238 Gm18:58083501..58085100 Cluster 5
gggaccactgaatcagttacggaaagagataaaagagaggttctaggcctctatcgcgcgcctttggcatgcacatggcggtctcttccaataacttcttttcagcaaaagtgaatgcgagtcctttgattcttgaaaatatccttaagccatgcaaatggccaagccaaaactatcttaatcttttttcatcactattattcactgcagaagaggacaacaggatacatgcatgaggtaaaatggcagtgctcctttgatcttgtattctgattcaaaagcttataaatgttgtttaagtaaaagcttatatttaagatagagataaaacactatgcatttacacatccaatcataatcacaaactattatgtgtatcattgattttcaggtgaaaaaatattttcaatataaaaaaattgctggatcaagatctttgtttttattttgatcattttactgttatccattgaatttacattgaaatgtatgtacaacatttctaactccattccaaacatgtatattatacacgataagtttatttatttttacaataattattttaaaaattatataaatataatatgtgattggattacagagtaaatctagtaattattttacattgttaatgcctagtgtatatataactattttctaaagccatatgatctgcatcaacgtctattttataaattttaattcataagggtcaatttggtagtcaaattaaataggatagaataactcgcgtcatgtttttaatcaaatgttggaagttctcttatttacataattaactatctaatttgataaaaaaaaatattacgtgatttgatggaaaaaaagtaatattgtcatttacacagagttattgattttttttaagaaaatactttgcaataaaatttattttattctctcttaaattttaactttaattgctataaagtttagttttctttgccaatatggtagatttgtataggattgttgtgcaaatgcttcttattgatgtgcgggactatactcgatcccttcacacatattacaatgaagatgcataagactgcaaattaaggtgaactaagaatatttataatgtatgattatttaatgagttatttatcttaaatttatgagtattataatgtcacagatttaaaatttttacataagaactgacttcaatactaaaattattaaaatgagtatttaatttgagtcatgctaatttttgaaattgaaaaataattatttaatcaataagaataaattaaacaatgattatttatataaacaacactcacttaggcaagcgcgcgctctcaaataatttgttcctataataaaaatttgttaagtaattcatgaaacactcattaaaaatatcctaagagtgtctgcaattaagaatagctcaacatttcgtgataattgtaaaaataataatgataaaaataacatcaataggtaccatgacacctgtgatgataataccataagtgtaaacatgagtcttttgaaaaaaaaatgaaaagattaattaatctttttataactaaaaaaatttatgtaaattaaaaattaattcaac

SEQ ID NO: 1412 - DNA, 1058 bp, Glycine max
  Soy_ogl_2275 Gm07:8128201..8129258 Cluster 5
caatttcatttcctcattaaaataaaaacagtcaaaagaatgataaacaaggaattgtttttacgaaaatcaaaattaattttcaatgaaattgattttgtaataactattctatatgttatatggttctcttttattttagttattatattataagagaagtatatataatatataataaattgtttttaaaatctttttttgcacaaatagcataaatctaaaaaataaaaaacaatagaaaattaaactaactttgctttatgtgtatttgatagtgtaatgtatgaaggtcaaggttgccagcacgatttaatttgtcccacttgcatcacccaacggaaactaatgtgtgcctggggaaggtattattttcttggagtagtatatatatggtcactaaatatattcttctacattcaaagtttgtagacaaaggggttgttgctctcaatcacatctttttctccaaacttacttcttcaaacataaacatgtactgtctgtcacggtaatgtctcagtaaaatattctcgacctaggtgtcatggatgacatttttgtacatttgagtaagatattgtaattacccgtattcataattatgttttttcataataaaaaaactattcccgggctatacttgtatatgattatcaatttagtatttatcattgtattttaaatacttatacttttttataagcaaaataaaatttattagaaagactatttggattttggagtattctaacccaaaagacaaccagtcagactacggaattttcctgatacaaagcacttgattcacatgcctgttcgctaaaatataaccatcacctctttcgagacaaaccaatattctatgaaaagagttttaatcatgcttataatataaataaataaaaagaaagaaatcctttaaaacctatttatttcaaactagactatatcaagttattcaactattgaagttatttaaagccactaaaacttaaacatcaaaattaattaaattaatcaatattttattcacaagttatttaactcatgaaaaa

SEQ ID NO: 1413 - DNA, 1600 bp, Glycine max
  Soy_ogl_2632 Gm08:12412401..12414000 Cluster 5
attgtgataacacaagtcacacaagatatataatatcttaccaactattttctatttgagtcaaaacaaggaaacatagagtaaagtctgagcattatatagttttataaaaagtctaatggtcaacctattatcaaagctttaatcttgtccctttattttgtcctccaaggttccaacaacaacaccacagtgccatttttttcagaaacagacttaaaaaataagtagtcaattaactagctttaattaattcccttgtatgtatggtttgatgaaagtaattttatttcataatattaaatatgatactaattaatatataaatataatatgaatgtttttaattagttatttatctatatataatataaaacaaatactgactagcaaatatatattattttgtcaataaattttcttaacacatacgttaatttagatgtcacagtttggttgaaaaatatgaaatagtgtgtagctagtcatttcataaaaatgaattaataattaatattagcataattttttaaagaattttatgtaaaactaaagttatattaatcatggtaacattttttttaataatttgtttaatcctaatagaaagtgtggctacgcgaaaattcaattaattgcaagaatgaaaaacaaaaacttgagtagaaatactcatagttttaaaactcacaccactcatcgaccagatgagtactggatcagtaattaaaccacacatcattcatgaaccgtatatgcattaaatttataaatttcttattaaatataaagtatatgaattttatttaccatagctacgcattataatattttgttgctgaagtggtaaaatgttttataaggagtgcatagccgctccaggcgaaatttagttgatttttttatatttattatttgatttgaagaagcgtatggctttggtaggagcatgggtgcagaaaaataatctagggaagacctgagttccattcccatacaatatattattgagaaagaataaaaaaaattagatgtgattaaatccctaataaaaaattagtgtaaaacaatatgatacatcgggattccaccatagaaccaaaagttttaattatagtgttccaacaaaattacgctggataggattgtgtgtaaaacaatatgatagattttggggaaggtctttcggcaacgtttaataatttattgatataccattttaatacccaataattgaatacccgaggttatagatagaacatcaaattattatgagaaatcgatcttgatatgagtaacaagatgagaggaccaaattatatgatttagttcaattttttaataattagagaatcaattaagcttgaaaaataaattaaaggattaaattaattaataattaatcctcatttttaagtaagaaaaagattgaggaaagtagctcttgtataatataataaagagagacagagatagaccgcaaaaaatattaatgtcagtctattactcaaatatgttttagattcttcataattgattgatttttatttaggttgctaataatttttttgttataatggatctttaatatataaaaact

SEQ ID NO: 1414 - DNA, 1600 bp, Glycine max
  Soy_ogl_6448 Gm19:39207601..39209200 Cluster 5
aattgaacctaaataataaattaaaaaaataaaaaaatttatttaaccttatatatataacttttcttttaaaaacattatcaagaaatcaaatttaataactaacaaatttataacaactcacaattcaacttatgtctacaaccagtcaaaaaaattagagagatgctatttgttcggaaagataaatcacactaattacatgaatgtaaaaatggacggtggtgattttttaaaataaatattaagagatttgaaaaacatgtaatgtgtagggaaattcacatagattatttgttgtgcgcttatgatgaaatctgctctcgtaacaaataggattttccaaaaagttatactttacaaaattgattttaatggttatacaatgaaggaagtccttaggtccttcatatttttcgggtcacgtgtaaacaaagaagtgtgttaaaagttttacataactgataagtttgacgtcaaataaacatagtttcgcaacccaacaaatgaacttaaattttttataaaattcagtacattagtttcaataaattataaattaaacttgagaaaatgttttgatccaaattagcattgcagctgctcggctgttcctatgcacacatcatcgccgagactgaagaaaaaaaagagagagatgttttcattcccacgcaaccagatgctagatttctaaagaactactatttcgccttaaattccatggaactcgcatcaatgccaattcagatatttaattaattcttacttttcaacattttccatagaattagtgccaggagagggacgcgttctggactctgtttaacgtgcagtctactattcttcctgaccccacaattaccttgctatggtcataaaataaaaggggggaaatctagtatatgtgctagctttgagttgattattcatgaaattttaacatatctttgaatcatttccgtaaacaagtttgtttgctacgtgcatttattttagtaatttataacttattttttataagttatttaaagtagtttacgaagataagttagctaataagtaattagacggttttgttttctcaatttttgtttttgttttaaaacagtattattaaaaatatatttaaatattacaaagtgatttcaaactatataattttatttaattaaattatatttttaaaaagaaagaaaatttggttaaaaaacaatataaggttattaacttattataaaataatttcaaacaatataagtaaaatatcataattttaccatatttttgtaatacacagttaaacaatttattgtcctaatttttaagatgataaattattagaaataaattattgtgtgtactcttttacgtcatttcaaagtttattagctaacttattacttaatcttgccaaacacttttagtaaaatgttcaatatctttagaatgttatattttaaaacttaacattcgttgtctttttgaagggctgagtgataaacacaatttgtgaccttgatgagttgttcttgactacccataagaaaaggttaggctagttaattttaagaaaaggttaggctagttaattttaaag

SEQ ID NO: 1415 - DNA, 1300 bp, Glycine max
  Soy_ogl_431 Gm02:7046201..7047500 Cluster 5
tgcagaagtaaaataattaatagaaaaaatgcttttattgaatttttagctgctttttaaaaggatataaaaataaataaacaaattaaaaggagatcatatcaaaagaacttatcagatatagatggatcaccccacaaggttcaccatagagtaataagattaaaaaaaatcctaatgcataaatatattttataactatattttctttaattaaggtattttaatacaattctaataagctggaaaataattaacgagtttaaaatttatgcactcttagtgtaataaatgtagattaaattattcacgtggtcatttaactttattttaagttataatttgttcttcaattttttaaaattgtaaaatgactccttaagtagtgtcttttatagcatgtttatcatttttgaaacattgataattttttatttattttagaacacaattttaaaccttttttttagttatttaatacataaaatttgtcttattatactcacctatataaaaactgtgaaatccaactaattttttaataaaaaaagacataaatatgataaaaattacatgaaaaataattcttgtggacaacttttcattgattttgggagattttttagtttttctattgttcattgtacaattttcatataatattcatcttctttgtgtctctttttggttcaaatattagttatgtttcataatttttatgtaagtttatctaataagataaattttatattttgaatcaataaaaaatattcaaaattatactcacaaattaaaaaaagatcatcattacttataaggatcaatttacaacttttaataaataatatataatagactaaattataacctaaaatcaagttaagggacctaataagtaattaattttatcaattttttgcattttcaatcaattaacaatcatcactgatgtgatttttaaaatattattagaaaaatcaatgcattaaaataaaattattttatattattagtacacaatttattttctcacaattaaattaaaattttaagatgaaattgaaatcattattactcttaacagctcataaagttggacatataatgcgaaacggaattccaattataacaagcttgcatactgtttttctataaaagtcactcagcccaatttaatattccttgaaattgttttaaaacacagtcacacatgcatgtctcaagctaatattatttattagtatatgtatagctttctgtcttctcctttgttcattgaacatgtacagaatgaaagaat

SEQ ID NO: 1416 - DNA, 1354 bp, Glycine max
  Soy_ogl_1659 Gm05:32321447..32322800 Cluster 5
aaattttaaaatataagaggagtcaactagcaaattaaaaaataagagaacatttgataaaataaggaaactaattttacaaattagacctattttcttgtattttgaaatggctgaaagagtcaacaataagaaagaaataaggaagaaagtaaccataggcaaagtcgtacttcccttcctccaatcacgtataagtctattttgtgtttaaaattcaagttagaccaagtattaggatgtaacaaattaaggtttcgacgaagcaaacgtagaataaaaaaatttaaaccttaaaatttcatgtactaataatatatactcacatagtttttaacaatgtctctctccacgtctctcaatatatataaacttatgtaggtatttaataaaacttttaacgtaaaactctattgttaattagtattcaaaacttaataaaaataatttcaacaatccaacatagaatcaatcgaccagtttaattagaaatttggcgaattaatgaattcaacctgttttttttttttttttaatagagaaactattaaagaagcggtggaagtagtcagtatcgcaaaaaatagtttggaatttttctttttttattttaacctcttatctataaaaaaatattgagacaaaaggcctagaaataataaataaattgtcattattcaatattttaattttatggagcatacagttaatatctttttcaaatattattttatttatttttttattaatctactatttaatttgctatgtaatctttaaaatatttaactaattattaccaatataatctcagagtgattcatggaaaagaattttttttatatagataacaaatatcttttaggagaaaaaatcttacttgagactagtaaaatcatccaaaacaagagaattctttcttcaaaatatttattgcagttgcatattgaaaattcaaaattgaaacaactaattaaagtaaaataatttgaataaataattaaatttttctttgaaaatatgatacattgacaaattgatttctaaaaaatgaaataaataactttagtccaatatgaaaaaaatatgacaaattagttttgtcattaaatttataaaattattttatgattaagttataatattcaataatcaatttgataataacttatacttttttagaatcagttaaaaaaagtaaggattaattagttattaaaattgaatacataactaaattcttacattttttatacattcaataattaaatttaaatgaacaaatttgattatttatcaaaaaatttcaatccataaacttgaatcacttgatagtgtgtagataataaattat

SEQ ID NO: 1417 - DNA, 1520 bp, Glycine max
  Soy_ogl_2463 Gm08:21221..2150400 Cluster 5
ccacgaaagaaaaagtaattaatgccccttttgattaatttttcacatcaacacttatgcagggaaaataattaagcagataaattattaaattgagtttctagcataatttttttaagatataaactttaatatataaaccatggttattttttttattaatcagacctaaactttcatgctttaattccacacatgatatgtttaaatgttttcttccactgccgtacaacacatgcaacacttgctttaattccacacatgatatgtttatatgtttaaatgttttcttccacacggtccatgcatcacaacggaattacaagtaacgcagacgaattgaataaaaaaaaagtggcaagcaaaaactttatttagtttaaagaagatattggtaaaatatttttttcggacaatattttaaatcatatttttgttaagagtcaagtacatacagaaaaagatatcattactttaatatattgtgacattctttaaaaaaaatcaatttttcttaattaaatgtggagaataattataattttctttcattcatttgcttggtaaaaaaataaagtttatttatttattcaaaaagaaagaaatgtatactttttagttatggataaattttttaatgaaacttttatataaaaaaaaggggatttgaaaataattattgaccttgacaacgagctgagtaaccacatctcttatcatgtgtatcttggagaatttagaaccacatgattattttctcaaaaaaataacacagagttcacgggctgttgcacttgaattaattcattttctttaaaatgttttttttttcaaaatgaaaattttgcttttttataatcatcataccatcataatcggctttcttccccccgaaatatactgatcatcaacaaagcatcatgttggaactcgtctattttttttatttaaaatattttaatattattttctactacgaaaacaaatgattttaataatagttatttcacttttagtataaaagtttcacactaaaagtgaaatagctaaaaaattaataattaaaaagtttgaatgttaataataaacataggcaaaggattcatctggggcatatttgtttattcttttaaaaatatgatttatttttaagagattcttatataagtgattatttaatgaaaaaaaagcttaaacaaccaaaaaatcattaaaaaaaacaaaactttgatttctctctctcagatcttatcataattaatggattttccaaagaaacagtttcaaattgcttctaaagaaacaaaattttggtttttttttcagccaaaaaaataattattaacagggtagcaaaggtaccaaagacaattacgtgttgtataattaaagcccccatgcagttatatttgccctgcataaaatgtccttaattatcaaaggcggtcagattattttcgaattctggttcttgaaaaaagcttactaacactttagaagtttcaatgagtgattttttt

SEQ ID NO: 1418 - DNA, 1300 bp, Glycine max
  Soy_ogl_91 Gm01:3756901..3758200 Cluster 5
ccaaaagtttcagatcattagagtttcttttacgttttacctacgcatgttgtataaataaggtagtattttctatattaattaggaattaaagactcaattgaacactaacataatattaaaaaaaactgaaccataatgattggttcaattaataatgagcgaacccatatgagtgctacaaaaatgacttcgatgcattaataaatattaaatacaaatattttcaacaaactcaaacaaatagaagcgataaattattatttttctcaaataataatttatcacttctaaaaaaaagtttagttagtaattaaatttacctatcattttctctaaggcaagttacttgtccacctaaaggtcaaagcaccatcaagattaacacggcatgttatttttatgtgcatttgtcaattgtatatttcatgcaagtcttataggtacatctcgcactcttttatttaatcaatatattttattttttctgataaaaaaagttggattattaaatttaacgtgtctatttagtttaaagtttggtataataaatactaatattttaacattaaatatgattgagatgtgtgtttaattaacctgaatcaaatatttatattaaaatgtaatgtatgttttttcatcaaaattatcaagattaattttctaattttataacaattaattatgctttgaattgttgtatgtaaggagtttcatattttcccaaatactataactgactagctcagtctaatgaaaaaaggtttgaatagtttgtatttataaggttttaaatttaaattttattgtctctgttgtacacaccaaaataatacctttccctgtgcttttaaaaatcatcgtcaattaattgctcgtttaaactttagagtatataattatgtattataacttattttcaatattgttttggtaatgtcaagtttcttttgataatgtattttaaatataaataaaaattaagttacacatatacttattattcaatgagaaaaaaccattccatatcctagtaaattaagcgtctacagtaattcttttataattagctttttctttgatgggtgaagtgtatacattctctgaaatagagataaaaaaaagttgaattaatctatagatatctctgaattatttgataatttttttaggttattattattttttaattgggttattgaacttgtttttatttttcaattaggtcattgtcgttaacaacatgatttaattataaaaaaaattcaagttcaggtactcagttaaaaaataatta

SEQ ID NO: 1419 - DNA, 1572 bp, Glycine max
  Soy_ogl_775 Gm03:712601..714172 Cluster 5
tttttttacacagtagcagcattgaggatttgaatgacttcttgcatctactctaactccatgatcctaagatggattttgctctccaaatgaagaacgaaacggcaatcagaaaatatattaaattaaagttgagacagctttaggtaaagccaccaaagtaacgctctgttgtctaattttacataaactgttcacctgtgtaatgaacacaagtggacattttacttatgtttttttaaaaaagtatgatatatgttaaattgactttatttatataaaatagttttataaattataaatttttgtagacatgttatactcaataggaatttttaatttaatggttagattaatatattttaatatatagaaagaattgttgaagataataactttactaagaattactgttgattcctcatcttttaatatatttatataatattttcatattattattttagttaaaaatgttatttaaatcaaagtaggcaatgcgaatagaaaaaaaaacagactttttaaatgagtttgagtgacttgacttaaatcagtcaaacattaatatatataacttccgaataaaagagtataaaacaaaaaatatatataattaaaaagaattttgcttgatatttttgttttatgagtagaattgcttaaaatttatgttcacttttcatgtatccatctaatatttaattcttattttccactaaaaatacgcaaagttagaagacgaataaaataaggaagaagttttctatcatgtactcatagacacaatgtaaaatttttacgttactaaaaaaataaactttgaataattaattagtcttttttataagattttaaaaaaattattaattactatcataaactccataattgtgtaatagtttattatattttatcatataaatatgatatgtatacattgctttatttcttaaaaagtgcttcaagaaagagttagttgtgtgaaatctaaaaaaataagtaggtctgtagatgttaattacagtagtatttttttttacaagacaatagtattaccattattgatcacgatctttaccccaaatgggacgttattataaatcgggggaacccacttttcaagtaagtacttaatagttaatgtgctattcaccaatcacttaaaaatttactgacttcgatgttgaagtgtttttacatgtaatcatcaccaccactacacctatatatggtcaactatcaatagttgaaagtttgccaacttagaaaaaattctgacgtgacgacatgcccgaggatcaatacccatgtaatatgtctaatttttttttttttatggaagaatatgtctattaattattcaactctttttttttacgtttaaaaaagtaaatttaagaaggttgataaaataaattaagaattattattattattatatactccttttctcatgaatattttaaattttttgggtgacattaattatgtcttaaatataaaaaaatacacttattaaaaaattagttaaaataattaattttattaatctcattttaagtttttttc

SEQ ID NO: 1420 - DNA, 1100 bp, Glycine max
  Soy_ogl_792 Gm03:1603201..1604300 Cluster 5
ctagaatgtttttttattaattgaaattttgaaaaaattatactaaaggtgtatgaaaattgaagtcaaaataaaaaatgctaatataaaggatttaatttttatgcattgcaatataagaatttacattatcaactaattacaaattgtaccaattatgatttctaatatagttatatacaagtaaaatatattttttttatcatgcataataatatgtaattgaatgatagtataaaaatcgtttacattaccagtgtgtttaaaataaattttaatataattctagatgtaatttttaatttgtatatggataaatttgaatattaaacgaatataattttttcacttttgttataaatttcacttatgcaaactacatcacctatcctcgtttattaactttttttcccttgtctccaaaaaaagttacaaaactaaaagaaatttgaattatagaaaaaagcaaaacttatgcaaattacaccacctattctcaatatttaaaatacaaaatttaacaatataaatatataaaataatttattttttgatatagacttccttcatcatagataattttgtttgaatcaagtaaaattattataaataacaaaactttcatttaaagtatttaacaactacatactcaatacgcaagacacaaaatcaagaacactatagttaagttggatatatagtacaatttactattgaatcaacaactcttaaatgtcaacacactttctaatataataattttttcaacattttttattattgaattgactaaaatttattaaaagttacataattttttgggtcttaatgttatgtttgatgaattttattcatagttttataatttcaactaattatagattgtgttaaaaaaatatcgtatgcttcttttttattctatcatactattaagacttttaattctttgataaattttaagtatgaaattaattattatttgagagacttaatcacatttaaaatttcatattcttttaaaaatatattctaggaagattaaattcaaattttctgtgttactaaatgagctatacccattaaataaatattttatgctt

SEQ ID NO: 1421 - DNA, 1098 bp, Glycine max
  Soy_ogl_1365 Gm04:43739403..437170 Cluster 5
ttaaaattttagaatttggtaacttatttttatatttttttactaaatatttctaaactttggatcgaagctaaaaagaaaaaaaaaataagtgcatgttcggcatgttatttcttgtactttctagctttctttattagttattttttaaacaattttgagtttattagtagtatttgataaaaaaaatttagtagtttgtaatgacttttgatattttacttcaagtaactagaattttaacgctaatttttaaattcttatattttttccttcttttatccatataactcttgtaactttgtatgtcgtcgtgtctatttaaaaaagagaaaaatcttatttttttaaaacaagctaaatcattttttttaacaggaaaaaataaaactaaatcgtatgaccatcatcatcatcatctaatagaaagaaaatagtcattcatttgaaaaattattgacattcttcaatacatgaaagactttacttttttcttttcatatttcatgtttcaataatagtgaaaataataattttttacctttttaacaatgtaaagtaattattttcaactttaaatacaattagtgttaagatgacaaaatactttacaaataattaaaaatcctacatattatagtaattcaaatattgaaaaaaaaagtatttatttttttctaattcaaaacttttacttttaggttaaataacatattatcttttatataatatcttattttttttaaagtagattacaaaatataagtttttgggtgaaattatttttactttttaaaaatatttttttatgcataattttttaatatataacatatacaataacaaagttatttatttctctccaaaaattgatttaaatatatttttagtctcttaaatttaaaaatctttcatttttagttttccaaattaattttttttgtcaatcaaaataacaaaaatgcttttttagcccatcttgctaaaaaaaatcatcacaaattatatattcaaattattaaaaataagtcaaaagaaattaaaaaaaatattttgaaaatttaagtaactaaaagagtaaattttaattttaaaaaa

SEQ ID NO: 1422 - DNA, 1146 bp, Glycine max
  Soy_ogl_1370 Gm04:43782095..43783240 Cluster 5
tttgttcttttctttatggaaaaaaatcctatttcaattttgtttgattattatgggcaaagcatttttctttcggatatttaaagtattagttgtatttaagacttaaacttaaaatcactattgaagttgaaaaaaattcgtactagtttatctatgcattccgtaataattaactatcaagcttttctatatattaattaacttattattaacccatgtgcgggatgaatattttttgcatacaattggtcaattatatattaaaactaccgtattatcttcttttaataaattaaattaatatgaaaattaaaaaatcataattttcttttacttaaatttaaagataattaatagtactataattgtatcaataatttaatttatccataacaaaagatagattaaaatataaatttgaaattttcgtaatgtttaaaagtaatctaattaatgaagtatctttaccatttacaaatagtttattgtatttaatattaattggaacaattgtatactaagtaaaaaaattataattctttaattaaataattaattaaataaatgttttaattccatatttgatatagaagtttgtaaaataattttaacaaaataaagaaaatatgtgattttataaaaagtaaaacacgtgtaaaacaattaaatttaataaataatggattgaatatattatataaaagtaagtgcgaaaatttaatatctagtaggtgcagtagatcaaaagaaccaatttaatatagtcaaccaaaatttatttaatttatcattccctagtaacttattactattatattttcctcaaaatcatatttttaaaaaataaaaaatatgaacaagcatttaaaatatatttgtttaaacaacatatacacatgtgcatacaatacttaatatcctatattatattgataaataatagtattaattattattacaatgcaactcctacccgtagctaaagcctaaatggtggtcgtcgaaaatctactattaatatcctatttttttaggaattaagaagggcaaactaagggtaagactattaaaactcaaactttcgatttatcaataaaaaaaattattttccatttgttttgataaagtaaaaaagctatgtat

SEQ ID NO: 1423 - DNA, 1100 bp, Glycine max
  Soy_ogl_1818 Gm06:7114101..7115200 Cluster 5
atttgttaatgttaacaaacttatacaaatcttttttttagtatgagtatattagtaaagttataccttggtaatgtatactttggtaatgtgttcatactaaaaaaaaataaaaataagtgtgaaagccatatatataaggatttaatggttttaataatgaaaaattgagaaagatttaaataaaaattattgaagggtgaaagtcatatatcaatcatagtagagtgagacaaaatgcattatttttatctaaagaaattgaactcaaatactagagggtttatgtataacaatttatatactatttaaccaattgagctagatttcattgatagataaaatgcaattaaaattatttatttttactcaacttttagagttaacataattaattagactatgtttgacaaaaataattgaaaaactaattaaaaactgaaaaactaatttatagttaaaaactattaaggtagtttgttgaattgtaagtgtctaataaaattatatgttaaagtagaaaaaaaatgtaaaatatcatatttaagtgatatttttatataaatttcaattttattttattcataaaaatatttttcagggtaatttcaaatttaatttttaattaattttaaatacatgtaatactctatttatagataaattattttatttgaatttcatcttatactatatgctgaaatattttcaatcaaatttattataaataattttttttaagtaggcatcacactttcattaagttgatcagtataatgattaaaatatcttgaagtataaaaggacaaaaaatatgtaaaactaaaaattaacattttaaaatatgttacttgaagtaacatcccagaaaatgtcaatagctatcaagaaaaattatttactaaatagtcaaataatttttttaactactaattaaaaacaattaaaaactaacttaaatgttttgtaaaacataagtgcaatttccttgaaattttttttttccatctaaaaaatgataatgagaattaattaaggacattcttaatgtttatagtctactccgtactcaagttctgcaatggataatcaaaagcatc

SEQ ID NO: 1424 - DNA, 1235 bp, Glycine max
  Soy_ogl_4097 Gm12:35641401..35642635 Cluster 5
attaaaattaaactttctgtaaaaaagagtattaaaattaaactcaaaatataaacacatttaatgctttgaaaacataaaaagtattaaatgctttgaaaatatttaatgtttttagatgaaaatatttaatgctttttaatatgtggcatagcaaatacattaaaaaaaatacaccatttaatagttactcaaaaatgaagtattaaattattttagacttttaagatagtattaaatatttacggttttattatttttttaaatttactactaacatttaatatttaatatgttaaaagcataaatcattgaatactttattttttataattaaaattaaaagatgaataaaaatataaatatttaatatcttaaaagtctaaatcattttttttactgggaaagtctaaatcatttaatacttcattcttttggtgattaataaattattattattctctcatttctatgaaacatattaatgtaacgaaacattaaatattttctgccaaaaaaaatcactccctcaatttaaaaataaacgtggtcataggttattttaaataaaccaaaataatttattaaatatatgaaatagaagaaataattttataaagtgttaatattatgttgaaaaactaaaataacactcattaaggatattaatgaaaaaaattattaatactacattgaaaattaatatgacatttattttggaataattttttttaaatgtgactcttattttggaagggaaaggataaatattttcaaagcatttaatacttttttatgttttcaaattattaattgtggcaaatgctaaccaaggctttctaaagaagcagcttttaagaaaagattataatttttttatttaccctataaaaaattaattaattaaaaaacaaatattaattttttttatgtatttaattaatgattatttttcaaatacctttaacttgtttcctttaccacatatataaaatgttagaaattttcatttctttcttgcaaaccggtggttaaggatttttatgaaaactgttaactattattatcatagagataataattacgccacaaaaaagagaaatagaaataataattaagaaataaaaagtaaacttttgatagaaggtgtaatatttaatattagcaatacatcttcactgtaatttttaataaatatttttttttagatttttcgcactagtatttacttggtg

SEQ ID NO: 1425 - DNA, 1114 bp, Glycine max
  Soy_ogl_4629 Gm14:3846290..3847403 Cluster 5
atattttttttataagtcaacctctttttccttttttccattttctcttaattcaaacaaaaataaatatatcattatctatgttttctttctttttattttttttcttcctttcaaaatacagttaatttaagtgttattttatgttgttgagaccgaaaatctttacctgtaaagctgtaaaaatggtgatttcaaaaaacagttgacaacattttctctaaagaaatatagacaacatatattttagcaagttttctaaaaatattttttttctcatttactaaaatttaatataaatcataaaatcatgtaggtctcatttcatttatttttttatccagaaatattaatttattagttttaattaaaaaatgtcaatgagagggattcaaactaactctctctttctttattcctttgcccttaaacattattttcaatctatcaagtcaattttatatccacatctcacttaatatctaataagttttacttaacattttataaatttcaataaaacataaatatttaacatgctagaaggattgtattataaactatgtggttagcattcttctaagataatattaatatattaaaatatgttgttagaactcttcttaattctatttcaccatgtgcaattaattatatattattttttctatgttcacatcacaaaaaatggtgctatatacttactattgtacaaaataaaaaacatgcaaactacattaaaattataatttatattgaaatttttgataaaatacttcaataagatataatatttggtaaattttatttttcaattataatctcattaaaaagataaataattaatattataaatcttttaaaaaagatacacttgttatcttaaaaatatggtttttgataaattatttataaaaaatataaattgataaaaacttatttttatgtatataatttatattttacatattcgcaatcaaataaatccgtataagtgtacaactaatcataataaagtatgtcacggacaatgtcaagaatgcaataattgtttacggaatcacaattgtggtgtaatcatgaaaattgtggcagacaccggtttaagataaat

SEQ ID NO: 1426 - DNA, 1300 bp, Glycine max
  Soy_ogl_6796 Gm20:36880101..36881400 Cluster 5
atggttcctaactttaaacattatgaacgagcattttatcttctaccatatcactaaatgtctagttgcctagatatatagaaacaacaactaccaagtgttttgtatattacatacgtgtttttaaatttatataaaatatttaaaatcaaataatttttttagagagaaaacatctaaagttataaaatattcataattaatttaaaagaatttaaaatttaaagcaaaaacaagtagcatccctatctaaaaaataatatctacttttgtttgaaaattgaaatgcacaattttaaaggtaagagtctcactctcaactttttccattaaacgttcttaatatattgagagtgtacatattatttactgcatcaaccaatcataaaatgtcatattgatctttttttaaaaaaattgaatctaatcctaactaaattaaaagtcacatgtgttcatgacttatgattgattaacggtatcaattattattcattaacaatggatacctattaaacttttttcgatataatatcttgtctatgaaaaaatgacttttgcttagaaaattagtcacattatattataaatatatatttttaaaatatcttgtaaagaccagatatatgtgcttctaaattaacaaaattaagaatttaatagatatgtacatatctttcatataatatattaaaatttaattagaataaattgaaaagacgattgtttacattataatctaatcataattaagtgtgtatgataaagtttcaattatcattttaaaagttgaatgtaaaatatttatattaataatatatatcaaaataaaattctaatatattatttctaattataaagtaaattatattatgctttatacaaaagtaaaaatatcattatgtaacactattattgttattatttttagttttttactcagtgaaataagcaaaaaaaatttatttttattttatttctatttcaatcacttgaaataatctacacttctacttcttatttttaacagtttatatatttacatttttaatatatttaaattggttgtttttgtaataattactttaagattacaattttaagtaatttctaattagctagtaatataattttttttacattagtaatatactaaaattaaattctaatacattacttctaactataaagtaaattatatattactttatacaaaagtataattactattatgcaaaattattatttttattacatcaaataagtaaaaataatacattttttcgaaaattcaaataat

SEQ ID NO: 1427 - DNA, 1004 bp, Glycine max
  Soy_ogl_6958 Gm20:43613797..43614800 Cluster 5
aaattacaattttggtctcctataattttaaaaccttgattttggtcttcttattttttagaattaaatatcaaatatttattttaatttataaatttttataattcaaaaaaattaataattattgactaataatacatacaaaataatatttataaaattaattaaacaaagcaagtattttagtggattattatttttttaaagataaaagggcatgagttaaatttcttgtaagatctctaatgattaaccgatggaaataccaaaaataattatcctgaaaaattaaaggattaaatgtcttaatttataaataaagagaaaaaatcacaaatttaaaattataagtgactaaaattataatttagtattatgccattcatttatactctcgaaatagttatctcttaatctttttttctattgtgttttttcaaatttaattgtttatactctcgagttgttttttatttttattttttccagtaaaattaattgtttctctctaaatcattttggttccattcttatatattaaagtagagtacacgttatcttcaatgtaaagcttgttcgcccttaaaaaaaaaaaaaaaagaggcaagttaatgattaacattaagtgtttcaaagacacgggtcgtataatcaatcaataattttctatgaaaaggtacactgacaagattaaatgttacacgttgtaaatattttctaattttaattatttaagggtttttaagacatctcgtccttctcaaaaaagacaccttgtcaaaccagtaaaaaaaaatcttgttaattactataaaaatttcattttaaaatcattttattttaaatcctttttaaattaattgtgaagatcctggtaattagttttaattttaaaaaacaattaaaatttatacttttcaatttttcccttgtgtgacattatattttgaacatagtatgtattagtgtgaataagagaatgtatgttaattttattaatcatt

SEQ ID NO: 1428 - DNA, 1127 bp, Glycine max
  Soy_ogl_1816 Gm06:7084874..7086000 Cluster 5
taggcgggactatgagtatcatatgatccaatgatccgataaattcaaataaagagatttttttatttattaattttagattatcgattcgggttttaaagttacaaatttaatgacgctgatttggatacaatttgagtgggtagaatttgaatcaactcaaactaatattgttttagaaaaaataattatttttaatgttgtgtaattttatagttttatagtttttatgttgtatgattgataatttttattattaatatttttcatcatcttatgatttttttttaattttttattattttattagatgatccgatccgaaccacttccaaatgtgattgagttgattccatttagattgctaatttttttaaagaaccaaaccggtttggatcaaaatatctcttaaaactaaaccaatttaacattcctcataaaaaataggtcacaaaaaaatagggggaaaaatgggatataggtgaattgtaaaagatttcgatgtatatttattaggtgtgttagtcggtttggtttgaatttaagaacaaataaaatgtaaattaattgattttaattggttcagtctaatttgaatttcagaattttttatttaatttaatcaaaccaataatgaacggattcactcaactttgtaattagatatctgatcattttaaaaaataatattttgaaaaaattaaaaataacataattttgtcctaattttgacaaataataatgtcttaatacaatgtaaacaaaaatttaaatgttatagacttataaccaactaaataatcacataaattataaaaaataacataattaattgattaaataaaaaaatttcatctatatataataattaaaataaaataaactaaattatccaacacaaccttaattttagagacaaactgaaataaaatacaataaaaagatccaaaagaatacaatagtggatatataaattaaacattaaatagtaataataataataggtatatagttttttttcgcaagtgaaaaacttttattataaaattgaaaactagcctccaaaacataagttgtgtaatagatatataattgatttgatttgatttaaatttgaaatgtgtaaa

SEQ ID NO: 1429 - DNA, 1197 bp, Glycine max
  Soy_ogl_629 Gm02:43461601..43462797 Cluster 5
aagcaaccacgtcctttgcaccacccccaaagatgagactgcattcacgctgtataacaaaattgtgttttgttattttgtttttttattccctttgtcaacaataaaatacaatcaagttatacattatataaagaaattatacttttattttttttttcatttttatgtggacaacaaaaatataattttgttatataaatctacaatagaatcgtgtttttatggaaagggtagtgagagtaacattttttgtagtgacaatagtaacttccttcattttttttttttttacttttaatatttttagctgtttgggcttttaataattgaccttggtagtctttaggtctataataagaaaaatgttaaacttatcattaatttatgacacattttgaaatgatactttaaagttttactatagaaaattcttttttggttcttatctttgaattttttaatttaaagtgatgaatcttcatcttaatttatctttaaatttaaggtattagatgtagatattataccataatccacaaacactactaacatgtgttaattaggatgatcattggtccttctaaatccatagaccgttaacgagtgtcatgtaataatagggataaaaaaaataaaaacttaactttttgagagataaaagtcaaaagaatttttttataaagactaaaatcaaaattcgttaaatttacatagaaaaaaatattcaagctttaatataataaccaataacagatttaaaatgttatcaaatgcttttaaagaaaacaatgcttaaataaaaaatccatattgaatatagtttatttttttgttttaaaaatactttttatcacccttttgaatttaaagcccttaataagtcattcaaagaaaggtactgatattataaaaaagaaaacatatattaagttacaaaaaaatatcaaaataatatttaatttagtcaattagtaatttgttttaaatacacattcaaatttcaaacaacacatataaaatgaaaaatataaacaacacatgtataatgatgtaaaaaaacacatgtaaaataaaataatatttaagaagaagaacagtgataactcattcgtgaatgaaattttttgagattcataattgattattgacataactacaagattttaaaagcattactttttgtttattaaatgc

SEQ ID NO: 1430 - DNA, 1532 bp, Glycine max
  Soy_ogl_6191 Gm18:55921201..55922732 Cluster 5
agggaaatatctccttcaaaccatagcattcgttcacttgaagatggtttctaaattgggtagtgaaggaaaacaaaaggcaaaatatcgttcttatttagtgtcaatagcggaagaaattttaatttccaaaggtttgtaacatggggcattccagatggtgttttcctggatagaagcaactatgcagtgacagccaatgaagagccaacgagaaaaaacaagggaactcaaacatagcagctcgtccactgggaacactaagtattcaggtccatcatttattgagaaatacttcctttgtgatatacaaagtaataatcagatattagaatttcattgtaatttccctccatgagtgttataaggaatctttgattttatatcaaaattttgtttgtaaaaattagaaatataaggattatgtgagtagtaattttaagaatacttatgaaccagaaaaaaaataacaaaagaatatttattataatcaaatttgattttgaaattttttttatagtagttggcaaagaaaaactcgacaaagaagaattagacataaaatcagtataaaatgaaatttttaatactctttcttaacttatcaaactatttcaaactttattattgttatattttacatacaagatttttattgaaaataaattccatacattattagacgacaattcgcttttaatcactaaataagaatttataaacttattataaatattttgattaaaaaaattatattttaattaacactattcaacttcctctaatatgatttattatattcaatattcgtcatgtgatgatgactttaagacatcaaaaatcttgatgcacgtaagtattgcaattaacaagtaaaggtttactttcggaaacactaacttagccaagtttacaaaaagttagattaaatagagcaatcttccaacttcaaacatatatgtatcatatttggtaaagtgagctagtatataaagtgcaaaaataaagttgaggccttctaactccaagtataattcgttaatttttattttatttttctaactctttaaacagaaaaattgttaattaaaattattgatcaagtaattctaacatctcagtgaataacaattccttcaatcatggtctggtcttgcagcataattgatctcaaattgaatatataaaattttgttttgacgataaccattattgcaaatattattaatgataatatgcaagtgtttcttattttaattttatcttcagtgtttccttaaaaaatttagttttagaaaactttatgaaagttcacgctaatagcttatgaagtagtaaaaagagttttgttatttcatattttctgtatttatcttagaatataaaaataaagttttaaaaaataatattttcatttagtttaaaaaaaaatttatttatatataataaatacttgaattttgtgtttgtttcttaaataaaaaaattacattgaatctttaatacgataatatttttatttttggtcctta

SEQ ID NO: 1431 - DNA, 1000 bp, Glycine max
  Soy_ogl_6434 Gm19:38705601..38706600 Cluster 5
aagttgtttgatttgagtttgattatcacgtcacataaaagataaagggattgtgattgacactacattgaattgctaatgacattacccacttggagcatatttgccttattgcaaaattgtcccataaaaaaagacacagcacactaaattcttagttttaaataaattttatgtaaaacaaaatacgttgagctattgaccacaaatgaaattatattaaaattaaggtttaatcatttatggaatacctatgtttgaccattaataaaaataattattaactaaattttatttatcttactatttaactctgaattaattagaattattttttcttgataaaccggaacctcaagacaaaaaaagatgcatgtttgtcattggatgttatttctagattttcttgtaattgtaaatagtagttcattcataatcattatggaaaattaacaattgaaattaggaaaaattatatcgggctaatttgtttaaacttaaaataagtgatttttaaaatatttactttttaaaaagtgatattttagaagaaaaaatgaatttcttttttttatagaaaacataaaactgttttctttaaataaaattagacaaacacataaaaaagcaaacacaaactgtttgttatattaaaacagtattttttaaaagaaaaaaagcttaaacaaatgggccattatagtaaactttataattagtttcaattttaatcgttaattttttaatcgataatgataagtgtaatttattatcttgcaatcttctcaaaactagaggagtcatatataagatgtaactaaactcagattctacagagttgtactgtgggtcatgctatatatatacagaaataaaattagtgaatttattatcttgcattcttctcaactcagattctacagagttgtaattttttaatcgttaattttttaatcgataatcataagtgtaatttattatcttgcattcttctcaaaaa

SEQ ID NO: 1432 - DNA, 1353 bp, Glycine max
  Soy_ogl_1581 Gm05:35260..3558222 Cluster 5
acaacttaaatgacttactaaatattgccaatatataatgatatattttaaaacaattttttatcttaatatttatttattgaattttgagtatttttacttacacataatgtaaatattaataagctttcttatataatttttatccacatttatgttaatatttatctttgttattcagttatatatttagacattaatataatcgaatataaatttcagcgtgtgtaatgtgcgtttgaatattgatttatacatattttattcttatacaagtatatattaatcatattatttttctactgacacaaggttattgtaattaaccaaaatgagaaaaaaatatatttatagaataagtggtccattatgcaccacatttaatttttttgagtaagtttttttttatcacgacattgttatagagtatttattgatgattaatttctattaaagaacttcattaaatacttagtgaaactttttctcttaattatctttttttctattttcaaagtttaaatccgagatattactacacatgtgatttttaataacattttttttgtctaacacttaataaaaacaatgttaaacacttttaacaacatttaaaaaaatagtcaatatataaattgttaatatatttttgtgatattttattaaatgttgtgtataatttatgtgggtaaagaatttagatacataaattctatttttttttactcagttatatattactttataaataaactataaaaaatattattttattgataggtctaaagctttaattgctttattattggacactctagatgaaagggatgggggatgtcgatcatgacgagggcacggaaggaaagggtcatgaaaaagaggaaaaggaattcacaaggttcaaggaaaacagagagtcagagatagagattctttgatgaggtccgaagttaaaaacaattatttcaaactttagagaaaagaaaaacaaagaaaagttacaagaaacaaaaccaaatttcaattattttatcagaatcaaaactaaaattttattgttctataattttaaagggtgaaaacttaaaaaagaaaaagaaatttatatagaaagcaaaaccaaaagtatccttttactcataataaaataagagtttaatagttatgtaaaataattatatactattatttaactataaatgatcgataataagatttttatggtaattatagtataagttaatagacttatcttatataataatttataatattattgtacaatctattttctcataaaatagtaacttaattgttttgtatatcatccatttgttttatttcattcatcac

SEQ ID NO: 1433 - DNA, 1171 bp, Glycine max
  Soy_ogl_2846 Gm08:41208030..41209200 Cluster 5
attgttttaataaaagaaaaaaaattcatattgtaaattttgtatttggacaggaaaaaaaaagatagaagaggagagaacgcgtgaaaaagaaagtcttccatacactgataaacaccacactagtacgtcacatttgcgcatagccacttagagaatgacacctgagtaaaattaaaaattaaaaattaaaaactcattatgtaatctaaaactaaaagaacgtgagtgtgacatcctcctctcttaatttttagataaactaaaagatatggagataagaaagaagaaaagagaagagagatttttttaagaaaattttgatttaaggataaagttttaaattcttaattttcaattaattaattattaagttttcctgttaaaattcttaaattttgaatttcattaacaaaatatataaaacagcaaattttagtctaattttaaattcttctcaaattttcttttccctctttaaaatattttattcaaacacatgcatccttaatgactaccagagtatcattgtaaactcatctcccttcgtataccaaatgtgatttacatatttttatagatacaaagtctatggtagataataccaaaaaaaagaagtctggtagatatgtgggatttatttttgtttttaagaaactatttatattaaaaatattttagattaaattaaaaaattaaatacttttttaaaaatgagaaatatcagtttaaattggccttttacaagaatgaacaaaaatataaaaaattgtttttagttttattgaaatatatgattttagtatattttattacttattttatcatttttttatttgtattctttaatctcttactaattgtgtaaggaaatctaaaattgacaaaataataattaacgctccattatgttctcctttaaaatttcaatttttttatataaaaaatgaatgctcgagaaaaggaggaataaaaaataaaatatttattatatttcttaatcatcataatcttaaaacatactataaaagaaatgtaaatggtatttgaatgttgttttaacctctgttatttaatactttgatatctctcttattgaccaatgtaaataaagaattataattatgaaaatgataattttttatattaaacttttaaaataagatataaa

SEQ ID NO: 1434 - DNA, 1717 bp, Glycine max
  Soy_ogl_4344 Gm13:29305084..29306800 Cluster 5
gctttcagtaggttatcaattaatttttaacttcttagttaacttttcaattagttttttaaaaaataaccaagtgtaaaactacctcttatataagtactgagttgttaatattaaaaaaaaaaaaacattttcttgcccaaaccaacaaaaaaataataaagatgtgggatctattgtgaatttgtgatactcattttgagttcgagttctacaattaaataaaaaaagcttattagagttcttaaatcttaaattaaagtgtaaaaaattatagataagttcttcatttaaaatgctattacgtgactgtaaaaacccataaaaacagtttttagaaaacttgtgaaaaccttaactattaaagagagactagtgattttgattcgcaataacaattaattactctcttgtttgccaacgaagattgaacaaaattagagctttcttggcacataaaattactcataatttttctctaattcatactaaaacatgctttaatatgttcaggtcacaataacattggtgttggtgtaacatatattaactgacatttttaattcataggaatcaaacaacaaatgtacatcaaatttataatgacttatacatacataattgagataaatcacgccaaaaaatttatttgactatttatattggatcttttattccattcatgcacgttatattatttatttagtatttaaaaataaaataaaaagctaaaattatgtcctacaatgttaaaaaattaacttacaatctttaaaattgggatggagaactaaaattattgattttaaaaaattgagggactatgttttaatttaaaaactgggaactaaaattgttgattgtgaaaaacagaggaccaaaattaaattttaataaataaaaaattgctagcagtaaaaataaaaaacacattcttgttttttaacactcctataactcgcatatattaaaaatatgaaacacgagttgttatctacaactagaagtctaaaaaaggagacagctattctagaaacacgcgcgacttatgtattgtttattaaaaactcagtttaattgaaacaacaaatagaaaaaaaaaaatattcctctactttctcttacatttatttgagagtatttctctaaccttttattactactttattttttaatcatattatttactatatttattagatttattaatttttctttctatcttttttttttctctttctacctcaaataccccctatttcgatgtgaaccataaggcctgttcaatgtggaaaaatacaaaaattgtagtagtaaacttacatgtttggtatcatgtctgcctgctgggcatttattcacttttttaacattcttatttgaatgtatacatttttatccttaactcaatttttcagttatgttttcaccttttagagaattaaaaatcatcctttttataatttttaagtagtcattacattgtaaaattaattaaatttttattaaatagtcaaacaaaaatcttttgctctatcaatttattttttatattaaaattttagaaattaacggtctgtttgatttaaaggatgaaattgaaataatgaaaatataagagatcttttaattaaagaaaagtataaaaggtatcggtcttacaaaagtataaaatttttcttaaatattatttatctcttcaaaaataaatacacct

SEQ ID NO: 1435 - DNA, 1364 bp, Glycine max
  Soy_ogl_4811 Gm14:47783415..47784778 Cluster 5
atattaatgtaaaatattaattaattttacggataattaacttttgtctttatcaaaaaacttgatcaattatttttaatgagatattttcttttattcatatttttttttagctagaagactaataaatttttttaagaaaattgaatttaaaactactcaaacctcacacaagacttattgtatttcttaatgttgtttgattgtgaggatataaaaaaaattaaattaaaatagaagtatgagatgggagacccaaataaaatgcacattatttcttctcaatttttctctctctctctcctcaaccaaatacaatatacattatacattttactttaatttaaatatcttaatttctctttatttttattatctctattttatcttttctaccaattaataaaacactagtacacatgatattcttaaaagagtagtattactaaatgggtaatgtttatccaaataatttgattttattaaataaaaattaggctttatattttttagtctttcaaatccaggggtgtatttttttagtctcaaattaaaatttacctttttatagtctctcaatttttattttttttaaatatttagtccttccttactgattttttgacgatttggatttggatgcacttatgacaatttttatcgaaaaagagacttaaaaaaaagtatttcatgaaattggggtactaaaaaggtaaatttgaatttggaaaattaaaaaagggaaaccttaaatttaagggaaaaaaaatatttaaacataaaaatatactattttttatgtgtataataattatattgtaatttaaatctataaccggcattccttaatataaatgaggtttaagtcactattgtcattaatattgcaaattaaaataaaatacaaatggcaatagaaacacttattattttaattaattagtaataatcactgttaacgtatattaatatccattggtagaaaaaaaaaatcaaatgcatgaatatctacaaaaagttatttagataaatcagcttcaatttcaatgtggtgaacttgtataaatgatgttaagatttttattattatcattattacaatttgtgtggatgtaataaactcaatttcaattagtttatgtttgattcaacctattttagaaaattaattattatttttgtcaatttcttaatagaatttttgaaaaataaatggtactttttctaaaaagtatatttaagtatgaaatggaagatttaatgcaaaaatgtttttttatgcaataatcattaatggttctgtccccaactgagcacgtagactataatacatacagagatgagaacgatattggttactcttt

SEQ ID NO: 1436 - DNA, 1095 bp, Glycine max
  Soy_ogl_5529 Gm17:5513701..5514795 Cluster 5
ggatatttttagtttaattgcattaatgatcaatgtgaaattatagtattctaattcttttggttcaaatttagttctctattttttaaaattaagataatcaaattctttcatctattttttcttttcacgaaactctcaaatctctattctacccagaatatattttaggacaaatttgagatagaaaatattaataatttgatttgtgagttttgaacaatgcttttaaaatcagactagacattgaacactttcatatgcgtgctagtttaagattcagtagttgaacaatgattaaatcaatattaataaaataattttaaagcttaatatcataattttacaatattaaaaaccaaacataaaatatcattaaccaattgcaatatatcataatactaaatctaaattttaactatatacaacaatgttcattagcaataacaagtttacatatataataaaaaataataataaatactttaaattaattttcattttgaaaaatcaaaatgatattgcattaagcaattttcattttttgttgcattaactcactatgaattgattttttactagttttaccggtatttgagcaatttttcgaaaattagacaactttattaagggaaaaatattaaggataaattattgagtatgatgtaaaataatttattgattattttttagatatttaaaataaaagaagtaagagctaatttatagttgtttatgaaataaataaaaaatcactctctttagaagaaacaatttgagaagccattcaaaatagtttctgatattatctatgttatagattctgtttagcttttgattattttgaaagaaaaaaaaaagataaatggataatttttaaaaaaaattgttacttttttaaaagtaaattttttgtgaaaaaattgtaaccaatggagataatatttaacttgattttttcctgaagaattgagtcataccttttctgaaaatctcttcaaaattatgcactttaatttttatgaaagaaaagaaaaaaaaagaaactttttaacaaaagttaagtgaattgaagaagctttttaaaaaactttg

SEQ ID NO: 1437 - DNA, 1385 bp, Glycine max
  Soy_ogl_5751 Gm17:37793301..37794685 Cluster 5
tttgggtaattttttttattaaatatgtaaataaacctcaccttttggatgattaatatatgagttttcactaagtgattttgcatgtttttattgaagcttgtgagattctccatgttgaggaaatttataaaaggaaaaaaaacttaatttgtttaattaagaaagggggattttacttaacagaggaggagaaaaaaagtcaggagaaaataaaatcttatttagtttggttaaaagagaggagaaaaattcatatctagttttaaaaaatttggtgccataggtaaattgagagaataatgtcttcgtaatggtttttttttttttaaagtcatcataatcatttgaatattatttttcttttatttttttgttacaaaatcataaataatccgatcataatcaagattctttaaaaaaaaaattgaacagaaattaaagtagcactatttaatttatcttgtgatataataggtggcaaataagattttaacaacttcaatttcatattgtaaaaaaatgatttaaatttcaaaaacttctttcaaaaaacttcttttaagagagagtattgcctgtactcctcttatgtataattgcatggtcacatgtttattttcttcacattattagttttctttttctaaaataaggtaaattttagtttagaagtggaaacatcactcattagtaatgagttcacgactaatgatcaatgattgttttattttattaataattttttattttaatatttatcaaattacataaaaaattgatgtttctctaaaaatggaatcctatgctgtcgtccacctcacctgtcctcggcctctgataggattcattgtctttttttttttttttttgtatttggtgagtttctttcttagaaaataattgtttaaaattaaactctcttaagacttactaaaatctatttttttaaagataaacaaattagaagtatacctatttactcttttttcttaatttttcttatgaataaaatctttgctggaaaatggataatcatttttaggaattttttatttacaaaacttaaattacaaaattcaactcaattctatttgaagtgaagtaacgtatatacacgtattttactttaaaagtaataattaattagtatgactacaaaagatatacaatgtttttttttacacagttgcaatgttttttttttttttttacagatatacaaatacacagttgcaataatgttaatagcaacaaaaatatataccaacaagttaaggtttggaaacaaaagacgatatctttgaattgaattttaagaaccaacatatagcaatcggaatcgcggtgggatgaaaaaaaaaattaaagaatttagaaataaa

SEQ ID NO: 1438 - DNA, 1176 bp, Glycine max
  Soy_ogl_5914 Gm18:3029073..3030248 Cluster 5
aggtaccaaaaataccaattgaattacatacaaaaagcccctggtcatactatatttatcaataaggtgtatctagaattgattgtgaatgcagaattagtttgcctccttcagtccttttcataggaaaacgaataatagttctgacatttcaatgtttagttcggttgttattgtcaagagatatgttaccactttcttatattattaatttggtaatgtatacttctttaaaaaaactaataattatacaaataaaccaacatttagatccaatttccaatgaaaagtaaagtcttaataattttcgtaataaaaattcacattgaaagtaattttcgtcacatgtgaaactttaattttaataaggaaacaacacatatgacgagggtcaccacgagaaatgttgtaatactcgtataagagaaaaagaaattgttattatcattttaattttttaatgtaacattaatttttttccacttatatctcataatattaaatattaatgctagaaaataaaacctataaatgatttaatgatgatatatattctctggcaaaagtaactttatcaaaagagctaaaatataattgtgaatctatttatatattgaggtaaaatactattaaagaaaaatatagtaaaaaaaataattaactaattatttatttttaaaaccataaatgtttcaaaatcaattaaaacaaaaatatgacatacaatgtgagagaaaaaatactagtaataattttgttatgatttcttcaatcaacttatcccatagattatttgtaatattattacaggaaataaatgttgccccttacatttaccgaaggagcaggggagtttagaataaaaaaagggaaaattgtaaccacaaatcaaaatactctctctagtaaacgagtgattttttaattaacatatagattttttatattaattatttttatatttttaatttattgcgaggtttgctaatgaggcactcgctcattctctatgcaaagtgaatatatttgttgatttattaacaatataaatcacattgatagtaaaaaaatatttcttgaattatgagaattatcattaaatataaccataacttaataatttaatccattgagtatttttggaataaaacttaaatttatgatatcatcatttaa

SEQ ID NO: 1439 - DNA, 1205 bp, Glycine max
  Soy_ogl_5933 Gm18:5136401..5137605 Cluster 5
gcatccaagagggtgatagagttagtgaactttcagctttttaattacatgtcttttttattttgttcctaccatattcatgtgatagtgtaaaaaaaaaaacatattcttgtgatagtttctcttcaatggttttcaagtaaaaaaggctagacctaattataacttttgttagcctaaatttgtacttcaagtttcgactttagatatgttatgtcttactttcaatatttattgtattcacttatgcgcttgtttttagtttagttattttttgctaattgaactttcattttcttttcaattattattctatgggattacctttgttgtctaaacaagatgactatatcagttgccttctctttctttgaaatttcaattttgaaatgtataaaacactcttgtgaaaatttaattataaaattgatttaatcacttttgaaactcatttacttatcactaacaaattaacaactaacattggcctttaaaaaaactgatcacatttggaattaaaattttcaaaattaattgaaaaatgtttaatatattttgaaattaaaatttcaaaaggaattttaagtattcttctgaaatgtattgataaatatttttctaaaatcaaattttaattaacaagtgatttgcatgtaaatcacttccaaggttaaacaaaggtatataattttgaaacaacagttaaaaaaagattgtagagaaattttaaaaaaggataatataaaatatcatttcctttcttgagttttagttaaaaagtcatattattgtcttcatttagtacttttattttctatttttttcaagtccatattttaatttgggattagatctttcctttatataagctaacttcaatagtcatatctaagaatctaaggcagtgagtttagtagattttaattttgggtaatctgtttatttaaaatatttaacacttttctcttattatcatttcacttatgtaacttaaatttatttgcttgtaaacatgcatcaatatagaacttacatataaatcaaattattttagagataactattgataaagttattctctttaataactatttgattatactaattttcttaattgaactgttaaattaaaaaaattagtgtgtataatttttttataaaactttaaaactatttgatacttcattaaataaattcaatgcaac

SEQ ID NO: 1440 - DNA, 1062 bp, Glycine max
  Soy_ogl_6460 Gm19:39610139..39611200 Cluster 5
tctgcatacaaaggaccaaaaaaagaggttaggaacaaattatattgggtaaactttagggtgagcaaaaattatatagattttcagattgattgatattatagtattattttttttattggttattgttttcaatttgtaatgaaatgttaaaatatttattctaattttgccttctatttttttcttaaaatacttaataatatatttattgaaattaagaaagaatgtataaaaaatattaagcaagagagtaagaatactttaataaaattgacctctaataaatatcattgtcttaaagtacttgttttgcttagtctatatgcaaaaacttaaatatcaatcaaaatagaaaggatgaaacactatgtaaaattgcttttagattaacattatgattttatgaacttcatttaaattaaatcttaatttatgataatgttagataaaaacatttataagttaaccgaaaactataatgctatttggtagttaaaaattattaattgaaatatgaaattaataaattataaatatatgataaaattatcgattgaagaaactaataaatatgaatgacaaaaatggatttgtttatctgatttcatttaatagttaaaaaatatttgagtaactataatttatatttttatttatttaaaagtcaaatattttaattacaacttttagttttaattatattttcatattgtgcattctactgttaatcttatattatatagtcaaatattttctatcaagtgtaaaataaaataaaaggaccaatgataactgatgcctttaggtaaatatactggttaaaagaaaatggtttttttttattgagatacataaaatgcgtttccatataattctcaataaaaaaactttttcttttaatttcttaattagtattctaatgagactaattaacaagattcaaataaaaataacatacacttaattaaatatcacactttattatgttgattagtgtggtaacaccattctgtaattaaaaatatcattatgtaacagtattgtcacactaattcatta

SEQ ID NO: 1441 - DNA, 1400 bp, Glycine max
  Soy_ogl_6738 Gm20:34248301..34249700 Cluster 5
attctaaaacaagtactttttttgtcagcaataaaataattatattaaaagcacaagagtgtataaatacaaaaatgtgtgaaaccaatcctagccttgcaatcctgcaccccacgcaagcccacacttagcacaacaacttatacacccaaagtagaaaaacgaatcttatcatatacaccaatgattctaaaacaagtaatggttgattacattacagattcggttaattagttttgagcaaaaaataatactcgaactagtaaaaatttatcttttactattaacatgaactaacccaaaataagggtttgcttaactaatcccaagtgaaaattggattagtttgtgcacattataattagtgctccaaatgagtgcttgtctgtgccaagctcaccactgaaatcttatatacacacatgtattttgtggatttttttgttttacaattaagtaaaactaatttcatttcacgagccaaaaataattttagctcaaattttacattaaagtatatattatggtgagaaaaattaagaatttagtttatgtgcattattgttataattgttttatagatagatctaataggatttatttattttatcttgtaatcttatttattaatataatttggtgataagataaatctattagatatctgtgtaagatattctgcactaacaatatataaaaattaaactcaaaacataattaattatattggttaaccaaactaacactaatgcttgtaaaaaaaacaataaaacaattaaattcataaaatgctcgtgattatgaaaaaagttacagatggataggggaaaaaataatgataacagtttatatttatatatgataagtactagagcaaaaaaaaaaaaaaaaacagtgaatgttccatattactgttattttgaatgttccatatttttatttgtttatgaagttcaccccgcattaaaaatacacaacacataatattttaaaaagaaaaaaaacgttataaaaaaaggaaaaaaggttatcagacaaaaggttgataacttgatatcattaattaaaaatacataattgtaaataagcagttggaatctataaatgaaattagagacagtttcatttttgttaatcacattgaccatgtccaaagttaaataactatttatttgttttatttcacaaatttttcaacaatactttttatttaaaatattttagatctctcagtattttctgttttatctttcttatattcatacgttaagtctttcaaatgattttgcctaataccctaaaatttctagacatgagtatgctcactaattaaataaaaaataaccactttataattttaattgaagtaataaccatgattttccataaatcaatcgaag

SEQ ID NO: 1442 - DNA, 1063 bp, Glycine max
  Soy_ogl_6763 Gm20:35053701..35054763 Cluster 5
attttttttataaaaccatcttataattatttgttgcattaaatatttgtttcctataatatcttttattaggattggagaatagaagaaatctcattaattaattatataagaaataattaagtgaaaagagaaataaagaataatcttaaaagagtaatataaattattgataaatttaatataattaaattaattaattatttttctttaaaatgtgaattagttgaaaaaatattatatataattaaaaaggtagtaaaaagattaaaaatattttttttctgtaagtcaatgttgtagcaataaatacataaaaaaaattgtattgactaaatctacttaaattctcctctattttataaaagataaaagattaaaaacacttctctgcaatgcaattttgtagtaataaatgataaataattaaaaataatattgagcaaatctctacaattactcctttttattaatataaaagataaaagaataaaaaatactttttttctctctctaagactatattgtagcaacaagtcattaaaaattggtatggaacatatctctccgatttatgtttgttttaaataattcaatcttttataattgtgatgctctaatgatggaaaaagtctcaaattttcaattgaattattgataccaatgtaatttatttataaaaactcatctatataaataacacactatacaatattatttattgtctaaataaattcaaggatccaactttgcatttgtgatatctaaaatggctgattcaactatcagatcctcaacataattctcttccttgtccttatttctcaaggtgaagtttcctcctaactatgaaacacatttgttttatattaattattgttcataacttatctcatacataaaaattttaggctatagccaatgttcgtcacatgatatcgaaagccaatttcaaaaaggagttacagtataaggaaaacaatttgtcaagtagtaaaaataaataaattaaaagttagttaaaatatttcgtcaaacacacttttagtaatattatcaaagg

SEQ ID NO: 1443 - DNA, 1400 bp, Glycine max
  Soy_ogl_674 Gm02:45320101..45321500 Cluster 5
gtggtaaatgtaaaccatgcataccgattctttgcacggtgcataatgggggtggtccgtactacccagtgaggtggttgtgcaaatgtggcaacaagtattacaacccatgaatatgctttctacaagtgtgaagcgtttttgttggatctaatagatacttcatttattaatgaagggggaatatgtgactattataaatactattatcaactacaaaagaatatcctatcagaaaactttcgaaaataaataaatattccaccttgtacttaaatattaataatgtgataacatataagttagaacatgaatcatagtagtatttttagaatgatattttttagaatactattactagaaatattattcttatcaaagatatttgataacattttatcatttttgaaatatttttaaatgataataaaaaaggacaaacatatatgtattgtaaattcctggaataaataatgtaagggaataacttgttataacttctaccaaacataagaatagttgtgtaagactagaaacaaacgcaatctaagttatcaattatgcgcaatggtgaacatacactacagcaaggatgtgtaagtatacctactcttttttttttttttttaataaaatcataagtaaattactttcgggtgactctaaagaagagttgagtctttaggtgagtcatcccaagatctttaagcaaggtatattgtttgtagggtaaaatatgtgcgtgatatatctctcatatatatttaacttttattttttactcatgttgttatgatttcatgatgatgatgtggctgttaatttttcaaaaatacgatttgtgatgattttaaaactatttgtattcattttgaattttaaattataagttctgacagataaaaaccgtaaaaaataattaaaaactaaaaaattattttttaacaaataatctttaattagatgttttattttaaatttacagtagtaattgatttattaaatatatttagttttgtgtagaataaatttttattgaatttattaaaaccggtattcatagataatcatttttcaatcatataacttttatatatacttttcaaaaaccaatacatcttaaataatatataaatttcacataagaaagaaatgattatagaaatattttcaaatttatttttatggtaacacaaattggtttatttccaatttatacacacagaaacaattatttttatacttcaaattattaccataaaaataaaccaatttatgttataaaaaagtatacatcaaatgtatggatcaaacaaagttcaaatgtgcatgtaatttacattatagccaaactttaaacacgattttgttttgaatgctgggtgggaagagactttgat

SEQ ID NO: 1444 - DNA, 1400 bp, Glycine max
  Soy_ogl_5170 Gm15:49115401..49116800 Cluster 5
ctttcttcacaagtgaattatagagccaaaacctatcctccattgtgttaatccagtggattataaaacttatatctaaaaatcatttttaattaattgataataatattaataattttctttatcaaaattaaactcttcttcaatatttgtaattcgaatattatgaaacaattgatcagttattgactgtgtgattctcacagtaaatgttttaattagtctataaaatataacattaatcaataagtatttataaaccatcataaaaacataaatatgaaaaagtaaatattatatataactcattctcataaagatttacataaatatttttttatttataaaactcagatttaaaatttttctcaaagaaaaccaaaattccttattatttaaatcaacaactactaataattataataatttatacatttggtttctctaaataaaattatagcgtatattattttgaaccaactcaacaaaatttttaattggtaaatttaatctctaataaattcgaaggcaaagaaaatatgtatgaacatgaacctttcagtagctatgcacatatttagttgctgcccaccacaacgtttgaggttgaagaattatttactattcggtttttattgagccgacttgttatcttttttattattttataaggaaatattaaattaaaaatatatttacttaatatcttaaaatatataagaaaaaaatcgaatgcttttttacgtaagaaatagaagttaacaaaaagatatgttaattagaatattagaataactctatccttggcctcactctttattcataaccatgtgtatcagtgtatactcctttgccctaagttatagtactattaataaggggaaatatctctccctgccatgttaattggtaagaaaaacaatttataatacattaatgaaatattgcgtggtttccatctaatcggtcgacggatgagaacataaatgactctactactatatactactagatagagtttggcccaatgaattttattttgataaacttaattcatgaaaataatcatattatataaatatatgacataaaaatttagttcaaattataaatatctatgtgcattaatttctaaaaatatatcaacaaagattgttaatattctaaaaatattaagaaatgaaatattttccattgaaagattaaattgaatttaaaatgtttataaaaatatttaataatttaaaatacaattataatttttttttattttttcatttaaataatatattatattaacatataaagcaaaacttcaattaaaatactaaataattaagtctccaatgcacagggagaaataaattgaaatgatttctgaaaataaatttaaatactaa

SEQ ID NO: 1445 - DNA, 1035 bp, Glycine max
  Soy_ogl_5574 Gm17:7854371..7855405 Cluster 5
atcagttcttatttgtttcatacaatttaaattgtaacattaaatttatatttgatgtttattaactcgtatcattaaatcatatttaacaaaattgtatcatttaattaaaatataaatatttgcaaaatttattttaagaaatacatgaatttagaatgtgaaatgttatattaattttttcattaagataaatcttagtgttagattgaattcagaattaacaataaaaaattataaatcattttactaatttggaatattatactagaagattcttatttcacaatcatatatagcaaaaaagtaatatctataatagtgagtatatgtataaaaagcataaattataattttattttttatattttagagaggaaaattatgattatgcaatatgattttaattatattaaaaataaaaattgtacactaaatgtatataaaaatttatttagagtttaaaatgataaatttatgataagacaatcatatttattttaaataagatgattcaacaattaaagttattatgaaaaatataaattttaaacattaatgtgataaaaaaactaaaattaaaaaattacacattttttaggatgattcttttttatataacaaaattatataacaatcactctatacatatacaaactgttaatccgtgaatcgcactgataaaaatcagggaatataatattaggatatacggtaattaatatgaggtaaattaatagtaattaaataaaaagctcaaaatactttaaaaaaaatacaaagagataatgataggtaaaagtaaaacactcgaagtatgaaacatagagagaaatcactagtaatatgattgacatgagtcatacaatttagtgatttttttctttttcttttttctatgactaactatcatcaaataaaatgaaatgacataaacctaaattgtcatacgaaaataaattaaaccaacactaacgaacatgcctacactccatttgattattcaactccactttttgttattgatcaatcata

SEQ ID NO: 1446 - DNA, 1000 bp, Glycine max
  Soy_ogl_6333 Gm19:2141601..2142600 Cluster 5
attttaaattctaccattaacacattgattatcatatttatgtgtaaaattaaaattttataatacggaaagagatcatgttacactctaaaaaattactcttgatataacttgatcccttttcttaaaaaaaatgttatatatataatgatataaagtttttttaatgcaatatatagtataaaattttagttttacacataaataagatgagaaaaattaaaggttgatatactaaatgtggtagtcaatgaattaattaatagtagaatagacacttatctaaattatattgacaattgaagatgaaattttttaatatcatttttacttgcggacgtttgaatcatgataaattttgcattcctataaatatttttacctgggaatgctattctcatatacatatttggttagtatttaatcattttagaaataaaaaaataaaagtgaaaaaggtaaacaaagaatgtattgggagtaggtagttatattatagacaataattaactttcattcccacgagaatatgagatactcacccactcttggtcgaaatgaaaacatgtaacaatcctaaaaataaaacataataaaaaaatattctttttataaccatataaataatcattgaacagatatgagaatatttccctctcatatttccgagagtcaaagagggtgaggtaaaacaaacatcccttaaaagaattattatgttgttgtcattggtcttaagtttgaattttttaattaatgtcttgagtttaaattttatgagtgaaaaaaaaaagattttttattaaagataattagttaaatttttgaataaaagttcgtcttctataaagtaaatgaatattttacattaatagcataatcacaaaagaaatattataagagaagcacaagtattaaaaaattaaaatttaataccttaaaataaaaaaaaaaagatttaatatttaccatacaaaatatatataaaaaaatagaattg

SEQ ID NO: 1447 - DNA, 1400 bp, Glycine max
  Soy_ogl_1773 Gm06:3045601..3047000 Cluster 5
ttatcttaggaagcgtatcatctgattcggatggtagtttgaaatcataccaatttacctgtaaactgcaagtttaatcatcttttatatcattatcgtaatattttaacatctacaatgatatgtgtaagacttaatttaatttacatgtcattatttttatcttaactatattttcaatgatataaataatcaatacattagccttaacttgcagcgtataaaaaccaattaagatcaagtcacgagattcaacaagtgtagggaaaatgccatgaaaattaaaaaagtaaaagagccaggggaaagaatgatgcatgaattgaacgtgtgcttgcgtgtttaaaatttggatatttattggccattatttgggttccgacccgagcgcgtggaccccgtgctgcacacaatctgataatagtgtgatgtagacgttgataaagggacaagtaagttagttaatcaatttagaagggacacgattcaatatgataggagatgagattaatttggtggtgaaaggagaaaaaatattataaatttgattttttttattaataatcaattattaatatttataaataaaaaaaattcaatatgtcacgagacattttgttttcaatggtctggcaacccctaatataagattagtacttttgttgctcgttatattaattttataattataacaagcagttctgtttaactattctaaagctttgtgatgactatacctgtttatgatttgcatttcaaacaattagaaaaattatagtgcagtcactagaccaatttttgtatataaaaaaaaattaagggtttcttgcctgctcctttcttattttaaaaaaaaatcttttctgttttaaaaaatattttcttaataatagtaggtttgatttttttaaaactaatatacatttttaatttttagatcatctctaaataatctaactcttttattttcagttttccattactcatgtttttccaacacttttacaattttttacagaacacttttacatcttattttctcacttttatgatctaaataaaccgtttttaaaacttaaaaaaaaaacacaaattaagttatgcggaaaatgtgtctagaatcataacctaaaaattgtcctcaacaaaataaagtaaattatgactattgagcaagcaaaattgtagactctgagccaagaggagggaagggttcttagcaaaattgtagactctaaaaattgtagactattgagcaagcaaaattgtagactctgaatcataaacaaatatttatgatttaaaggcaatatattaagtgaaattttttgttattgtgagaaataaaaataataaatataatttattaattagaccatatttgtctggttaagaaccta

SEQ ID NO: 1448 - DNA, 1090 bp, Glycine max
  Soy_ogl_5652 Gm17:12328325..12329414 Cluster 5
ttccagttaaaaaaatacagcttttccaactcacttaaactaaaaaaaaaaacagttttgtaagttagatcgtaatatgagtcaatatcctcctggttttaaccgaagagaacgttaatatcaaaactagtcaacgaaactgcatgttgaaaataagttgcatcgaaatcttcaaattataaattggggacatataggtcttgttgaaaaaggtaataatgtatgtacgagtaaattcctcttaccttcattatacaaatctcctcctttgctgaaaattacaaaaatgcccgtccacattattttatgctagtaaatttatcatttattgtgcatatgtaaataaaaatatatataaaagataaaatattaatattaaatagtagtgaaattatgtagttaagatttttttaaaaataattaggattttttttattagacagaattaaatcaaagggataacagttttgaaagtgtactaatttaatatgatgtgttcaaagtaatgattaaaaattatagtcaaattttaattcgaactatctaaatttaggtaataatatttaagggaaatgaaaaataaaaaaacaaatataatgagatacttaatgcaagaaaaattatgtgactcaacgagaaaaaaatagtttctaaaatttcttttattaaaaaaagaatactgaaatttataatatgtagataaatactaatatacctcatgattatgataataataataattagtaattgaaataaattataagtattttataagagtaatatttttttatatttttctttataatttaaattttatgtgttataatgaacacaagtggaatattaaaaaaaaaaaagaacacaagcggagattcctcttataatgatagtatttatctatatatcatatacagttaccaagaatttaatcaaattcaattagatttaggtatagaataaaataataaaacaatcatatgactgatttttttacggtattaaaagttttttttttcattattaactcttcagataattggtaaaagttcaagagctgaagtctccaatggccaaacgaccctttgaactt

SEQ ID NO: 1449 - DNA, 1136 bp, Glycine max
  Soy_ogl_4438 Gm13:33725365..33726500 Cluster 5
aagtaagatagataaaattaaagttaattatattcattaatcagggctagcctaatagtacatcatttaagtagaatgtaaatgattatatgttctaacttcaatgccaccatcatatagagggacaacaccagaaacatttgttttggccgagggacgaaaatttaacacttaataagttaaaggtttaattgcatattttatcactcactcgaagttttataatttacaaattttattactaaaacttttaatttctacccattttaccgaaactgatcatgtcactaaaaaaattatcaatttttgcaaaataatgttactttgttaccaacatgataaaatgtataaaaaaaaactgaatcataaaattcaaacaaaaaattggatggaaaaatttataaaataatgacaattgatgataaaatatgcaattaagcctaaatgaaatcaacaatgatttataattaaaattattttttctcatataaattaatttatctaccaaattaaaaacaatttaaaatgtaacataaaattataaataagaaaacatatttgaaaccaataattcaataattaaaacagtaaaaatataacataattaaaaccaattaacatatattttcttaaaattatatagcaaacgaaatagtcagtgctactataattaataaaagaagatataataattagtgcgtttaatactttagttatttaacaatctgaaggtttgctctggctattattacaaaaaaataaaattatgaatccatttgttagcatactttcgttatttaacttgagcaaaggctaaaccaaaattaaagagaaaatgcatttaatactttcgttatttattaagttcgagagttttaaaaaatactattaatcttctgtaaaacaaatactagtaatctgattggtttataattattttgactatacaacatacaataagtatatatttatagaaaaatagtgggctgaaaataattatgtaaaggtgaaaaacgaagtgaagggggactaaaagcaagattagaaggggaaggggacaaggaaaagggagcaaatatttaatttttataaggaatgttcagtaacttttgtcatttagggggacgatagcccat

SEQ ID NO: 1450 - DNA, 1030 bp, Glycine max
  Soy_ogl_4662 Gm14:4953401..4954430 Cluster 5
aattttctaatatatttttgaactatattatgaagtgagagagtttactcatcgagtgaggcagaactcttattatgtcatcttgttgaaaaactaataattagtaataagaatatgttattattcatgataaaaaagaatatgttattatttacttattttaaatttattagaggacaggtaaatgtttgaccaaatgtttgattctaaggacatctctactaatcaaaacttaagatatttattttggatatcttagaattatttttaatttttaagaaactttgaagatggtgactcagactaaaagttaaaaaacccacaatgccaattaaaattgttccagtaaaaaaatatattataagaaactcattaaacatctttcattgaagatgacgagctgctctcattcataatatcgagagagaaaatattatggcaaaaaaatgataactgaacgaaattattggtatagtaattgaaatccacaatgtcaaatgcagtatgtcattttcaagtgtcttcttcaagttgagacttgagcccacccacaaaatatcaactctctcatttaaaagttaaaaacatggaatttattttattatttccaaactaaaaatattttttaaaatccaatatattgaatttaatttttaattagaataaatttatttatgaaatttttttaatacacctatttattttttagttaaagtgtattaacaagtgaaaactagatattatcataaataatggatagtgtaatttcttattcactccaactaaaaaataagttggtgtacatcaatcaacttattttttagttacagtaggttaataaattactagaaattgattattttaaaatgcacactaggcataactttctaacgtaatctaattaaataataaacagatatatggaaacaaatttctttatttttattatataatcataatacacacacgatatagcttcttaacgtattctaattaaagaataaatagatgtatgttagtaaatctcttt

SEQ ID NO: 1451 - DNA, 1000 bp, Glycine max
  Soy_ogl_6920 Gm20:41913201..41914200 Cluster 5
cttgtcttactcctacgcttattggggattgaattcaatagcatcatgattcgaatatatactgtataaaaaaatggcttcttacacaaagagcgtataagtactacgcgtataagtcctcatgttgaaaattgaactcttaagatgggatatttcattggtaaaattcaatcatttcataatttttttgtaagagtatttgttcatttagtagaaggcagattaattttgttaatacaattaaaaaggtaaaacaatataattctcacacacatatatatacaagaaaaaagaaaaaaaaaatattaatagggaaaatgaataaagaaaatagactaataaactgttgacgttatgcttgcttaatttctttctgatattttatctctagttttatacataaaattaataataaatatttttataaaatttgttatttattagaagccaaatatttaataattatgaaaaaaatcccctctaaatacatttttagatctgttcctaagcataatttaagtgaatgatatattataaaaaaaattaacttcgatcttttacactcttacaagagagtacaaacgtttttatcttatggcaaataaaaactagaaatatgagtcatatagtgatacgtaaatgatcaatattaaaaattaatcagtgatcacatgaccacttaaaatagtacacctggatgattaattaagcaaggtcaagttaaacattgtttatctattctaaaaattttggaatttcacttactgatctaaaacttttatatatattcagtattttaactgttttttttttcattttcatatctcagttgacattatattaataaatgaagcagatatcaaaactttatataacttttggtgaaataatcatttgctaatatgcagtcaagaatatatatactaagacagtacttaagttccgaaacaaacagcaatagcatgcttagaattatagtgaaaacaaaattatttgagta

SEQ ID NO: 1452 - DNA, 1126 bp, Glycine max
  Soy_ogl_3574 Gm10:46279901..46281026 Cluster 6
tttatattatttcacatttttctttcttctcttcctacgtctcttcttgttgtaagatatgttgtgaaaaaaaagtattggcaaactagctttactcatcactaatatgataatttttagtgactagtcctagatatttttaagagatctatatattcagttttatttgatgataaaaaaaatgagttaaaaaagctttaacatgaataatcatttttgtgtttttttatttatcgttgacatgagtttatttaaaaatacactaagaaaaatgctttattacgcaattcaagagcagaaaaaggcttgatggaccgagtcgttagcagatcataaattctcaaaataggttataaacacttaaaaaatatttcgcttactgttttagtttttaaatttaaggtgtgtatttttttgtccctaaattttgaagattgtatttttttagtccctaatataataaatgataatttttagttgtcttaaattaaattttattttttaatcatttgaatttgaaaactgtcataaaatattaaaaaaaattatcacaaagtacttaaaaactgttataaaatgtctagggattaaaaaaagtaatatattgttaatataattattttaaactaatgatgtaaacgtatggattctctgcttgaagcgtgttgcctttgcagccaaaaaatacaaaaagaaaaagagagaggataaaaaattgaagttagataatagagagatgaaacggctgtagaggtctagagggactgtagagaggatgaccacagaggatccaaactcaagatacaatgtgtcatattcatgaacaattttattcatataaattattaatatatattatcggtatatcatactaaatagtataatatattatacttagaaaataaattatacattagtataaaatatttttattatgttattcaatcacaacaattccctttaaaaatatgctgatacaaatgtcaaatttatactaataaacattttccttatttaattagtaggatttttttagaaaatagattatacaatgacaatttaaaacagttttaaatacatctatattgaattctttatttataagggccaaacatttttttatgag

SEQ ID NO: 1453 - DNA, 1566 bp, Glycine max
  Soy_ogl_1043 Gm03:42504035..42505600 Cluster 6
ttacttaatacatactaatagaaataaaacaaaatatatcaattataacgatagtatataaagtactaaatgtaaaaataaaactcaatatgcatagattgttaaccttaaaataaatattgacaacgcatcatcaactattaaaattatcatttatgattctactagttatatataaaaaaaacttttatacattcttaatttgatcctatacaaatagtacattttcaatttgactccttacgtaagagaccaaattaataatactttacactcataaggaccaaattcctttaaagagttaatgctctcaaagtataaatcagtaagattgacatgtatagagtgcttcaataaatttttacatttttgtcacaaaaaaaaaatacatattgggatcggaccaaattaaaaaagtgcaataaagataagaaataaattatatatttaaccttaaacataatttcacccttgctttgttataattaaaaacaattatttattatcgtcaaatttcacttaaaaataatttcattatatagacatattgtgtaacattacctttttataataacaagtaatctatataattaaataattaagagaaaaaactctagttgtcaaatatagtgaatgtcttttttatgctattaaaattaattaattaccaactatatttttcttataagtaaaaatattatttattattgtcaaacatcataaaaatgcttcattttatagatattgtttttttaggggatattgttttaactcttacccttttttctaataacaaatactatacataatttgataagaaaaagctttagtcaatgtatcaaatttaggaaaaacttatcattgtaggaacatacatgtgaaatgtgacccctatatagagagaactccggacacaaagaagttcattgcctgttcttcaacactcaaccttcgttgtgggcttgtagcttatcgtaaacattaccaccaaaacttaaaaacgatgggtctaagaatgtgtgtgccagggttcttgcttttactaatcatcggaatcttcgaactcgatgtcgtttctggttacattcaaccaccacctcgtcaaacactctttattccacatacagatcaagactctcattctacacaacaggtacaagtacaactacaactttacaaatttaacgtttaattttctgcatcaatattttagtgcttaaattatttgcgttttacccgtcagcttttaacgcagaaccaaaaacacccattgaattgggttggttgagtttgtgcctctagctcgctgcaccaaatgtcttacagcttcctaattttattttatttttacatcgtgacaaatgcatctcacgtcaatattcaaataaacaaaataataatttatatatgaattgtcttttttattgaaatatgtgctttatcatgtgaagtgtgaacaatattattgccaacgatttttttcttctaaaaataaattatcaggaagttttgttagataattatgatgggagaaaaggaatggcttttaataaactatattgtatt

SEQ ID NO: 1454 - DNA, 1200 bp, Glycine max
  Soy_ogl_5909 Gm18:2723601..2724800 Cluster 6
ttagttgtagtaatcaaaggtaaaattattttgttatgagttactaattaatattattattggcttgttttttagttatttattattgtattggtattgttttcctcgtcttgaactagaactatttagcgtaacacgtaacaagtcatttgagtattaaacagagacacgcatgaggatagcactaacaacgtgcagaaacacaacatgtggaagatgcaatacaatcacacttgcttgcaatgtgtacaattgttgttgaaggggaaattaaaatatggcgtaacggatatcgggtagggctactactacaatcgaataacaatcagttatgggagatggattactggcgtaaacgagttgaacttacactactttataataatttatttttttgacattgtcaaataaattaacaatttaatagatatatagtaggtacgattattgtcaatataaagtaaattatacaaattcttgaaatttattcttattacacctgatactctctttttttatattattttgagtcttctaaaggaacttgtgtaacactttttacacctactataacaatttacaactcagaagtaagaatgaaattgatataaccaaagctataaaaaaaaaggatttaaaaatggggatgtattgaatataataacaaaaaattcgagaaaaaaatttgtataatttactcttacatatgactatgtctaattgaataatagtagtataaaaaatccttaaacttgatgtatacaattttctctctctcataaattaaagcattaattagttatacaacatttatcatgactatgaagcttaccgtattgaaattacttacactactgaatttgattgataaaactttcaagcttttaacgaactaaaactcacaaatcacaagtatccttttcttctcatcaaatcaataacgcgtatagtaataatggaaaaatcgactcataatctaggattaattacgttaaattgaagtgatttttttagtttcaattcctaatcaatttcactattacgtgaagaattaatttggaagagtacacaaataatttcacttttgatttttctgatcttatgcatgcaggggtttttataaaatacgtgcaataaaagaggaaaatggaagaaaaagaaaagaaactaggttgcttataggaaaattgattaatttgt

SEQ ID NO: 1455 - DNA, 1559 bp, Glycine max
  Soy_ogl_1497 Gm04:48785589..48787147 Cluster 6
actaatttaaccataaatttctgactttttcaagtatttattcactaattaatgtttaaatttttattaatcatttgtatgacataaatttatagttctgacgttttaaaaatgagaattattcttattatataatttatgtttattatatatataaaggtacggaattaaattacgagatgttaaatttagtaaaataacatatttgatcatttcttacaaaaatcatattttatcactctaattcatattatattatcttgacaattaagtaaatcaaattttagataatttaaaaatatttgtgatctataataaaaatttacgtattttaaatatcgtatatattatatgttaaaataaagtaaagtgatgaaaaaatattctaattgcatgaaattttataaacttaatatatttcataagaatttttaacacagtagtgggattaataaattttaattattctttctcttatatatttttaaccctcattgttattataatttcttcttttcttttttattatatccatcagtgttatttctctcttactgggtggggattatgtctcaaatgagtgtcaattttatttttcacacacatatatatagatgcagttatggacaattatatgtagaaggttagcatatatattaatacaatataacaagaaatttcaattagaatattcaaataggaagatcattttgacccactctactccaatatatgccccttcaagatgactgtgtggaagacagacacactaatcttggacaaatgtcttagtcaacaagttgacaagttggtgactagaacgaattgtgagaaacgtggtgagcatgggaaactactaataagccacgcacaaagtgataataataaaagggtgcttcatgaatgagtgaaacacaggattggctcataattaattaattaagttaagtagcaccaccaatactatcacaatagatggtggataagggtaacttgtgttgtggaaagtatttggattattgaaaaatgaatgctttgtgtgtgtgtgtaacactttaaatacaaactaaaaataaataaattacaaaacttaaataggaagattatcttaactcaatcaatactcaaacaatgtagttatctgtcttaccaatagaacgtttttgaagtgaatttaacatttataacctattgttcgtgatattgccacaataggttgcattgtcttgattattgttaatgttgctcaagtagcacaatgatgtattttgttacaaataatggtgcaaaaatttagtacttctatcttccaaatctaagtgtgtgttttgttctgtgtccccaaagtgtttgtgaaaatggttcactggggaaaatttctggattagaaataggttaagggacagtggcatgataacatctgacatctgatagcaagtgtttttattctttgtaaaagtatttttattaacaaatttgttttatcctcgcaactgtgttatttaattcttggatggcatatcacctcacagcttcctcatcaatgaatatgttataat

SEQ ID NO: 1456 - DNA, 1192 bp, Glycine max
  Soy_ogl_3537 Gm10:44987409..44988600 Cluster 6
atttattgataaaataaattgtaatttaaaactttttaagataatataaattattaattttcaatcatatattatcatatgcaagaagagataatattaattactatttttaattaacaaaagaaatgattgcaaggaaaatatataaaataaattgatgctacaataagaaattttaaaataatatattgattatatttcttaaacatagataaaaagaaatagagagtcgaagtcattttttttattaaaaatatcacatttgatgttatcaatgcatttttaccatattattaacaaaaatatatatctatcaatatcttaaatgttgtttttaggtattcacgagaataccgtaagcattaatcctttaaaaaattagtatgtgcaagctagggtttatatatataaaggaataactcctgtattttttggtgctgaggaataattcctgtataaaattaaaaatcaatcaatgccgcttttatttattatataaaagtagtgtcagcagaacccctctattctcctcttcccatcttgctagctacttgctacatacaacatgacaactttacaagagccatcctgttcaggtaccacaggaaggaatcttattactcatgtcctctaaaaatcaattaagctattcaattataatattctttttccatgttagtccgtgttgactttgatacatcaattatatattgggattctccagatcaacatgttcattattggacccgtgcggaggttgaaaatgctattcaccgtaaaacataaggaacaaattaacaaagaatacgtaagtaatgttgatgatttctattatcccttgattaacaagatacatctcaggagcacaaggaaaaggattttcgtatttttttcataaaatatatttcaaaaaaaaaaattgctaccaataaaataaactatatataggagtcaatattatatataactctatgcatgactatattcgagttgacgttgaaactttttaatagtaaatttgcttataattgggggtgatgaacaatttcaatgtccccatgagagatcaacaaataacaagtagatggagaaggcccaacttaaaagtttagaaacaactaattggctagtttggggagatttttagtattaattttttaaaatgtgaaaccaataacgaccattttttagt

SEQ ID NO: 1457 - DNA, 1400 bp, Glycine max
  Soy_ogl_1044 Gm03:422801..42508200 Cluster 6
aatttgagattgattaatgctgtttcacttatttaatttttttttttttgttgtcaaacaagggtttataaagacaaagctaacaattgtgctccagttcaattcatatcacaattggagacgggggaaaccatgaaggccttgctaccaagtaattaacatttgacctttttcttcttcttatcaatattaagtttgagcacttataatttcattgaaattaagttttgccatcgtttcgtgcaataatgcacgatattaaatttttataattaattctgtttgtgccaacaatatcaatatttagggagggtagctttggatacggtacattagaattatttaatgcatctcatgcacattgaacttggcataagaaagataacgatgaagccgttgttagtgattctatgcggcttacaagtttctcctctaatccttcttgtaaatagtgatactttgaaaataatgatcctagataccttgcatttatggcaagctgagatgacagatcgatgttttttcttattttatttattcattttgatgaaataatgacatggatatatttggaggttcaaactcatcaaccatgactagacatgactaacacataataaagtgattatgttatctgattcttctggaaaaaaaacttaattttctgttttttcttattatatttttcttcattcttggggggaggagcacgagtggtagttacttgttactaactggtcacttgtgcttatcccatatccattaaaaatatatctacaaattcctttataattgtggatatttactataaaaaaataaagcagtactttaaaagtattataaataatttaattataaattttatttattctaacgttttcttaaaaaaataaaaaaagttaaaattaaattatttaaatattttacacatttactctacacaattatactgatcaagatcattaaatttataaactaataaatttaaaatacttcaatctcatgagttcaaacaaaaggttaataaactaaaataattcaatctcataaatccaaacaaaaattaaataaagaaatacttcaaaatcataagtccaaacaaaatcatttaaataagaacctttacgtatacctcgttatccgtcctgccccatttaataataggcggtagatatatttgcttaaattatgcacgagtatccatttaattatcaatattctatcctttacgtattttatatgcgagtatgtatgtatgcattcttttatagagagaattataaaaataatactttttaaatgaaattataacaaatgtgttcttaactcttttagttgtttgtttaagcgatgcattgataatttgatattgctctttataattcatccctcgacaaaag

SEQ ID NO: 1458 - DNA, 1337 bp, Glycine max
  Soy_ogl_3611 Gm10:47795604..47796940 Cluster 6
aacacatgatacggacaaattattatgggcctcatgtaggaagtaatactatattcaacccaaaataaattgaaaaatattataaacatgatcatctaacatttggcaccagacttgtgccaatgaattctaaattatatatctaaataaaaataatacattttgatttcaacaaaataaaataattcgtaatttttaacgcaagttcgtaacattttttactttacaaaatcggcaacaaaaaaaaatgcacactacatcttgcgattcacagctatcacctacaaatatatgtaattttattgtatacatactttgtctttataaattcttcataagcgaatgatcaaaaataaaaatcttcataagcaacgagatgattacataataaattatgacttttacgagaatttgtcaaagtttgtaaacgtaaattctatatagatattattactgctatatatcccaataaaatagctgtccatttttcctatttaatttttaaagtatgataaattgataaaattatcattatgtgtttaaaaaagatattatgctgcacattaaaataataaaatctaaactaaacccaaattatctagcaagaattggatgcaatggcaactggcaagttgacttctcaaaagggtgcaaaagtttgggctcggtaaaagggtctaattatattgtttcttactcgaatgaattattagtttcccactcgagttagataccttaaaaaaactacacttatgttcataattatttataattaaaaaaaagtttaatattctttatttatttattcatactgttaacaaaaatcgaaattgcaaaatttttgctaataaatctgtagattaggtagtagctagcaggggaatcttcaaagctaattgatgaaaatcgaagatgctaattaagaaaagggaatctaatatcacacacatataaaataagtctgtgcatgttagcaatgtacaccgtgttagatttcaacccttggattaaataaaaatagatcaataaaatttggtgtcaaagcttattaggttgttatatgataaaaaaaatccaatgatgagtcaaaatactcaaagaaataactttgttatgagacatgattagtttttttttatctataaaaattaaagatatatattaaagaatgtataaaattcacatggattatttaatcaattgaattaaactcctttaatataaaatataatcaattaacatttgacactaacacttaaataaataaagtaataactttttttataaaatacaaaagtagtcaatctaatcatcgaataatttaatattatctttgt

SEQ ID NO: 1459 - DNA, 1100 bp, Glycine max
  Soy_ogl_5218 Gm16:889301..890400 Cluster 6
attaattaatccgcacgtcttatgtttctatttacctttttgcataatggttctagcttttagtttttagctaacattttcgcttcaaattattttttaccaaacaaaatgtaaaaaatatttttttttatctagtaataagttatattgaaaaaaaaaataacttgtgtggtggctgtcgacatcagctttaaattgtagaaacaattagaggaataactcaatttaaagcaatcttgcatgtgatatactcacaaaaaaaatatttataagcatttcaagagtttaattttaaaaattaatttgtccaacattatattcctctttcacccgtgtataaaaaaagtgtatattgtcttttactaaatttaagcttaatggaaaagaatgagtttgatcatacatccttagagaaattgtaaattttaaatatgattaaatcttataatgagattagtcacacaataaaatacttacactcacactatcgagaagtctctccctttccattaacctttgtgtgctcgttgatatcctatgggtataccttcacacacacaatgtcgaagttggacccaaattgaccacttgagaagaagcattacagagagaagaaaaaagccattgattttagtttaaaattaatccatttgatttgcagtaaagtcaagtttcataattgaaactagttttatatagtttatttgttaaaactaagatcaactcagatcaagatgtatggattgaatatttaggaacatatatgcaatttccctttcattttatatatgcaatgcatcaaaacaaaaatatttcatttagggagagattcttgtgttttggaaggagagaggattgtcaaatgatgtttgatgtaatctatactaatgttattcttgatacaaagtcaatgaactatatcatcccaagtcaggccagttttcacaaagtaataaataaaccgcaatcaattcataattgtttaaaacaaaccaagagtatcagaccttaagcaaagggttaatgttgctttgaatagctttactgaatttcatctttagagtttctgcattggaattgtatccttcctttaaaactac

SEQ ID NO: 1460 - DNA, 1231 bp, Glycine max
  Soy_ogl_2906 Gm09:448270..449500 Cluster 6
aattttaaaaaagtaaccttatctctatagaagtttttctccacttttcaccatttctagaggtggtaaagcaaactatttggcccgatgcaagttgtaggctgtgtatcgaaaaagagagagagtatgttaatcaattttatcttctaaaatgaagccgatgtccattttttccaagtgttttgtgggttttgtaagttaagtttgtttttaattttattttatttatcactattgtttgagtaattttgacttaatggaattaaaaaaatgcatgattaatttgtggaagagatgttgctgtcaacaactttttcaaaaaagttataaaataaacaattataggtttagtttttaaaaatttaaaaactaaaaataaagccactccaaacaccaaataagatacaggggaatgaaagttctttcctacaaaagattaatttgcaaggtagcttaattatggagatcaagaacatgccctctcctattgtctttgtcttctatataggtaggtagtaagcttaaagtataaacattataatgatatgtttggtatggtagagagagaaaggaaacaaacaaaaagtatgaaaatttaattaaataattttttttaaaaaaataatattggtagaaattaactttttttttctttttactttatgttctaagttataattttttttatatgtgagaatcaaagttaaatatcttgttagggaaaaatatgcttttaattattttgaatatgattaagtttgatttcaaaaaattgttttgtttttcgtaaattgaacaaaaattgaaataattccactctttttaataatgactacatgcatatcatggcattatcaatgatcatataaatcatttaaaattaaatttataaacatgcattaaaattgattaaaaaaattaagattattaaaataaaatttatttattttataaaaattagtaatagattacatcgattttaaacctagcatatttattttaaaaattaatagagattaaactccagatattgtcacagaggaaactattaagacgaggtaacctacccaaccgttttattctccaacccatgtaaatgtaaatggtaattagaacgaggaaataggagggaactaatagtttaataatatccgtacagagactactttttcttccttccatgcattaacaaatttcaataccttgcgacgtttttctttaactttggtct

SEQ ID NO: 1461 - DNA, 1812 bp, Glycine max
  Soy_ogl_5227 Gm16:1298889..1300700 Cluster 6
tcaaaaattatttatttcttaattttgagtcaatagcttaatcaattacttgtaaagttattaaatcataatcgttgtggatacaacaactcactttaatactttcttacttgtacaagtgacacttgctgcattcctaacacactcattgctatagtgtaggatgataagaaggaaatgggtattattgcattctagctaaaggattttgaaacaaagagctatgcacttaaaatatacttaaaaacaagtatatcaacaagggaggtcagttcaaatattatatcttgtcaccttctaaaattttgcattatctttagatgaaagagagaaaaaaccccactttttaccttttagttcaacggaaggatcgtcatctggaagaaacaaattgggagaagtgtgaattactcaagggataatttcctaattttcatctagaggaaaaaatgaaaatgtctttatctaatgatataacacatcttgtacagacatattttaagatgaagaaccgtgaaaaggagatagagttagaaggttttgattaagtcaacaatgaccacctcattactataatgtaaaggtgtaatgatataacatttcctttgcaaacatatttcataaggaagaaatgtgaaaaagaagacaaatgttgaaggttatgaccaacttaacaatagccatccaactactataatatagactaagaagataaaaaagaattggaagatgtgtacgttcaacattaatgaaagattgtgtaaaaaaacattaataaaagataattttttagttgtaggtacagtagtttataggctatgtaggacattatgaatatgagtacattgtttaggagtaagggaaaaagattttattcgatatatttatatattttgttagaggcgaatcttttttgtatggatgttctactatatgccgagattcttagatttattatttctgataactcttatttttttttaaaatgttcatgcgaaagaataaagatgcctaatagaaatttaaactttaataagagaaacacaaaaagccctcaagacataaaaatgagtttatatattttattcattaatgttaatttgtaaaatattgaacatgaaaataccaccgtcttgctcaactcatttttccccacaaaacaagtaaacaaaaagccaaaaaattaagatcacttaatgtatgtttttaattttataaatgacagtttatatttataatcctatatgttgaattagaattaatattttaatataaaattatttctcccacgtaaaaggatatgattgcaccctgttgcaagttcaattaaatctctttgggtttcgcttctctaggatgaaaagtttgtaactttgcccaaaaaatcagttagagaaagaatcatcaatggcgattgaacacatcttaagaacgagaagaatattgaccccctcgaggacaaggatgacgttgctcttctctcaacttctttggcgtcaaaacaacctctttttcgccaccactctccgtattgccactatttccacttttcctcttcaccttcatcaccaccttgtgtagcattgtcgaactattcaagtctctcaatttcttcttgactttagctcttttcttttgccattttctgcgacaatttcgatcttttctctctaccctggtaaaaaccatcatatgttgatgaacaatgtccaaagattgaacaacagtctaaacaaccatgaaatttttctgagaaaacaaaagtcaaaagagatgatgtttcggttggattagaattttgtaaggtttgaa

SEQ ID NO: 1462 - DNA, 1300 bp, Glycine max
  Soy_ogl_3968 Gm12:1401101..1402400 Cluster 6
taactccaactccctggagcttggaccgagggcctccacctcattctttcaccttcaccatctactgtttcgtcttgtcttattttcctatgtaagatagaaagaaaattaagaatcaagctaatataagatttttctttctttaagaataagagactatatcctctaaaaaaagagagactatattagaaccattattgattattatgcttcaatgttataaggacactcttactgaatttagtatgtttaatgaacatcattctaaacaaagatgtacaacacaacacttcaattgggtcgctagcaacatcgagaataatagcttttaatagtttacctttttttttaaaggcaaaagattttaataatttaccttaatactagtgtaagattaactttatatatgtaaactagggaaagatatgtgtttgtagttaaaagcatactttaaattattttaccttgtaatttgtaatttagattaaattgtggtttatgataaggtttaatattttgaaatatatttttatatatttattacaattttattataattagaatgcaataacagaataaatatttttataccattatgcaattatcatttatgataaggttatattatgtcgttgatctaaaggatttttacttaatgaatattgatcacatgattttatgctaaataaattgttcctgcaatgtgtggatgcattgtgactaattactatgctaatatgtcaggttgaagataatatacgaaaattaaattttatttatgatatattgaatttcatttaataagttttgttatccctaaaataaaaaaaaaatagagttatcccatttgaaaaaaatcggattgaatttatttaaatttaatattattttcaaactaaaacgcaatctttttattctggcaatttttttatagttaaatcagataatttttttatctcaaaattaatttaaatctagccacgaacatcttacttgtatgaagcgagtaacatcatgcaaaagctaacgattgcattccattttataatacattaaataattgggagtatgatataactattgaatggtctttatattattaattaatgtataaaataatttattattgaataaaatttacttttagtttttcaacatatactcataggcatatattagaagattcgtttttttagaaaagtataagatttatatattattttaacttaaataaagaggactaagaaattctagaatggttataagtggccagaaaaaagttgtatgaaccaagtgatgg

SEQ ID NO: 1463 - DNA, 1008 bp, Glycine max
  Soy_ogl_644 Gm02:44462001..44463008 Cluster 6
cttccaacgcacctgccctagcaaccttcaataatcacttctttttcgggaaaaagaaatccatgtaaaagttgaactagacgctttagcgtacgtaaatttgtttttaactaggaccaatagaattatcaaaatttacactcacacgacaaccatttagagtattaattaataattagtatgcgttgctaactgaagtataattgtataaattagcattatctaagttcctattttttatgtttactaaaaattgctaactgatatttgtagccaacttttggttcactcatctcttataagaaatacttttgttcaaagtgcagtcaattatatactctctctctctctctctatatatatatgtatataattttgttctgttcctcatcacctcttttgtgttgtttgatgacaatttaaaaacaaacgtgtaacaaatcattttatgttgtattgtcccttgcattttagtgaatcaaagacacactaaatgtttttttcaaagcagattcaaatgataatttgttatttttagcgagcgaatcgaagcttcttttgttatacttatcattttcttttagttttataaaataaattctttatttaatatttttgctagaaaaaatattcagtcgcataatatgttctttttcgaaccgatatactttatattgctttattttttacaaacgcaaattacacactgaaaaaaaaaattggtatagtgtaatctcttccaacttttcctttctgccttttggtaactcctttctagttcaacattcaacaccttatcaaattcgcatcttcaatttttttatacatatctttctttgttgagttagattttattcatatattgatttttttattattaaacatttacaatcttttttttatagtcattaggcatttacaatctattcagtattatattaacttttaaaattaaatttgcatattcaaattatctttaatttactattaaatcatcacttcttcttc

SEQ ID NO: 1464 - DNA, 1244 bp, Glycine max
  Soy_ogl_21 Gm01:1367087..1368330 Cluster 6
aaaaaaaataatttattagcatctcccatgagttccaccttggaatagggagaaaaaaaaagcttcaattttgtacatttttttaaagggcatggatgcttcttatcaaacaatactcaattagaaaagggaaggaaaaaaaaactccttacatgtttctctgcaaaataatgagtgaatgcactattttcatggatagggatccgttcagttctggttctgatctcttgagttaaagttcaattcgatggagaaatgacaaaaggacaaacggggaagaaacgatttggtttttgagataatgtgagatttgagaaacaaagtgtgacaactgaacgagatgatatgtttgccttacacagttacacactcaactattcatgcaaagtggaatcagtgtgtggtttccttttcatgcattattatggcaactaagacaagaaaagtcgagagaatcgaaaaagactaatacaccaagacaaaaggtcaaatgaagacgcatgaccccatattgatttgcatacacactttgttaagataaccctatctattgcagtgtaaatgttatgtttgagacacgattgctgcttatatgcctaatacgtgtaacatgtgttaaaaaataataatagagaaaatatattttttattaaaaatgatgaaaaaaatatgataaaaaatattttagctagaaaagtattgtttgtataatataacactttctatatgtattaacgtgttttatttcatatatgttgatggtttgtgttatgcttcgagatggtagaccatgaggtgataggaatgaagtttttttatttgtctgggattctaatataaaccctgcagtgtgaggaatgtgtgcgtttgtttgtttaatatctagtgtttcttactcttgcgatgtactatttaaattaaacttaattcgggtaactgaagtgtttttagttttaagtttttaaagttttaaaaattaaagttcgttttttagatcttgtttgaggtagtttttagtttttaaattttttaaaattgaaattagtttttagtttttattttcatattttgtagttccattttttatttttgttttaaaaatggttaatctaataattttttaaagtttactaaaagacgtgggattttcacgtgagactctgatgatatatattgatcagtgaaagtataacagaagcaaaaatttataggcttttgcgagttaaattcatattgagtcataa

SEQ ID NO: 1465 - DNA, 1700 bp, Glycine max
  Soy_ogl_302 Gm01:53089801..53091500 Cluster 6
tgaatgatatacatatttctaactgctcaaaaccccttgacgctcctccctccttccctctcaatgtcaatacattccaaggacatctcagccctgcacctaattcaattattgtttaatgtattattctatattacgtttttcccgtcttccttctaatttaaattagtacgtggtcttaaattttcgcagcttacttcttatatggtggtgtagcaataacctagctagctagacccttccgttaacgtgatttcaagctcatagttaacttccaagaatacccgggtggaggaggaccttttttttttcttcatacactaaaagaatataaaaaaattgttaaataaaaaattaatggctgagtttaacatatagattaacggtcaaaactcagttattgataatgagttagtttcgagttagcagaataatttgtcgatataatagtaggcatgtagttaatttttttttttgttggtgtagagttaagaattacttaagacaaaataaaaattaatgatgcttatttatgtaaaaataaaatttgagttaattttacacattttcattttttcactaatgaaatatgatatttatttatgaatttgaacccagtaaaaaaaattatgaatttgaatcattttcatttttcattaatgaagtatgatgttttagttaataaatatatcatcttacatactattaattaaattaacccttcacttaagactgatctctacaaaaagttgtatccttatccttttaacttgacctgtcttatctaaaaagaattttaagattcaaattcttcactcatttatttatcaaaagattccatcactcatttcttaagaataatttaaaagtgaccatagagcatataattaaatataatcaattaaaagcaattttattgcaaatatttcaactttattatcattttaatacatcttaatttttttatcaatacttgtataaaaacgaatcgatttcatgattttacctaagtttgattcgcatgatttcattttttggagaattaatctgataaggtttttagttgttttttttttttatatataattcgccaaactgtgcggccaattccttttattgtaatggaatgtatcatatagtcctaccataaaaactacaattatattatttcgatacattttttaaactatttttataattttataatctcttttcttcacattgctcattttattttacatattttatcttttataaatatttctcttaattataaaaataattacagaaaaagttgttgaaatggaattttcctgaaaaatatatggccacctaaaacattttaatattgtggaccgcttgtcaaattcttataagttagagttatttgctaaataaattaaatcaatatttttaaaaggtttaattaattaaaaatttagattttggtccattaaaaaaactttttttattaccatttaaaaaaattaaaccataacaaatcaactgatttaaatgaatataaaaatacgagaatattatgattatattaatttttattacaatattgtgatattatatatttgttagtctatttaaagacttaatttattagtctatatacaagtacagattcattaatttatgtttaaaattatgtttgtaaatttatttgataatcttattataaattagacttt

SEQ ID NO: 1466 - DNA, 1700 bp, Glycine max
  Soy_ogl_1451 Gm04:46948801..46950500 Cluster 6
tctttacattttaataccatgcgtaaatgaatataaaaacaataatattccttcttaccaaaacaagtgtcgttgaaaaaaaaatcgtcccaaaataaatgttgtatttagcttttaatgtaatattagttactcttttccatcaatacacgtaataaatgtcaatttaatttttgaatttaatattaatattactctttctcatccgttttgtaaagaataaatggtcaattttatcttagtagtttcggacaattttatccatttattatgaaaatgaacagtttagtttaaaaatttacaaatataccgacaattcagttcaactgttaagttatttcgttttcattagcattaagtgcatcgtgacatgtgaggatccctatgatagatctacatgtgtagggggacatttcacattccacgtcaaccaataatattttagactaaaatgacaatgaattttttttaaagttgatttttctattttcaaacctaacaattattttgagaaaaagttttttcttcttgatttcttgttgatacatgattacgcaatgacactctggttcccaatacttaaatgacaaaatggttcttatgaattaaaaacacattcataattaaacttaagattttgttcataatatagccaaatagtagcaaaatttctaatatcacagtactaaaaaaaatacaccaaattatgtattaatgttcatcattctaaccacaagtctaacataatattgtcacaatagaaatttcaaaaaaaataagttaaaaaagcaattagttcttcaaaaaaaaaaatagaacataagaggtgacaacttattcatcggagcctaatcatctaaaatattagattgtttccatgaattacttagaaggaggttgaggatgctgaaaatgtggtgtaggaatataatccatgaattttggttggttcattcttggagatgatccacttagaaagaaaactttactcataggagtggattggaagtggtctaaatgtaggtgttgttggtacaaatgttggaacatttacaactttaacatgaggggcactttacggtgaaatttcaactgcagttagttcaatgactgatacactttgagaacaaataattttctgatgcggtgaatgaatgaaattaatataaattaacaaataataacattctaaataaacattagatatattgagtaataatatactattgtctcaattgttgtttgcacatttttaattcatgacagtgtcgtagactattttatcattaggttatatttattgtggggaccaaagtgtcattacataataaggtattagcacaaaattaggaataagacacttcttctcaaaatagcttctaggtttgaaaatagaaaaatcaatatttttaaaaaaagtttactaacatttagtccataatattattcactgacatgcaacatttcctgcacacgtaaatttgtcaaattggctttcacgtgtcacgtatgcactcaatgttaatataaacggagataagttaactattagactaaattgttaatacatttatatatttatggattaaattgttcattttcataatctagagattaaattgttatcaagtaaaaattataggaacaaaattaatcatttatccttttgtaaaactattactatccttcatttatttatt

SEQ ID NO: 1467 - DNA, 1600 bp, Glycine max
  Soy_ogl_5784 Gm17:39512701..39514300 Cluster 6
tattttaaaaaaattatttttaaaactacagtagttatcacttaacaacattgaaagtcaaaatcactgttatttaataattttaataattaaaataatattttgtaatttgaaatattaaatttattagttttataattaaataacaaatttgatgcattattattgtatactagaaatatctataaattattgtgttttagtttggtattaattttgcgatttgtaaaaaatattttttgtttaaaactaaagtagctaaattattgatgcagtaaaaaaaaaaaatattgataacagtactgtattttattgtcttccctctcgtcgtatcgtataataagtaagatgtaaatgtaatgctctctcaaactgagaaaaaacagtaaaatatacatgttcttcttttatatatgtaacaataattttatatcatcgcagcaaggtatccaacttcttcaccattttctcatttgaaaccaccagaaatttcagtcaattgttaaatttccaaatattttttcacataaataaaaaattatgatgattttataccaccaaaaaaaaatggtaacagtgtacgattaccctccctcataacttcgctttaatgaggagcctcactggaattcgctagtttttttaaggtttgatttgtaataaaaataagaaaagtaaaaaaatatattccattaaggtatactcaaaagaaatatacttgttttagttgtttatataaagtaggataaaaatgtaataagagtatcacaattcacaatatacatgaaaatgacaaatttgctcaattttttaaagagacaagttagctcagttaaaccaagagtcagtgagttaatgtaatttttttatatacttaaatttgatttttataggggaaaaaaaatgacaaactactaactagctcaatgcaatgtaccttaaaagagggtggaaaaattattataatttatacttaaattcaacttttatagataaaaaactgacaaacaaactcaaatggtttgggtttaggtattgggcttatcattacacactgggttgagatttgagaatttcagaatatagtttccattttcatcattgccacgcacgcgaacggtggaccctttcggtcttcgtcagcttcattaatccaatcatcgttgcttcttttttatatatacctgggtcttcaactaaatactatcaattttcccaaaatgtattagtaataaaatatcaagagaaatagttcataacaaaaaattatccataaaaattgaaaacatataccaaggatttacaataattgagatatgccccttgaacttggttcaatcaatgcattttgtttgtgaaagtcaaattattccagacacaaaaaatatgatttttttgtgtaaaaggagttattggaaactatgtgaaaatcctatttaaaatattaacagtttaaattacaaaatcttcaacttaaaaaaagaacgtatacctaacaatcacttatgatctaaagttgtgtcgtctattcaatatgccccccaaaaatgattggattggctttattatatgatacagaataattaaatttggaaactca

SEQ ID NO: 1468 - DNA, 1300 bp, Glycine max
  Soy_ogl_6823 Gm20:37964101..37965400 Cluster 6
aacaaaattaatgagtagcatatctaatttgaatggttttattattattattattatgaaaataatggtttgttaattaagatgcggagtgatcgtagaaaaaaaaaagaataaagcagtaactattttatccaaataaaaaatatgaaattacactaaaggtaaacacacaaaaacattttgattttacaaatgtgctacatttaaatctaaaatctttaattctatttttatatgaaattgacaaaaatacctttctaaacattttaattcattatatatttatatatatatttttttttattagtacacaaatctcgttttattttataagtgcattacaaataagttccactatggtattaaaacttgaaattatcgtatagttcagctattagaaattgaagatatttgtagtagtatgaatttcagtgtactttcggagtacaagtaatcagaagtggcagaatgaactattttatcaaatacaggctgaccctgatatggatagtgagctataatgaactgggttaaaaaaaagttttagatttaatttgagtaaaatagagtctaacccttataaaagctcattttttaggaactttatcaattttttgcaagataagccttggttggactatgatcaaaaaaagataaaatagtttgcatttaattcaagcttaaaatttaccttacattttagcatactgttttaatttggtccaattaacttgacttattttgtcacctttataattaatggaaaaaacctttcaatattaagcttgataccttctcatgttgtttcattctgtgtttaaaataatgctactacgtgtccatttcaattggaaatcatatgttataagtagaaattataataaataaaattttattaaactagatagtaatagttgaattttagcgaaaatcttacacttatgattgtgtaaaaattattagaagcaaaccgttacgtaaattatacttttaaaactaaaatacaacatagaaacttcagtcctatgtttggtagatgcaaaagaaaaagaagaagaaaaaaaattgaaatttaaattaaaaaataagattttaattttttttaaagtcaacaaattattttactttctctccaattacaaaaaaaaaaaaaaaagacatcatcatcctatgtttttttcttcattccattttcatttattccgaacgggtcataaataaaaagataactataatattgacaaaaccaatgatgcataacataactagtggacaatactactagctagcattgaagaga

SEQ ID NO: 1469 - DNA, 1842 bp, Glycine max
  Soy_ogl_2918 Gm09:739001..740842 Cluster 6
gcccacaaaacaaaaatacaatatttttattttttattagtaaatataatatttttataattatcaagacaaacttgtcagttaaaaaacgcaaaaaactaaaccagtcatataatttacaattttaataaaaatattttttaaaatttaattcaatttttaattgcttgattattgatcataaatagataaaaataaaaactatacattaatgtaatataattaaatactattttcacttatttatatcttttagtttgattattataactaataacttaaatgagaaatacttaattttcattttttctgcatgcttaatttaaaaacatctttatacaaatatttattattttataattttggtctataaatcatcgagtatgtttggtctataactgaaagtacaataaatatatccataaaatacatttttttttataatttaagactacatattttttaataacagtcattctatttttttaataacatattttttttataataggactcaatttgtttgattttattaaaaaaaaaaactattctcacatgtcatatattatattaaattcttttttaataagtttacacacataaattaaaaaacatatccaatgaaatattataactgtgtatcatatgttatatatagtttttgtttgcattaaatgtaaaaaatacattcttgtgaaatttttagaaactttaataaaatagaataagagtgtatatcttcataaaaataaattatctcacatgtatcatatattatatataatatgtaaattttgtttaaataaataaataaatatatatatatatatatttaaaaaatatttctagtgaattaagtatattctatgacaatattaaaagagaaattactctcccggtatatacattgaaaacattgtgataattaatttttaaccccattcttaagcaaaatgaagaattctattttaactatttgtgtagttgatcacattgtttggttggataccttttttggtcgagtcatatctttatgttatgtagggtgattaatttttgtttcatcctatagctccaaagtaacatgtatgctttggtgaattggtgttgcataaatataattagacatataaattaatttataaaaattagtgtgtcaggcaatgattcctctacaacaatgattctttcatacaactaaaaaatatgttatactccaactgttttagaagaggagaaaaaaattaaaagaaatatggataataacacacttaagaaagatggaggagaaaaaagttgaaagaaatatgtatagtgacgtacttcagtaaaatgaaaagaaaaggaaaactaaaaagagagaataattgacttcttaaaataacatttgaagttttatattttttactttattttgttgaaacttgaaagttgaaggagagaaaagataagtaagaatctattcttccctttgattgtgaaaaaaagaggagtatgagatttggaaaaaatattatcttctgagagtggaagaaaataatatgatcctttttatatttcagttactattaattttgaatcttttgccttaaaagaggctccctttgccaaacttatatatcaatattcacaacagcaggcaaaattaaaagaaagttgttttattggaaaaaataaaaaaaaacaatcaaaatctataaccacttaacaacaacatcacaacagcaggcaaaaccaagttcttagccaagaggaaaaaataatcacttaacaacagcaagcaaaatcaagttgttagcctagagaaaaaaaggtttaaaaaatattttttccttcaaaaca

SEQ ID NO: 1470 - DNA, 1200 bp, Glycine max
  Soy_ogl_4636 Gm14:4002101..4003300 Cluster 6
tacctatagctttgatttggatttgcgttatgcttaattttaaggtaaaaagtcttttaaatttgataaaataggtgatacattgacattgtaaaaaagttgtattccttcctttaaatataactcattatatatatatgataaatttattaatttttataataataaacttaaaaatcatactaattaacttaaaagtgtatcatcattaaattcttttaagttttaacaaaattaagtgcttcgcctttataaattttattttgaaacttgaattagaaatataatttttttatgtatatttagtaatgtagttttttaaggaaatttataaatataattagaatgaaataatgttttttaataattctgtatgaaagttgtaatttaaaaaaaatagatccaaatacacattaagtcaatgttagagtaatttaatttgaagcaaaagcaagctcattttgttttatactattattattattattatattataaaagtatattggctattagttaagctaaacaaacaagttatttacctaatatgtttggtagtgatgaaagcgaattagtatttcaggtaaactttacatgtaacgtcatcaattagaattttaaatcctaacatcgctatttcaaagattgtgtctctgtattttatcaaagaaaaaaaatatttatagtgattatgaagattttttacaataaaataaaataaaatttcccccctttaatcgaatcatatatgataatagatcatccggacaacactggacatcagtaatatatcacatctgctgtgtaatttaatttaaaaccatgctaataataatacatatgaattgatatagtaatagataaaaatttctcttacgcatatgataagcgattcaatctctaaattcgtgtatataaaagaacacctattagattatcacaacttctcaaataaatttcaacacttagaagaattaatttataactttttaagcacacaaaagaaaagtataacaaaaaaaagttggcttatacatgttctaatttataaaaacttttttatttaacttttctaaaagcagattttaacttatagtataaattaattttaacttgatagaaaagtttattttccaaataggtcttttgcctcaagtaacaaatcctttctacatacatagtcataataaaatgttaatca

SEQ ID NO: 1471 - DNA, 1114 bp, Glycine max
  Soy_ogl_1730 Gm05:38382816..38383929 Cluster 6
catgggaatgatttttttttatgaaagtaagtaaaggaattttacttcatgggattttttttctttataaaagcaagtagaaaatttttcacctaattgaaggaaatacataatttacttaaaatcacattaatgattaaaatatatatttataatgcttataacgctcatgttaataaatattaatgaataaattttgtatgtttccatgtagccgtgcgttgtgaaatgggaaaagcattttttggtgaaatggtcggggcccgaggagaagagtggggaaggaaaggtttgtctttgtccgcatgcatcacagagcaagaaaataaaaaaataaaaaaatggatgctaacacatcaacataaacataaacatatgctacaattttcactctgctctctgctaaatgaaggccacatttctttttcacctaaatatcatttttttatctataaaaattaaatacaaatatctagagtttataataatttatgtgttgtcctccataatttaatatttaaatatcaatttataaatttctaattctgtaatatgtttgtgcattattttatatgaaaaaagatacataggaaaaatagtatgaaataaaataagtgatctatgatgaaataaaataaactgtacaaataatatgattcatatttttttttatgaaaatatgattcatattatattaatatgtggaaaataacattatttattctttcaatatcatttccaagggagtcatgtagtaggaagtggaaatttgaaacaataccattatcgtctcactgttggagaaggtggcagcaataccctgatgttcaggaggaaaaaagaatgcatactcccacaaaccagtatcacaagaatattaattaaaattccaacaaaaaataatattaattgaaaattattaatttttttacttaagaaaaataagaatttaaaaaatttatattttaacataattaaaaattttgatattttttttacgagttgaaatgcacatatataattactcttttatttatcttttttctcatataacataaccaattattttaatcactcgtttttttttatattaataatcacattaatacctctt

SEQ ID NO: 1472 - DNA, 1166 bp, Glycine max
  Soy_ogl_4831 Gm14:48993001..48994166 Cluster 6
ataggaatagtcaatatgttttaaccttaaaataaattaaagtaattagttgtgttgcttgagtcttaaaaatagtatttgagagatataaaaactaattttttttaatgaacaaaataaatttttaaaatttgttaatttattaataaagttttgtcttttttttaaccaaaatatccctctaaatacataggtttatttaagagtttgatctctcttaacatatgttttatcataacatgggctagggatagaacccattattacatgtttaagtgataaattatctactaatcatgtcatataaaaaataattaaattgaaaataattaatttttataaataaaaactttgagcaaccaaaaacagcacaagtaatcactttaaagcacttgtacattaactttaaaactctcatagattatgttatataataaatttaccgtaaactgttatatataataagatcgatacgttatgaaaaaaaaaaatacaataagattgataaattttataataacacacatctctatttacctttaatttcttttttcagaatttaatatataagtatgcttacttaatgctgaaactttctgtaaaaaaaaaaaacttagctgaaactttattttaagtaaaaatagtgataataattagaattaaattctaaaataataaatattttaacattatattatgaataaactattttagaaaatcaaagctattaaatgaatacttagtgtatttttttaagcaaatatacttaatctacttttaattattgaaatactattttttaaaataatgctttttatttaaattttatatacttttagcttttaaaaattcaaaaaccacattctctttttagtctctgaccgaaactaaaaattgcacatcttttgttaaatatagagaccaaaaattttaatttaaaagaaataaaaaaatcacacaaaaaaatatttagacatattaataagtaactttatgttatactaccttatagttaaagtaggggcattggtgttgcaaataattaccttgctctgaactgcgaagaccagtgtttcaaaagctaaatgatgaaatctatgacgatatttgtatttgatgttgatgttgatgtgggtgagaccctttccagacacaactccatgtga

SEQ ID NO: 1473 - DNA, 1320 bp, Glycine max
  Soy_ogl_5807 Gm17:40063481..40064800 Cluster 6
gtgcacatataatctaagtaagaggctttgttgtttgatttcaaatgttaataaaaatccattaattttatctaaatattaaaataaattataatctaattaggtttagttattgatttagtccctcaaattgggagtcttgattttttttattttttattttgtagtcttttaaattaaaattttattattattaaatttgtgcgaagtgggaacaggattcatgttagagattcactttttatattacatttctaattgcgagaatattttgtaattatacataaatattataggtttaattatattctcttaaattagagggttattctttaaagtctttcaaataaaaaattatatttttagtcttcaaattatgatgaagggactaaaaagagtatttttcaaattttaaaaactaaaaaatgtaaatttttatttgaaggatcaaaacaaacatgtccattaacttgaaggattaaaaacataattaagtcaatattatattttaaaaaggataacatatatttttagttattctattttttgtcacatttattttaatttctgtaattttaaattgatcaattttgttcatagatttctttttaaaaagatagatttagtctttattagaaataaatattataaaaaatatttatatataatttgttattgcaacaaatcacaatacatcatgaatatctaaagaccaaattcacgtattttttaaagaatagaaatcaaattgataaatctacatgtcaagactaaaactaagtaggactgagaatatagatattaaaaacatatttattcttttaaaaaaattaaagtatgtggggactgttgcccccaaaactcccccaaatagattcgtctctgttttaaacgctcaaactatcattttcaaacttcactcacaagcttcattttattttctaaagtcgcgggaaaaaaaatgacccaaaggagtgtaactttcaaaatataaaaaaattacaccgtgatttaaacatttctagaattcagaaaaatgtgccagcaatatacttactaattaagaatgtttatttccagtatttatagttgattatatattcgtatagattattgagtgaaaaaatggtatctgaatatctagagcttgcacagggatgagaagagaatctcagtgttcagtagtggaaatatacttttttcttcaaagcacacatggtgataaaggaccctgctcgagagagctcaaatagcaacacgttgctttggtagggttcagttacatgaagcatgattaatcaagtacatataacattataa

SEQ ID NO: 1474 - DNA, 1181 bp, Glycine max
  Soy_ogl_1933 Gm06:13937530..13938710 Cluster 6
gtatcggtctttaattcttacgtaaaaaaataattctattaatattaattttactaaagtttaacccacagataggccgtcgctagaaagttaagattgcttttattttgactcaattagacaaatatctcatgaagttttattaaatttctttttttatctcctgaaaaaaatatattatattgacactatttttatacattgcattaacctttttattatttgaaaaatattttatgtatatccctataagagaagttattgtaaatgttaaaaaaacataaaatttataattttaagaaatctcaaaggataggatgttagtacaatttactcttttacttttaataatactttattgtgtttgattactaattgcactagtgtttaataagactttgcattctaatttattattattatttaagtattaggtataacaatagaacaagtagataatgtatttggcgctctctgtccctattttcgtaaagacaagacatgtttgagttaaaaaaatatagagataaaatatttaaagttaactttattcctgtcatagattatcataaaagtggtttcttcaaagattctaggatgaaaaatcacttatgataacattaaaattaggtgataagagaatactttttttttagtaaatgcataaattatatttttatatcttatcctaatatctttttcttcctttaagaatacagagatatgatagagtaaccaataaattcatataataacgatgattaataattgaactttttttactgcataattatcaaactttttactatataactaagaaaaaacaaaaaaatactgtgacaattacaattgaataatttgttagatgaaaaattaaaaatactacaaaatcaaaagtttaaaatcattaagttttacaaacttattgtaaattattcatgttattagttaagaagataaatatgcaaatgaattgattttttttttcttcaatcttatctaacttttttaatcccttgctccttgattctagattgttgtctcttatctaagctcaagataactctacacttaatttatgtttgataaaattaattaaaagttaaaaatttaacttaaagttaaaagttgaaagttgaccgttagaaattaaaaaattaatttatcaaattttaaatgtt

SEQ ID NO: 1475 - DNA, 1387 bp, Glycine max
  Soy_ogl_6446 Gm19:39157214..39158600 Cluster 6
tttaccatattctgttaatatcatgaacgtattgatcttgattgacttctaaatagtaaaaatgacgttaaatatatactaaatgggatgaaattgaaaatatatattgacatatcattgtttaggcattaagaaaaaaatattttgattttttttatcatattagtatgaaatattcattagttattcatcagttttgtgaatgattaatttttattgaaaaacttacctaatttatttttaataaaatctccttccaatcacactttttaatcagaaaggtcaaactcaaaatcttaattaagcaagaaaactgagcacactatcacttgttagtaaacattatcttaatttaataatcgagtaaactatggtagagcactaacattaattgggtagggttattttattttaataagtaatttcgagttaaaattttaagtttataattacattaaatatttgtaagaaaaattttgtgatttggtttaacttgtcacgaggagacattttttttgtaaatgatacttttagcatttaaaaaagtaattgagtaaactacataatgggaaacagaaatattaatagtatattctctaatatactattttaacatactctttatcattaaaaaaaattaaatcacaaggttcagttagtctcaccacctatttaagataataaaattgaagatagtatttttgaatttatactatagacataaattaaaaaaaaatgtgtcaaataaattattgaaaagaccaaaacaaataaactttattttttatcatttatttcattttaaaaataaaattaggtatgaaatatttataaagtattattaaatgaacaaatttcctttaaacgtttcgctataataattattcaaaaaaaatgttaaaacagcgaacatgctctaacaaaaacaactatacattattttatgtgcatatactcagaacacctctttagggagtcttttttatcctttatgcaaataaaaaatatttaattaaaatataatgtaaaaaatgtgaattttacatataaaaaattctcctatttttctcgttcctcacttaaccaaacacagcctaattaacatttgaaaggaaatacgtaatatagaaattgaacctctataaattaagtttacaatgacaaaacccttataaatcacgacacaatcgagcgagagacacgaaggccatttcaatagacaaaacaagagagacactaatgtgatgatgtgataagttgtttttgacatttgagtacaagttgtacaataataatacgtactagcttgtgtttctgacccgaggaagtgcttatagtcagacgttcagaaagatgcattgcatgttgcagagaaaatgtctacgta

SEQ ID NO: 1476 - DNA, 1100 bp, Glycine max
  Soy_ogl_5305 Gm16:4919301..4920400 Cluster 6
ctctctctattggtgtgaaatcgcgtggtaatgatgtacaaaataacggcatcatgaacttttttttctttttttgtcatatgaaaatttggctgtcacgttttcttttaactaggagagaggacagataagacgcgtagatatgggttatttcatgcattaattactgtgtacatttgtggtgatgtactttggataagtaattacagaactagatataataaatgaatttgttttaaattttatttaactaataagtactatattctagtttttattattcaataaacattatatgtcattaattaaaataggataaaactttttttgcaattttcttgcaaattctcgtttatgctctcaagtctcaagcttttatttaagatgaatttaccataatgctatatgcataataaaaaaacgtatattgataaatagcatatataattttaattgcaattagtaatgacataatatgatctattaagtaatgaggatttttttgttgttgaagcaattacattgagtaacagaaaatctttttttgaaagggagtaacagaaaatctaaacgatcaaaaattaaaacaaaatagtagacatagttgtgatgtaggttatccatgcattaattattgtgtacatttggcatgtctgttgtgatatactttcgatgagtaataatacgaaattccttaaaaaaaaagtaacagtacgaaattagatataatgaataaaattagtttatattttatttaactaagaactatattcaattttttatacggaaaaattatttaattaagaaatatatgtcgttacttaattgtttcttttgcaaaagtaagtaattatataattaattttacaattaaaataggatagctttgtttataccaaatagaaaaaaaataggacaattttttcgcaattttcttgtaaagtctcgtttatgctctcaagcttttagttaagagaacagttattatttattcatttatcattatttttttataatttgtaagggagataagaaagaagcaatgataaggaaaccaagatatttgtgtggaatgtaacaggagtttaccagagtgagca

SEQ ID NO: 1477 - DNA, 1600 bp, Glycine max
  Soy_ogl_6429 Gm19:38554901..38556500 Cluster 6
gaatctagagctcaatttcactctcatttttataaggcaagttgggtaaaaaaaagagactcatttcaggacaactaggacacactagagcaaagatttgcaatgctagtagtagtagtagtagtggaactaggatggagaaaatttagcatttttacccaatgcactggcacagagagaggaaaggagggtccattaattgtctatatcacaaatatagtaatgatatctttaatttctccatatggcatttgcatgctggatttgttgctggagacaggaaagtacttggacacctatataatatatgcagaagaaaattattccttacaagctttatttaataaaatatgggaaacgggggagaattaggtacaactgcttaatttgtgatatcaaggcttactgaatggaatagcattcaatatataagattaggcaaatattaattagtatttttagaactttagttaaaaaattaaacaatttttttatcaagatacgtaaaattgtacttctcgtaatttttttatgttctcttatgtttttacaataaatatattttttaatttcttaaccaatatcctaaagtaataattaacaaaattataatgataataatggtgaaattaaacttaccatcaattcattaaggaaagttcctagttttccttagatcggatccgtgggctctgaccatttaaaaagaaggtagtactacaaacagtttgatacacggacatatactgtccattgttaccctaaaataatattattttgaccaaaataatacaataattttatttacgtgagtgctgtatacgagtttgggatagttattttaaaagaaaaatcacttgtgaattagaattgtaatctatgagtaagccttttatgttttggtaaaaaagattataaagcaagacccagaaagatttagcctaaccaaaccttgcgatcacactagaaaaatggtgattcaagtaattcatgtgtccttatctaacatctaacagtttaaacaatgtgtttattgattcatgatatgctattagagtttatttgatcaaattatctagaacttaataatctcattctctcataagaggtgttagagatttaatataactagagtttatcaaaatggatctgacctaacttagtgggccaaagcatgaaaagttaattgatctggtttcgtccaattttttatatgaattttgttggctcaccaagtcaagccaaattggccgtattttttgcctaaatttatatgaattttaaaagaaaaaatataataaaaaataccagatcaaattggctcaattatttttgggcttctaatttgataatttgacccaatccaacccattgaaccattaggttgggtcatcaattcaaatgacaactctaaatatgaactaatatatgaaggcataacatataaagtaacattaaaattgttatatttttccccttttgtgaaataaatttttctaattctatgaatcaaatttattgattttggtactcttgatgataaactattttggccctcttttctatttctgataaatgtattttcctaaaatgttcaaac

SEQ ID NO: 1478 - DNA, 1186 bp, Glycine max
  Soy_ogl_5883 Gm18:2055558..2056743 Cluster 6
attaattatttaagtattaaaatttatgttacatttatgactattaattaaaaattatcaattgagattatgataaaaattaaacacatatatgatcatttggatcttaaattctcaaaaaagaaaaaaaaaaagtttgaacgacacatgataaaaaagatagtttctcaagagttgaatgtcatgtgtgattatttgatgttttggagtatattagttcggttacggacataattttaatttaaattgatacctaatgaattattaatataaatgagacaaattaattatattattgatttataaataacataaattgattttaagattaaaatatttattggtcatttatatctatctatatatatatatatatgaaagtttaagaattaaaaaagatgacacataacaaacacaagtaatttcttaaagttttgaatgtggcatgtcatcatttgattcttcagagtacattgattcagttataaataaaatttaaattagtacttaatgaatcattaatataaatgggataaattaatgatataattgtttcataaataatataaattaatttcaaagattaaaatatttgttggtcatccaaaaatttattttattaagccattttttataattgaaactgtacttaaaaatatttttatcaattaattttgtttttttataaaacattggtcatttaaaatatgcttataaataaaaaatagtatattttagaaattagttttgttctaattaaatttacaaaaagaaaatttttagtagatttttcatgtaaaaattaaaaataattatttttctaataaaaatatttgtgttctgttaatttgaaaaataatgttgaaattttaaattaagcaaaatattctgataattaatgcaattttaaaaatactataaataaatgaaaaattgaatagttaaactgtaaaaagattttgttataatatgcagttttgttatattccagtaaaattaaaaattcatgaatttgaaaagtgtactgtaattaattaatgcaaacatgagtagttgaataatatttgcattctgttataggtcaatcatatgtaatcctactaatgagtattcaattttaattattctgaatcaattttaattttgtttaagataatcgtgtgaatattcaaatcacacgtttaag

SEQ ID NO: 1479 - DNA, 1669 bp, Glycine max
  Soy_ogl_220 Gm01:49201732..49203400 Cluster 6
taaaatttataataaatagacattttaaatataatatttaatgttttaaatttatgacatataaattatattatagtatgaagttatttttaatcattgagatgaccaatagttagtttgagcatctactattaattttgtatattagaagaaaaaattagaaattctatatctaacaatagagatattaaaaacttcatttgacgctctaaaactattaaaataataataaaatatttaaagttagtcgtcaatgggtgaaactacaaaaaatgtttttttttaattatcaaatgggataaaattaaattatatattattttatgacttttgaattgaaagttataaattatattatgattttttttcttttttcatctaagtcataatactttatgattttaatttttttaaagtcattagagacttttaaaaatatatattatatcatctcctatactatatataggataaacaacaaacacacttgtttaagttgtttctcaaagttgtcagtaatttgattaatattcacagtttctaagagtattagaagacaaatatcaaagaataaagtactttcaaacaataattctacttctcactagaaaaaaaaggatgaatacttgcttttttaaagattacaaccaaatttgacaatcactcataattgcaatgcagtttatgacacaaacatgaagcggtgatgaagtatattctttagcaaagcaaggtaaaaaaaatttcagagattaacacataaaaaactattctataagcaacctttctcttcacatttcattaacaaaatgcattaagccgatgaggcattcagcaacaaacaacgattttcaatccaaataaagaaaaaaaatcgaagtcttaaataaaaaagaaaaaaaataatatccttaaaatataatcatagaatattttatgacttcaatggaaaaagaaaaaaaaaatctttaacgactttaaaatggtgttataaaaataaaataataaagtattttatgatttaagacttacttttaggtattaatttaaattttactatcacttaataattttgaagaaaaaaatacttctttttcatcgttttgtggtcgtcaatgatactcaaaataataataataaattattgagagacacaattatatttgttaatactattaatatattgatttactttatagtagaataaaatataatatattttgtattttcaaaataaataagagaaagagtaatttaaaattttaaatatcttaattgaataaagagatttaattcaattgattaataatttttgagttttttttttataatttctacgagttgttgtaaacctttatatcaaagttgaaatcctctctttaaaaaacaaaaaaaaaaacatcttgaaagtgtcatttgctcggaccatgaacaacatacatcccacaacatgtaaacagtcgtattttcttcgttccttaatccaattttcaccatcacaaggccacgaatgctaacccaaaaatagaaaacgatacaattactcaacaatcaacatgatgcaccaacatcacccactcgtcagaccctcaacatcttttttaaaagtaaccaaaacccacaacaggccaaggttatctcgctgtcgttgtgtctccattacatacac

SEQ ID NO: 1480 - DNA, 1818 bp, Glycine max
  Soy_ogl_4703 Gm14:5969583..5971400 Cluster 6
aatttgatgagtttctaattcaaacaaaatgtaactaatattttatttatattaaaattacttttactttttaatatgacctttactaatttttcatttatgatcaataagcacataaaatctttaagaataaagtaaaaataaagacaaatataatattaatattaactttgatgtacaaataaatacttaaaaaataaatttttagaacatgacataaaaagaaacaaaaagattattttttaatcatggcatattaatttgattttctctaaaaaaatattgtcattaggtttcaaagtcattaaaaaaatataatcaatttacttcattgattgcacaaatattgtgaatctagttttcaagtattatgatttgtttataaattgataattttcgtataatcttttataattgattaactattttttttcaaagttacttgaaatattaaatatgtaatacttgtcttattggaatattataaaaaaaagacacttaaattcaaaatacaaacacaataatcaacatactaagttcagattcttcataacgaagttcttatccttaaaaaaaaataaaaaaaattgaagttcatatcttcggcgagaaatcgtccctaaggggggaccctgggttgtggtagtacggtggtaccaaatttcatttatctaaggatttctaaccagaaaaaaacaaaaccttttctgcttgctagacgtttcaactttcaattcttgaaaatgtttctctggtgtgtttttttttgtgggtatatttaaagcattactttattgacattatatatatatatgactatctttttagtacatatgttatctaaatacacatttaaagcatttttatattgatatgtctaatatggtactataaatgttttttttatctcaataatccacaccttatgagtggtgcctaacatgcatatgcggtactatcaaatacgttttaattttgtcgtattaattcaaaacgctagttttccttctctttcatcttaaaaaattgggaagaatatattttaatatggggtcaataaaataaaaaatcacttttccctctagttagagaatcaaataagacacaagtgcttttaattatttttcttcttttctttccttttttattaaaaaaatcattcatgccaaacacagtaaatataataatatatttagttgtgaggaaaaaaataaagagaagagaaaataaaaaaattgaaaaaatctttgtattttccctttaatttaaattttaaattcatttctcatcccatttacttttctctaaaccaaatagaaggtaagggtgcacgcatgattggattttagtttatcaaaagtctcaaattatctatacttgataaaattaaattttgttctttaaaatttgtattcaaatcataatttaagattattaattataattattaaaatcaaataggataagtcaatttaattgaaaacatgttacgtaactggttaccaacgagtttggtttagtcagttgaataatatgtttaaattgttgtaaattttattatacttgaatttgatttttatgaataaaaaaaataaggttactagctaaaaatttggtagaagaaaaggtgatcgaatatgaacaagcattactcaaccagcatctgtttgacaacagttacgctgaatgtaactagctttcattttaaaatacaaggaaaaacttcagttgaatgcggtttcaatgtaacattctaaaagaagttcatatacatgtatgggattgtaatattaattgttattatctaactacttatca

SEQ ID NO: 1481 - DNA, 1600 bp, Glycine max
  Soy_ogl_3649 Gm10:49387601..49389200 Cluster 6
tcatctttctttaatccttatgttatcttaaatagtattcatgtttctttcaggtcgaattaattaaaattcatttaaagaaataaagctttttcgacacattttttttcatacgtaaaactgcaaaaagggatgattttcatataattaattataattacactaaatacaataacttttgaaataattattattaacacgcgcagatctgccttgtttcgatctgaaggggaccatccctctttaaaaaatatttattttgtgtaattttttttatatttataagacataaaacctttgcaaaaataatctaattgtatttaagaggtaatattttctcataagtttccaacacactgaatttgtcacaccaaatatcttaaggatctaaacagaatccatatatctctgacattgatcttgaaagtaatagtaaatatcctgtgacttttcatattttaaatcaagaaatagtgtttttttttttttaccaacaagaaatagttgttaagtggtactaatttgggtatttgctaccacacttaattatctataaatatagggttaatctttcttgcaagtgtctcctttctacctaattattgttactatgttaaaatctttcctgattttagtattaattagagtttgtgtaagtacaactattttttcccttgcgtttccattgagtttcactaccattcaatctaaatatggtataaaatatttcttggattgcctcggatggtcaaattagtttacatgttaattttaatatatatttaaaaaaaaggataattttaatctctaaactagaaatgctagcaataatttttatgacattctttctcggagactttttttttataattaattaaaatttattaaaaattattaattttattaagttttgtttctcatttaatataaataagaagagataatcatagaaggaagccggtagaaagagagtatcaaagaaaatatcgtaaacatttttctaatcataataaaattgtccagcatgccaattttgaaaaatttactatactttttacttactcgttgatatcttgtaaatttctttggttgagtaatgtaaaatcatggatcacctcagattgtgtcagattagtttacaagttaattttaatatatttttttaaaaagtataattttaacaacaaatacaattaaattgtccaacatgctcatcatgaataaaaaataaatcaataatattataagattaattttttaaagttattagtctatttcatttgtttattatttttttctttatatgaataaaacaatttaaaataactattattttaggacggaagaataatttattatgttaaaaaacacttattatactaaatctttaatatatattcgatttctttaaacttatttattaaaaaatatttattttaataaaataagtatatttttttaaattgttttttcttaaaaaccaattttctatttattttgataagtaaatcctctctatttattaaacaagcaatttaaaaaaaacttattttaaatttaaacaaactgatatctgtatatatgggtgtctgctttataa

SEQ ID NO: 1482 - DNA, 1082 bp, Glycine max
  Soy_ogl_5808 Gm17:40065119..40066200 Cluster 6
tccgcggaaaaaaggcaaaaagtgttaaataaaaagtaaaatgtttattacattaaaaatataaaataattattgaataattgctaaattttaatcataagtactaaaatttgaataatacctttgattataaccttaggttataattcagattaattaccacatttgaataataccactaataattctttttctatcgatcaaattataatttaaaaacaatctaatccaaatatgctctataaatcaaattataatccaaaatttttaaattaaattaatttataaaataaatgaggagattaaaataatttttaaatggaaaattaaaaaaatgttaaataaaaagtaatatgcttactacaataaaaaaatattgaacagttgttaacttttaatcacaatctttaaagttattgtttcttataaaaaatatatttctttttgttaagattaagcaatcgaatgcaaatatgctctatgaatcaaattgtaatccaattttttaaaattaattttgaaaaggattaaagagaataaaataatggttaatgggaaaaggccaaaagtgttaaataaaacgtaaaatgtttataacataaaaaatattgaataagtttttcttcaaataaataatgttaaatatcacttcatcagcgtggatatatatatatacttagacataagtacaatgattaacaagattcatttagaaaacaacagaatgaaaggacacactttacttgatattttaaaattttctttttccatgatggaaggaaatagtaagctggaaaaataataatcacatacatacattatccccagacacatggacgtgagtaaaaacttgcatgtatatcaatttggaaaacagctaccaggtagctagatagatacacttgatctctgtcgagtactaattggttgaaagaatatggaatggaagtactttctgcattatatgttaccattgtctaacacacgccattttattttcttaaaatcaggctttgtaactttatatttaacacgcctctatacattctttaggcaagagagtttttttggtctaaactcta

SEQ ID NO: 1483 - DNA, 1300 bp, Glycine max
  Soy_ogl_4933 Gm15:9061101..9062400 Cluster 6
tcatactttcaaaaaatttaaaatgcttataattaattattttaattattgtataaaggctaaatgatttactgactattttcaagagtaacgattggtgaataccttaccacttcaaacatgtgtgtgtcagtgtgtaaaagaataataaagtttaatatatatattcacacttcttaaaaaataaaaatgcttataattaattagtttagttattgtataaaggttaatatgtgtgtgtaagagaatacaaaagtttaatatatccaaacttttaaaaataaaatttcttataattaatgcaaaatctatttttttttatagtaattcatgttggaaatacatcaaaattttctattttgaattgtgtgtgtgtgaattcattatataccatccataatagacgtaaataggatcccatatgactcatgtaatatgtcacgatacataactttatgtgaacgtaattataagactattaatttgtgacagaaacttttataatactattaaaagctttcaaaagcaatcgcgcatgctgatcttaccgttgaaggaaaaaggagtctacattcaaattattaattcaattaatacgtgatagagtcaaaataaattttgtcaaccaagtttactaattggaaaccaaatatatatagagtagttgaatagtcttctcaatttaatatcgatcgtttagcatgtattgatcaactatgtgttcttcatcacatgtaaattcactaaattgacgtgtgttatatatatgtgaaggaaagaaaaatattaattagtgacaacctcgttgttatatataattttatttatattatttcaaaatacgtagcattttagttttcaatataaaatattgaaccttttattctaattatactaaaaaagaaacataatggtttttgtgtattttgtgcatcaatttttcagcaaccaattaatatataatttagtaaaattgttatagtcattatgttatttttttttttttaaagaaaaacttgaaggtcggcttattttatattttaaaatggaggaagtaatatatatactattgaattcttccgtttataatcttacgttttttattttagatatgtgaatccaattcatggttgagaacgtaatggtcagactttcaaaattccaaagccgtgcattttcatcgtataggtacagacaaagaaaaataatggaagaaagagccttattaattaataaaatgtttgaagtcatttgtggaagtcatattggaaacctattgtatttgaagttaacaaaagag

SEQ ID NO: 1484 - DNA, 1000 bp, Glycine max
  Soy_ogl_3222 Gm09:40239001..40240000 Cluster 6
gcaaggaagggcgtaaggagcgagatcagaagcttatgcctatacattattttctccccttttctgtttttttttatcaatttggctgtaaatttgtgcttccctattttgatgtctagctaacttacatagttagggttacaatgtaaattgaacccgcaaaacctcgatttcttatttgtattgaattactgttttattaatcaacttttttaaagccaaaagaaggagaatctatcaagggagatgatttctgacatcataactatgttggtacccaaaaatcaactccctcaaaagcagtctcccaaaaatactgcattttttttagtcaaatggattatccatttattttaattcttgcctagaaatgatcactataagcatgtatgattcaataaaattgccagtgtttgtacagtagttagttggcagccaacgtggcacatcaccgttagcattggtccaataataaaataattaaagttcaagttttaggtcaccactaaaaaaataatttgctatatataaaacaaaaaaaaatctcgtatgttaaaaaaaacaaagtcatatatattaataaaaaaaatcctaatatagagctctcatttaaaataataaaaattttcttgaaatttattttagatgttactcgccataggatcggtcttaatcatcgcttaacaaatatacttaatgggaagaattaaaaacaatagaaaataaaattaatttgagagaccatgatcgataaaaaattattgaagttcaaaagtaaattttatataaaaaaaacgtaacaataagactataactttttatagtgtcaataaataaagaatataaataattatatacaccgtccggtgtaatatcaaaattttaatcttttaagttcattctgctcctttaaaaactctgtatggccggcaaaatacaattgcatggtgtcaataacaattaacaaatatattatttcggttggcaaaaaaaggttata

SEQ ID NO: 1485 - DNA, 1133 bp, Glycine max
  Soy_ogl_3948 Gm11:37437768..37438900 Cluster 6
tcaatccttaataatcaaacataatccttaataatcaaacatattatagatgttaacacctttattctaggatatatatatatatatatagaatatgaaagataatcccaacagataatgcgtcactcggctcggacacacgttcatccaacttagaaaaacaaggatcaattatttttttaaaaatagtatatacacatattgatagtttaaatagtttttgcactctcgagtatcaattagaaataatcgttgtatgtataattttgtcatcatcaacttttacatttactatatataccataaaaataattggaagtgacgggacaccaacaggatcacaggaaaaccttgatgaacaatatgggatctaaaagagtactctaggagagttcagagcagcaagaaatactttaaattttatagaagacaatagacaaggtaggagcaggataaatgtatgaaggatattgttttgttgtgatgattaatgggcacacatgtgaatagaggtggatacgtgatttaatttgtcgttgtggaatggtgacaatactggaagcaacacaaggaagtaacagctccaaatacaaaatacgtctgatatgatttagatctgtgtcattatatgtgtgtgcgtgcatgtagacatctgaatctgtatgtatatatataattcaattcatactagatgattctcgatcagtacgtgctcatcctcgttaggcatttgttcaggagttttacctaacatcttttaggaaattgacttttcattgcattataaatcataagtttaaaactttattatcattaattattatgccaaaaaaaacttttataaccactaaataatataaatatcacactcaacatcacataaagtatcttgagaatatattttatgagtcacaaagctatatatatatctcaataatgtgtataataaactatttttatatatagttagtcaaataccatgtatgatatctatccatgttgtatataccatgtaaaccttaccatttaataagataacagatacaaaataacattatttaatttaataaattttgttaaagaatttgaatcaaccaaatcttcaatgagtacttgaattggttcaagctata

SEQ ID NO: 1486 - DNA, 1500 bp, Glycine max
  Soy_ogl_5187 Gm15:50216901..50218400 Cluster 6
taaatgggtagattcgaagatgatgttatctctattttagatttctctttataacttttaattatttggagattttattaaatttgattatatgttagtttgaattctagaagatttgattagctttttcttttatataatgattaggtagattttaggagaggagagaaaattaaggttaacttctttttgtttttgttttgttagtaatctccttattaaagtggctaccttagagtgaattttataaattgaaaacgtaatccctttcttttgacaagttgaataaaattgaagttttgtctccattgtaagtgggagtagagcattagctccttttttgggttccagaactaaaggttttcatacttttgtagtgaatcctcacttggtttaccactcttcattttggtaaaagcacaaggcgccagtcaaggaagcaccccctgcattctacatgacaaaaatcatccgtgacaggtaattagttttgtaaaacacccattttgatattttgttttgtggaaaaacccattttggtaaaaaaaaaaatgtcctttattgagtgtgacaccatgctcccatcttctttctagtcttattttgcgatgaaagagaatgaaaaatagattaaaatatttaaattgaagttaattggaagataattccgagggtaaaaacatgtttaatttcaaaaattgataagtaatctctaataatttttttaattagttaacgttagatattagtttttgttaaaatattataataatatttaatagttcttcacaaaagttcatacatttttaaacgaataataagtatattaagtaagcataaaatccttcttattcctccccaagtcctaaaacaaataacaaaaagtataataagtatatttagtttggcttaattaaacaaccttcttcgcttattggttggactgcttagcttccatgtaaaacctcggcacctgttaaatttgggcatcgttttcacctgatattttctctgtgctgttttgtttttattcaatcgtgctattgtatattaagtaaatgattttggctaagtaatgatcatgtttacaactttctatttttggtagagtttaatataattgtcaatataatttttttacattgttaacatgaaataaattatgtgcctatttctttaagctgtttgttaaataagaacttcacggtcaaattttttaaatgggttaattaattttttattcccttgaatttttaaattttattttttgtacttaaataaaaatttaaccggtcaaggtccttcaacattttttcattaagatttttagctcttaaaattttgaaaaatgtagttttaaaagtgttaacttttttacaagggctgcatgactaagtttttagttcctatttctttttttaaaatttaatttttaatccttaaacaaaagtttgattggttaaagtttttaaatttttttaaaatttgatttttagtctc

SEQ ID NO: 1487 - DNA, 1300 bp, Glycine max
  Soy_ogl_1457 Gm04:47090601..47091900 Cluster 6
aaacttatgtataatattgatgataaagaattttcatcacatagttctttatttgacttaatgaatgcttaaattgattttttacttaaaataatttataatcaaaattgttttgccaaatatgctctacccatttccttgtaattacgtgtttttacatcaattaagttttcatttaaaattttcaatatttctaattttttttacacaaatattatactcatattcttgcgtatttgatctgatattaacacaagtcaaacaaaagtttggcaccgccaaatcggatacattggtccctacaattctaaaaatgttggctatctaacaccagttggatttattggtgtctaaaaatatgaacataattacctaataccttcctggttttaggtgttaaccttgttaacttcctgctgatattatttcaaaaaaaaaaaaaaaaactagccacttatatttgcaatagttgaaataacacaatggctataaaacaacccacaaaggaaaccgatggcattcgacggccacggaaaatttttaaggcactgaccaaatgcaaatgtaaattaaggtgtgttctatgtatgatatactgcatttaatttttaaaatagtttaattataatatatttatagtataaaataaatattatcatcgatcatttattatgtagtaagattattgattttttaataattattttaaaattatcaagcataataataactaattgattatataaaattatttagaatgacaatgtaatataattaatataaatttatgtagaatggccatttgatgattccttatatgtccttgtggtttgtaggatacaaggacagcagaagagatcttggaatcaatgtagtttgaagttgacgaacggaaggtacaattgtcaaagttaatgcaacctgcaatatataattaagtggtgcatagtctttacttggaccacaaagtgttcctttcgtattaatgtcatttttttctagacaggacatgaagaaatgtgaaaagtgtggtcatggtgaagcaaaattttatacccaacatgtatgagaaaattataattcatattcactacttatatgaagtttatttatgtatccaatttatatttgagttcggaagaatttcagataagatcactaacgaagggctaaaccccactagagtcagtaagtaatgggaagtttttgagtaattaatatgtatgaagttttagcgactattgtatgaaaaaataaactaaaggcaaaccttattctatacatatgcaatagccattgt

SEQ ID NO: 1488 - DNA, 1400 bp, Glycine max
  Soy_ogl_3210 Gm09:39879001..39880400 Cluster 6
ttcattatttttaatgtatataaactggaatattttgcttttaaaagtattaaagtataatacctttttttaaaaaaaattacctacatgatgtaaagttttgaaaaaccaatttctaacggccttttcctgacaaaaaaattgtagcattttcaaccatgttataaatgtgtaaaagttgtcagaaattgactgagaaagtcaatttatacaagtaaaatcttttttaaataactcaaaaagcaaaatgtaccattttaatttttataaaaaaaaaaaatcctctgcagacagcacggtaatggattgaccacggactaaaagtcattccttttgcccaaataaaaggaaatgactcaaaattttaattcagctagaaggtgtgagatatggtatttttttaatccgcagatgtgagaaaagtatcaaaacattaataataatttatgcatttgatttaaccaacagttacatctctttgataaatatggtatgaatttagtccaaaatatttaattatacacacatgaaatacagaaacaaagtactccacatagcaagatttataaaagataaataaatacatagtaagagataactgagctacgacgtacctgatttatatatgcaactaaattaattatcctctgatttcttcgcggacgtaattctattttcttcttcgcaataagcactagcgactactacaagtctacaagactacaacgctggcactgaatcacaggcaataaaatcagtaaaaaaaaaatgttaacgattgcgcatagttaacaaataataaaattaagagagaaaattattattcttttcaatttgactaactgatagataagaataaaattaaggtttaattgcatctttttactcttaacgttttaattctttttgcaaattttatctctaattttctaatttaacaaattttacacccaacttttaaaaacttagcaaattttatctcaatcactttttcattactaagcacaaaaattgaaggtaaaatttgccaaagaataaaaattggggtaaaaaatacagttatattagaaataaaatgatagagaataaaagccacaagtttctttaaagtttaggataaaatgtgaaattaatttttggagataaaatttatcaaaaatttaaaaattagaagtaaaaaatacagttaaacctaaaattaaatttcagtaagaatataatgtttttatttcaaatattactacgaattcgtgtatttttttattatacgtgtcctttttgagaaataatttatttaagttgaaaaaaagctctttgctatatatgaaaattgaaattcaaagtttgtgatatcatttaaggatctattcattgagtttggatatatatataactagttt

SEQ ID NO: 1489 - DNA, 1292 bp, Glycine max
  Soy_ogl_4513 Gm13:37274101..37275392 Cluster 6
ttttacttacaaagataatttttatctcatgagaataaatattttttttatctcctttctcaagattaaatattgactaaagataaaattattgtttattcagataaaaaacatattcaagattaatcaatttatttcttcgtataaaatgcaggattactttttcccctcatatattatagagactataaaatctaccggtgaaacaaatgtcccactaggtcatgcacggaacaaaatctttaatataaataaatctaaaacaatgtgttaattatttttataattttgtataattaatatgatgttttcttaaatcaattgttgcgaagcagcaatttaatgaagaacattctctatatattttcatctaaatactaacagaaaatagtagctgttactcttgagagattaatacatgcatgacgctttcatcccacacagtcacatgctatattatttaagagatcaaatgtatttgtaatttttttaaaggaaaaaagaaaatttactataacgttatgacgatcgagccttcaacacaagatgtgttgagaagctgccccaaaccagcgttacataagattgcatctgcccccaacatctaccatatgtactatagatacctatcaactcatcaagtcattattccccacacaaaacctatttgatctagtccatatggtattaaattgagtagtcactagtgcatatgcatttaaatcaatccaatctattttttttatataaaaaaagtaaatgggttggatgtattggattattgcaattaatagaggattgatgattattttttcttacgtacggtagattagttagcaatgaaatgtaagcttgaggtgtagtattggctccttatctctctccccctctcaaagtacttttgagctatactttttttgattgaattgatagagatcaatgtccaaacctatgttatccacaaaactctcacttaggagatcaagttattgtacaaaatgatttgtgaacaccacatgcaaatctatttaacatttagtaagagaaagagatataatataaaaaaagttattgtacgacaaataatatgatatgataagaagagatagatgaagaaaaataaaaatatcaatgagatatatgaagtaagataatgtttatgtatcataattataataaataattaataattttatattatgtaatggttttgttaacttttacttatgaggtaatgattaaacaataaaaagtataaataaataaataaattatatttaatactagcaata

SEQ ID NO: 1490 - DNA, 1581 bp, Glycine max
  Soy_ogl_4615 Gm14:3517720..3519300 Cluster 6
ttcaagagtaactttttaatttaaagttattttttatttttaccattcattttcttgaaatctaatgaataatatcagttaattatctagattttaaaaaaatgattaataacgatgaggagtaaatattctcgatattagaccccctttattggtcaataattattttaaatgtgatttcttttaactatgtgatgtaagtttattatgatagatattttggtctttacattaaaaaatatttacaaaactaatttaaaatctttctagcataatctaagagtaactcttttatttagagtcattttttatctttatcatttatttttttaaaatctaataaataaggttaatgacttgttataattattagatataaagaaaatgaatgatgacgatgaaaaataaattgatttctcttctcttttatatatatatatataaaattagagtacatgatgaatgattaatatgttcataatgtttgaataaatcattatattctcgagaacacgtactcttgcacaatattatttatttcaatatatatttctagtttaaaaacccaattttagtctcgttattcattaatacacgcaccaagtgaaacataattttaaacacgccattaagaaaataaataaattgaaatgaaccaacatatttaaaatttgtttaatttgtctagttgtaagagttgatattaagttttacataagctaaatcacatgttaacttagtatagaattcaattgttattaattttgaagttttataattttgaccctttgaaatattatttattttacatgtaataattaacaatgttaaatattaattacgttctttttaatttaggcaacttgtattgagatttaacacattacatgtgttacctctgatttttttaactctacacaactttccgcaatttatatagcatatataagactatatatccctcccattgacacattttttcctaatttctcatactgttatatgttagtataatgtcgaaaaggaaatactcttatgtgaagtgtgaacgggagggttacaatgcagtgttcagatatgttcctttttaagcactcttgtacaacctcatttatgaacaaatataaaatctaattactagatgaagtttgaaagacatatatattataatttatgtgtttgaatgtcctttttaagtatatattagttaatgatacttgattaactttgcatgtgagaataaaatcttcacaaatgtgcttatatatattaattataaaattaagataggtttaaacttacgtacaaatctgaaatgttcaataattgactccagagactgattagcaatttgttctctatatgtataatggcaatttttacttggttttgacggtaggtacaagaggagacataagtttaattataaaccataatagtcaacgatacatttgaaaactatttattgttaatatcttaatttagatttaattcttctctatatgtgacagctatggaaataatactttgaatcaccatgaaaccactcattagttcctaataatactcataaatggccct

SEQ ID NO: 1491 - DNA, 2000 bp, Glycine max
  Soy_ogl_6836 Gm20:38246201..38248200 Cluster 6
agatttgcgcctaattaattttgattgaaaaagatagaaagaaaacgaattgcaaattaaaatattatttataaggtctatttggatacaagctacaagtgtttttaagatcttttttactggaaatataaattttttttctgtaaattttttttaaaaaaagcttctaaccttgtatctaaagaactgttactactattaattattgttacctatgattaacttacactaaagtgcagattgaggcgtgtattgaagcaaaagtgtgttttgtgactattaagtcaaaagttaactttaattaattagtcatcttcttaagcatgaatataaattagttattataaaagttaacactttattatataataatttgtggttaaataatgatataaaattattttattctattgatatacaacctatttttacatcaaataatgttaatccatataatttaatgttgatgcactatcaatttaaaccgttttaaattaccattcaatagcctatttttttttataaaaaaatactcttactagttgaataagaaaaatgtttgttagtacaaatttgacatactaccagcagattttcaaggtataatagcctatttttaattttgacatactattgtaattggatgatataatgaaattactttacactgatgtatctattttcttagtataatatattatactatatagtacggtataccgatagtatatattaataatttatatgaataaaattgttcatgaatatgatgagtttgatcaaccatcctctatacagtctctgtacagccattccatctctatccattatctaactttaatttttctttatatattttttctctcctttttctttttgtattttttggctgcaaaggcaacactgcaagcagagaatcgatacacttgcatcattagtttaaatttaaaatagttatattaacaaattattttctgttaaaaaataaagttaatatactaataaaaacaatcctaatgattagcatttttttattataaatatatttttcaagtgtttataaactattctgagaatttgtgatttgctaattactcagttcatcaatccctttttgctcttgaattgcctaattaaacattaattaatgaatgaaaggaaaagtaaaacattcttcttagagtatttttaaacaaactcatgtgaatgataaataaaatacacaaaaatgattactcgtgtcaaagcttttcaaacacatttttttatcatcaaataaagctgaatatattgatctcttaattaaaaatatctaggactagtcactaaaaatgatcatattagtgaatagtgatgagtaatgctactttttgccaatacttttttccacaacaaatcttacaatcaacaagaagagacataggaagagaagaaataaaaatgtaaaataatacaagtgatgtaatgaaaggaaataaaaaaatgattaatgaaatatgttataaaaattcgagtgaaaatagtgtaagatgttcaaattgcatacacatttagttcaacttatttaaaaaaacaccaagtttagaaataaaatagcgcttacaattttggagtcgaatgcaaaataccctgaaaacacattggtggaaagtggaaactcacattctcaagcatctttcacgacatgttattagcttttacgtgacactaggaaaatgctgtagaaaaatcaaccttacactcataagcatgttaggctaaagatatgcatttcctttaaccttgcattaccctcttatttgctaccaatgcatgagattaagctaaagcagccacagggcaactctcccttggcatgttgttaataccaacttttggtaggtaactaccaaaataatgtctgtctgcatgccaggagagaggagccctattgctgatttgctcactaaaacagttttcaactcgaattggtgcctctgatttgcttgagatacttgagc

SEQ ID NO: 1492 - DNA, 1600 bp, Glycine max
  Soy_ogl_6274 Gm18:59417201..59418800 Cluster 6
gataataattgtaactcttatttttatatttattgaatacctatatattcacactcatattgaaattcaaaatttacttaatgtataaaattaataaaaaaatatattaattaaaaaattattataagtaaattaaaaatttacttttaagtaactcaaacataatattaaaaatattcacacataatagtacctatggttttatatataagaaataattatctaattcatcaaaatcaatataaatgattaaataagttaatttgtcataaattttaattttattttagtactatccataacattaaatgatttaagatgtggttatttttcaaagataatttttaactatacattatattattaatagctcaatatataagtgtatccacttttattaaaacgaatgcatatcattaatagacctcatagttaattatggataaaaacaaaatttagtaataaagtaatcttatatttcttataattaagataaaaaaaatgtcgcattatatttcttatacatagaagcaaagataataataaaaacaagcaaacatgacaatgattccttcaaacttaagtaaaaaataaacaatattaaaaatataacgattcaacattacaaaagtctttaaatataactatccaacattgtaaaattcgttaaataaatataaatctacactactaatttaaaacaccaaataacacaaaatattgattcacaaacttatcaacaaagtcataaatttataaataaaaataaatatcatttcaatattagtatataaaatgtgaagcaaatttaacatagcaatgttggattaattttttttattctatgttggattgttattgcttgtcttaaaattaagaaaatatatttttttttatagaaaagtaacatattttattatatcaatatataaaatatatgacacatatgtgcgggacaagacaggataagtatagtatccatactcgcatttattctcataaaaaatatgagcaaatattcattttcggttttaataaatagataattatcatttcaacttacaaatacttttctgtatagtcatagactctgaatccattttgtgatccctaattatcaaccagaggttaactttacccgattagaatatatggctcgttcgtcataagcaccagtttctttctctcttttttcccttcctatttaaagatgaagatagcattattcatgaattgagaccggaccaaaaagtacaaattatagtgcaagcaagatatccaaaacaaccatgaacaagtttgggctcatctcatatctaactcaccgaataaaatgtattaatagtgcaagagatcccaaaatagttaattaataagaatagatctgagcgcatccctacatcaacactaatccaaaaagacatatataacgacatcaaaataaagcataaacggaatttaattaaatacataatatagtgcaagagataccaaaacatatcaacattcatccatagaacgtcactgacagcaaaataagtatgtcactgtacaccataaaaaaattatttaactccctaaacacatggccggatcctcc

SEQ ID NO: 1493 - DNA, 1500 bp, Glycine max
  Soy_ogl_4820 Gm14:48466801..48468300 Cluster 6
ttattgtgtatattaataattaaaaatgaaaattaggaaaataaaatttcaagtatccaaaactaaaaacttataatgatttaatatttatttctatgatgaaatttttatttatttatttttgaaaaaaaagtattctcttgcgttataaaacatatatattctagttttatatatatttatgtcaatggtaaaaaagaatcgaaacaaataaatttttaaaatagtacaactaaaattgagtcccacccaaatacaaaatatctttgatatactccttaattaatttatggccactcaatatgcatatatgtttaatttggatcggctatttaatggagaaggatgtccaagtggcgttcttcctgcctttggttcacagatatgtcccaagtcaattcggacttatttttgttacgtacagaccaattttcttaattttatatatttgacttctttcgtgataataattattgattttattttttaaatatattgttcccctgactttagggtcttaaattagtcattgcttatcttcaagcattgatagtttcacttcgaatatttcaatgcactaataatatctaagactaacaagtggaagggtatgtcaattaattattttcaaaaattaaaaataattttaatacagataatatgttaattatattttttatttaagtattcttactttaaatgatacttaagattaagaatgtttctctttaagataactcaaccatgtttctaattatatatgtcttgtaattattatgataattaaaagataaaaaaaaatgttccaatttaatgtataaaaggtctccaaattcaaagaatatatacttataggaaaactagttatagagagttgcaagaattttgaaagaaattagtttttatttgtacgtagtaacactaaaaataaaccatgttattgatattttttgtatgaaaactttaaccaaagcattacagataagggacacgagtcagttgcaaaggtcaactgtggttgtgtttgttagttacaggataatgtcactatcacacaatgaataagaagtaattatcatatctgcatggcaacaaagctaaataacttcacgaggactgatcgccccttttaactactattaattgtccattcttatgcattcccactttaacttgcttttacaatatcctttacatgccacgatgggtcttttggtttatatgtagctttatcaacactgcttgtctgctttttatattagagtcgtgagatctatattatagagaatagagatgatagagataaagttaaaattaatgtattaaaaaaatttggatgagattcaatttcaaaaccaaataaccttcaaaaaattgagcaatagtagtagatgttccttgtcatgtcaatcaatttgttgaaagagtaagttataagagggactgagtttaaaatcgaaccaaattatctataatcgttaacctaataaaaaaaaaatt

SEQ ID NO: 1494 - DNA, 1500 bp, Glycine max
  Soy_ogl_2964 Gm09:3285801..3287300 Cluster 6
gaattttgccaacaatgactaatcctcataattgcctttgaggtcacttcaattggatccacatgcagaatattcaagtgagaataatattggagcagttcgttttctactcttgaagaacatataaacatgcatattttgcatttaccccgcaagattttaatttgaaaagttgcatcgattaatgctcatcctgtctcaaccgagcctaaatgtatgcttccttgccagacattataattgatcttttgacaataacttaatcatgagctaatttacaaattaagttgtatgtctaattttgcttattacaaaataattatgcaatttgtagctttttactatgggtgtttatgggcggatttggttttgaaaaaataaaatttccaaatcaattgatattaaatgatttggtttgattaggattttagagttatttttgtctaacccaaaccaaatcaacctgataataaagacaataaacttgcttgttggatttgagtcattgaatatttgatcaatttttttaaaaataattttgaaaaaaataaaaataacatgattttattctttttttttaaataatggtgtcataatataatataatataagtaacatatttaaatgtgattggcgtataaccaatagccaactaaataataacatattataaaaaataataacacgtaattaattgattaaataccaaaattctgtctatatataataattaaaataaattatctaacataattcttgattgataaggcaaactcaagtaaaccaaagtgaaaagattaagaatacaaacacaatagtaggtaagttaaatattaaaaaaataaaataataataataaatatatagttgatttgtttcatgttgattccgatacagaaaatgtataaatttaatatctgaaacaatcaataatagattttaattggttttgttcggatccaattaaaaaaaatatatatgaagtaatttaattcattcaatttggattataaaattagtcaatatgcaccgattaacatcctactttttacttaacaaattacaacaaattattatttacaaaatatcaatctttttatctttctctaacatactaaattgatctagtaatgaactctcattatttttgcagctcaccatatagcttgaaaaaggagcctcaacaaatgcgatatgtatcatttgtcaattgcaaactgaaaagttattcatgttgattgctattcgtccagaaccatttcgataatgatatatatatatatatgtcattattcgtatttttttaagcctataagagaaagatcatgcaattgcacacttaatggtggcggggtccgtgttgtgtgaagttatatgctgaatcgatgctgacctcaaatatctaagtcatacactttacaacaataataacgggaaaagaatgctttttcatcaataaatgagaagatgactttttggaagctaaattaccaacaaatt

SEQ ID NO: 1495 - DNA, 1300 bp, Glycine max
  Soy_ogl_4516 Gm13:37399501..37400800 Cluster 6
acaagtcgggggtaaaagaataatgtccgtcgaattacatgtcgatctaatggtgaaaaatttacaataatatacataagtttattggttcaaatttcaatacgataattataagaaaaaaaatcataaataatgcattactaaatgtatgtaaatttatataaaacaattaatttgttaccaaaatttaattattttatcattctcttgtattataaaatagttaatatatttataatttaacaaagttcatcactgatatattaactttttaaatatcttgttttttatttgttatataaatatataatttaatatatataagaaaattagtccgaataaacaaagatctaaacattataaaataaaattaaaaaatctggcatttgagatgtatattactagccttgctaattcaacgcatatcacaaacctaattagatgtggtcaattttcatgttagatacccttgtgacacatttacaaggtgagcaaatcacttaaaaagttatacaaaatttcaatgatataaaacgtattagttagattcttttttttctttttctctcatgataatgcatcggggttgtataatgtatgagtgtcccactctgtacccagcaaggacgagccccatcgcctgaaatcgcagttgtagtcaaaagaagacgaaagaagttcttggattgtagtgtgtattatgtaagaatcagagcatggtttttctgtttgctagattctgggaaaacaaacaagagcaggttatgttttctcatggtctccgggacataatcatgtacaaattcagacaatttcggaagaaacagacaatatttttcactgacatgttgtgttctgcttagacggataaggcatatatcctgttcaaaaacgggtgatacaaattttgaaaggcttaattacttttcgtaactaaaatatataaattatgttgatataattttcaaattttaaaacacttcatttcgattcttcaatcgttaaaattgaatcaattaaatacttttctctcttaaaaaaaatattttttgtcatattcattaatttgagtgataaaattatctaatatgacacttattttgaatcatcatatcacatgtcacctgtattgaaattaatgtcgttaagattagatcaaactgacagaaagaacttgatatgtttttaacaattaaaaattcaatttgagtgttttaaaatttgagaatcaaattaatgtattttaaatgatttagggaccaaattggcaattagattttttaaaaaaaagagtatttgt

SEQ ID NO: 1496 - DNA, 1042 bp, Glycine max
  Soy_ogl_4635 Gm14:3973124..3974165 Cluster 6
taattttctaatcccgtgtgtatatatatatatatgttttgatgaaaaagattctatggttagttggtaaagggtgggttctgtattggcccatatctctttcaaatagctttctgtaaaatgtttaatatatctttacgcgatcccgaattgctttgcatttctatcagactacttatagataacctgtacatatacacgggcagcatactattggaaatcaaaagagttaatcgcgggaaaaaatttggaaaattagagttagagcacgttaacaattctcttctttttcgataacacgttaaaaaaattctgacgacattcaatcacaaatttttaaaatattcagacttaattcaaaattgccaaacagtataagcacctcaaaattaatttaacatttgaaaaaaaaaagagataaataagtcatcactcatatgcacgaaaatgtcaacaattccatgtagctgcacatggacttctagataacatttatatgtataggaatctatcactatccatataattcagacatcatataacgaccagagtctttgcaagaaaatattattttttaggggaaacataaattgaattgaattattagagaaatcacgaaacacattgaatagccaggccaaggataggtaaacttataccctcgccaatgctattaatttcatgatcacgaagtaatatattttttaatatttttttaaatatactttttcttgttatttaatttattaaaaattacaaaattaaaagagataatcatttaaatatgatataaaatttgtctaattttatcacttttaactaataaaagaatatgttcaatgtgtcactctttctaacatttttctaaattcgttcacctcggagcgtgtcccttcggatcaatttgctatgctgaactctttccactattgtacttataaaatgtacaatgagtttgggtttaatagaagaatgaatgaaaaatataaacctaacatcattgttgctgttgggtttgatcatattcatgaaaatttgtgag

SEQ ID NO: 1497 - DNA, 1300 bp, Glycine max
  Soy_ogl_6961 Gm20:43660201..43661500 Cluster 6
atagaatagaaaaatatcttactaaaagttgttcaattttttaaggttgatttttttatataatttgtttctcttttttgttgtaagctaccatacaaaaacattatttaaaaattaattattaaaacatacttttttttctttacatgtatcttccataaaaaaaattatattaaaagtgcaattagatattaaatgagagtacatcttccgatcacaattctaataatggttcattatattgtgagaaattattcttttttcttataatatgagaaattattctcttttattaggccaaacccaaattaaaaattaaatcacattgcttcattatattgtgaggaattattgtaaaactaccttagacccaactttaaaagataaatcttcacggggataaagcataaatagttgtcctttttataacagacaaaagttattttgctatcattaaatatcagtaaaaaaaaaaattgaaatgcttcacctttttggattttacattatgttttgtgttttcatcaatttcaacttttaaacacaaacatgttattattttgcattcttctatattttttcttttgaaccatgtattttgggttcgagagataaagactaattcttaaaaagattaaaatttatttaagaagttaagttctcatttttatattaaacctacaatcacatatttaaaagataatgttatctatcaattatattatccaatattgattccatccttgttacccctcagggaattaaacacattatatatagcagatctaacctaatttatcttagtggcattgctgatcatcatacgcgaaactgttgactggaaaagactatccttgcattggcctagagagctaaaggaaaaagataagtgaagaggaaagggtgggggaaacaaattgctgtagctgagtgtcattatccatatagacattacagttgaagcaggcctgtaaataaatgcttgatatagtggggccttgaatttgtattttttttttccatatgaggtgttaaatcctttatccttatacaaatccccaaataatgctagtgccaaaataaaattaaaaaaagttttgtaagttttccgtttatctaattgcgcaagttgaaagttttcattcgtagccttttagtgttgagctactataaattatcgtgaacttttttttttggtgaacttttatttatactagtatagtttagattagagttaaatttttatgtactgttgtagtaagaatttatcctatcgatcaaataaaaaagtatgactttt

SEQ ID NO: 1498 - DNA, 1133 bp, Glycine max
  Soy_ogl_5235 Gm16:16158..1637900 Cluster 6
tttttgtagtaattactttaaaaatcatacatgtgggtctaattagcaccaatttggtctaaataaacaataatgataaatgtactgatgaatgaattgtttaacaaaccatttccattactaatatccaatttcattaagctaacaacacacacaattttttgttaatagattaaacaattatattacaattggtttcatttaattcattgttactaacatattagtttcctattttttaaataaatcatatatgcttggaaattgattttatttaattagttttgggctagctttgcattctgtggacaaaagactgtaggcctaccactacaataaaatggaaatgactttgtttagagattggaccgaacctagcgcatcacaaaggcaaaaaaaaaaaaaaaaaagctcaaactcagcgtagttatgtttttctgctcctctgtgattggattcctttatatacaacaatgaggtgttgtttgttttttttttgaaatatttttgtgatttctgtattctctggaaaattttcaacccttaacacaattttgtttctggtatttatagcctgctgggttgcatgaagtatgtttggtttgactagtattaaaaacatactatacgtaatcacccaagctgtagctggaaccgcgaaatcacaatctaatattccacaaattaattaaatactggtttctcatagcacattaaaaaaaatgtatctttgagtttttaagagaaaagaaactggaaagaaagaaggatattaaacagtgaactgtctttcacgttgacaacatttagaaccgttatattatgaatatagtgtatgtgaggtaaaaatgttgtgctttcattgacaacttcgaaatttaagttcctttcaattcttcatcattttaatgccgttaatggccatcatttattatataaaaataaaatgtacgtgaagtaataattctagtgaaccttagattagacaggcatcatcatgtgttgtatataatcccacgctttgaatattggaccacccacaaaaaccatgcttataattaattaattaattagtttgtgaagtgaagacattaatgacatgggcaaaaagccatataaattacaccttttga

SEQ ID NO: 1499 - DNA, 1665 bp, Glycine max
  Soy_ogl_893 Gm03:36121151..36122815 Cluster 6
tactttttttcctctttctatcactaggtgctatcaaaggtgttcttcagatcgaattgacatgatgatgggtgaatccaacaatttaagtaaaattaatttaaaattggtaaggttattggatctatctttttcatactaaactaacccaatgactgagtaacaattatttagcttttacattaatatattttatactcaaataaaaaaactgtttgagccaaattcaccatttaaagagaagaatataattcatctctacatatttagcttttatatatatagatacatagatagatagagggataagatcaaagttcttgaaaaggaaatgcaaaagcatttaatttgcatgtttcgaagcatttaaatgtttctcagttaccatgccgggtcggctattcctatgtggtgcatgtttcgcatttaaaggtaagttcagattaaatttgagtttcttgagagggacaaaatatttctttgtttttatatacgaatatggactgcacaagattgaacccaacctatttttttttaatcaatgttgtcctcaaccgtggggagcttgaccaacaattttggaggggataaaatagttaaatttataatatataagttaaatgtaacaatttttttagcaaatttacatgagtaaggtaatttttttaagaaattacattaatagattttgaaaatattacaccttatggctaagtcgtgtattaaaacacaactttaaaactgtaattaaaaaaaaaataataaagtcgtgttttgaatcataacttcaaacattttatatttttttaaaaaaaatactgaagccgtgttttagatcaagacttcaaatactttttttttcttttttttttttaaattacgatgttctaaagtcgtattttaaaaaacaacatctttatatgatgtcgtgttttaaaacacaattaccagtaatcttttcaaaaaatctatccattcctgtaattttcttaaaaaattatcccacttctacaaatttgccaatttttataatattatctgttatgggtaattttaacttattaatgattttatataatattaattatttttaattagttgtttttatgatatttgtatatcttattttactctattaatatcactcttcagtcttttatgacttttataaccttgtatgctactaaattaaaaaatagagaattttatgtttaaattatttttgaaaaactcctgcaagaaaaattaagatattttatacaaaacaaaattggtggaagaatacagagaaagcatttcaaaatttcaatggattttttaaaaaaattaatcatatttttgtcataattatagcaaaatttgaagaaaaaattcgtaagaaatcataaaatttatataaacaaaattgcattaaaatattgcaagaaaaatctgcaaacaagaaaaaattgcaagttaattatattgtataaactttcctatacaaaatgagaatataaaagtcttaaaaataagtttggaaaatggaaaaaaaatgttataaaaatacaattatctaatggaaaagttcatgtattaaaagtattattgatttgtaaaattacccacaagttctaatgttattaaaagcaaaaaattaaaatgtaatattaacgtaaattatct

SEQ ID NO: 1500 - DNA, 1395 bp, Glycine max
  Soy_ogl_259 Gm01:51003099..51004493 Cluster 6
gattaacgtcattaatcatttaaaatatatttttttcaattatttccccttttccttcctctccactttatttttaacaaaaaaaaaatcctaaatgattaaagacatcaattttaagtgaccaaaccaaacaaaaaaaaaagataaataacttaaataaatttttaaaagataaatattaaatttaataaaaaaacaagataaatggtcaaattgaactttttaaatgataaaaaattaaattgaacaaaaaataagataaataactaaattaatcatttaacaaaaaatattataattactaaaatgttcttaaataatcataacaaaaaatccatgttatttttacaaatacaagtgattctacccccattttttcaacaaaaaaataaaagacaaaaactgcatcttttttttggtagctaggtaatctgggttcactcaaataaaagcctatacatttagaaaaatgtcttcttttaaattgattatcattatagttttttttttcagaagctattcgaaacttctgaattctgattttctcaaacttaaatgaatacagtcaaaaacttccgaagtggctttttaaaatataagtgatttgtttataaaaaattgaaataaaattagtgatagagattattggattgatgtgagtgtgtttttttttttcaagaccacgaacatctttataatacataaagtttgaatccagatcttaatttgaagagaataaagcatatactatttttatgatgcgcgcatcttaatctgctgttgagtctatatatatatatatatactgttgagttgtataatttaataagtattcaatttcataatgtaggtattaaattaaaaaaaaattgtgagtagctagatacaactttatataaattcgaatatgttttatattttataatataaaagagttttgcatgtttacgaagaaatgtggattagaagctacgtgatgtatatccctagtttctctcacctgaaatctggttgagttgagcatcatatctatccgtatctatttcaaaggacgaagaatctgtcctatcgccatgtaccatgaccaatgacaagaaaagaaaaaacaagtattaattccaccacgagacctaaactatatatatacacgtcatgaaattaccaggattttttcctaataagacaagtccaaatggcgacccatcaacgataataataattagaaacatagtataatatagaataagattaattaaatttttaattcctcacgttttataatttttatgagaaagttcaaatgacgacccatcaacgacgcaaataataataattggaaacatagtataacataaaatataattaattaaatttttagtccctcaatttttataa

SEQ ID NO: 1501 - DNA, 1027 bp, Glycine max
  Soy_ogl_2260 Gm07:7865574..7866600 Cluster 6
attgtaagtgcttagctaagcatattcacacaggcacatggggtatcaaacagtgtcaattattatatttggcttcatatctctctcataatttgtgccgtgacattcgtctgattttgactctatctggacccaatatatattgtgcccacccagtttgttttaatttgtttctatacttttttggatcctcaactcaatacatattgttttagcatgttccttaatttaattattcttcaaagttggttatcaataccaaaatacaaaacatcaactttctatttattataagttgttctgatttcttttctcatcgttattcaaaattttaagcaattagaaattgaattgcatgtgtaccaactatatgccttagctttatgataaaacaaatgaggttgaagttgaattaaaaaaaaaaaaaaagaagagagggagacagtaaaccttaagtaaatgcattgtttattagttcaaagcataataaatatttgtgtcaacatattgaatttgttcttgtgatattcgtgattaaaacaccgtggcaagagagaaaccctggaatttatgtaagatttttttaaaataaaaaataaaatttgacgtttaactttctaaagtgaactcttaaattgatccctaaaaaaaattataggtgttattagatttgttcataaaaatctaaatcatcaattttttgatttgatataatcataattatgaccttagactcgtcaattgtatctcaagatattctcacaaatttttatcatttggagagtttaatcacacttaaaatttatcatttcttttcaagaatatattctacgaagatcaaattcagatttttttttcacaaactaaatgtgtgttgtcaatagaactatattgagtggttaattatcaatttaagaactaacctaaattataggtgttattagattaattttaatcctacattctaagttccaagcgtggaatttatagtaaatgttagcgggcacagtataaaatactttgttct

SEQ ID NO: 1502 - DNA, 1848 bp, Glycine max
  Soy_ogl_3629 Gm10:48650701..48652548 Cluster 6
cattttgtcgctaatattatattatattgttcaagattgatcgtgtccccatgtaaagacatggttttccaactagtttgtctttaagcaatactatgcttttaccctccctgaagatgctgttttgttttgagtaaaatattgacttgaacttaaaattagtaccattaattaatctagtttctaatatttttaaaaaatattttctagctacaacatttactaattaataattattttatccataaaatcgatactagtagataatttaatccttaaaatttggaataaaacaaattcaattcgttagttttaatattttatgaatcaatttggcctttcatgcacctgttagagactaaattgacaaatgtacgccactatgaagttgacttttactgaattcatggatcaagttgatttgtttatttatgtaatatttatgaaagattaaattgactaacaatgttggctaatttcaagatcaaattattgtttttctgtaatgtcagtgattacaatgataaattgtataatattttacataaaaaaatttgtataaatttttagtacggacttaatgttttactcatctgctcttcttcgattatttctggtttatttatatgacaaactaaaaaatatatatcatttttcaagtaaacgtactaatttttatgggagttggaccataagcacgtttgaaaatcaaatggaaaatgatttttgaggcaaaaataattttacaaaattatcaaaaattcttatttttttattcgttggatttgtattggagcatgggtcatgaaaattttaactacaaaccaaacatatactatattagtagttagtcatacttgtaaaaacaacacaagcctactttgttaaatcttttatgatatttgttctgagtgaaatttattcttatatttgttattcatttattttttttaattttacttgaattcttaatatagtttttttaattcgactgaaaaataaatgcgagtaatcaatgttaatttggtcataaaaaatttaatgtaatatttaagtgatttattatttcgattaagggcatggataaaaaagccattagttaaaaaaaatagcaataggatgataatatttgcatattaacaccaacaggatgatggtatttaagtgatttactgttttaattaatggcatgaataaaaaaagatacactattatttgaaattacattaaagtatcttttctaaactttgattctaattcatttatttagaaagttatttctcattactagatttatagaattaaaattaaaagtattaatataaaaatacttagttttactttaattttatttttatccgttaaatttagattgaaatatgcgtcaacaattttcactgcaaaccaaacataggctatgttagtggttaatcatgcttatataaaaaaaaagacctactttattaaatcttatatgatatttgtttagagtgaaatttattctaagatttgtatttcatttaatttttgtaattttacttgaattcttaatatagtgtttttaattttactaacaaataaatgtgagtaattaatattaatttggtcatcagaaatctaatgtaactattaaaaggaattgcgttttgccgagagtcgaacccaggtctattacttggaaggcaattatcttaacctacaaacgctgttgatgttgttaaattggtatttgttatctgcacaaactcgattttaatattaagttaatattcttatttatttataactgttaacaaagataattattttttttaatgtacacatttcttattcataaactactcatta

SEQ ID NO: 1503 - DNA, 1566 bp, Glycine max
  Soy_ogl_2213 Gm07:5387958..5389523 Cluster 6
gtatgattgtaattatatgtcatagatttacatttttgacatttgtaaaatgaaaactaattgctctttctctctctttgaactatctttttggctgtataattatcctttattagttaaagtattatagggtcaatatatatattttttaaaacttaaaaaaattgaaaaaaaaacactttttaaaataattttttttagaatcctaaatttcttattaaactgaaataattctaggtgaattgatctacttgatcatgcaaaaaccgtttaaacaaaaatatcgtaaataaaatattgttattttattatttttttaactttaaacaaacacaaaaaaattcctttgtccataaagtaatatacacagacaaaaacaaacaattaaattactatcattatcctttaatcataaaataatatacacagatctaaaaaaagatttccccaaaacattgagggacaattagataattttaatagcatcagaaagggtatcaaaattttaaatgcaattaaaagacatgaaaaataaaaattacaatccaatgatcgattctcagttgatgaaattctcggtgctcttaaaaaaacagcaaattcacgggagacgaatttaagctacaattgaaatcaattatgtaccaacaaattggtgctcttagtagtttaaaaaagggaaaattcttggtgaaatcactaataagtgtaatgtaaattaatcaattaaaaaaaacgtaaatttatcaagggtgttgaaatatttcataatttatgtcattttccatcaatttggattccgattgaccttatatcatatatacaccaaattgcaacgtcactatctgtaccattttatttgttaacccaagcttgagacaattttcccgggaagcaggataatggatatcctgtagtattattctggttctcgtctcgtggtgcaagaaggaacctgtcgtatatattactataattttttttcttttcatggtgagaattaagtatctatggatcttgtcttttattaatgtttgctagctagaaagatcgacttctggtcgcggatcttttcccttaactacattttattcatttacaggatttaaatccacaatattgtttgagaaatttaagtttaatttcactccagcagcatataatactgatagtaatacattgtaatatgcacccacataatatttatgcttatgagcatgtcaataacagaagtcagtgaggaactttcaatgatacgtataaagtttgtcttaagtcggctactaagtcatcaaatattggttatctggtaattttttattataaaatattaatcgcaaattaataaataattaacagatgatttaattttatttttttaatataactgatttaaattttttacttgggagaagaaaatgaatgtagtctccaaattcagaaaagaaaacagaaaataattagtttctctagccactttttttatgcctctctaaataaagtacattgatatttgttataatttaacatcggtgccaatattccaattgtttaaagggtctcgtg

SEQ ID NO: 1504 - DNA, 1600 bp, Glycine max
  Soy_ogl_6555 Gm19:44183901..44185500 Cluster 6
agattccaatatctcttgctaataaattaaaggaaaaagttaataacaataaaacttgtttatcacatactttttcatgtctattttttattttaatattttagctttgattttaattagttaaaatttgagaaaattagtaaaatacagaaaaattaattttttttataaaatcattatattacaatttaacattatagtaagtttgttgaatttaaaattcaaccattgagtagtaacaagaggtttaagtaatttgtatgaaatatttttttcaaactctaaccagcccccaactccatatcatatacaattaatctggtaccaatgacaccttccttgtcatgttctagcatgatcttctaaagtttctatttcaatgaactttgttgcttttctccaatggcaagtattattccactcacgagtcggacgagtgaaagttttacatttttaaaggttctttttttttttttgctctccttttaactaattaatttctgaattaattgtgtcaagttacttatttattaactaactcgtcaataggaattgaatggagttaattaatttttatttcaacctactagatcaattcaaatgagtgctatttacttactttaacagctctaatcaccaaagcaaatagtaatcaaaatcaaacgtgttgaaacattataaatgcaacctttttcataaataaaaaccatgtattttacaagtaatttatatagtaaatttcaataagttcagtgtttaattttcatacgattcttttttttcaatgagcccttaaatgaaagaataaagttgaaatttttggactaaacgcaatgcacggacgtcatagcaacgttaaggcatgacgtcatcttctttccttttcttttcttttattattattaggtgggatgcttttaatttattaatcctaagagtgacatgcatagacaactttttttaaatttttatttttatataagatagacaacttttcaaatcatacgcctctgtctgtgaagatgcattatttttttcctgataaaaaagatgtattatttgtattgttcctaagagtgattcttttttttttaaatgtatcaaataggcgcctttttttttatccaacacaaaaaaaatgggcatcattgttcgcagctcccactttctaaattctaaacccacgtgatttaatgcctttttcaagggtctgtcacatctgttactgtgttagatcaactgtcacagtgagtccgatagatcactaaacctggatcaagtgattaaaaatgagtgagatcagcttgattgtttggtttcgtgtctaaggatttgtttggaaagagtgaaaatagaaggagaaaaattaaaagaaaaataaatacttataataatatcttttcatttgtttggttggaaaaaatggaaggaaatcaaagaaattaaaaaaaacaaattcaagttttcctttctgttttatttttcttgtagttgttgtaacaagatagttgtattaaaaggtgtgactaaatcacttccttttcatatggttttctttcctctctatttttgtttgccctcttgtcaaacatagggtaag

SEQ ID NO: 1505 - DNA, 1145 bp, Glycine max
  Soy_ogl_1041 Gm03:42269422..42270566 Cluster 6
aaggagccattttattttaattatatatatacatataaaaattatgattaagatataaaaaaggtgtaaaataaagaatggtaatgtaaaaaatgttactattaaataaatattataaaaaattgtaaaaaaataatataattgtttccatcgttgtattgatcaacgtcaaaaacatatacattgagcatattttagtgacagtgacacttttaccttcccttgatggctattggtctctcaagtcatgcatgcgtgtaatgccatacgtacatattaaaatgtttgactatatgtttgtgcatgtctttcaagcgccccgaattaaggaagtttaaaaagaaacacaaagcaattcttcaaagggtaatgagaaacatattacatatactatgtgagacatgggtagaaaagagagataattaaagaaaattaaaagaaggaaaaaattatgtgatgaataataaaataactgtgtgtgtgtatatatatatatatattaatatttttcttcgggtaaaatgaggctaggaagtttgtaactagatactgtatgatgattaaaacatagattggagcaaatacagcaaaagcacagttgattttgaaaggtttccgtcagtactgtttcatttataatatttattaattcccccgtaatcctgtataactaaataaacggataattttcatttacaaaatattattgaaaaatagagtacataacttcaatttatacgctgtaaaaaaaaatccatttatacgattctcaattaggatattttgactattttactcaattagagtaactacatattatgaaatggtacaactttaaattaaacatgttttgagttctctgaaatatgattttgtcaaattttagtttttgtcagaaaaaaaaaacttcaacatttagatcctaacacttctttttgtcctttttagtttttataattaatgttagttagttaatttagtgctgacatgactaataaaataaagaataataattaaaagataatcaagacaatgaaaaatattaattaagatgattaaggtaataaagaatattttgaactaaaataattagattagtttaaggtgatttgcacaccagtacatgcctagttgtgaaacacaat

SEQ ID NO: 1506 - DNA, 1298 bp, Glycine max
  Soy_ogl_5812 Gm17:40129901..40131198 Cluster 6
tgggagctctagctaggggacacatggataagatttgttggtgccaaagatttaactatatatggaccaattatgatttctttacctttctacgtattattgagcagatttctttttataagaagagttcattgtaattattcttcctccactctcttagattatttcagcccctccccccgacaagaagcatatgtgaaaagattaaatgtcatgtataccatatcatagcgattttttttatgacagagagattctttcttatcctctgtacttttggtaaagttattttggatatttataaacaagctaataataatgaaaatgggtgcatgactcgcccccatcaaagaatcatatgccacatttgacacaatcgtcctatttggactatataggtgatgagaataattaactaatgcaactttagagaagaataaaaatattatataataaattgaagatttatacgtgcaatatatcaatgataaactcctttctaattttgattttaatatttatcgaaaatttgattttaataattttttggttactcgattaacaagactgtctaaagagggagatgtaaaccaagctagaacccttgaagttatacgttaataaccttatatagctcactgctgacaaagtaatccaatggggtttgatttaatgatgatcgtcaaacttggctgtagctgtaggaaaagatcgagtgtgtacaggaatatattctcaaatgggaggtccctgattattcaaacttgcatcacctcattttttgctagtcaacagtaccacagggcacgttatcgaacatttttgttcatatataactcagctaattaataacaaccttgtgtaagttttctgtcatatcatcaagaagaatacaaccacttgttcttctcgtgatctttagcttcccaagtgtgcatgatatcactcatacatttggcaggtttttagtcaatgttatctttttttggagcaactcactttcttcaacatataggtcttcttaaagtaaaaaaaatgttaagaaggctttggttatccgtaagaattgaaaataggataaagagatttataatatttataccctcttaatcaattgaagtagactttttgattataaagttataatacaatcatttaattataagattttttttttaaatcaagatatcatcataatcgaaagtaataagattaactttcaaaatataaaagattactaaaataaattttatctctttcaacaaaaaaaattcatacccaccggacaataaaaaaat

SEQ ID NO: 1507 - DNA, 1176 bp, Glycine max
  Soy_ogl_6867 Gm20:39412525..39413700 Cluster 6
atatgggtcatgggacattgatttattcttttatcaactggtgtttggaatcatttactattttaaactgattgcatttttgtttttttattaattttgtttttttgttttcatattgacgtattctttttgggagtcacacatcttgacacattttattaatatattaggctcgttttaccctttaaaaaaataaatgttttttaaaaataaatgtttgagtagttgttataataaaaaaacaaaacaaaataaagtttatgaattttttttaaccaacataattaaggtttttttatcacaagcttaagggtccttagtggcataatcacacataaaattttgtacctctaaaaatattatattatataagaatcaaacttatataatttcctaccaactaaacatgtgatgattaaagtttatgaataatattttaatttctttattagataataataataataataaatatccttgaatacatcgtctcgaagttgcatacatacgtagtcacaaataaatgttacatatgtaaattatttcacagtaattctaaagaaaaaataatctttttaaaaggacaattttgatatatttatatatttttaagtagatataatttttaaaacataagaagattataggtattttgcaagattatcataaagagataatgatatattaaagttgatgtaacatatccttgcctaagtgatcacttaaaatccattatctatgagaaaaaagtgaaataaagagagatataaaaaagaaaaagtcacgatccatgagagtttagtgtcacgttatactaccaatacaaacaataatgacaaaacgtttatgaatgaaacggtccaaccctaccctacctattggttgcttgtgcaatcccaatatcaagagagagatacattgcacttttggacctttgaattattaattattaattaattataaattaaagtttttgcgatggtctgtcactcgatccgtcatttcattttttaaacaaataaaatttaaggaaaggagataacaagaaaagcatttggactcacaatgctttcaagactacataaattttccttatctttggataatttttttagcttatcttaaaaaacaaatggaaatttaactattcgataaaactaacttaaaaaattagtt

SEQ ID NO: 1508 - DNA, 1405 bp, Glycine max
  Soy_ogl_6946 Gm20:43202101..43203505 Cluster 6
gtaatatttgaaaaagccatttcattgataggatttggtaccagccatttttctttagtttttcaaactataatatagaggtatgaaaacccaagaaaaataaactcaacaaaaaaacataaagacatatgaacaagaaagaaaaaatttaaataatgtttgttcaagaaacgaatgatcttatttatgcccatataagtttttaggggtgaacattattaaggtaaagttgaatttagaagctaatgatgacgaattttcgggtcaggtatgctcattttgcaaacgtcaacacgatcaaacttgataggaatatagttgggtgacttggatcaagacaggtcatcaagttgtctatttaaaaaatataaaacaacaaaaggaaagataaaatatgggaaaatttgtaaacattgaatttgccaccaaaaaagttgtaaacattcaaagaaaataaatattttgcttcaaaagttagatttaaaaattaaaagtttaatatatttttaattcttcaaaatattaaaaaatttagttttaatccataaaaaatattcacttttaatttatgaaattacgcaaaggaggggtattcataggttggattgatttgtctcaaaagtaaagtcaaatctaaattaattatatttcgtggacattgatcgtttcggattaaaaaaaaggataaatctaaaaggttaatcaaattaacttgaccaatttaattggtttgttttaattttatttattgaattcattgaatcaacctaatttggtgagtatttataattagaagtggtgtgatttttttttaatagttaaaaattaagaagagagttatcaaaatttacaacaattcatgtgatcagttgaactaattgagttatatcttattgataaatgacttgattttaatatctcaataaatattattattaattaaaatgtagtgtttttaaaaatacatacatagaaattaaaacaaaaaattatgatactgtgaatgctattatataggaggagatccactcatccgttcaatatatcccctcagtaaagccattgactagtttattggacgtaattgatccatgcggatctagacccgtcgtcatagacacatcttgcaatgtttgttctatgagatccatcagtttttggtgaacgtgtaaagaaccaccacattgaaaatattcacttaaggtcttgtttggaagggtttatttaaattaatcttatcatataatactcgtatacaagtttgaaaagcttataagaaagcaccttatgatatatctataagctcttttcagcttctttcaataagcttatgaaataacttgtgtctgtcaaaaaagaagaagaaaagaaatagctcgtgaaaaaacttatagattttataaaa

SEQ ID NO: 1509 - DNA, 1000 bp, Glycine max
  Soy_ogl_977 Gm03:39686901..39687900 Cluster 6
actagtggagacaacctggaattcttaaaaatgtagtttcaaggctcaagttaacctaatttggatgggaatttgactgaaatgactgacattgttatgcgtacgtgaatgagctaggaagggttggtcctacaaaattgtcccggtatctacgtgacagaaacaaaaagtgtaagaataaaactaaatatactactctctcgtttaggttttgatttattatttcaaataagcagcacctaagttaattttcgttttggcatatattgacttcaatcttgacacattgtaatttgtatgacccacgcccaaaagtatacaaaatactcgcataacatctttcttagtcactgatatgtctcgttgtcggttaattagaaaggttatatgcatgtcaggttactgtctaaatcacttaattaatttattgaattataagtttttttataaagttatttattaaagtaattgataaacataaaatgattggatgtgtttgtctaatatttaaatttaaatatcattttaaattttattttatggataaaatatacttttaggtgattataattttagtttttcttttactttgaactcttataatttttatttaaagatgaattattttaattaaaaaaattagtttacgttgttatattttttcatagtgtattttattatcaattttattgtatatcttatgatatttttaattaaatttaaaataaaatatatatacctagataatcatcatactcccattatgttgcaagtgaaaaaaaaatctagtgcatgacaaaattgcatcaatctaaagtgtattatgttaagaatgtgagagaaaataagaaatcaaataaggaattaactagaacaattaaaaaaggttaaattgtaattatgatgctcctacaattaaaaatatgtaaattattcaaaataaaaatatataaataaaattttaaaaaattatatattaaatatactttaattataaatt

SEQ ID NO: 1510 - DNA, 1700 bp, Glycine max
  Soy_ogl_3571 Gm10:46234701..46236400 Cluster 6
caagcgttgcagcatgcatgcttccactatgccaaacccatttgggcttaatctccaattcttgattacctgaacaactaaagagagacaaagaagattaacagaaggtatagcaggtaggctttcttgaaaataaatcactggtattagtcaaaaaaattggcccactgacactttcctttaattgcttgttggtcattaatttgacattggtcatggtcttttggttttgggataattagtaggattcggtcgtagctccccaattaatcttcttaaggtaaaaagccgcaattaaatggtctccccgggccctatgcttcagctttgtgctttgctttccacaagtcactttaacactctgtgatgtgtgtaatgtattttattacccagatagataatcaccctgttcttgatagaaactcagtgccaaatgagatgatggtgactggaatctggatcctatgttttccaaccaattaattaccaactcatttgtagataagtatgaaaatatgtgtgtatttttggatgattgttgtaaaaattgattttgattaaaattaattttaaaatggtataatttatgtttggatgttttattataaaattaaattaaaagtaaaatttagtataaattttttgatttaacacacaagatattcaaagttattttaacttaatcaattttaaattcataattaattttaaaatattctataacctgtagaaaaattgatctaaaattacgacccaaaattaattctccaatacaaaatcaaatacacataataaaaaatcttgctaacttgttctaagagtgcagattaaaaaactgaaaaatttattaaaaattatatgataggatatttataattcataaagaagcatatttttatctattttaataaaagtaaaaaaaaaaaatcttcatctacctaagagaactggttggttaacatttgcatacaccaaaattaaaattccatgtatcgcaaacaagacagaaagattctcaaacatactgtatatagttagatgaaacagatgtttttctctttcccttgaacatcgatttctgttggccaaccatgtaatagtcttgaaaaatactaaagtttatcaagttatttaatcgttattaactttttaaatattttgaaaggagaaaaaataagagagaaataaaagagtaacaatgaagagaggtgtattattgggaaaaatatgttttccgtctcttaaaaatatgaattaaatttttgtcctatttttatcttttacctaagaaatacttgacttttaatcttcaaaatggttatacttaatatttattgcagattatcaagacaagaaatgcacttagaggatcaaaataaagtatttccaaattagatagataaaaataggataatattttttagaagactaaaaccaaatttgaaatttcttaagaacaaaaataatatttttatcctgtatttgaatagataataataatagtaaataaaaaatatctttagtatttaattgagtaacacagaaataaaaaataattatacattatcctgtaaataaattgttaaaaatatatatacacaaacttatattcataatattcttttggattttatattgatattatatgtatccgtaggctggattggtagagtaatttaagatttcattatattcattca

SEQ ID NO: 1511 - DNA, 1440 bp, Glycine max
  Soy_ogl_6224 Gm18:57040461..57041900 Cluster 6
ctgttttagatttaaaatatttcttttttattttgggatgaatataatcagagacggagccgggtttaaagtttagggggaccaactaaaaaaaatagaaaatatatttaaacagaaaacaagttaagcattttttaagacccaagatcataaatattagtcatcaaacctcacactaccactcccttatatatacacgattaagtgagtgaaaatagaaaaatatttgttaatgagtctcacacctcatattaccaaccctatatatagagttcgtaattacacatatttattctattggcaattgtgaataaatgatttttaattttcaaattatcaatattaatggatggataataaagacttgtaagtgtaattatttgtatcctttaatatagatgataaaagaaatatatattgaaaaaataagtgatatatattaaaatattttagctaaatagagaaaaaaaatacaatcatgtatctccacaataaatacacatggaaaaaatatatttatttaaaaataaaaatatataattatcttcacaatagatattataaaaggagaataaatatttataaacaaataacacctaaatattattatttaactccaaaatttaaattaattactcaaatatttatatatctcatcatatgtataaaaaaattaaggaggccaaaggcccccacactcttacgtgacaccattccttaataaaaaggtacgtgaaattcacattttttttaaatttcttttcttctttgtttctactttaccaaacacactcctccatttgctatttttttctttatttatactgtctttttttatttcacctccattttttttttctgccagaaccaccctaattaagttctatcaagatgttgagcatatagccgttttcctctaaatttttgcatcctaattaatttcatcaagttaaaaaggaatatataacttatttaataatatatattttatcagtttttctaacgtgtgaaacattacacatcataagagtaattaattatttaatgttacctatttagattaatacttattttaatgattaattcttccaaattaattattattatttcttagattaatagattcatcactttcaatcagaataataaatattctctcacatttattaaattgatttatttcttgtaatatttttccctaaaaaaataatttttctctttctgaaaattaaaataaaataatttataatgccataattatattcatatgtcagggcaataactattgaaggaccatgtgaaataaaaagcatgtgaaaccaaaagcatatgttaggtgtttgcggtggtgttatttttttagggaaaatattataggaaatgaagaacttataaatataattatgacatttaaatatatatttttttcagaaagagagg

SEQ ID NO: 1512 - DNA, 1800 bp, Glycine max
  Soy_ogl_1702 Gm05:37330101..37331900 Cluster 6
ttattcaagtaaaattttaccataaagatcataagaaagaattaacatctttaagagaagttttaatgtttattattttttatattcctaatttatccattttattttttgcaactaaacaaaaataattctttaagtccacattgacattgttatatcataacattatatacaagttttattttaatatttatatagacataataaaaaaattgttttttctctaaaaatggggattcgaaccctaatcacttccacataccgtttcttcacactaaaaacattaaaaatcataaacaagtagcatttagtagttaatcagagttttaatcattttattgtctttgattacttattctctcaaatacccttcttttttaaataaaaaaaaatgatgaattcgttggcctactgagaagttggttttatagtgtaaatggtttgatcctattccccaagcaataaggttaggtaattatggcaatgttgcaatataaaatccaagagatatcaaaattatagtagctcaataagcaaagttttgttgacattcttatgtaacacagtaacagaggaagggctaatctctttgttgaagaaaattgacgttgaaggcaaagaaaatataaaattcatatcgaatagtaaagaagaggaagaatttctttacgaatacataaaagaagatgaacatctagaacacgcggaggaagatgatgatgaagaaacttatgaagagacaaattcaatttaagttatagagtaaaaaatgtggtagctgtgcgtgtgtcctattcttaattttttttatgtgctattttgatgtataccaatggaaggttgttaatttttatggggttgctttaattatttatatgcatttctattttttttatatacattagttactaatggagtaatttttatttttatatgtatataaatagagtactaatggtactctctaacactctttgttaaagattctatgatttgataagaaaacttaccaaaaaaatgataatttttaataaattttaatgaaagagaactagaaagtatgaaattactaacatttctcatataaatatagatacagattaaacacacaataaaaacattaacgttgaaggaagggagagagaagaagagataaaaagaataatactttgttatttttttgaaagagcgtcgttctaaatcttaaaaacctgtaacttccctacttaataatatgtttagttccacaaattggatataatgtaaaaaattattaattatagctttcaaatcttaaaaacatgttattaagtattaaccagtatatacctaaccattttcactttcattcacacataatcatccaaattcatgagtcaatttttagtcttaagaaaaaatgattgtaataattttttaaacacattctactataattaaattaattttttccaaaatataaaattttattaattgcgcttctgattgatgatgtttagtcataatttatagtttttaataaatttaaatcaataataaagaaaaaagtgtgctaaatgtgttagctctcattccgaatttaggattgaaaggcttcacgcaaccacaaatcatacacatacaaataagaaattagaatgattgaaaacctcaaagaatattttatttgtcttattgattaacaaataacaacaataatgagttgggcccagccgggtgtctctaattggagacctaatctaatcataactaattcaataaatttgtttcaaattccatcttaatcaaaatcgaaattga

SEQ ID NO: 1513 - DNA, 1400 bp, Glycine max
  Soy_ogl_2983 Gm09:4085401..4086800 Cluster 6
atagtcattcctggtcaaccgacaggagaacaaggtaccccgataaccgatgtttgggttcagctaaagccacgtgtatttctagagaatggaaatgaaaattttttttaaaaaaaaccaatctatctattaaatgaaatgatatgttatcgaattaaaatctaaaggtttagaataataatgcatcaaatcaaaattaagttcaataaataataatgatgttcaagttattttttttttctaattacatttcaggtatgtaaaagattacacgctacactggctaccaataaaagattacaacgctttctttaatttccttttttctctccatttcttaatttttggcgtattttttttaatttcttgatttcagatgcagaatttacgtatgaatcattgaactggttcttaaacagacatcataaagacaactttgacttattaggaactacatatgcccattacatcattttcaatatgtagatacagttgctttgcaaatattcttagtataaaattgaaagaagttccgcgtactgacagaaactaattgagaacatttatttttaattttatattgcctatttacctgctgaagtgttttttaaataaattttagtatccgtgtatatatattaatatatattaatgagtcaaatttaattttcttatattaacagtaagcacagaaatatttagaaaaaaacaatcatatattagtaaagcaattttatttaaaattaaaaaactaagcttaactctcctcgctttctaagtttttttctatttaataaaattatttttttctttttaaattttgactatcctcaatctagactcttctctagtgacggaagatttcgataaagggacacagttatggtacgctagcaaaaagatattttagtttaggaaaaatatattttattatatgtaagtataagttacaatattaaaaaatcaatttaaaaccattgctggtctaaaaatttgccgtaccgtttaatagtatattaccatattattgaaaaaatttagtattctaagtatcaaatccactgtgtcaagaaaaagtatcaaatggtatattatcgaatgaaattataaatcaaatcaaaactaagtcccaataataatgatgttcaagttttgtttttttaacctaaaaaaataagttttgttttttaattaccatccatggaattggctttgcttttaaagaaaaaagaattcctccataagatgaggcactttcctttttctttattttgtattaatgatgatattagttcgaagtaattctaccaaaaatattattctttattttgtattgatgatgatattagtttgaagtaattctatcaaaaataatgactagtattatatgtaagcatata

SEQ ID NO: 1514 - DNA, 1600 bp, Glycine max
  Soy_ogl_3228 Gm09:40349101..40350700 Cluster 6
ccaatcacaacttcttctaaccttaattcctttgaacattaatcatttttacctgagttatctaaataattaacacccattttattatgttaactaaagttatcaattatttttcaatctcaggataaaatgtctttcaaaagttgtttcacgcaagctcctttgcacaaacatatgtgattgattaagattaaaagttagttaataataatatagtaacttaagattatttttttaaaaaaaagtcagaaaaatgcacttgacttcaagttcttataataataaaaaaaagttttcacttgctacattatattatattagataaaatctcaatcagatccgactagtaaagaataaacacatccaattaaattcaaacacgtgagttttagtttcttaatcatatagttagatttcacttatacaaatgcatatattaacagtgtgtttggtactatatcaattattatgtgatgtgcgtaactgcgtatgcttgaagtaagaagagttgtttcgtcgaatttcaggtctcggtcgacgtggagagagtgcccgatcctcgtaaaataattgtttttaaacacgcactaagtgtgttatatttacatttctttagaactttatctaaaataaatttatgcaacatgaagagagagcgagggagaaaaacctgcttttttttttcttagaaactaaaacttatcagaaacggagggcgatggatttttatgcgaaaattgcaagtgaaataattaagcaagtaaaaaaggaaaacttttaatatacagtaatcttaaatattcatattaattagcatatagagaaaatttttgttgtttatgataattttattcaattcaaataggataacttttagttaaaaaacacgtgggctctaaaaaagagggtacaaataaaagttctttattttttctctagcttttataatttgtagaccacctctccatcactatcttgaaaggaatagttatagttaagtcgttacacaacaatccaaaaaaaaaaggagagaatgtaatgaatcttcaagtggagctccaacaacatgcatgcttaataaatttttgagactaaaatcttcttaaaaaagaataattatttaaatttctctaatatatgatcaaattttcggctgctgttggagaagcataagagaatttgagttccttatagacataccataataggcggctcagaagtcagacccaccaattagctagtatactataaataaattaaagtacaaaatttctattcttgtgcatgtattatatagctgtctctctataattaacagagagaaatacgatacaagtgatataatagaaataaaatgagacaacaaaattataaaaaaaaagtgaagaaaaaatgagtataaaataatataatgttcataaattaaactatttataactgaagattaattaagtggcactcgaacgcttcttagtgcagcaaaatcctatatctgaattatgtgagcagagctgtcgcaaaattttaggttcgggtaatcgaacatacatgtacattcatgtgaaacaggttaggtttttcagcttattacatgaattaa

SEQ ID NO: 1515 - DNA, 1300 bp, Glycine max
  Soy_ogl_1435 Gm04:46103501..46104800 Cluster 6
atttatttgttatttttctcattgatcatgatatttttgaatgttttaaaaaaatttatgaaattctttaaaatcttttaaattcataaaatctttttaaattttataaattcatattttataaatttattaaaatataaactataaaatcctaaccataaaagtattttaagaaaaaatcttaaaaattattacattcttacacaatcttttaaaatgcacatgacttttttttatggaaaaacttttaaaatgctacttaaatacaccccaataactagttcaaagataaaaaagaataaatattaaaaaggtaaaaacttatattttaaagaaaattcttagagtaatatctcaacaaatgctacaaactaattaaaaaaaacttgttacaaaatattggcttttatagttcaaaattataaaagccaattgtgtcggctgccctgggtactttgcatgttgaatttactttaaagttgaagataaaattatccttaaaattttggcactgtctcatttgtttcgaatttttatagttcaaaatattgcacttatgagaggttgtttggactaaacttcaacttcaagcttaatttatctatgatctagctacacttaatctaatcagagtttctcttcatgaaaagtatagatatttgtttaagctttccatataaactaaaatcacctcgatcgatcacattattggataacaagttatgatctagaaaaaaaaagaaaaaaatcattaaaatccaaaacttaaaccttttaaatattactcaattatcttaattaccccctccccccaaaaaaatagtttaatcatagtttttttttttcatttaacagcttcatcacatgagaatataagttaagttattttcttccggtatttcatgaaaatggaaacattaaaaaataactctaaatgtacatatatactttatatttatcactactatagtattttctttttactttgtttcactttttttattaaaaaaaaaaacactccattaatgaagatgtaacatctgcatgataattggctagtccagtagtcctcaacactcaatcaatcaatcatgcttggttccaaatccaccaaatactgcagaaccaaaccgtgttccagcacaatatcctcgtatcacagttgttgaaccgtcacttcccaactatgtgctatatcttgagcaagtcgatctatatatgtccgcttgctctgatacaatggaagaggagagttgaaattataccacaattgcacggtcctatatatgtacataaggga

SEQ ID NO: 1516 - DNA, 1500 bp, Glycine max
  Soy_ogl_4520 Gm13:37469401..37470900 Cluster 6
aatgtgtacataaggaaatgactttgggaccactgatccctcttcttttctttcaagaagtacaagtgcccaagtggactgtgacaaaagattattacatgaatatatttgtataaaaaaatttgtttgtgcatatcaaatataagtgaattatctttttgactcatggtaaaatttaaatttttatcttcttattttaaatatttatttgttttcatgcaacaataaatttctatttttaataaataatttggattaattatatttttatctataaacttctttaagttttcaattttagttttaaacaaaaaaaatgatcgatcttagtcccttcatgctttattcagggactaaaagtgaaacctaacaaaattttaagcattacattctctacggactacggctaataaaatgatacttattatattttatttcattttaaggtgaatacaatttttagtcctttttgtgacttttagcatgattgacaatttagttttaaacccataccatcagatttcgaactttaaaaaattaaataaatataataataaaagtgattgtgtgattatttaaaatatttttatctactaatatcataaaatcaatcaataataattatgattaaaactaattgttaaaaaatgattaaattaattgtaagtaatctttgaaattatagagaaaagaataaaatacttttgatgtgtattttataactttttttattaccactaggcactaatagatttatttagtgtaaaatggatcaaaatacactactaaagttctactaaactcactactgtaactaatctaagactttaggttggattagatttttgtttttttatgaaacttgagagagaaagagagacatggatatgataggtgatatggtttagtaagaaaggagaggtagagaaaaatagattgtcaagtagatgtttgatatggttgagacaacactttgtttgaataatgaaaaagtgttatttaaattactttaagaaaaaaaaaaataaacatagtttacatagactaaaataaataaaaatccacacaaatgaaaagcaaaaaaaaatatactaattaaaaagatttaaaaagcatttaaaccaaaatattttatcaagagagtgtaatttagttgattaaacatgatgcctaagttatagtaaactttcacggataaaaaaaatgatatttttgtaaaataaaaaacgaaaacaagcatagagtgcgaaaattgagcatgaggtgtgaatgtcatgtgccctctcattctttttatggaaaaatgggttaagcctttgctctgttgttgtctgggttctgcggatcaaggcatatattttggcccaattgccgtcaaaaagcaaagtgagaaactgagaatgacccaatatggttttgcggaagcccagcgatggactttcgtagtactattagaagcctatgaaacgtgtgaactggaatgtttgcttacatatgacc

SEQ ID NO: 1517 - DNA, 1529 bp, Glycine max
  Soy_ogl_4913 Gm15:8366220..83673 Cluster 6
attgcttctcatatttatagttaattactttttcaaaaagaaaaacaaaatattaccaaagtttgatgcctaaccttgttaaaaggggaacatcaacgtttttttgggatcaattttaagtaactatatatttctgtgtctctggactggtattacttataccttgtcctttttaatgtatctcttttttcgctgatttaaaaaaattacactgatagctagtacatatataattattaaactaaatatttttttttttttttataaaattgactcttttaacaactatttttttaataatggaattttgtcgtatttggttggttgttgttgcatgtcccaaacgagttaaactcaaacgtaaaggttctcgacccaacatatcatcattaatttcttgctcatcaagtaagggatttttttttttttttttatcaattaagggatatattttgacaaattgacaaaagaatatatataacccatgcatgttaagatgaaattctaatttccatttcattattttgcactaatttaatttcatgctgttaaggtgatattaaattaaaatttatctctctcaactgtaacaataacaaaactgctcacgataaaagcagatgtcaacttctacttcaatttttttttcagccgactatattaaattattctaattatgttgtattctttttggtgcgctgcacaggagtaacttttctacttttattaaaaatctgttaaatgtatgaaaaatagtcctttgacaacctttatttaatattttattttaagaattttcattttgatttgtgtaaaattatacacgaagtagctcacagcttttgtacttgacacttacaaactttaattttgagcatcttttttactacactaatttttttatcaatcaatattagttaatttttattaacagaaagttttaaacttgactttttttttctcttccaccttatttccctgcaagtcgatattaattataactctttatcactctaatctttatttcattatcaggaacgtgaagagataactctgttttatttgggcatcaaaaactaagaaatagcaaacattactgttcataaatattgcggaaaaaaaggttataggaatataaataccaactaccaacagtacagatggatgggtccaaaatttttataaaataaaaatgactttttaatattttgctacgtgtactaaattgacattatttcacactattgaaattagtttcaactaccaaattagttagactaaatcattataaaattagagacagttctaaaatgtaaaaataaaaaatgatacaaaagaactaactttttttaatctaaaattcagaacacaaagtacgaattaggattcgataatgcaaaaataagttaggggttgatttgacttaaatttccacagctactcttttatattcccttcgcccaagacgactattgtttaaaaaatttcacacacaaaaagtaagtatttcaagaaaattaacatttatt

SEQ ID NO: 1518 - DNA, 1249 bp, Glycine max
  Soy_ogl_5894 Gm18:2266224..2267472 Cluster 6
atttcaaaaaaaaaaaaaacatatcaggtcttcgtaatagaaatgatagaggtgaatttgtgttggcaagaacactttctcatactggaaatcctccggttcatgaagtagaagctttctacttgttggctgcaatttcgtggatagcttatatgggtcttcaaaatgacatctttgaaattgactgcaaacaactgtatgatggcatgcactctacatcctttcccaattttgaatttggtgttattttgaagaaaaaaaatgtaaagagaagcttttagttttcaattcctaactcttctttgagtttagtatgaagttaatcaagttgttcactgtctaataatggcatctgcatttttagttcatcttcgggattttgatcatatgtccaattgtatttatgtcatccttcttaatgaaatgatataatccttttgtaataaaaaaaattattagcctcgcttaaagaaatttagtccgtgatcaaaattaacttttgtgttaccatgaaaaaatttacaccgatttggcctttaacttttttctaaaataaaaatatttaaatataaatgactatactttaaaattaattttatgaaattaattttacaaattttcactcagcatatatcaataacaagaaaccaaacagcccttattttggaaataaaatgtacacttttaaattttatttattcaatttgtgaaaggaaaaaaaaccgaaacaatgcatacaaaaaaccatattcctcactattcatacaactattggaaatatttttaaagagttttgcatagatatatgatgtattttgttaattttaaacagtataaattctataaggacatagttttgtaatatttagtgactaaaaaaattacaaaaactaaaataacaatatatgtatatattttaaaattacagatatatttaagtatatttttagtgtaaaaatctaattaatatgcttaaacaatccaattatttaatatgtatcaaatacgtataacaattttatcagtaatgagtattcgattcaatttatttgtaaaaataatcatttaattttattagattcttatgtaagtttttgaaaatattccaaacatgcatgcatttggacgtcccaagtactttccaattgaactaataactcgatcattaatttgacaaataatagctcaattcacttggtctgatgattatgtttgcagtgattcaggtcttttggacaaaaaaaattaa

SEQ ID NO: 1519 - DNA, 1458 bp, Glycine max
  Soy_ogl_5597 Gm17:8991443..8992900 Cluster 6
gagtcttataaataagaaaaaaaggaatataagttttctcaatttaacttcttcataaacttatttttaacttatatataagctctaattttagattataaatttttatcctataaatatttatggagaagtttgttaaaatagactctaaatgtgttttccattttggtaaggacatgttactaatgtttaataatacgtactcctagccttcaaagaaataatacttacagagtaggtaaattttccgcccgttaatatcggagaagtctataatatactaccacattattaatactaatttattaatactccattatggacaatgattaattattgttcattaataatgaaaaaatatagtatattatagaaagctttttccttaatcatacgcaaaactatgctgcctttcaaaagcaacatgttatatagccccactgtaactacaattttctcgttgcataacttttctgcctcgtaattgaacgggattctcgaactttaggatcacaggttttttttttcacatcaaagatattttcatagtggacgattaatctctcaagtaaatagagtatcaaggaaaaaattcacttttcacgtatattattctctttatatagttagaaatcgaacctctaacatatatttaaaaggtttaaattattcatcacttgggttacaccttttaaatatagatacaactactctaattctaatttttatttatagatgacgagacaataattaattttttatacatcaaaacttagattaggagaaaactcttctccaaataaagttagaagaaattacctgcatcattaatcatttaagtatgtagtacatgttaataaaagggtccttcaagaactttgaccatataaaggaattttttattttcattcaattataaattataatatatactatgttaatttttataataactaaattaaaagtctacttatcataattttagttgacagtataaaaaaattatactgtataggaattaaactctaacaatttattattaagttacatattgtctatcaacaaattatcttaaaatatgtttaaaaaatattatcttaaaatctaacttgagtgacaatcaacattttatattataaatttgaaccatcacccttaaaaagagtatttttaagagatattcttaccttcattaaactacatgatttatccaaatcttatacattcaacatttaatttaatttattatttttaaatttatttatttaaattttaaaaaatgataaggtttaaattttaaaccttaatgtattgtatcaaatcgaagatagttttcttgtttagataaattaaattttaagattattgcaatattaacaatcttaattactcttatataataaattattcaacttaaaattctaaaaaaaaagttttaaaaaaatatgtcaaattaag

SEQ ID NO: 1520 - DNA, 1351 bp, Glycine max
  Soy_ogl_1037 Gm03:42153701..42155051 Cluster 6
gacagaaattaataataaatattgagtccgacatagtgtagtgaaagaaaactaaataataagagagaaattcataacgaatattgaattttcacacaccttacatgcggaaaaaactttttcaggttagtaaagtctactttattgtgtaagaacactttaatagttttattagccttagctagttagcttgtcttttgagttctaatcatcttttagattgtaaatatgaactaatataaatcaaagagaatcaaataatgagagattcataatgaatactgaatctgacaaagtgtagtagaatctgacaaagtgtagtaaaaaagaaccaattaacaatagagaaattcataatgaatactgggcctgacataatctagtgaaagagaaaactaaataacaaaagaaaaatttataataaatattgagtataacatagtatagtgaaagaaaactaaataacaagagagaaattcataataaatattaagtttgacatagtatagtgaaagaaaactaaataacaaaaaagaaattcataaccaatattaaatatgatcctatagctaaagaaaatcaaataaaaagagagaaatttataacactattgtctcaccagtctattcttgtttgaccagccacacacattacatactgaaaaaactttttccgctgttagtaaggtctactttattgtctcaagaacactttaatacttttattagacttagctagttagcttatcctttgagttctaaccaccttttgattttaaaatgttaaactaataaaaatcaaaaccaaatacttattttttccatgattttaaataaaggttgattctcgttgctagctcattaactcttcttaaaaaaatttaaaaaaactaaattatttttttatacttttgtaactatttataaaacaaataaaaaaatcatttattgcttatttacgtgtataaaaaaatcatttattgcttatttacgtgtataaaaaaatcatctattacttatttacgtatgaaagagtttacttttctttaaataagaattgtaaacttgtataaatataaaataagaattgaaaaaatacattattaaataataaaaaacagatttgtaataacacaaaatagggattttaagataaaaatttaaaaaattgtgaaaagtattactaatattttttatcttgattttctagtatataactaatgtaatttttttatcctcgaaaactaatttatttttttaataaaaaatagttattaatccttcattactttttttaaatatatttttttatcataaattattaaaatgaaaggataaaatatgtttgaagt

SEQ ID NO: 1521 - DNA, 1464 bp, Glycine max
  Soy_ogl_1841 Gm06:7934921..7936384 Cluster 6
atattaaattatagggacaaaaatatatttaatcctaaaatatattattcagaagagttcagttttgcatttaaagagcaagtgataatttataatacgtgcatgagtgacctttgatagaaaaataagaagaaaataatattatttttattttcaaattaaaaaattatatgctttcttcattttaaaataattatcgtagaaaaaaatcttctcaaatttagcattatggtagcttttaaatataatattaattattttttccactcgtacttgtaataaatatcactttaattttttaatataatattaatactaagattatttttataagattattactctatttcatttatttgttagattttttaagtgggatggaaagagtaatatttataaaataaataaatattaaaatattaaacttatgttattcttttatttaaaaactaaattataagatatttaatggaaatgatttatctttttctttttaaaattcaactctcaaacatattcttaagaaattaaaaaacgatcatctataaaaaatacttcaattattaatttaaaaaacatcattatttttaagagcaatagtaccaaaaagaaaaggcctgttatatttttctataatatagacattaattattttattattttcttaatgacataattattttcacataccatcaaactcctaagaactaattcatttaggatcctgagttcttcaataaaatcttgaaatgtttttacaaatttcattttttacgggctatgaaactaattcgaagttatatcaaataacgatcatcttcctttcctaattatgtattctatggccataatataggcatcaactgtaacaccattattagagagcgctgtttaaaattgaattaaaaggtcgttttcatcataaaggtatttgataaagattaggtatgaaaacgtttttcaaaaatatcttttaactgctgcaccgagccagtgacgtgctgatataacatatttgtaccctttttttctaattttggtttttgattatttacggttccagaatatttgaaaaaaattaatacaagttggaatgaataagttgctttcaatctcgatgacagaccaaagtccaaaaaggctcaacaaattgatgaaagcgttcaaccaagttgaaacgacccacagttcatgttataatacatatgctccgttggtccaattttaatttccatttaaagaaagcaagttattataattgaactttttaaactcaaaatttaaaagttcattgcatttgatcagagaaggtcttggtatatcggcatcaccgcgacatgcaaagtgagaagtgacgtttccattatggcacttatactttatctctttgactatattacagccatggtgcataaagacaaatctgtctagcttggatgccgcaattctataaccatccaaaag

SEQ ID NO: 1522 - DNA, 1527 bp, Glycine max
  Soy_ogl_2262 Gm07:7890574..7892100 Cluster 6
tggatgggtcgaatccgcagctaccgggggaataccttttgtcattatattcaataataacacccaaagcataaatgaaacctttggtcatgctattcttatcttcaaattcacttttaaaatctattattgtgtgagtctgtttgtgtgtttgtgttatatccatatattctctgaaaatactcaaaatcttatgtgtctgtttttggactttttgaaattaaccggtcccagtccaacttcatcctatctggctaagaaaaggtgataaagaataatgacaaatgattaaacgtgtgctaggctgtttttgggttgctgcaactatacagtgctacaattttgatcttgactttttttttttctctggtattgtgcttttaaatttaccaaactaatatttttttttaaaattatttgtatagtataagtcgaccttactttatatttatattttccgtccactaaaaaataccataaatttttttatcgtaaaaaatcactaaaacttacttttataaagccaaatttgactttcaaaaggtcgatttacactatacaattatttttttaagaaaatactattttgataatttcaaaagtagaatataccattttggtaaaaaatgttcgttgactgtttcatcatttgctatttgactggtataattaatctcttgacttctttgacaaaaataaaatggcttgtctatgattttggccttgttatatttcttggagtgcatcagtgtttctcagatagatagtagtgctatttgaatttgcataatacgcaaatcaatgaataagtatggatgacaattgaattttgcttctacttgtttcgttcaaaaaccctttagtagagacgggaaaaaagaatgaaaaattgtagaatttaatttccatctctgttgtcaagtattcatgcttgtgttgtactttttcttttttttttgagaaaacttgtgttttatattgggtgagtcagaaattggatgtcatatatattaaaaaaaataataagaaaacacacacaaatctatcagaagattgttcaagatactcacgttacgtctttagagaaatgtcttcgtacgacacttgagtataacaagtaataatgagtaaaactttgaaattataaaataatttagtagcataatacatgaagaaaatgtgtacgttaattcaaaagagactaaagataattaatatatccttaaaaaaataaaaaataaaagagcttctttttgttaggtgttattttatgttgactccattaaccaagaacaaaatataagttatttagtaaaagcaacataagatttaaaatattaaaaaatataaaaaaaatcttacatattattctaataagaatgacattgattgaagttttatttaaaactcaaaagagtattatattttaaacatgttaaaaggatatagtaattcaatttaatttatgtaacataatacattgatcaaaagactacatactaacataatgacttttttttttgacaa

SEQ ID NO: 1523 - DNA, 1278 bp, Glycine max
  Soy_ogl_2273 Gm07:8050023..8051300 Cluster 6
atcaaagttcaattctatgttttactccattgtttagttaaaattttataataaattttttatttattagatataaaaatatatgattttacatattaaaatttaactgtacaatgtatgtaatatataatatattattaactagtgcctgttttatagattgtgttgcaaatttgttttttcttttcaattttttattattgaaattttggtgaaagaaagcataatagtatgaaaattttaaaagaataaatggtcaaattaatttaaaagtagtcgtgtcattaaatttgtaagatcatattattattaagttgtcatattgaatgatcaatttgatgataaattttattttttaggattaattgaacattaagttataaaatttggagactaatttattattaaactatttgatgaattaatttattgtatttttttatgtatttaaatgttaaatttgttttttatcttttattaataactaatatatcagtatttgacacttttttatgaacaaatttcattatctattccaaattaaagcagaaatacaaaggaaattgaaaattgtggccaggactacgaggatcactttcgtcaaaggtcgtgccacattagaagaagattgattcagtggtcaccgtaggaagaaaggaaattgagcatcatagccatggaataattgaatttcatttcttgagctggggttgatttttttacctgaaggcgtagacacgtagtcttagattttatccaaactttggattaagttttattagaatacaaactactaactagtttcctcagattttaaagcatctccaatggaaagtgttttcataattttttaggttaaggaatgattttttgtgagttattctatattgaagcatactaatatgataaatgtattttttttattgctaagaatagttttttttatgaaaaactctaattttgaattttttgtattggaataaaattttatataaattttttataaatgatatgatattgtgagaattaaaaaaaatgattaaaaaattcatataaatttcttacatcggagatgctcaggacaatatatttgcatcctagtcaccatactttccggtgtattccatcttatattgtagttcttcttgatatagaaatgtaatgactaatgagtatattccagaaaaaaaattgaatttcatttctggttgcaaataggtggtcacgtgactcacgtacactatcggaaatggtggtggctgctactgcacaaatgga

SEQ ID NO: 1524 - DNA, 1598 bp, Glycine max
  Soy_ogl_2460 Gm08:2026052..2027649 Cluster 6
caccttttaactggaatttgataataaaaacaataattacatataaaaaatattcacctttgaactataatttaataataactagatagtatccgtggaatatatgatgagtttattgagaagtgagtgaatatgtatataaaaaatatgtctgtaatgctattaatttgttatattacttttcttttactgtaatgtaaactgttatattacttaaaaatataaaactaaatcaaatttttgcaataagaaacttcttcattaatattattagttgatttgtttaaaaaaattatatgattttttttaactttaaattgaatccttaaacggatacaagaacttgtttattttatgctgaaaaaacaaacgatgaagaatatattttttacaaaaaaaatataataaaaactatataataaaaactatataatatgcacgatgcccacataattcatcgttaaaaacttaccatctattgaacacttcttctcactctcaattataacacctaacccgcatccataaaaatattttactagagacaacaaaaatcaaaagaaaaaataaaaaacaaaagtgtaaaataaaatattttacaagcaaagaagacacaaacaaattacttttccttccaaggtaggcaataatatctacacctataaccaaagaccaaacgatatgtataagaaaagagagagaagaaaaacaaattaaaggagaaaatataaaaacaaagattgcaactccatcaaactactatcatgactgatcatcagcatggcttgaaattacaaaaattaaacaaaaacaataaaaaataacaatcaatcaattagtcaaaaaaaaaaatatcagacgagaaaaaataagttgcagtactactttcagtttcacaatttataaataatagagaagtaataaaaaaattaaagaaatcaaaatcataataaaaagcaacaaaaatatttatttaattcaatcaaagtttatcgatataaaataaaatttccaaaaataatttatatagaaataatattttttaaattatcaattcaaattaaaataataataataataaataaaatatattattggttcatattgatgtgaaatttaaataaataatataatgatttttttattaatatgtaatcaattaattattacttcattcaccaaaaaaaattattactttttgaatcaattagtaattaaagtaatatgaattaaaaatatttatttttttatcgtaattttgaattttaaaaaaattgagtcatcattttactagattacaatactactttcaattttataatttacagaaaatagagaagatgtattttattaaaaaaaaactgaatcataaaaaaaacaaaatatttatcttattcaactacagtttattaaaatttatttatgaaaataaattatttttacatttattttggtctataaatttttaattaaaatattacctaaataaaatccgtttttatcatgactgattgtccaaaataaattatttatgaaaattaaataaaatgaagtgttttaaaaaataatctaaatactcataacgagaattcggtaaa

SEQ ID NO: 1525 - DNA, 1781 bp, Glycine max
  Soy_ogl_3300 Gm10:1266720..1268500 Cluster 6
cacaaaaattactcaaaattacttcaattttaaattcatgatcaattttgaaatctcttataatataaaatcaaatatataaaaattgatctaaaatcaattttatatctaaaatcaattctcgaacgtgaaatcaaatacacacaaaatgtgtaattttagctgttagtgaacaaaaattaattattattatatttttaacatgtttacaatttattacgtgtgtatacctaaaattgactagtaaagctttcattagtataattgatatttcttattcttttctttgcataaagtgaattatttattttagagttgtaagttttgaaggtattgtttgttttaaagtaaataatcacacttttcaagaatatcgcaataaaaatatttatataacaattttatcctttcctatatccgtgttgaaaacattcaagcaacgaaaatatgaacaaactactaaaataataaaaaatatataatgaattttctaaaacgagtgttctgagaactagagtgaaaaatgattttatatatgttaaaatttatatttcaggaattttaaaatttgaaaagaatgttaacaatctagattaattataagaataaattaatgtcaaaagtaatttctaaatcgattatatatacaacaaatctaaaaaattttgtgaaaaatttccaaaagtttcaaaagacatccacattgtacaacggttataagataacatatacagaatgttcatcccgatattacatacaatgccaccaagttcttaaaaagttcattgatttgctaattttaggttaaattatccttgtttaattttagtcattatagtttaaaacatcctatttaagttctgatagatgtgatttttactcttttaatcctcattcttatgttttgactaatgtcgattgaataaaaacaatgttagtagaaacttgacaacattcaataacctttgaatttattttttcattttttttcttaatttgttcatgctttttcaaactgtattatttgaaatttgatagtgagaattaaaagagtaaaatatatgaaactctagagacaaagaatgttttaaactatataatatttttaaaggtttttcttaaaaaaaatattaagaccataagaactaaaaccttaattttagaagcagaatatagtaattgaattccacggctgctggaaatagatagtggtgcggtggtgccaactggatgagcattatgaagtcgtgtacaagggaaaaagtggtcagtttttcttaatcagttctgcacacacaagctgtctaatctgcactcaatacaagaaaacaaaggattagatagggaacgtcaattcaacttttacccttgtattccgtacgatcaattttgtttaaatgtttaagaatcaataagatttctagggatatgttcgtttgtgtgaaaagataataaaaataaagagtaaaatgaaataatatttatgtttttatattttttattttaatttaaaattttgatctcaatttattttctgcctatcgaacaaaccctaagtttttgtagtatattttaagtattatacagctaataatgcttgtaaaaatttatacagtactgcttatatatggacaatttgaagagggtcgttgttgggaatcaatgaaaaggcttcaacatttcaacctccgaagcctaataattaattgtcttttgtttgaggcgtgctttctttctgattcacgcaaaagcttgagcatttgttcttctgtgtaagagat

SEQ ID NO: 1526 - DNA, 1700 bp, Glycine max
  Soy_ogl_4702 Gm14:5956301..5958000 Cluster 6
ggtttgtaatcacgttatatgtttattgatatcacaataaattgtaaaataataatttcaattacaatcgcatcgtagacattttaaaaatgttaatattgtggtccaaaccaccgtcgctcatctcttttaaaaagcttgatgctgataattgttactgttgtaaaaaaaaaaaaagaatgaacgacaaaaagtagctagttatactgtgcatatagtgttattttactagagtctggtttcacactgactaatgtttactcttgcgtcaaccttcaaccatcaaacagatcctcttcgaagacccattttgatgaattaaagctatttacatctatttagtatgataaatgagtttatcatgtgaataattacgtacatgaatataagttggaataaaatggaattgatgaatcacctaaagaaagttacaaccactggtttatataacatcatcgcttcttagcttttagaataaacatcgatacatgcacatgcaacaccacaaaaaaataatgtcaatcactgcattacatatgaatatgaacatgtaccaaaaccaaaatcctcgaataattaatcaagttgactttgtattctattgctttcgtgattcttgtctttgggaaatgagcattctagaaggccattttcccctgttgcaactttgctgcttctggtttgcgtttcctttaaaaagaaaaaaaggagaaaatatcacgttttcctcttccttttcgtttattttacatacacgatacttgtttacaaatgcgattgttttcatgaagtatggaaacacacgagagtttccatgatgttgaaacgttaaacacgtgctcatttgaaacttgaatcagtttctactctattcatgggccaccttgacacatgtgatcgacaacaataaaaaaaataaatcattaactacattcttaattaaattattacaacctcttttttaaatgatccctgaagtaaaaaataaaataaaataaaaaccattcaaattcttcagaaatattagttcttcaaatattacaaaaaaaactctgtaaattagtccttgagctttactaaaatacattaattttaaagattaaaggcatggatatttaatatttcaagaattaaagatttttattgttttagagactataagaggagagaatgatacttcaaatatgaaattaatagtttatttgcaattaatgtactttggaaagacctcatactacttttgggcgtgggaacaaataaaattttaagaagatctaatattttagtttgttattgtttaggataatgttgtttaatataattaaaatttataataaataaatacattttagtatgtaaattgtaacatcctaaatttttttcttataattattgttattagtttcaatataaaaattaatagtataaaagtttatttgaattaaaatgatatatatagagagagagagtttgtattgtaatatattaaatttcattgaaataaaaaagtatgattaattgttttaaatactttatttaaaattgattgagttaaataattattttattattaaaaagataggtgattagtataagaattactgaaattatttaataattataagataaagtgtaacaatttcatatgataattaaaaggattaaaagattattattgtgaagataattattagagtaat

SEQ ID NO: 1527 - DNA, 1000 bp, Glycine max
  Soy_ogl_335 Gm02:2905101..2906100 Cluster 6
tttttttacggagaagcctaatgagttaaatgatatagatttgtgattcgatattttccgtgcataaccattaaacttattatagaagttatatttaacccaaatatttaattttgtgtttgtataaattgtaaattattttaatttatttggaatacatagatatagaatgctagagatatttttttttacgtaattcaaatacgtgctagtttgatttttatttttttgcattatcatctaaatataaattttgatataattcaaaattattttcttttatattaattactttaaaatatataatattttaattaaatagttgataatgtaaaaatatttacattaaaaatgcatcaaaattaaactctaccttttcttacatattctttataattagataacattcatgtaaaattatatcaaatgaaaagagttttaattttttatttaataaattttaatctacttgttatttactgattatattcaactttctagttaataaattttagatagattgaacatgataattctaatatttttacgtagatttcaagtcatattaatctataaatcattatttgattaattcaaaatgactaaatttaattcaaggataaaataagttaaaattcaaaataaattacttgaatcccttaaaaataatagaaacattaataataaaaaatattgtcacattcttttaagcattaaatattcaaggtgtgttgtttcaccataccgataagatagctaaaaacttttaagttaaaaggtagaagttgaagcttataaactagctatgattaattaaaaatgcttaatgaataagatagctgataaatatagtatatcgtattgtctccatctcaattctggtagataaatggagtatattgttagtagcattttaatgggactttcgctggtgtatcaggtaataattttgaaacagtaagaattaaacatcgttagtaagaattgaatatcattttta

SEQ ID NO: 1528 - DNA, 1589 bp, Glycine max
  Soy_ogl_343 Gm02:3211201..3212789 Cluster 6
ctctatcatccatagtttgcaaacaaattaattaaatcaattgattttgattgggtctaaagaaatccaaagcctgtctagtagcatttattttctcctaataatctgctccatatcttttccatgcattatccactcattctaaatacctcaggccttcttcatatctagtaagaaaaagagaaacaaattacagaaatgtaagtacgatggattatgatgtaatagttaagagtgtaaatgagttctcataaatcattagagatgtggtggtagatatgcagaagctacaattaattttaaatagaattaattttcattaaaattgattttgaaggtgataatatgattatatgtttgaatgtttttattataaaatcaaattaaaaataaaattttgaatctaataacacagaaactagtcaaattattttaatcaaaattgattttaaattattctccaccttaaaattaaacaaataaaaatatattaaaaattaattttaaattcaaaatcaacttgtgaagtgaaaccaaacgtactgaaattacctttgaacgcggataaaataatttgaggcacgtaaccaatcgtgcacaagtggtttgtggacatgtttggcttgggaagtttcctagaagaattaagggcccgcatgaaattgatctttttcctaaaaagtttgcacgtaaaaagcttgttattttggagtgattacttgagaaagaagaacatgaagattggaattggaatcttcttcttcctttcccaagaaggaagacagaaaaatcaaatgtgatgtcatatccgcgtaacgtatctcactgctcttcttgcaacttccaggattctagtgccatatacaaatcaatttatcgcaaaaaacaaactatatgtgcacttgtggaaaaatatttttatttatttgtcctgctaacattatttattatttttaattttattttttaaattgttatacattttacatatttgtgataaaccagaggagaataatagtagaggttgttttaaaaggttaaaagaattttttttatgctaattatattacttaatttatgtattgtttttttaaagtatacaaaataaaacaaattaaataagtactctaatataacttattttattcacttttttttgtttaaaatttgtcacacgtttttttctaacaactattttcttaacaacttaataaaatcgtcaacaaagaatcacttacttaacttgtaattcatgtaatataaaaaaataacaaatacttccttcctccattcttttttacatgtcttttaaagttattaggtagaaatcaagaaatgaaataaattttcttattttatcctttttttctttcatttcacaataaatacatgaataaattaattaaaaattatgagacaagtgaggatataattaataaaataataattaatatgatcttaaattttacaagctataaaaaattctctaaaaatctgacaattttttacacttttttcaactgtcatattataagttaattttctatctttctgctatttcctatctttctctataagaaatgaaccgt

SEQ ID NO: 1529 - DNA, 1357 bp, Glycine max
  Soy_ogl_721 Gm02:47708084..47709440 Cluster 6
gcattttagtataattttaattaatagttataaaactttaattttacacataaatgatataaaaaagaaatgaaagataaaacattaaatgtaatagttatatcaccaatgattgaatgtaaaataagataattatctaaattttattgattattgaatatgagattgtttaactttctttttacttggatcaattatacaaatcccttattaatttatatgaaatttcagttgatcacatttatgataattaatgaacatactcataaagatatgaagtacacaggactgaaatcgaatgaattataactttgttttgactaaactctgaaattggaaagtaaaaataataataacttattttgaaagtcaagtaacaacatgtcatcttctttgaaaattttcaaacagtcaaaataataaatggatttattaatagttttaaataaaattttacataataaataaaaacaaaatatttttttaatggtcaataatatgaagtgaaaaaaaagaaccaaattattcttataagtaaattgcatacatttctttcttcttagaaatgtgagtattagactatgctcttgtgttatattaaaataattttttctttcttgacaaataaaaatacactacaccttacttttttaaattttttttgtcaaagtttcattaacttccattaaaaataaacattatcaccaaaatatcttttccatttttctttattgaaagacataaccatttcactgttttcttctcttatgttaaataagcactcctttggagacaaatttaagataaaaatacaatatagtatattttcctctatttttttaaaaataatttgacaattaagatattttttacaaccgaactttttttttattaagagacaaattttttacatgatttttaaaaaaatttgtccaagttttgttaacttccattttaaaaaatatattaccaatgtatcttttacactttcctctctttctttcttttttgtttaggattacgctttccttccttaaaacatgggaacagttcacttttctttctctcataaaaaaagcattcattttactttaaggcagcaaatctaagataaaagatactgtattttactatattttctattgtttcaaatatagttttaagaccaaattatattttacaagtcaaagaatttttattatgaggcaacttttttgcttttcttttgaaattattatttataaagatttaacttcaaagcttatactaaaaagttcttttaattagtaaactaaactattaattaaaagatacactatttgatttcaaaatatatagatacataatgcattagtct

SEQ ID NO: 1530 - DNA, 1230 bp, Glycine max
  Soy_ogl_1187 Gm04:2398801..2400030 Cluster 6
aatattgatttttttcgaataagtgaattcatttgagatcctacggatctactttatttcctattcaaagatcaaccttttatctttgtattttcatatcaacaattctttacaaatgaagagatgtcaagaaaacttcttacttcccaaacagatgttcctcacaatccataactaaccagtcacggaatgaggagaagcatttttacatgaaacctatgaacaattgactcatcatattaattcaagaccataaaagcatcactttcccacacaccactcgctaccatatactaattatatgtaaacaagtgacatatcagattcacaaaaaaaaaaaggcggcatacagaacttttttgggtaggtttttatcttgtcaagaccttgatttatagttgggtaatttgctcatttctcgcgtgctcatggtataaaaggagtcacaaagtaggactgttttttatcttttatttgtagagaagcagcaggactgtttattactgccacaaaagaagtattcaagaacagctaggagattttattatttgtcaccgacaattctttttcttttcattctcaacatatttattgattctatataaatttttacattaattatgaatttaatttttattttattttattagataagttttatttggttcatattttagttcgacaataatatgacattattgtattctttataatgattattatgaaataattataccaaaacatttaataattttttttcctttattaaaatttaggccttgcatataaaactcctagaagattttatcattgataaaaaatatattcctctgtgaatatttgattgaaatttaataatagaaaacatttatttatctattttaacaaagtttcatttctttatcacatttattcatgaaaaatatttaatgaattataataaaataattataaaaaattatttaataacattttttacattactaaattttacatcttgaaaataaaaattatgcaaaactttatcattaatggaaatatatcactctattgatatttgattgaaatctaatcacaaaaaatatttatttatattttaataaattttcatttcttatgacatttattcacaaaaatatttaatgaacaagttattttttaaattaattaaatttaaaataaaatcaaccatacaaaaataaaaactaaatttatgtaggtaaatgactt

SEQ ID NO: 1531 - DNA, 1104 bp, Glycine max
  Soy_ogl_1400 Gm04:44674740..44675843 Cluster 6
tctcaaactctatactaatcttgttattttgaaacttgtcaaattgtttataaaaaaatttacgtaaaaatgtttgacgttgaaaaacagaattttggcaatagaaaaaaagtctgactagaattggtgaatagaaaatgagtttaaaaagaaaaataaacattctgacaaaaaggtagattacaaaaattaactaacagaaattatataaattgatacgaatcgaagaaaataaaaataaagtgaaagaattagcgtttgtaagacatgacttgattaatctatagcgggctaaatataacttttacatttatcaagatgtttgaatgtgtgttagaaacatgattctaaattgtggactccagtctggttaaagcaattggaagtaacttttgtatcatcattaacctgagtcatataatttaattcaagtgtatctcttgttaatattgatgttgtcctcatgaatagcaagacaaaatatattttggtaattatacatccaaaatcaattttgattgcaatttttcaaataacattacgtgacaaaattatttttttaacatttgttatccaaacaaaaattatgttgattctaaatcaattttataaacccaaatccaaataggcatgggtacttcattttggatgttctattcttgatccttgccacaacttgtggtttgtaaccttttttaatgaaagttctctttgcctttccgaaaaaaaaatgtttaaggaaagtaaaatgcaacaaacataaagagtgctaaaaataatgttgcaagaaaaataatatttctgaaatttaaatgataaaagacttattgttacgaaatactagttcacattagatgttcacatatggatcatgcataatatagtattagaatttttttagtttttcagttcttcataaaactcacttttcatataattttcaccttatttaagttaatataaaaaatacaaagtagatcctaaaataaataaaaaagataagatttttttaaaagaaatacgtgttattaattaaataagagaattattttaaaacttgtaaaaattagtggacaaattttaaaaaaagtttagaaaccgttc

SEQ ID NO: 1532 - DNA, 1200 bp, Glycine max
  Soy_ogl_1401 Gm04:44736701..44737900 Cluster 6
ttgttcatatttaattatgtcacaaaaaggccgtggtctccaggagaaattagaaaaatacttagcaagaccaataaagacagatttataaattttgggtttgaaaaaaatgtaataattctcttcaaattggatttttattatttaaaagtggtttattccttgctgataagtataaaaaaattatagttataacttctaataattgagctatatataaaccttgaaaatcataacttcagttttgatataattatcaagctcacattaaaaaaagataattatcaagttagttgtaaataattcaatgtctatataataattaattaatcatatatggatgacgataacgtaagttctacatgaccaaatacagcaactcaacatttaacacaatatgataagtataagagaaattgcaattatatattttctttatacacaaaatgtataataaagatagataaaaagagaaaagaaggaaagtgtgcaataagatgatttctgtaatgaaaaaaaatggtattttagtattttttttataaacaattattatacaaaaatataactctaactacatataagtaatcatgaccagaagaaaatagattgtaaattgactgtgctcggatgaatttaatatataagaaaaaaagttatcgaatataagcaccatgttaaaattttttaaaaaaaaaataaaaacctagaaatatataacaaaaataagagatatcataatatagaatatattatgactttcaacaaatacacgcacaaaaaaaacatgagtgagagacatagaaaaaaaaaaaagagagaagtttaggataagataaataacgtgaaagagagattgagagaaaaaaaaatcttataaaaatgttgtaagaataatacagtatattttgttagataaatattggaattactatttatttaattattggtgctaagttttacattaagcagagattataattattgtagtgtcaagacaggtcgcaagattcctaaaaaaattaaaggaaattacatattgacttccactttagttttagtctcatttttttacataaatttgtaaagaattaattactttctagtattttgttgcaaattaaaattgaggacaatagcaagtagtatatgatggagggcaacatttggattatttgaaacggattatataagttcaat

SEQ ID NO: 1533 - DNA, 1146 bp, Glycine max
  Soy_ogl_1526 Gm05:13996..1750141 Cluster 6
ctttttttagatgaagtgagaaaaaaaaaactaattccatcctatctcaaattgaaagacaagaaaaaggaaaatataaaataaaataaaatatatcttatcaaatcttattttaaataatccaaataaactaaatgccattctgttcgactttcttctctcaattcaagtatattctcatgcaacttatgtgaggcaaacatgaaacatctttctctaacatagccttattaacttgtacaaaaataaaataaaaaagccttatgaacaacagatttctttgcgtttgatataaaatttgacaattgaaatgtctggataaaattttgcaaaagtacttttaaaagagaaaaaaatgaaatgaattttttcataagttaaagttatgtataatttaatttatagaagttatctcatactaacttctctaaaagacaatttattatagaaaaagtttaattcatttttttttattttagaaatattttcagagaattttattcaaaataacaaatcacttcgttagaaatattttctctcctttagtattttcacattaatgaaaatcttatatttgttaaccaaatccgagaaacggaccccatcatggctgataattacatacattatccatttttataatatatattttaaaataaattatgtcactcatttaaattattctattgaatttttccttagaaagtgtattttatgatattataaaaacaaaaaataattcatcaatttttttctaatttaaagaaaacttttctctttttaattttagataataagggaagatagaatccaatttatttattttttttaagaaatcaaacagaaccaagaaaaattgaccggaaataaaaagttacttgctatttatagtctctgtctccttttacattctaattatccattatatcctctttttttcttaaaggagtacacccctaaatactcattttcctttcttgaaatgtttttcaaagtatcatatatggaaatatatttctagaactatatatcatagctccaaaaatataattctagaatagatatatgttattttagaaagacatgttcgataataataaacttaaaatcattgatgttataaattcttatcttacattctcatgt

SEQ ID NO: 1534 - DNA, 1528 bp, Glycine max
  Soy_ogl_3579 Gm10:46485673..46487200 Cluster 6
aaaatcaatatatgatcttaatttcaaaaatttatataattttttctataaaatttgaatatttgaatatataaattaattttaatttattttaccaatttatcttataaatacttatagaaagatttatttaaaaggacttattacaaattctttcatcttttttccccttatgctaaaggattgcacgccatcggccacgacccacgaataaaaaggtagaatggaagaatgatggcaaggagtttaataagcaatgacaaataagggaccgcgtctttttatcccctctatatatatatttagggttttgataattatgtttgtgttgtcacgtttttcatatatatattttttatcttatttttcacgaatcatggcaatgataaaaaacaacaacaacaactgttgtacatgattatcaaagagcaagcatacatatatataacatcattattcatttccattgattttagttttttatttcattttattaactgatacgattttacgtttaagtgtaaatgatgcatatagaattgtttcatgtgatcatttgtattacacaacagctttcataacaattatcaacaatagtttttttatttgatgattaatttattaatattcacacaaaaaaattgacattactagactaattattttactgtatattaatataaatccaacaaattctcaattacatagtaattctatctctaagtatgagcaactttatatttattaaaattaaaagaatcaattaaacaacagtttaaaaataaatactttaaaaaaacatttttttaattactcaaaataagcaaaaaataatttttaaacataaaaaatttaaacaaacacactaaaaaataaaaaatgacttattttactaaaaaaatcaagaaataaatttaaacaaactcattcaagtatttctatctgaaaagttgcgataatttgtacatgttaattatacaaaagacatattcatcttcctcctcttttttaagttattaagcaaatgatcttcattcatataatcatgatttaaaatatcaagattcttaaaccatacccctttaaatgtgaatatatatttttattttttttgtgtagttagcatgaatccaaatccaattacctaattaagtaaagtcatgttttgtgtggtttagttacaaaggactaaaagagacgaaatgttaaatgttatcggttgtacatttgcataaaaacattttatacatctttatatattattagtaacttcatatttcaattataataacactgtatcttataaattatatttagattgatatatatggattaagaagctaccaaaattacatagaatgtattttacccattctattaaatatccctttttaatttgagaaagtggtttttttttatcataagaatatttatacgataaaataacattaaatatcaaaatataactggaatttgttataggtgttaatcatagactatagttttcataacagaaggaagtggggaa

SEQ ID NO: 1535 - DNA, 1056 bp, Glycine max
  Soy_ogl_4939 Gm15:9211684..9212739 Cluster 6
aaaaacttgtggagcatgacctagtttctatccaaggattataagaaacttatatgtgcaaataatgaacatctctctcctcaacaatatttattacatgtaataatgagagaaaaaatagacacaaaaattaataggcttaattactgtttttattccttaatttagaatatatgtttttttagtccctcaaattttgaaatatttttttagtctctaaattttgaaaaatacattttttagtccctaacatattaaattgacattttgtgagggtttttaattgtcttaaattaatttttatattttcaatcactcaaatttgttaaaaattatcataaagtgataatttattatgtcaaggaataaaaaaaataatttttcaaaattcagaaattaaaaaaaaattaaattataggaactaaaaaaaatacacctccaaattcaagaaataaaatagttattaagccaaattaatattatataagattgttgtataaattattataaatgtatgacattccattcaaattaattaatacgatattgaaagtatcattattcaggtaatttttaaattaattatatgaaaatgttatgcaaataacacctctcattaattagatcaaccttgattgaaaaaatattaaacgttgtattatagtttatcttttttttttttcacttcgcaaaatatacaagcatctcaataatgtttaccatcgaggattaggactaaaaggcagttgaggccattttccttcctttctctttgttttttccatgctttcacagtagttattgatggataaggataaaaacatccctttctacaactaccattatgcatagaggcttctattatgttctcaaaaaaaaataaatagaggcttctattatgtattatctttatcgtaaatcaattatgttcgaataatcagatttaatatgatatgtaaatgtttttcttacttatgagagtctgtttataaattataataatactaataagtcgctataacattcaacagatgtacacctgaacagacatatatc

SEQ ID NO: 1536 - DNA, 1600 bp, Glycine max
  Soy_ogl_5803 Gm17:39755901..39757500 Cluster 6
cttcttagggtgtgtttgaaaacccgtttgtatcaactcaaatagaaatttttattttcaaaagacaaaaatgagaaataagaattataacttctccgttgattgatcgtttgagacatctcaactgttggtgtagttttaaaaattcaataaataaaaagaaaaaatatttaaagtatatttaaaattttaaaatattcatcaaatatcttgcccgaatatgtatttgatacaggcactgtgaaatatttgaattttgtcaatgttttgattattgaatttcgtattgttcctgttcgtgagaataaatagaagatgctctatacaaaaaaaataaaaatagtaaaagaagctaatgcttaatttataaactcaattaattgtttacccaacagaagcgacgcacggacagtgaaaaacaacaaactaggaagtttctcttacactcacaattttcttcattttttagagactaatttataacatggaactacgattttaatttcctaggtgagtgaattgcatgtcacgtaagccatacatgcaatctgttcgtgagaaatagaacttttttttagaactttgaacacgagaaacattaattttgaatatttccttctggtgtttggttacgtaaactacgttgccggttggaattttgaggatgatatatccatatatgcatcattatggatagttgaattttctttttttgaaaaaaatggataggtgaattgaatcttaagaattttgataggactttattaggatgatatacggtaggtttgttttggttcaacagtcaacgctcgttttggatcactgcgtagactttttacagttttattacgtattttcgttgcgtggttttaactccaaaattttatcctttgattccatttgtatctcttttttttcttcatagaaaggagcaaattccatctcatttgttctatgtcaaagaaaacgccattttcagttataattgttttgttacaagactaatgctatgtttgattcacgaaccaaatataaagaaaagaaagttaaaaaaaaagataaaatcaaatgattatttaatgtaaaaattgtgactcctcttaagttacgtacatgtcttaattgtatttaataattaaaaaataattatacatgacaacttaaagttcttgttgacagaaagtttttatttgaaattatatgaccacccattttacgctttctaataaaaatatttgtgcgtttatttctttaaccaacattagttaacatttacctaacttaaaataatagtatctcacacacacacatattaatgattagagtttgatgaaaactacaaaataaaataaaatgagatttattacaatttttaatttttaataaattttattagaaaacataaaagaaaataagacagaataatgtttttggtctcacaatgtagaaatatcctccaggagtattacgctttctttttggtctcacaatgaatagtatttttttgtttttgacaattgattttttctctgggtcaataaatgaatattgggcttcagttatgattaggcccacgtggtaaatctggcttatgctaaat

SEQ ID NO: 1537 - DNA, 1254 bp, Glycine max
  Soy_ogl_6565 Gm19:44629422..44630675 Cluster 6
aaatttaatcctttgatttttaaaagtatttgactttagctcctctttcaactttacagccataaaaaattgtcactaaatattaagtttacatattttaaaaagttataggactaaatttattaatttaaaatacagagaccaaaaaataattttaaatattttattttcattaacaaatgttcaactttttgatattttaaactattaaacgtgttttgtttttgtttaatctttaagcaatattaaaaaataataatgtttataataaaaaaaaatataacattaataaaagataaattactcacatttaaataagagaaaaacctaataaaggagaaaaagaaatttcatttaattaactcgatctgaaattcccaaaatgacatagtatttgccaacattgaatcccatgaaattatcctcactgtattctggtatgataggtgccattgtattcaccggtaatacttggaaggtatcattaaaaggccaatttattggagaagtatggtagacattattaaaaggcttcatttttttcttattttagttgtataataataaattttattttgctcataaaataatatttttattattactgcaaaaaaagaaaggcattgcgtaaaaaaaaaaaagcttaaaagaaagagaaaggagattaaatcgaaaatgagagagcttgtgaccgggagaaagggggatcagtcaccacatacaattaaagagtaataatgttttaaaaatgaaaatcaaaggagcctattatcattatatattatcatagatactatttatattttttgaaaaataatgaaaacatgtattccaacaacattatattttttcgtaaaaaaaattatcaaaaaagtcaaggaagaaaaaaggaacttttgaagtagcattataatatcccttcatattttttcaattgcaagatggcactaaagcttaactgttcatatttttaaaaatttcatcttacttcaacacaaaattcaaacttaattaatacctcttttaagagtctaaatttaactatttaagttgtcttgtgtgaggtaagagataagagtttttttaatattaaatttaattatttaattaaattatatgtttcggaaaaatggttaaatgctatcgaacaaaaacaattaaaaatcaattttacatataagatataagagaactattgacaacattaaactataaaacaaatacaatataaaaaatattattctattaatataa

SEQ ID NO: 1538 - DNA, 1100 bp, Glycine max
  Soy_ogl_1450 Gm04:46937701..46938800 Cluster 6
tttcaaaaattaaaatattgtagacagaataattaatgagttaatacaccaaataactgatttattgtgcagtaaaaaatactaattttttcagaaagactaattatccaattatatcatatcattgtcaacaaacaccaccaagtatattgatgaactaaccttggattattttaatttaaccagatcgtatttaaatcctaactatacatgtccatatatgttaaatattttaaaaaaagttttatcattcataataattatatttaactcaaatgagattattttcaattcaatcaaacatacacttattctagattttaaaaaaaaatcattgtgatcaaatgaatcctaaaattttaaagaaaaaagaaaaaggatgttacctcgtcatttaacgaccttaatagcattagattggaaataatcataatagtattttaaaaataataaattattgtaaaagaaatcaaactactgtctaatgaagcattgttacgacatttaatgaccttaataacttacgcggtatctacgcgtgtttggcaggataattaagtaattcacaagttaattaactaatgtatctaacttaaaataagttattactagtgtttgattaaagtattttataaataggttatgtttttttaactattattttttttagtaagttaattaaagtagcatatgatttatatgtcaagaatttcacatttttttactaattccgtctccatttttttaaaagaatgaaaatatgtcaaattttcctaactaatatacttgtttttaataaattatagaacaaattatattcacacttcctgaatttttttgaattacacacgttatcactttttttttaattcatacactaacctccgttaatgtttaaagacatcccttaatatatatatatagagatagaggtaagacatccccttatatattatgttaacacttcataatgtttaaaataaagagagatattttgtataattgctaaaaacctcaatttgtgttaatgcaatttgctctagatttacacgcgcatacttaattattccacatttctttatgctttttttctgactaaa

SEQ ID NO: 1539 - DNA, 1200 bp, Glycine max
  Soy_ogl_3585 Gm10:46613101..46614300 Cluster 6
agaattaaaaatataaaactaaatttaaaattattttgcaatatttttttttatcaatgtcaatataatattattttatgcaaaatattatctattaaattaaagaagtcttattattgacatgcataattttttaaagaatatactttaatcaagttgagttaggatggtttataacatgcatgcttggtttcatattttaaatgtgatttttttacattttagatgtgattttaagaagttaatgtttataattgttatttctcaaatgtagtttcttcatttttatgagttttcaaatacactattgaattattaaagacaagacaaatcatgagcgctcataatgttgcttaccaacaaattactcctatgttgtaatattaatttctttaaaaaatggtatattaataaatttaataatttgagttttttttgtatgtactaaaaaagaggcaaacaaaataataatataagaagatgattttttaaaaatttaattataatatattaacagtgtaattttgtatatgtttaatcataaattattatatatgataataaaatttattatgactacttaaaaaataatagttaaaataatttataattagttagcgtaataatagaggaaaatttaattcttgaattgtttatatggattaaaaaaaaaactttctgtattataaaagactacagaagtgaggaggcatgctatcaacaattgaaatgtgtatgtatagtctgttatttcctattttttaaaacagaaaagcaataaaaacttgtttgataatagttgatttaaaaaactgttttcaaaactaaatatctcttagtttttaaaaccagaaaatcaaaatatctcttaaggtgtttttgtttgtatctttagttttctattactcacgtgttctcttatacttaacttctattctttgaaaatcagttttcgaaaattatctatagaatagattttaaaacaaaaaaacaaaactcaatcaaagtatcaaacacacctttagtttctttatattgttttcttcttctacactttctgtgcaccctttagtgttccataagaaattattttttggtatcatgtaacatttctcaggtacacacaaactcattctattttaattgtttcattcttttcttctttgcatatgatttagatgaagattgcaagattgtttc

SEQ ID NO: 1540 - DNA, 1233 bp, Glycine max
  Soy_ogl_4634 Gm14:3971377..3972609 Cluster 6
tatagaaaagaatgaggaatgatttgaattttcaatgatttacagtggactttttctatcgataatactgatagagagaagtcattgataatttgcagggtaaaattaggattttatttaagagtttaattttcatatatagtattatatataactttaaaagccatctatttttttttttgcattgctaatcaattaaaaataatcttaaatataatttttaaagtaattattataaaaattagttaataaatttatcatacataataattatcaattaaattatcatatacaaaaaatctttatgatatcactatatcctaattaaattttatcttaaatattcacacacaaaaaaaatgctatcctaaataatgtttgtaagtaatgattccgattaattaagctgaaaacattgttctccaaagtgggatcagggatccaaatcaagcatcctcaatttgtaaaccagtacgtatcgtatgaataattgtcgggtagatgcactagtttactagctaagatatagttcaaatctcacattatatttttacttgaatggccaaacagtacggaccctaccttactactagaaggtgctatctatgtttaccgttgtcataattctaaaccatagctttgttttagccttttagaagacaaaaatagggacacttcggggattgctgttgtccttttgagccattagaatactttgcttttttttttttttcctctctttcaatttatatgattgaggggccatgtaaatataatgaatcttatttttaatctttcagcattggcaaatataataatttttgtttttaatccatattattacaaaatataatctacttttacttgacattaaaacttatctctctattcttctaaatttttattagcagtgagttatagacgtaggatttatgacgaaatttttgttaactcataataaagcaaacttatttatgattgcatgtgaagcatttacttactattgcaggaaccaaagttaaaagaacaggtggaagaatatacacctttacatatgtaaaggtatttttatctattaactattatttaataatttctgcaatggaaggtttgttttatattgttcataaatattaagtatattattttacgcatttttaaatttagtggactaatttttataggactcaaatattaaaggagtaatgtgcttttccttttgggggattatgc

SEQ ID NO: 1541 - DNA, 1100 bp, Glycine max
  Soy_ogl_5608 Gm17:9567501..9568600 Cluster 6
atttgtaatatttgaagtatgcgtcgcacaaaaaaaaaaaatatttgtagtatacatttattttattgattcggtagccgaaatatttcttgtacaatgaaatttacgttaaaattatttttactaataaaaaacataattatatttttgtatctctattatgattaatgtgaagttttattttcttgatactttatactcgatttcagttgttttttttttaatttttaattattataataattttctttacaaaaattttattttatccaaacacgcggtttaacaaccctattgaagctaattggtacaatatgcaaatgcagccaatcatcttaaattacgtaagagaattgtaccaattaattttgatgggatcgtttaattctatttttaattgggataagttagacatctcgttataataaaatttagagtttatgatttgaaggatacaaaagtttaaagttttattaaatttaaaagattttatagcatagacaattaaaatgacaaagatgttgaaaattgggtaaaatataatattttggttcttgagttttgaaaggaagagatacgaaaatggtttaataattttaattcgaaagattttgagtacaaaaatatatattgagagatgttcattttttaaatgtattttaatatttcatgggaccaaccattgtttttcagccaaaagatacactcggttaaaaagaaatgattacattaatattatttttcattaacgtaacatttatttatattttattttacgaatccttttgtaagtatttaaaaatatctttttttcgtaaagttcacaaattttcttcatcagagcagagataatcctacttaaatgaggtatttaacacaattttacatctaatatttaaatttgagaccattaattaaactaataatcccatgtcaatgtatgtgttaggtggttttaaaaatatgtttataacgatacatcattgcaagtttgatatcaatattatgtttgaattataaaaataaaaaaaggttttgaaaaaatgactacaggacatcacaagtgggcttgtcaccaatatcgccaacaaagtttaatg

SEQ ID NO: 1542 - DNA, 1500 bp, Glycine max
  Soy_ogl_5614 Gm17:9682130..9683629 Cluster 6
tctcaactaaaactaaaagagttaactttattagattatagtttatacatgttggctcgaataagatcacattccataaaatatatttatatttgcagtcttacgcacacacaaaatggattttatttttttgagagacaccaaaaggatttttaaaatataaaataattccaattccaagtgtggtgcggacgtgcagtcaattataaatttataattttaaaaacaaatagaaagtgatttaaaatatatattctcaaaagtcaaaatgcttgatttattgaggaaaataagttacttatgtttccaatatttgttttcgtctttcttaatctttaaattcgatttttatctgttacatattattgattataatatattatttatttttctgataaaaaaattaaaatatctagagagtgaagcactctcttcacagttttaattagaaaattttcactagtctttctattatttctttaagaggtatgttacatatcttttacataactagttaaaaaaatatttctctcaactcaactatcttaaactactttatttaatttatatactcgattttcttaatttcttacctatcccaaattaacattagcattataatgcaatttaattatttattataaatttaaaatacaatttatatatttagaatatttttatttatttataatcttaattatattataatttctaaattttatttgttttgaattacaattacaattctataaaagtaaatatttatcctgtatattattatttgtatggtacagatgaactatgtagataaaaagttacgatttaagtattttttttagtcaagtttattctgaaaatgatctttatcttatttttaatttattaaacagttaattttcaaaaaatacatttaaaaattgtattaaattgatgatatttcattaataaattagtcctagcctacaactccaagtactcttcatttatttgtggacttgtaattttattttttttgctgaactttttggggattgtgataagttgtaaccttatagtggcacaactacaagtactaataacttgattatttcaaaaaaataatgaattaatatatttttttacgaacttaatatgtatttagacatgtcactttaaaacgataaatgtcatggcatgcttaaatttatatcatagcataaaaaaataataacaaaaactattttatttttattaaataccttttttccagaagaataatttcattgtattaactatattttacatatactacgaccttatctatgccaaaaaggaaatttcaacgtagtatcccagttgccgtaggatgttagaattattaggccattttgtccgttttcaccaagatatttgcgaaaaaggaaaatactattttaagcaaacattttttaattttataacttttgaaaataaattttttaaatcagttggaaactttctctcaatttttttattttaaaa

SEQ ID NO: 1543 - DNA, 1400 bp, Glycine max
  Soy_ogl_5798 Gm17:39740401..39741800 Cluster 6
aggctcaatttgtataatgggtcactttggttcaaatggaggatcaatttagatcaacacttaaagagtaagatttttaatttgagatcatgaatagttcaaaataaagtcgcctatttttacactttttttttgggtgaattcctatttttacactaagacaagggaatattgttcgataatccttatgtctcatatcatgaatcaattaatatcattacacgaagtatgtatttattttcacaatgttacactggtggaatatttattgacttcaatgttggaatatcttttgtaaatatcaactcaatgtcactaggagacttcaaatatcagctaggacatcaacttagtccatttcaactcagttttctgtaattagttaatattgctatatttttgtggggagttgatacactggtggggagatttataagaggctatatatgtgttttgtagtgggagttgtcaaattatatgatagaggagtggatggattgtagatgttctgggaggttatatagcttatttatacacaatatgctttggtataaataaattttaacatcggggtttcttctcttttgtattgctattctctctgtaactgttgatttaggtacctctgatataatttatttattcacttttgttttgccgatttaaaaaaacttagtccatttcgattgagacatcaatttgattcatttcattcatccaaaagatcaacttaatccatttcagataaatcttttcaaatgcattaactcaatccatcacaaacacacacaacatcccactccaattctatcataacatttaccatactatatttaaaatacataaatagagtgcatggatgttattccttcgcgagagacgttataataattatctacagattttagaaaacaaaatatggttgaggtaacgacttttattcttcttttttttgtgtgtggctaaattacgtatttagtctataaaatattatgattttcattcctttaattgctcatctataaaaaagtttattattattctggtaactataaagtttattattgaatcttcaaaatatcttttcatttttagatagtccatttctagagatgttttgttccattaagtttttatgtgactctaaaaaatgaaagaaaatatcaaataaaaaagtactgattaattgactgacaaagaattatgatattttgaggtaaaagtaacacttaacgcacagaattaacagatattaaattaaaaaatgaatatagtttagcctaaagttttgtatcataattaaaatattatttttattaaaatttaatcacaatgcattaacaatgtaattttttttatatatattatcttctctaataataaattgttacatatgataa

SEQ ID NO: 1544 - DNA, 1293 bp, Glycine max
  Soy_ogl_5811 Gm17:40124301..40125593 Cluster 6
atatgtcaaacacctacttcagcaagctaaggttttataattaaggaagaaacagtactacgggaagagggagagggatcatttgtgaacacaaccgctatgatcttaagtaattggaacctgattccctttcaatatttgcaataattaaaatattcttggtttgaaaatttgaccaacaggaacaagaatttggagaagcttggtgcttaattcatatatgtgaccaaatgtgcgtgacgccaaggctttttacaagcattgacgtgttgataccataatttgatccttttataaaattagaataaagtcgttaataaattggtttgggaagttggtgcggttcaaataattggattttgactttaataacgtgactctcttcagtgggactccgggtggtttgtaagaattttggggcttaagtgttgtacagaaatttactataatattaagtattcatctttatattaattttctatttttaaagtcgtaaaattaattattcatattttatgattaggtaattctagtattaatttattctcaatggcgttaattcaatcaatttatttcataatattgttgatattatatagataaaaatttatgtaagtttaatttcggaaaacttctttgactatgacaattgttacgtgtatacatttgaaaaaaatcatttgatatattttaattttttttaattaatatctttctcaatattttttattttgaaaatagatcaagacagttagaatatttactaaatctataagatgtttaaagtttattataatatttttcaattcatcctcacttaaaatttaactttttcgaattcaaattaaaaatgatttcatacggtaaaagttgttcagatcgaattgcaaaagaagaattttctcgcattaaaattattggtgtcagtttaaatcatctacaaatatgtccagtttttttatagaacagttttaaaaactgattaatttgtataaaattgaatttagaatcaatttatggcttataattgaagattatgatttaaaatcatttttaaaattaatttatagttgaaggatttaattgatgtgaaccaacaatataaaaaaatgcaccattaattaattatgaaaaggtcacatatttaaaaagtttaaattttatatatattaactatcataaaaatcatagtgtaaaacaattaaactcataatttaaaattagtttaagaactgaggccccacatgcgcccatgaaattgaacttcccaaattttggcaaaatattcttgca

SEQ ID NO: 1545 - DNA, 1300 bp, Glycine max
  Soy_ogl_968 Gm03:39425601..39426900 Cluster 6
ttatagtttcttcattaataataaagaaaatgtactggaaattagaactggcaataactagctagctagcgttttcaggatctgaagaagttgaattgaaatctttagggacttcaggttgcactttgctgatctaatttggtttacaaggataaaggaggagagtttatatttaattttctttttcataattaagtatattaagtacttcatatattgttcgttatttgaaatataaaacttaattgtataacattgtgattagctatatgattgatcaacattgctatttcatttctaaatattagtaaattaattaaggatgattcaacagaattctaattatttactaaaataccatataagtatttctcctcacaaatctcatattcattgcattatcaatatattagtttaataacttcttttaaagtgatccaaaatattccccttgaatgttatgaaagattggtaaagattaaaatatctgttctaagaatctgaaaagaaaaatattttatctatttatatatctatctatgaaaaagggaggggagagagaattttaaaaaataaataaataaaaacatttaaatgaaacaattgtaaaaaaaaattataaataaaagactactgataaaataagatgaaatatgaaatttattataatataattgttaaattaaattcagaatatacatgaagcaaaaaatttaaaaaataatacaaatatttaactatataattttgatattaatacattttcatataaaaattgtatgtaagataaatattttttcccatgatatagttaataatgctttcatatgcaaaaaaattattttcatatataatacaagtatttatcgtgtaatttaatactagtaataaatagtatcttctaattctttagcatcttcctaaattaccaaaaaaaacaaaaaaaagaccactagtctcgaacaaaacatgtcagtaacctagtacaaaatatatcttcaaagtgttaaattaaaaaaaatgaagaaatgaccatcaattttttaatatgaaaacttataattttctagagcaacacatcatgttagtatcatagagtatgagtataatttaagcaacttattttaaggttcttatcttctgctaattagtttccacaatatcatttcatatttaagcaattcatacatattttatttcaaatggtataattctaagcaataaagtttaattttaagcactccaacatgagatgcagatctcctccacatgtagaaaaaaatcaagcaacagcatttta

SEQ ID NO: 1546 - DNA, 1036 bp, Glycine max
  Soy_ogl_1715 Gm05:37766565..37767600 Cluster 6
cggaaataaaaagttttattatttgaaatgttttatatgctcattttaaaaatatatctcaaaataaaaaaataataatattttccatgtaataataggataagggacgatatatgcggaccatacccttttctgcggctttacttaattactttggtgctgctgcacttttcccaagattacgaatgtttgattcagaaaataaaaatttaaaatttaaaattaaaataaaacttagaaagtatgagatttatttgaaatttacataattcttttttctgtttctctcctctcttcctcaaccaaacacacctctttatcttagtatttgtatataaaaaaatgttttttataaacttttttgaaaaaaataattgaaaagatgaaataagttcaaattagtttctatattaagctaagtgtaaaagttttattatattaatttctctaaaagataatttttaactcataaatttttcatcaaaaaacttatatagactaattttaacgtatataaaaagtttatatccaaatagctataagttataccgtttgagatttttgagttatcatatcagtttatagaccaaataaatttttaaatattaattatttattattttatggttatatcatttaataattgtgaaagttatatagcttttagtggtacgttatttataaatgtttagttaaatatgaaataacaagtaaataaaatataataataaatatttaattgtatatttggttcttataatttatcaaatagataattttaatttctctattttcaattgctcaaaaaatcaagctctcatacatttgttaatcgaggtgggatttgaacccattatccaatactttaacgataagcacaacacactataacattcttgttgtatacatcaaaaatatattatatataagttaatgtatagagaactaaaaatgcacgtatatttacagctagtaaataaataatattatacattttaatactaattattttcttgtaacttattatcccatatta

SEQ ID NO: 1547 - DNA, 1058 bp, Glycine max
  Soy_ogl_14 Gm10:43055075..43056132 Cluster 6
acaataaatgcataaactcttatattttttaataaaaatatatgaaaattcattcgaattatttttgtatgttttatcaataataataaatttgagttttttatacatactaatcatattaaaaacagaaataaagtttgaaaaaacgcatagaaatttaagtagagatatcccttaatatagtatgagaaaaatatttatttaatttttaaaaataatataaattattttattaaaatgaataataaaaatcacaattgaataactaaaaaaaacaatgtttaagtatttagaagttaactaaattgctagctttattggaacatattcagaattgcctaatcatcacaatactttaaaaaaaatgttaatgtaatagaatttaaagtataaataagttaaatgaattattttagtttgtttgaatcgatttgattatgataaattaaatcattttatatttgataatttttactaataattatttgagtaatcaatttattgatgaatgtataattgagttcaatgacttatatattattatttcaagtatttatttataatattaatttttaaacattattttaccttttaaatgacataattatttttggaaatatttgtatgagttatgagttaaaaccccttttaaatgacataattaattttaaacattattttactttttcactagagtttatattttttttactaaaattaagaatcattttagagcacatattatgaatcaaccctttctttagaatatgctaatgtaatttattatattaatcaatcatttttttgtatatatttgatgattaccataatatgaaaaaatataatacatacaaaaaatatttaataaattataccttaataatttaaagtttcgaaatatcaatattaatttactctttcaacaatttacttaatattaatttattttaaaatacttatgatattaagtccttctgaataaagatataaaaacacttcatattctaaataactctgaataattatttttgatgaaatttgaaagaattaattgattc

SEQ ID NO: 1548 - DNA, 1300 bp, Glycine max
  Soy_ogl_3949 Gm11:37456301..37457600 Cluster 6
tggtgcatgggtaaaaactaatttatgaatcagttttctaaatatacaaaacaatttcaaaaactaatttatgaaatatacaaaaaaaaaaaaacctaaagggtgtgttaaaaaaaagtacaacacgtaaacatttaccttatacccgcccgcctgtggatattaccatataatttgacggatatatagtagagatttaaaaaattatatgaaaaaacctaaaatatactactataaatatagttagtctaattgtaaaattagtatgattgacttttgacacacacaaaattagcataatagatccatatacgcgtgtgaaatggctatgaacgaggattaaaaataagaatgaaatacacaaaattgaaataaatatatttatatattacgaaggattattttttttattttaacaattttttcatttttagttgttgtaattttattttttaaaattttagtcccaataaattgacattttttcaactttggttcctataattttttttatttttagtttttgtaagtttatattttttcaattttagtccctttaaaattatgatttttttcatttataattttcataagtttacacttatatggatcaaaattaaaaaagtaaaaacttataagaactaaaaataaacaaaatatcttaccaagactaaaattgaaaacaaacaaacttacaaaattaaaactagagaaagaaacttacataaatcaaaaataaaaaaatatatattaacttacattatattaaaaatatatttaagcctgttatcaataattaaatatattataaaaaaggaataattaaatataaggacttccacatatgagttttctactctaatagactaaggtctagtttgaataagtttatctaaaatcacttaaaatgaaataagttttttcataaactaaaaataacttatacataagttaaaaacctatcttttaaaaaaattatataggagaattagtttctacaaattaacttataaataaactaattttaacatttgtaaaaactcatttcattttttcctggaattttaaaaaaattacccaaacatttataccgatccctttgtgtttgtaaatagacggagaaaaaatccgttaaaatcgatcacccgcacctatgatatctatttaaaaacttgaacattatctgcaactgattgctacaaaaatgaccattagcataactatgaaaaaaattacgaagcataatatactccaatttaagaagcggctacataatgcaaaacctgtggagagttttgac

SEQ ID NO: 1549 - DNA, 1300 bp, Glycine max
  Soy_ogl_4637 Gm14:4028601..4029900 Cluster 6
tccgacatcgggtgccggtgaagatgatggatatttttgtcctttagggggtgcagaagcaaaaaaggaggtggaggaagtaaatagcagctttgatttatcagtgttggatttgtttgataggtcaaaacccaatttgttatattttactactaaaaggaaaaactaatacaaaactaaaagttgtataaaatatataaaagtccgaaaaatattttgggttcacaagtacaaattcaaaatcaaacaattaatatttcatagtttttctgtttaatacttcactcttaatttttaaaagagtctctggaaatttctcttttaatgcacacccttaagtattattaccttttggtaactagataataatgttattttgtctaaaaaaatatttttaattatataattgacctatttagttgtgttggattgcttgaaatagcatacagttttattagaatatatatgtctattgaactggaaacattatttgattctatatattttcaaatacttcctattttctttattatggcttttcgattgttattatgaaatgacttgtcaatcagtaatgttaattataattttggtaacaataaacatgattattttgtccatataattttttttataattccatattataactgttataattgcaaactaaaaacaaacaacagatctctataggcacaaatatctacatcaccaacttctaaatatatcattgtcatgaaatatatcgatagatttcatatgtaacaaattataatatatttatatttaagtgttattttattgatgcataaattaacatcaataacgatccatgtatacgtgcgagtacagtattaatactatcccagaattatatatgtgaaatactacctcagaattaaaacttcctttctctctaacaaacacatgtgtgcgtaccactaggttgtagtaagtcaagtgattgtcgaggtatgactacaaaggaatgggatacctgaggggaaatttgtcaacgtcgtttttacaataattaattaattgaactgttctaaaacatttatttcatacataaaacgaaacatttacatctttgtctttgattatttttttagttttttggcatgatagcaatgttaaaattaattttattggtctagctacgggttggtcagttacggtagctaatgaaattaattcacatggtgttgttgaggaaatttctatgaaagaacacaaacagacttgacagagacaaagaattcttgcattttcgaggaattttctatgattgaaaagg

SEQ ID NO: 1550 - DNA, 1021 bp, Glycine max
  Soy_ogl_4822 Gm14:48591180..48592200 Cluster 6
caaacacgcacttaatattttggggaaaaaatagtcctatgctttaaatttacgagtttacctcattaagatataaaaaaaaaagttactctaatttgtaagcgaaactaataatggtaaatagttgaataatttgaatggctgagtcaacaattatttatacagatccattcgtacgttttgttgggtcagacccaatattacttagcccggtttaataggctagtggggacccaactgaaacaaagaacattatttaatcatatatttattttattttattataaatgaataaacaatactagagagggagtaataattgaattgtgggtgaagaactacaagaaacacacggttgggagtaagacttttgtcaaccatttaatcgttgtgccaaaatttgttgggtagctacttatgaaaattacttgtgataaataataaataatatttttacattatgatataatcacaagttattagcccaccaaaaaaaaatacaagtaattatatatgataaaattattaaccatttatataattaatagcatttaaaaaaaattaaaagtgtatgtaaactaaaatctattattgtttattaaataagtttaggtctaagtataaataactgttcagaaatttttgtggatatgcaattaatacctaattctaactatattcacataatatatttattatgtgttagaattagtttttaaaaataatatttttgattaagttattgcatatttttattgatagtgtttttcaattaagaattatattaattttgaatatatttaaattaacttgtatatttttaatcaataatattttttctttttttaatttttccttgtaatgttagtattagaataccattcatgtttactattttgtttattgaatataatacaaaattaaaatcctagcaatagcaccagacattaatataaaatccaagtattagaatataaaaataaaagaccttgtttaaattaagagtaaaatacagtaatca

SEQ ID NO: 1551 - DNA, 1577 bp, Glycine max
  Soy_ogl_5523 Gm17:5280028..5281604 Cluster 6
agttgcagacttcgtgcttcaacaagtgtgacaagtttcaaccgtgtgcaatggatgtgctttccattacatcacgttggagtgcagaaggtatattattggatttctttcaattaattacttgcggatgtgctgttgccgtacattgtgctcgttttgaaagaaaatacatcacaacctcatttttttttatacgaaattacattttcttaagagtgaatactgaatagtgtgtatctgtatattatcattcaaacacagatggatatgtataaaaattcagcaaaaataaaaaatggatatgtataaaaatcatacttatcatacttttaagtcttacaaagtgacattattgtatagaaattatacacttttttaaatacgaaacctccaactctcccagtatcactttgtcttgagaattgttttaaagtttacaacgagagatttaaataatttgaccaaggtacatgacagatataaataccaactttatatttcaaaaatttatttaaatttaaaaatatccatgctttgtcttctattctacgtctttaatgttatattttatgtagagaatggaattttatgaaacaaaagaaaaaataataaattacagaaaatacattttatgattttaatgttaggtaaaattaaagataaaatataataaaaattataccacagaattgacatataatattttacacgtatatatgtggagtgagacacacagatagtacatatttatagaagaagctaatctttgtcattttatttatatgtttaaaattgttttttcttggttttttgttacacatgtatgtgcatcgacacataaaatattaatgtttatttaaaaaagacatatttaaactttgaacaacttggtaagaaatatattctaacaatttgttgacaaattttatctttcataataatcaacatattatcttctggaattgtattttaataatattggtaaagtactagttttagtactgcacaagattaaaattcttgataaaaaaaaaaaaaactgtcctacatatttgggggaagtaactcaatggaaaaaatattttataaattatgaaagaataatgaatgttatttaataaaaaaatataagactacattaacaataagtacatatatatggagatttatttgacaaaaatatatagaatgattttagtttaaatatatttgcaatataaagatttttaacctattattcacttataaatttagtcgaatatcttttaattaggtgataatgtcaaaatctttacacttatagtatataaaaattaaactcatataatacccatgaaaagtgagatttcacgagttcactcaataaaatttagaatgggaaaaaaattgtatttgacgaaaaattggaaattccatcccgtatatgtaaacctatcgtgtaatctgattttaaatttaaatgcgtatgatatttcactcatttagaccaaacatataataaaaataataaagagtgttcacgtagcctatagtcaatcacatttgatgtttggagattacttgagttcatttttttg

SEQ ID NO: 1552 - DNA, 1100 bp, Glycine max
  Soy_ogl_5895 Gm18:2308201..2309300 Cluster 6
tccctttagggagttagttaaatttactcttacattttttttaggttacaattatatctgctttgttgagaaaagagactgggcatatttatttatgtaataaggctgatacttaattgccttccataatgggcagagggctcagcaagattcgacctaatcactaacatgacattttatagctctgaaacgaaataatataaaagctcctaatatataaatattaaaatgatatattgttatttatctttcttttattcatatatgtttcattacattttaataaaccttaacaaattatcaaagtttcagactagataagaataaagataaacttatcttaacttgtctcatgctcacccctaataggtagttgatagatatgcttggtgacgatgtagtaatactcttaatccaatgcatatcagtacgtaaatcttcttttcttattaacactataacgtcacattaaaatatatttcatccgaactcaaatataagtaaactaataaatttttgtgccaattaagaacttaattaatatcatttaattttattaatcatattaaaaaatatttgccaattgattgttgtataattttttttgaatcgtatcaattctgtaaaatggtttctgcgcatatattttttaagttggtatttcaaaaacaaagtaatgctaccagattagtgctgctagataaggtttgaatcaatgccaagaatatagtttggctaataaaagtgaataataaactaatttcaattgactaaaaactgtcaaattgtcgacaatttcaaactttttatttttaatagcaaataaaaacgtattttttttttttgaaattaggacgtaaaataatgagtacaaaaatggtaaaaaaattatgaaattcaaaatcttgttttgatgaagattaaaaaatattatgagaaatattatctagtgttatcatataagatttagatcaattagtttaattagatatagcaaattatgtcacattacacattaattagtgttaaatttttttgagtaaactttaggttttagattatctaaattaagtgaccgagatttgatataagtctaataa

SEQ ID NO: 1553 - DNA, 1642 bp, Glycine max
  Soy_ogl_6227 Gm18:57223501..57225142 Cluster 6
tcttacaataaaaaaagagaaattaaagaaagaaaaatgtgaggaagaaaaaactttgaaatatatacatgatatgatagagagataaagaaagaaaagtgagagagaaaaaaacaaatatatacatatataatatgattgagagataaatatataagataatattgtataaattattataaaaattattatgcatgtaggatatctgtttcgaatttctacttttggtgatggagatgatagctaggcatcttagaggttgatgctaacagtagggccctcagaaaaaaaggaatataaaactatatgcgcatccatctatacataacagcttatacttaaagatagttaatttataacattatatcaaaatttcaacaaccacatatttctgattcaaataactctcgtgtatataagaggtacgaattaaataataaatataagtgaagaatgtaaaataagtttattctcttctataattgctcgccataaattcattatatattttcgtgttcttaaataaaaaattcttactctatatcattaaacggagaaatatttgcattagaaatactagagtaaacaagttatatattggcacattattaactaattaatatgactactgtgttatagttaattgataattaacattagtaataatgtatcagttatttattaataatatatgcacttagtttatacgaagagcatatagttatgtaccataatttttgttaagaaacaacaacaaaaaaattgtgttttagtggatgaataataagttaaaaaaggaaagaaaaatggacaaaaatcacgctacgtgtttttcgtacagttttttttttctttcaaaatattatgtattttcctatgcaaatttttccaattaaacgtatagtctcacttttagcattaaaaaatatatagccaaatagttgaagtggcataacatgcttgagcaatggctctccgcactttcaacgcgacggagaaagcaagttcaaaattataccctccgcactaaaaactaaagaaagaagaaaattttctggacatcattcgatactaaaacaagaatattcaagagattagatgccaaacaaaatgtaacacacacacatatatcgatttcacttttttaagaaaaatatttcctggacactcatatatataatctgtgtctgaaaagaaaaataaaagagagaaacaataaatgtaatatataatgatatgataaaaaaaattaagagtgtaagtgtccaaaaaatatattattttttaagttatatcaaattcatggtagatttactcatccgtgattgatttatgttcgtatatatactaatttttcttaagtaaggtggcatttgatctgaaagtgagatgaagtttaggccatacatgaaatataatagaatggttagatatataaaaagtttttgaaagtcgcctgattgtcagtaaactttggtttgtcatatatatatagatagatggaggagaatgataggactagaagaacaaatttaggtcgtaattaatacaatgatgttgggaactgaaaggtaggacagaagataggttaagtctaattaactagactttattacatgtattcatcatgttggttagaatg

SEQ ID NO: 1554 - DNA, 1137 bp, Glycine max
  Soy_ogl_6965 Gm20:43819802..43820938 Cluster 6
cttttttcccactatttatttattttgttcaatttcattctactgttaattaaagattcaattaggtccggttatttttataaaaaaaaaaacttctatataatcatttttgtgtaatttcgttgttagtgtttacaatcagtgacaatttaaaactattgctaaaaagacggagaggactgcattggaactcttttaaaaataatggaaatctgattgaatatttaaagttaaattaaataaataaatagtggaacaaaaaaataggtaagaaaaaaaagaaaccctactttgttaattaactaactcatttaaatgcatgtttgtaagagttaacttgttttattcacgggttaacttggattttgtctgtggtcgcataccaacttgtttaacccacatattaactttttaaaaaataattatttattaaaaagaaagtttaatgtgcttgaggtatttggatgttagatatttaatatttggttcatacacataaagtatttaaatatttattctagactggtttagaagacattgaatctttcaaactttatttgatatttatattaaagattttttaaagaaatccattacttaatatttatattagtatttttatcagtataatgtccacaaaaccagattatctattgaaactaatttacataatttttttaacataatcactatttactgtaataattttttaaaaaaggtttatgaatttacctattatcaacccgtacgttttctccacaaatttaatggaataagtcaaaattgttggtagattaaaaacttcaatctatcttgagaaaaaaaagagagttaaataggttaccccttagccaaaagcctaactcatttttctcaccccaaaaaacattagcaacacaatgaagtcgatttcaaggtcatgtggcaaaaaattattccccaccccaccagaccaccaatacgtaccattttgtcatttgtattcattcggtagtattcaagcaacccaatactaacatacgtagtagtcatgaggttattagtatttactatttagtagatttcaccgtgatggcatctgctatttcatttccatcctccatgtgatttaaaattaatttatgataaatcgtacta

SEQ ID NO: 1555 - DNA, 1046 bp, Glycine max
  Soy_ogl_198 Gm01:48451301..48452346 Cluster 6
aaatagacttttcaaataaattacgataaaaaaattcatatataagacctgtttgagtaagattctttagaaatatttctaaaagaataaaataaaaaaataaaagatgagatgagtttttttataaacaaaaataaactttccatcgaataatttttagatactcactaatataatttctctaaaagataagataacatttataaattaactaataaaaaatttattttagctaataaaaaaactcatttcatttttttttattttttttttctagacgtgtttctaatttgagttcatgcttgaaaaagaaaagcattgcatgtttgtatttttttttattttcctcacgcaaaaaactcttggaaggcattccatccaactaataattaataattagaaagtgcaaataatgttagaataggttgtcattacggaaagcaaattaggcatatactacattcaaattaatccaacctttataattaaaggagtgtaactcacttgattggataagatacacacttattgtaattaaattttttggtattacttttcattcttacggattaaaaataaattaaacctttaatacaatattgattgtgttttttctttttcttctacttaatttaatcattactttctcatcttctttttcacagtttttatccatcgtcgcacgtaatcgtagattcatccttatcagctcattaattagtcctaagtcttaaatgtgtttaacaggagaaaacatgcatgtatatatcttatgttgcgatgagaaagtgactgattaaaaatgatggaattgattaattagctcgatcgattcatgcatatatgatattaggtaacgtttatctactaacttcacttgattcttggctttcagtcttaggatgcacatatataaatcaattaatatcatcaaacgcataaattaatgtgaaattatttcaatttaattaaaggtattgagtttgaatactaagaatgtaattatgttaaatatttagaaaaaaattttattgttcataatgatc

SEQ ID NO: 1556 - DNA, 1200 bp, Glycine max
  Soy_ogl_232 Gm01:49674201..49675400 Cluster 6
atatgcactcttcaaacatatttgagaatacaggcacattattctatgtatatatttttcgttaaagttttgttaactttcattggaaaaaaattattaaaatatattttacattactatctcacaaaagatacgtattactttttttcttttcttattttaagtgtacgatttttcttttaatatatgaaaatacattatattttctttatttttatttttctacagaaaactaataatttctattaaaaaatttcccaaaaatcatttgttagtatattttgtatttttttttacaaaaaatgttactaatttattggattttagtataaaatattttcggtaataaattctttcttcactgaatgccattttaactacttttgtgtattactaataacaaatttagatattttgactcatagaatatttactttacctacaatctcttataaagagaaataatattgatgggtagaatcgcagaagaaataacttagaaaatttaaaatactttagtaatattttaattaaaatatatattagtgtattacttccatgtcttaagtgatgagaatataattgactttatcgatattaaattgaatggagcaatttatgtatttgaagaaggagctggacaacataaaaatttaattattaacttgcatctcgtataagaggggttgtaatttactcattaaataaatgtattctgattattataacttaaggcacacatttacaaactctctctctctctatatatatatagacacacacactagggggaagacactttgtgtctctttacataataaaagtttaaaaattaataaatgataaaattatttaaaatttggtggacaccaaaaaaaaatctttattaatagtataatactatagattacgtattttaatattaaatatgagcatgactattttctaattatccttattttaatgtcgggagtaatttataaataaaactaataaaaggttctggataggaatcatgattcacgaactaaacattaactaaatgcttgaaactccaatgacgtatgagtgcaagttagtaaagagataattaaattgtaagtaccagtagagtatttgattgggtatttaaaagacaattgtaagtataagttaagatagataaataatatttatattaaggatctagaaatgttttga

SEQ ID NO: 1557 - DNA, 1100 bp, Glycine max
  Soy_ogl_2965 Gm09:3369801..3370900 Cluster 6
agtgtttaaaataattttatgattgaaaaatattttatttactaaaaaggcacttaactaataaaaaaattatcgacatgatatttaacataattattataaaaataaaaaaaattattaatataataatttattattagatgacaaaacaaattatttcatattatttgtgcctaatttgttatctctaaaataaacataaatacgcataaataaaatttacttcttaatacatggaaaaataaatattgaacaaaatctgttactattaatttatatggaaaacacctttttttatagaaaaaaatatttattttatttttcttaataaagtcatagaccgtatatttttttatcttgaatttttcagatgataattttttttatacttatcggtagtagatatatcgtcactcaaaaaaaagaaaatgcgtctcttgagtattgacacttgatatttgctaatgaaatatctgtctctgacatttttcatctacactcttatgagtaatttttattttattttttatatatatcacatgcagtttttttttcaaaaaaagaaagaaaaaacggcataatgtttactgtatacatcaatgacttccctaaaaaaaatcataaatccatgacttccctaaaaaaaatcataaatccatgacttccctaaaaaaaatcataaatccataaccatgttgtcggttgctccttagtctagtcacgtcaattcaacttaggagacagcagtagattaggattttaaaaaaatttaagagatttttttaataaaaaagtcttttgatattagatcaatattttaaataatataaataaattttatgatatttaattaaaattgttagaattttttaaaaagtgtataaaatctgatgacatttaattaagatttttataacttaaaaaaattgatattaaaaaatatataaattttgatgcattgtattttaagatagattttgacatattttatgactttttaatataaaatatctataaaataattgcacctatatctttaattttgctagattttgttttctttttctattgattatcaagctttcttttttctctctcat

SEQ ID NO: 1558 - DNA, 1600 bp, Glycine max
  Soy_ogl_5828 Gm17:40768901..40770500 Cluster 6
ataacaaaagaaaaaaaaaaaaggaagctaataaagacgtgttgtgagtgcctgtttcctctttagacttggctccacaataaagttaactagaaaaaatgaaattaaaggacattggagtttttcccaaggtgtgttctgggacgaagggatggaccacgacctccacttcggcttaataattgtcccttttctagactaaggactctcatttcttaatccataagttaccaatgaaatataaactattcattcatgtatgttcctctttttctttatcaatatgctgaactatactattttacaactattgtatttttttttactgcaactattataattaaatgctagtagccaatgttttaatttcagtcctaattgaattgcaactattactcataatgaaatgatacaagtcttttgtggtaaaaaaattaaaatactacaggttatttcactacaagttatatataaagcatcatgagtaattttattttataaaaaatatactcttatttcttaaggtttaataaaatgatctttgacattgttttcttccttttgcaattatggaaggtttgagttaataaaaagggtatgcaatggtatgttatattatataaattaagaaatgtatgtgcgttgttaaaaaaaaatatttggtgaatttttgtgaaactttaattaaagaatactggtataattttgtttgtttgattaaagtatttgcgttacacctccttgttctactttctcatataatctaaatattttgaatttttttaaaaaaagaaaatctcacattgtcttttctttccatgtatggcttttgtgacaaaatttcagcatttcctttttgaagttttttgaaaattaagaaagctcttttttttttaattaaagacatataatttatatatttgattatcatttaattcttttgccacgctagcttgtacatttttccaaagttagaacttaaataataaactatattactacaagaaattcattaaatatagactgatttcgagactgaaaattttcactcattatattgactgatttagatattattttaaaaattgaaaaatgtctgtctctaattgtcaacaaaaattgaaatatagagaatgcttttaaatggctaatggtcataaaaaaatattttatttaatcagagagaaacttttcggtctctgatgatataataaaaaacaaattaatcttctttggaaactaatttttcgttcgaaaaatcaaataagattagagactaatttttagtcactattatctcattttagacactgtttttttgtcatgcttgtacatttttccaaagttataacttaaataataaactatatatattaatatggatgagttgcagttttttttcattttttgaatttatttgaaaattacaaataataaactatatatctaatatggatgagtagcaggttttttttcttcctttttttcaatttatttgaaaattatttttaattgatatcttttacaaccaattttaaaataatttttaatcaattttgtataagaatctcatccttggtattttccaacaaaaaagtta

SEQ ID NO: 1559 - DNA, 1000 bp, Glycine max
  Soy_ogl_1456 Gm04:47075001..47076000 Cluster 6
ataagtaattgaaagtaacttgttgaattaaatggaagcagtggatagcatcttttttgactttctagggtttgtatggtcctgggggagacaaaaacactcctcttctccctaatctgacttcaaatagcaccattttacaataatttataggcaaccgaaaatattgtgccgactattgttaagagtttaaacaccctttaatcttaaccgtccgtttatgtatttataactacatataaagaaaatagaatattttgttatacgtatttttatgtccattttattattataactacaattataagttattattttatccttataactactttcataaactacactaacttctattatgtttccttttattaaaaaaaacatgaaaaaagtaattaagacacatggtgtctgttttctcctaatgattatataataaagatttatttattctaattcctagactattatcattattaaaaaattaatttactttgaaaataaattttaaacacttaaacaaagtccaacacaattggttgataattgtgtttcttaagcatactaacacataaaccagcaaaatcaataaggttcaatacaattggttgaaaataaattaatttacttcgaaaataaattttaaatacttaaactaataaggtccaacacaaaatatattttattaatttctatgacttaaacgttaatctcgtgatttttaactatggaccggatatatgtagtcttttgtaaataaattataaaaaaacaattgaataattatcaagtttatttcaaattatatgcaatttcgtaaactttaattatttaataaaagttattcattgaatggtttgattgataatttaatataataaaaattaacaaaataaatttatcagctcatactcttaaagtaatttcacccacatattaatttatttaatggaaagttgaatgagttttgtttgacacaatttattttaacattccaatt

SEQ ID NO: 1560 - DNA, 1673 bp, Glycine max
  Soy_ogl_6450 Gm19:39214001..39215673 Cluster 6
gtataagaggtgtaaacttaatgtttttcccaacaactaaggggaataatgtagggatataaaaaaaggagaaatatcttatgcactatgaaaaatgtcagaggtgtaatttattcttttaaaaaaagagaagtataatctcttccttttttttttttggaaaagaatacctggacatccaacatgttagttgacaccagtgaaaaagagtggtaaaagacaaaaaaaaaagatattataagtaatatgatgtaataagaaaaaagaaataaaataaattaattgataagtgttggatgtgtttaaaaagattgattgttgaaatattataactttttttttttgtatagattatatttattctacacatgagataattcttcttgagtcatatataacttatagagcgacaacacattctttctctcttagtaactaattccattacatacttaatactccaatgctgacaataattcttcttgagtcatatataacttatagagcgacaatacattctctctcttagtaactaataccattacatacttaatacttcaatgttgacaataatttttcttgagtcatatataacttatagagtgacaatacattctctctcttagtaactaataccattacatacttaatacttcaatattgacaataccatttaagttaaaacaaccctatatgtgtttaaaaagattggttgttcaaatattatagctcttttttccctatataaatcttatgtgttctttccgaaagataattatgcttgagttaggtataacttatatcgcaacatcgcaggcttcctctcttagtaataaagttgcataccaacactcaaattttgagaatactgtttaagcctggaacaatcctatagtagttaatctacaaactcggtgataggaatatagtctttaaaattaaaaaaaaattataatttaattttcttttttaaaaaatacagtataatttatccattttatttaagatcttatgtcgggctttgtttccgtttgttggggagaattgtacagatatatgaaaattagggtattttttttttcttcaaatgatcattcgatgaaaatgtataaggacacttgcattaaagaagaacattacaacaatgcacaacaaattaagaatcatcagcaaaccagactatactaaaagctaagctacaaatacaaataaaaatgaaaaaaataatggtatttactgtcccctgttacaaagaaaccttgttagggtaacggtttttcttcaactttccttcttgttttgaactaacaagaagaaagtgctactaatttattgagaaaaaatgactgatccgagaaactcatttatactaatttacttttttttttttgctgaatggtttatactaatttactaactttaagagatccactaataaaaaaataacttaaaatgtaacacaattcattctttttaataaagagaagtatagtcttttttggtacagatgtaaatgtatcttctatttttatgaaaaataatccagttagaggtgcgcgagtaattaaagaggaacaaaaattacaatttaatttattcataatatagtactatttattgtaaaatatatcttaatttaagttttacatttccttttattcaatgatttaacg

SEQ ID NO: 1561 - DNA, 1000 bp, Glycine max
  Soy_ogl_46 Gm01:2162501..2163500 Cluster 6
ttaatagtattaagtgcaattgaatgattgaattatacccatgaaatatgttattcctcctgttttatatataagaaatgttagacaaaccattaaaattataaaagtggttaaattagttatttttaattaatatcacaataaatttaaattttattctaaaaatgttattaagtttaaatattgtaagagagatagtcatatttaatgtcaatacttacaatctaataaatgtctaataaataaaattaaaaataaattaaagatataaaataaatttaactcttgataagtttgaaaactagtcattatttcttataattaggattaaaaaaatacaaaaaaaacataatttatttcttatatataggaacacatgtagaattattaagttataaaattaaatttaatgacatcaaatatcattcaaaatcaagaataacaaatcgtaaaaaaaatataaaaaaaaacaaggttggctgtttggaacaattttaagaaatatctccttatttttaagatgattcactttttatttaggagaatattgaattaaattgaaaataattttctcttaattgtaaattttatcactcaatttttattatttcataaatttcaccacctaagttttacctaagttttttttgaattttatcaaccaaattatcttttttactcattttactactaatgacatgtaaaaaaacaaaatgatgtcattttgttatcaatttcttgtgacacaatatcattttgttattaatgtggtgataaaatgcataaaagttgagaactttaatgataaagtttgtaaaactataaaagtttaatactaaaatttaaaataaaaaaattaagtgataaaatttgtgaatcgatgaaaagtaggcagtaaaatttatcattaaacctaaagtctattcaactataaaaaaattattgaagaggacttctagagttagaaatgagaagtcgaaccttaactagaatctaagat

SEQ ID NO: 1562 - DNA, 1237 bp, Glycine max
  Soy_ogl_4151 Gm12:38557664..38558900 Cluster 6
atttttatcttgtacatcatttaacaaataatagatgatacaagtaaaataatataaaatttattaaaatacataatattaattatcttaatacaattgatatcaattttaatgagtttatcaaaataaaaaaaatagagagagattataattaaaaaaatcagtatttcctttttaaaataattatggtggttagttactattttttcatttattaaaaatatataaataaggatatatgtgtttttataatactttatatatgagaaaaaaattgtcttacaatctaaataacaaaaattaaagattttttcatatcctcatttgtttaacttgtgttatttcttatttttcttcaaatcaagggtagaataaaaatatttattttgtcaataccataattttcaaagaatcaaaccgaatagtagttgtatctctaaagttatttaagagtgctgtgttgtgaatgataagaatggagtaatattgttgccactcaaaactgcattcatcattttcttggttattactcaattcattctctcttttttttatacagtttaagttaattattcttcacgaaaaatatttattagttatcgctatttttatatgaatatattgtttgagagagtgtgttaattttttttctttcattttcatgtttattacttttttttataaaagtaattaagtatgtttaacgatttcaatcaagtactattttctttaaaatatttcattataaaaatttcttaatgtaaacaattgttaaaaatgctataaatatttctttatcaataaaatttaccaaaagaccagaagtgatagcaattggctatcttaatatctttgtttatccaggttctcgagttgaaatcttataactaacacttacatcggtcagatatcatcttcattcaatctttactaaacaataataattaatcatatttactagtcaatttcaaattagttagatcagtttttctcgatgtacggagtgattaaaacaacaaaaaatcttataaataaaagacattaaaatgacctttaaatgacaatatatcaaaaaaaataaattatacaactattacattatttaacatccccaaattgaagcaaattataggcctcggattttcgttccaccgaaaacaaagaaaatttggtattgactacgaggagaggtcaagcacagtggctgggttaagattgtcaacttttgtgaactaac

SEQ ID NO: 1563 - DNA, 1100 bp, Glycine max
  Soy_ogl_1352 Gm04:42806201..42807300 Cluster 6
aaaaacagaaattaactaaaagcctgaaataatttgttaaacataatcataccggatcaacaataacatgttaaaattttagaaagattgaaatggaacaatttttttttaaaatggtcaattcaagatttcacatattttagaaggacaaaaacatatttttattaaagaactatcactcaaacaattacaagttatataataaaattataataataaaactagatagtactgcatggtccttattataagacacaattttgacaaaaatgagtgtcctttttataagacattttataattcctatgtaacatttatttgtttctacgggttatccttattaaatattgtaagtatctatgtttcttattgataaaagtacataatattttttaacttaaatatttttaattaccaataactaatgattattaataacgataaaattagtatatcaataaaattttaaaaaaatcaataaaatcagctacattactaacttttttcattgttccatgtgcatatttatgtccaaagtgtcttagggggagtaattaattagcccaatcatattttgatatgttgaaactccttaaaacataatcttttataaccttataataaatatttaaattttattaaataaaacttattatcaataaaatacttgatatctcaattcaaatactttttttatagctacaatctcacttcaaataattgatacttaattataagttttattttaagtttattttctaccatatattacagtatttggttaataaatattaaaaagagtttaatactatatttatcataatatactaacgagttgaatcatcaaaatatcataatatgtatttatacagaagcctatgtaaagagacatcattatcgtctaaaactaggttaatagttaaaggatggattggaatgaaattaactttaatataagtttaggatgaattgtcctattaaaaaaattaattaagataaagtgtattttactctatttattaagtcaatctttgaataaataaaaaaactactaagtcaatcccgcgagttatacaaaattaatagcaaaaaactttaac

SEQ ID NO: 1564 - DNA, 1000 bp, Glycine max
  Soy_ogl_1387 Gm04:44252501..44253500 Cluster 6
ttacttttatgataggtattactttatctttggttttgtataggtagatgaattaatctttatagaattaagctcaaaaaaatctttcagaaatcattaatcattaattctgttattaatagtttaaatctctatgttttaaactaagccagtgaaagccattgcgttaatttttgttatttttacaataggtattactttatctttggttttatatgggttggttctttttttttccacactgtactacttgtctatcatcatttcaagatttttatcaatttttttgttttgtatattatttagtttttgcaacccacattctttctgcacattttatcatgctttttaattttagtatttttttttgtcagcaatgaatttgcatattttatttttatgttgattacaaaatgtcatttcgcaaaaattgatgacaaaatgacatctttttttaagaacacatcaatccttcattatacatctaacaaatccataaactgcgaatactgaaaaaataccatggtaaaatcattgaaatgtatgggaagaaaaattgaataataaaatttataaaataatgctaatttggtagaaaaatgtgtaattaaactttttgatcatatctttttccctaaccacataatacttttaaaactttcctgtcctatacttatttgatacggaaaaatcttttgcgcctaaatttactcttgttttgacatcttatttaattgatttgataattttaataaattatgagatatcaaactcaaaagatggtagttgggcttggatccaatacgtattagtaaaaagatatccacaatggaaaagagaattatggaatttactatatctactcttcttttttctaagtatactccccttactggtataaatactcattatacccaaaatatccctatatcatcattctagaaaatacattccaaaattcatgtttaattttttatattccaaaaattatttttttaat

SEQ ID NO: 1565 - DNA, 1647 bp, Glycine max
  Soy_ogl_2688 Gm08:14616401..14618047 Cluster 6
ggtcaaccttccatcaaggatatattgaaatagtaggtgtttgttgttttatgtacgtaattttttttggtgaatttatttatgttgtaataatattgaaagtacttacttataccggctttattccattattggtgaaagctttgcaattttatcatggtaccagagaagcaaggctgtcgaaatccaaattaaatataatgaattggacataggtatatgtttatgaaagcttcgaattaataattattaaaatatatggtttatagataatatttttctttaagcatgagataaaaaatttgatctttgatctatgcgtatgaaaaataatatattgaaaaaaatcaatcttttaaataaattttcaggtttaaattttcatacctgaatggattactcattattcttgtcgacagatactctctgaattaaaaaaagaactttaaataattaattaattacaaaaatgtatcattaatttaataaattttattcttttttatagcatcctccaaactaacaaaataaattatggctaccatgccatgagattcataaaaaaaaaattattttacaaaacctaaataagattctaatagggtgtatgtaataatatattaccattgagtcgtgattttgaaatttcaatgttacgtactcaactctgagttgatttattttttatgttttacgtcttgatacttctctggctacaaatgcattgcttgttaatatttcttatgttttaattattttttacattttccaaatttaatagtaatatttaattttttaaaaagagaagtttttataaaaaatatattatgcattctccttattaaaatcatatactattcttttttttaatcgcttcttttaaattaaaaatgttaatttttatgagaacctatgtcaaaaccttcaatgcaactaattttccttggttgcaacatcaacctaaatatttatgaatataattaaagtagttattagattggtaagaaataaaagttacaactcagaaaaaaaaagaaataaaagttacagaacaaatacaaaactatccatatattctttttttaatataaaattttctttagtattaaaatgtttttaagaaaacattatatataattatatgattcttaaatcaaaataaaataatatgtattacaaaatttcatcttatgcaaacattttcttctagctctgaacatacatgcatatcaaacttgaataaccaaatagcctatgcatttgttacaaaaaaaaaaaaatatagcctatgcatcaaatgaagaaaaattaattcggcaagatcggtttcaaatatacagagtaatgtcatggaaatgactgtattttcaaaaatacaaaaaaataaatgtttactcaaataatacatgtgaaaagatgtttacatggattataaaaacaatatgtacaagatgagaaatcggtttctctaagtcgatttttcacttacacaattttattttagttaaaaatacacttttgaaatcaaattttcaagaatcgattcctaaagtgtgtgtgtgtttttttcttagtttaaaagttggttttccataaagcaatttctaaactagattttaaaaaaatcagttcataaaacaaattgag

SEQ ID NO: 1566 - DNA, 1200 bp, Glycine max
  Soy_ogl_4692 Gm14:5825201..5826400 Cluster 6
aggtgagagtgtgatcatgggatatgtcctagatattaagtcagtttgtttaaatttattgttgaaaaaaatatttattttaataaaataagtagaaaaatatttttttaatttatttgtttaaactgttatgttttgaaaaaataattttctactaagaagcaaataagttaatcttattgctcataatcttacaacaacatcaaggctttatgctagctagcatccatgattttgattacattctctcttatattgttttcaacattatgaatgagtctatcccttaaaaaaagtaatttttatatggctattaaaaaaaatacttcttttaaaattatttttaaaattttaaacatactactagcccattaactctgtcaaggctatttgcttccttcatcatgtttggtcagtccgaaaggtaaaaaacaaaacattccgaaaagatgagaagctatattaggggtgcggaagcaacactcatctatgaattggtagttgtgtgtaatcgtatttagatatgaagtggtaaaacaagattagtcaaaacgtatcaacctgtttaacttatcttcttctacgagtcaacttgtattcaacttaataagttttgcctagttaaaaagtaggtttacaatggactaagtggttaatccgtcggaacaacgatttttttatattttttgaattcaataaaaaattgtaaaaaagtgcaagatattagttttattttataaaaatcataaaaaaaaaactataagacaatgactttgccttataatcagagcaaacacaacattttattgtcttatattttatgtttatttaacagaaatatcattgactctatttggatagctatttgaaccacatacaacggacatttcatgcgttccgaggcaaaatcataaaagcaatgtgtaacaaagataggaaggaatgtcatgataaactcaaataaaaagagatatcttgtgaacaaaattattaaaataaagagaatatttaatcatagaaaaatgactaattaaaataaatttaggtaactaataattaactcaagttacactatgatgattaataatgtgaaggaaattttcatttttgaactccttcgcaaacacatacattgtacttataatctcgaaagtatgcacgaaaatttctaatgcaaggtcattgaaataagtggttttc

SEQ ID NO: 1567 - DNA, 1600 bp, Glycine max
  Soy_ogl_4932 Gm15:9058701..9060300 Cluster 6
aataaataatttttacttttgaaaaagatggttctcataatttaaatcattgattgtgttgatcattaaagaagtaatttaatataatcaaacaatataaaaccaaaatctactcagaatattacagataattgtactgtattttaaattaaacttaaattaatataatatggttctaaaagcaaattgtattttttttcttctaaaatgaataacaattgaatttctattttctgaattctaccaaactttcatttccgcttatgacattttaatgtgacgtatgcaataattcctaaactaagaaaagacaatgagaaactacttcgttagttctgcatgtaagtgttttgagtgttatgtctaacgagaacaaacttaaaaagtctattgactgacttctctcattttgtactttttagaatatttgttagaaaaataataaataggttctgaattaaattatatatattgctcccacttgaactctgttgacataattagactcatcatgtttgaagtattatttacttcttttttttcaccaatatatcaaaattattagggagaggttgtttcatggattatttattttttaaaagaaatacgagattgaaaaaaattattctcatgtttattatgaagtaataaaataattattataaaatatatcacatttttctaaatactcaagaataacattctcatatcatatttttaagaaaaatgttctcaaaattaaaaaaataatccttgaagcaaacttccatgtgtattttttgttttgatttaattattaatttggttcctttatttatttgaaatattcaataaaattcctctatttttaaaaacttttaggttctttgttttttaaaatgcttcaagatgatcctttattttttaaaaaaatcctcgatgtgattctttccatctaattgagatagcaatattaagttgcaaattccggcaaaaaaggactacattaagatatttaaaaaaaataaaagatgaaattaaatcaaattaaataataaagaactgcattgaagtattttttaaaaattataaaggtgctgattataagttttagaaatcaaatgacctaattaaacattctaaataaataaagagacttaaattaataattaactcggttgttgttttttccttcttttttttagtaactctgggtacgtatatggcaatgtattccacatttttgtcgtgttattaacattttccttacttgtttaacagaagttacaaaatatgaaacgagcaatttggagtacattgattagttatcactcattttgaaacctttggttgagttactgactttttccagacaagtttagcataagtccggaaaagctgaaacgagtaatttggagtatattgattaattaacactaaactatggaattataatagtattttatagttaaaacatctgtttaacaagtcaatttgtagcacgcgattcttgtttaatgtcactattggtttgcttgctttctatctactttgcctacgcttacatccctctttaggtaacagctgaagcaagttattacgccttatatatagttccagt

SEQ ID NO: 1568 - DNA, 1792 bp, Glycine max
  Soy_ogl_6548 Gm19:44032301..44034092 Cluster 6
taatattattttgttaaaactaccacggttttatttaaagtgaaaatccattgaattaaaactcatattagtgttcaaattgaccaactaagatcgaggatccacaatattccacagtaaattgagaagggttagaaatgaatagtgtgtggttttggggttgagtcctttaaatccgatttcgaccacatccaaccagtgattagccctggaattgacggtcagggagtaccccaaattttgacctgtaagatatgtgacgactaatgaaatcttgttatatttctcaagttggaatatatttgagcaatgagcatgatggtatactatttgtgaacgataattttcatgataaatgcaaactgttttctgctacaactcaaccatttcaattttagagttgacttgcacctcaactcaactcccttctttctcggcatggatgggtcatcttccagtggttcaagaatctttggtcggtcaataaagtatgagaaatcatatcttttaattgttttcttaccgctaatttattagttttgttaaaaatattagcgaaaagatttgaactaaaaacatcttggctctctctttttcatttaccaattagtctttcattatcaagccttcaaacttttaaatgaatcttattaccttaaattaaaaaattaatttccttaactccttaccaagaaaataccatgagctcaaaaagaaaaaaatcttcagccaaactaattcatcattaaaagctaacttaaagctaataaaaattaatagagaatattttaggtcattaaaaggaatattttaggttaagaattaacaatttaactcctctagcaaaaataaaattacgtgaatcttgcgttaagcaatattgttgaaaaaaataataagttgtatttctacaaattcgttatttgttaggtgtatttatcaattatctatttttctcatcaattattgatgtgtaacattatattgtttttacaacactctccaaattcttgaaaaaaaagacaagactctccaaatcaactctttaatactatataaagaaaatattaaataacatatgatacgtttaatattgtagcaacataaaatgtatttgatttttcatttaaaaaataagaaaatattatataagaatttaaaatattcatgatgaattaagcacatgtttaattcatttaatattagaaaatatttcctaattttaataatttccaaaaataaaaataaataaactattattatttttacgaaaacaatcccaactaaagttttatcaggatattaattttaccttttctcgtaaaggagtcatatattttaaccatatacttaatgaaaaattgtttttctctatattcaattctttttaatggtatatttaactacatatcaaagtcataacataactaacaatagttaattcaagtgattatgtgtctgatccctcaggcaagattttagatttaaattttgtaaataaaaaaaaatataattaagaaaaaaattataataaaagtagtatatcagattcctaacaaagattaatcacagaactaataaataatctgcgtcattcagtatcatgattacccattaaaaaaaactataacataaatcaagtgtcattttttatgagaacttgtataagatatggttctaaaattctgatggtcttccattaatgcccgttgaatataataatgatgcaattaatatattcagtataaatatatcaatggagaatcatagttgatcgaggaaccaccttata

SEQ ID NO: 1569 - DNA, 1233 bp, Glycine max
  Soy_ogl_1747 Gm06:587101..588333 Cluster 6
ggaacattttcaaagttttgtggtggatattttttttaaaaaaaattatgaaaaagaaattaagaaaaaagaatggattgcgttactctaaaaaattaaaaccaatttttataatatattaaaatcaatttatacatttaccttttatagaagttctattatttaagtttgttcaaaaattaaagtgtataaattgattttaatttttgaaaaatcttttttttatcttataagtatttatagaaaaaattattcatataaacatttaaggatttagggatgcgatgtaaacactacaccttttgcgttcctcgtctacaatttaaggtattccattttttcttttatattttttatgatatttttaaaggctttttattttttatgatattaacttattaaggttccacaattttcatacttgttgtgctttagttttgtccacatgtatttaaaaggtataacttaataatacacattaaatttataatttttaagaaaagaaacacttggattcaacccctaaccaagtttcgaaccaagaaaattaattctataaccgatttgtaaaaatattttagaattctattatagaactaaagattctaatgaggaacaaatctacgccaaagactatgaaataattgtctcattagttaaacttttttacttaaatatattaaataattaggattgtccacgtaaattattttttaagaaaaaatgcaaaaattattagagataaaaaaataaattaatactaattttattcactttataattttaaattgatagaaacatgagtgttttgattttttttttatgataagattgtgcatttgtaaaagtttataatatttttttctctataaaatatcattgattattttttactaccactagaaaagttttcttgatccgtcgctgatcctaattatgattattaaaaaaaagagttttgtgcacgtgttttatgctgtttattttatccggtgtccacggtttgacatatgataggatcgacttcaattttaaaatacacctacttcaacactcttgtggcatgtacaacttagaactctaaaaaatataaataaaaatgtacaactgagtgggggagacacataacaaaacaagaaagaagctccatagtaagtgctagattggagtttattttcaatttgttggaaatattttaagatttattataagattaataacagtagaatacac

SEQ ID NO: 1570 - DNA, 1400 bp, Glycine max
  Soy_ogl_3504 Gm10:42924801..42926200 Cluster 6
tagatttaaatttcgttgttaatataagaattttgtttgataaataatttataaatattcatgtaagtgtttagtgtaacttgaagtattttctgatcttaataagtttcaaaacctaaattcttttaaactttttatgttaaaaaaatatttgttttaataaatgtttaaattgaagtccaatttaaatttgtaacttgtgtttacataaacaatccaagtcttagcttatataaaactgaatctttagtcaattttaacatataaacatatttctcagctgactcttttgatggtaactaaacatattacgaaattaaatttattttttaaactgaattagaaacaccttaaacaaaagatcaaacatagccttagtcttcccacataaactttttaattaattttagtttttactgtataaaattgtatattgaacctaaaaattaaataaaaaaaattaaactgaatcaaaaagtgtatgtgtaaagactaaaataaggtaaaaaaatatatacagaatgagtaatttttagatgtaaggactaaagcataatgtagtaaaaaaaagagtaaagcataaaaattatgcatgtatagaaatcaaataaatatttaaaacatactattttttaaatcaactttttattattgacaaaaaaaatattaaaaattataagttttatgagtattttagtttgaaaattttaaaaaatgacctggtttttaaaagttttagtctgatttgatttcagtttattttaatttacaattctattatcccgatgtaagtctggaattggctgggtctcaattaataaattgttggcgattgctatatacgttattctttattactactaatatactgccctttctatttattttttctttccaaaatactagaacacaattaatgagaggaaaagcgtggagcatcaagaggaggagtgatcagtgggtatctgctggtagtgattaggttataattaattaagctatatagtattaaaacttataagttattgtttgttaagtttaattataaatgaaatgaaagttttcggatttaattaattataagttgtgttcattcgtgcatataataaatttcatagtaaatctatccgtacttataaattgaaataagtggggaataatatatagcatcatacttttaatatatttttattagttaaaatttattgagacacatgaaatggaaatattttttaataaatttcacttgtaattctataagttttaataaataatttataagaataaattgttattatttctgtcaaaataaaagtgaaagttttgttgtgacttgtgagagacagtgacacaacatgagggaaatttcctttgataaggttcaacggagcaaaatcatg

SEQ ID NO: 1571 - DNA, 1600 bp, Glycine max
  Soy_ogl_4929 Gm15:8913901..8915500 Cluster 6
attttttatttatatatgaattcagaagagcatttccaaattctatggtcctaatatcttgttcaatcgagatatgtcttggaagacataagttggatgtcctaacctatactagctagtatgctagacaatacgatagacactgtccgtcaagaatgaatttcatgctgcaagttgcaagattatttttttacagaagcttaggtatctcctttttgtgtctaagaattgaagcaacatagaagcttattcttaacgtgcttacgaaatggacgtttccaatttatctgaaacatttaggaaatggagcattaagattaattcttaattataatcttctcttatgaaatcactgatattattgtctttatctccattaacacattatcgtcgttgtcaatattgttattatattttcaccatgtaataacaatgaagacaagattagttttaaaggtttttcattccatcataatttttttaattgtgatttaatttttataattaagagtttatctgaaaattgtgagaatatttataaacgttttaatacagtgaatgacattgtcaatttttttaatccaagtgatactaatttgaacaaaatcttgaacggtaaacttacactttctttttccatttctcatcgatattctcttttgaaaacaattttgttcttaatatagttaaatattaatatatgtacacttttttcaatagatatttagatttttgttcctcacaatctcacattatgggagactactactttcacttaacctatcctccgttaaaaacttttacaatattatgaggaatggaactttttgcattaaaaacaaacaaatatgatgtacgtgaaatcgtgaatagctaatagtagtacattatataaggcgtgcaaataaagttactcaaaagaaagttttagatgacttgagtttataaggtaaatcatattcttaattagttaatcttgacaagcgcgagacacttccctttttagttgattagtaactccgacgtctaaaatcacctgcaaaaaagaataaacaattctttttgaggaccttgcaaaaaaaacaattgttttttagggggttcatatccttgaaaagaaaatccgaactccattgaaacatctttgtacatattggaatgcaacggaaaaatcaaactaatttattgttacatttgtttaacagaattagatattttgtcaaagaatttttccttaacgtttcttgggagtatatcagtaacagatataagtaaattcagtgagttttttttgttttttggtgaatgaattaaattcatcgagtttacttcaactttgagtctcacagaaattaagctgcaataatgcatgaatcgtcctttcatcgttgttaagaggtgtttgatttataggcatccatctaattttagtatttaaaatgtttaaatactttggattagctgtacaaataagatatttacatttaatacacgaatgcgatcgagataataagaaaatcataaatgttcatcatctgacatttttattgtttgtacccattggtacattttaaaatttacaagtacaagttttcacata

SEQ ID NO: 1572 - DNA, 1536 bp, Glycine max
  Soy_ogl_5612 Gm17:9643969..9645504 Cluster 6
gaatgactgagtatttcatgttaaatgttttaaatatattttatttacttaccggattacaatgaattgagagataggcatgatatataaactagttataactacctttagttcatatgacaatttataataacagaatttgtgatataattatgtatttttcaataaaaaatataattatatattttaacatataaatcaatcaaatcaatattatttttgaagattcatccctttatcatttttttctttccatagtcgtcttttatcctctggcttgtttgaattaaaaatggatgaaataattgatatgattatgcataagagtgattatgaaattatataaagattatttttattttatttttgaacgtcataacttaaaattattttatatgcaaatagttacgcataaattattatgtgtgcaattagttttttattaattgtatatgttaattaaacaattgatttattaataatattaacgttaataataagtatgcagtaaaaaatttatcgtacatgtataattattataattaactgccaatcatttttattattataattgtaattataaaaattctgtttgcaattaattattatatacaactttcatgttttttaatttcaaacgaattttctttaaaaaaattcaaataaatttattgcttagaacttttgaagatgccacgtgtaaatattctttttgaaaaatagtttcatattatataatattttcatatgtatatagcattgatacagatatccaagagtaaattatggattgtatttttgtcaaaactcagtcgaatctcataagttggttggatcctgtagaaagtattcaaaataaaattcctaccactagtactcccgggctgtaatatttttcagaagtaataaaatttcttaaaagtcatgcatgactcatgataatatcttaaatttagaataaagcttttaattatagttctctaaatttaaaattaatttttttaatcctataatttagagagagaaaaaaactattttagtatactttgtaaagaaaacaccaaaatatggttggatgtttgaatataagaatacaaaattaaaaaaacaaagttattattgtaagtaatttgtaatccgttagtcacctaataacatatttaatcaattcacatatattttattttaatgatatatttttaagtaacagatgaatcccttaaataatctttaaattgcaagaaaattatttttttactcatataagcaaccgttggttatagaaataatcaaaacttaattttacacgatctaatatgacaagtagatcgatcatctccaatgataaaaaaaaaaaataagtaacggtgtctaaaaaaataaacaatccattaaacaaaccaatgttagagatgctctaaataaaacgtgtaatgacatttgggtagaatgacttaaataaatttcttctttttaattaaaagaccaaagagattaattttaaatttgaggaataaaaaataaacttatctcaaa

SEQ ID NO: 1573 - DNA, 1100 bp, Glycine max
  Soy_ogl_5771 Gm17:39132601..39133700 Cluster 6
ttaaaagactattttagtagtaatcttaaagacttatatagtggcatgttaaatatttaaaaaattattttgtttatcaaaattttagataactaatgtaatagagcatataattttagaggattaacttgagagtttattcttaaaagcagctttgtatttggcttctatttttcctaacttggaactatatgtattctctactagtgaggctaattcagtaattctttgaatgaaaattttcatatataatgtttaaactcaaaactttacttaaagaaaataaacatgcaacattttatttaaccacttgtatgttgtttttctcattctttctattcccatgttaagtatatacgttaatttttcctgagactaaaagttttaaaacccattactaaggttaatttctgataagagtaaatgtactgaaacccacatagaatccagttgttttagatttttatataaatgattttgagaaaatgaaattgaaaaataatttgtatttaagaattatatttaaaaatgagtttagaagaattaatttttgtttagatgattgagcaaaattactttttaatcacaaatataaatatgttttaagtccaatatctaaaatacatcaagagaaattttattttttaatattttatttaccatatgatttatttaaatcaaaaccaattctgtaggaattgattattttggccaccatgaatttagaaggggaccaaccaggctaccaatcatttactttcactgatacaatttccttctaaaacattcattctcacataattttatttttttaaaaaataaaagttaaataaaatttgataacattcataaaaaatgaagcattaattaaatatatttttaaattttctcaaaacaactattacaatcatagtgtgtctaaaagaagttgttttgatcttaaaataaacaccttcaagcagtactcttgcttagacaaacaagattcacatattacttgtcaaagatatctcttatttgcaaatgaatattgaaactaacttataagtatttgataaatgagtttatgtcattaattgttaacattttctctaacagaa

SEQ ID NO: 1574 - DNA, 1720 bp, Glycine max
  Soy_ogl_6557 Gm19:44263181..44264900 Cluster 6
ggtacactggctttgtgtactacaattcttgggagccatgtttatacttgttggaagactaactctgtgtttagtctatgatttgcacaaatttcaagtcagatgaatgaaaaagaaaaggtgtacgagtgcatggattaagatgaatgtttgtttgagttgttttaatggaaattcaaatatataataagtataaatttaaaatttcatttaattgaactaaacatcaatccatcttctctgttccttttacgcttactgtttgggaaggtgagactttccatttacaatattttcaaccaattttgaaacacactataaaaaatttcaaacaatataattggactatacattcagtcatttaaattttccactttaattttatttatttatcatgaataaagctttaaagtctatgttgaggtggttagtaaacaagaattaatatttttttccatgtataaaatgtgtttaaaatgttagaaaccaaaatcttatgtaaattactcaaactccttatcattagatggaccctagtagtttttatatataaggtttaagatttaatattgtgaacataaacattatgcaatataggtaagaaatataattagaaagaaaagaaagaaaaaaaaatcacaaatagtctgtttaaataaagagtctttttatcttataaatagaaaaaatgttattaaaaagaaatcttataaaaaagatcaaccaaaatttataatagaaattatttttaattattgtaaaagattttgtttagttttcattctttaaaaaaaataaagtaaatacttttagtccttatcatcatatttgattaattgcttatgtatcaaatagaaggacacagtcattatagttaattagtacctgataatgtacatgtattgtgatgtcaagacatgatttctataattaactaaagctctaaaataaatgatgtttatttttcttaagatgaaaatggtagggatgaaaaataatgagtgcaaattttagatggatgaaaactaaagattttttttttatatagaaaccaaaacaaaaattcactaaatttactgtaaaaataattatttaaaattttagaggtataaaatctaaataaaaaatgttttatagatgaaatcaaaatttgctcaattaatttacataatcacagacatagtttaaactattaattagaaatattcaaaagaaattatcattttgggagtgtaccagaagatttgtatcttactaattagaaaaggaaattgcatatcattaatgcttttatattgactttattcatatttttactaaaggccagcaccgcttttcatatttttaaacatcttcaccaaatcatgcgatcattttagtggctggtattcgatattataaacaatgagtggattatatgtaaacccagataaggctgcaggtcaaattcaaacaaaatattgctaatgaagttacgcaatatgatttgctaattaatgaatctattagacctgttcaagctcttcacagttgatttataatcaggccatgatactgatgttttttaatttgatatatcgtcaaaactcaattatttaggctacagccccatcaattactcattgctacattttgccattttggtactacaaaattcagttcttttcttcctttgagacttttgtgcctgcatgatttgcgtgacgcaaccaataaagga

SEQ ID NO: 1575 - DNA, 1310 bp, Glycine max
  Soy_ogl_4681 Gm14:5453901..5455210 Cluster 6
attaaaaattataaaagtgtacaagtcttactctttatttaataaatcttatttataattttgtaatttttttataatttttatttaataaaagagtgtgtgctgagagatgttactgcttactagttctagtactgctattattaatatcgaagttgatttcaacataggttgaaaattatccgtatatatacatggtatcaagtcaatcactaataataaaatattaaagaaaattttttagtgttcatgacaatctagtagaattttttttagtaaaatatatatgcgatctttaaaaaaaaatcactaaattatcaaattatgctattcaaaactcatagttgacaatgatcgagtctgagtagagcacatacacacagataaactcataaagtttataatcgatcatatactacacgacgctattcaacatgcatacatctcatattagataaattcataaattttataatcgaccatatatatttcacaacgctatttgacgcatacatcattatccgttgcattaaatggttgaacacattgtaattatagatacagtttggaaaatgatgtgccaccatttgacgatgccccttcacagatcaaatgccatgcttagcaggcgaaaaaatagccttttaatttgtctcatcgataaaagtcataaactattgaattttctatcgagggtcttgtatttgaagttaattctcattagtgttgtattcatgaatcaacattattatttaagtgaatcttttattttgaataaatagctaaaatgaacagaattatatattttaaatatcattaattaatattaatggtagaaataaactaacgcggtttttttttatcagccaaataaaacctcaaataccatagttggcacaagagatgtccaccccaaatacaaggaatagaacaagaaagaaaacaaaaaagcctccagacataaagtataaccatagccttcatcaaaccacgcggtttttttttttttttgacagaactaacgaattgtttctcgataattacttatagaagataaaaataagaacaaaaaatgagattagttaacttctctatgacctaaagtttatttataatatgcagtttgtagttttgaggcacttgaactttgtactttcgtggcatacaaagtttggagctagttgtgctttgaacttgttttaatcatattaatgatctattttcctttttttttttggagaagttaatataagagaggttctacacagcagtttttgcataaactaatgttatctatggagaagttttga

SEQ ID NO: 1576 - DNA, 1519 bp, Glycine max
  Soy_ogl_5926 Gm18:4474082..4475600 Cluster 6
tattttttaattgtattttttattcacaaaatttaaatttggggttttccttaaaatgtgagtctcgttgtactcacattaacaacttgttaataacttttatattagtttaataatggatatttttgtagaaataaattttatttttaagcttttatgggaaattatttattaatttatttgaattatttttaaaaaaatgtttttatggcctttaaattttttcataagataaatttctttataacaagtcaaattaaatatgtcgagaaatttttaataaaaagtaacacactaatatataaaaaaaaaaactttggagattgattattttcaatattttaagtcgatttcatgagtggatgtaaaaccaaccaatacataaagtaaatactttttaggttgatttcataattaatgcagaaagtaatttttttagatcaattttactattgtagccacaactgactttctacattagttgtgaaaataattgttgaacaaagtctttttttatatatatataaaaataaagctacaattatattgcctcctaaatatacaatattacaattaaaaaataataaataaaaaactataaaaaataaaacaatttcatttcattgattttatatatataatacatctcgtatatcaaaacgtaagtgtaattttcctattacaagtttacaactaaatataagtgtaatttgactgtttacatgagccaaatgtgagaaaatttcgattccttttattttcttctgatccaataaattttatttccctctaaggtatttttccttccctttatgttccacatttctttattatattaatacatgtctgacaaaaactatcaccatcattttgtactctctaacacccatttttaagtggggttttttttttttttgttaaatccagtagaaaataatgggtgttgtcatgttggaatgtataaggtagtggtggtagctttattagatatatatgaattaatattacttgagtggaagatttataataaaagaaaaaaaaaagaggaaaggaaaactgccttcatagaagaattgaatttctattgaataacaaaacaaaaagaaaaagaatagtcaaatttatagtatttggtccatgtaactagaaaaaagagaagttaagttcatgatctcttattgttgtaatattagaccatgataataatgtttggagtcctcaaacaaaatacacattcatctataggtgaaaaataagaaggttaagtaggatttgaaacacggaaagagattagggtttgaaaaagtcataattagagagaaatagaaaaggttatctcagaaaggagcgaagaaagtgcatgtataaagaacatcttatgagactagggtttgaaagatgaacacattgaaaacaaaaaagtttcagaaaaattaaaatgatataaagaaaataaaaaaaacgaactcgtgaaggtatatgtaaagttgaaaatatttttctcgggacgttggaatag

SEQ ID NO: 1577 - DNA, 1647 bp, Glycine max
  Soy_ogl_4000 Gm12:4692754..4694400 Cluster 6
aaacaaaattttatttcttcaaaattaaaaatatttttttaatttctataaaatgagtgagttttgattttggtcaattagggatcaaatgttgatatagtaacacaaacattagtggtatccatctagagtgattgtttgaccttctgctacatataaacagttgagaatggatttcaaatttttgaagaatgaaagtcaatgaaaaaatatagggattaaaattaaaacttacttattttaaccaaaaacttatttaagttttatttttttgtgaaggattaacttttgaagaaacaaacacgagagaatcaaaggatttcaagttcagaaaataaatgaataaatgaaaaattaggaagaacaacagaaaaaataaaataaaaaaatcttaattaagaattgaaaaaaatagactttttaactagaaaaaaatatttttaattagttaaaaagtgttattcttttttagagacaacaagtatcatatgctgtttgactcaaattaaactctctttaaatatgtatttaatataatactaccgctggtcgttattataagtaataattatagtgcattttttcgcacttattgttacttataataaaaataaaaaatgatcgcgtacatcaataaaaagtttaaatttaatatatctaattaagttaaaataatttttatgtaaattaattcactcgttctatgtttgaaaagtgcttaaaaacacactcttaaatgcagttaattgattagaaattttgtccactcaaatttttcctctaaaatgtccagtacgtagacgtaaagcatttaaattgtcattcctttgcaaaggtgaacttattttcacttttgtatgaaaacaatatcagctcattagttattttaaaaaacattaatgaaaacgataatgtgttgaccatggatatctatctatatatataattgaagattcaatccatcccatgccacaaatacaatgaaaaagaaaggcagaagcttttattttaaactagattttgttatggatctaagggaaacaccatcattatattagagttgtgctttagggatccactcttatatagggctaaactaagaaaggaatattgaagaaaaaaaaacgaaaaggaatttatgttaagaagtgtcaaatgtcatgaaaatttgcaatcgaaatctttaaagttagggcacacgcaaaaaaggaaatttattatacagcaaactaagtaaaacttttcattttccttgatgaaaaataaatataaatggtagttatttttattttttaaagaaatatataatactagtttttttttttaaaaaaaagctaaatatattatcttaagtaattataaacatttatgaatatttactacccaagacataaagtcttaaatatataattacattaaatattaaaacaaaaaaatgttatatataagaatctcattcacctcaaatataattatctttcacataagataattgtagtttcatacaaacaaagaaacatttatggtcatatcatacatgatatacctttcatacaacagtaaattttgtaaatgataaacttagtttgcatttctactaataaattttactcatagaataactttaatttatgtcatataaataaa

SEQ ID NO: 1578 - DNA, 1300 bp, Glycine max
  Soy_ogl_4172 Gm13:20532901..20534200 Cluster 6
ttaaatttatattaattattacactattggataattttaatcataatttgattttaaaatctaccgttaaattaaaaattcccatgtatttaatttatataaatgtcactctttataataaatggtaataaatggtcatttattataaatcttttagtgttatatatataagttaaatttaatatattaatttaaaatttaagtttaatatttatatttggcttttggaaagaaaatgacatggtgagataattttatgattggacaacatactcttgaaatttacttgtctaattcatttttatacggatcacataataactgtagcaatttattaactatcgcttttcaacttatttgcataattataaatttataattaaacatgatagttttaatcaaccttttgctatatttaaaatgatggaaaatatgaaaaataccaaaatgaaatgatatatgatgagattcaatcgatagtaaataaaatttgataaaaattatttttaccaaaaattaaacttgtatataatattttattatctgaataatttaaaacgacaataaataaaataaaattagacaaattcaaatacatttcatgtgcatctcttatttccattcctcgaactttaaagatatgaaatggaatcatacttttttttttttcctgattctattataaaaacatctaaataaaactttaacttcaccttatttcatccatcattaaatacttaagaataatttttaaagttttagagtaattgaacaattttctttttactatttattgagcatctttataataaccaatataccaaaaactaaggttgtgttcagtaaagacggggatatgattgagaagagaaaaataacaattgttggtttacacatgagataagtaaaaaagtttagtttaaatttgatcggctccattatgataacttttgtcttctaataataaatatactattttacccttatgaattatcttcttttgattttttttttttaagtatcatgcaactgttgaggacaatattatattttaaatagttcattcaattattttcactttatttacaaaacatattattttatttctacactatttcttttcaaattatttttctcctatttttatcttcatttctctcttctaaatcaagcacaacacacaaaaaaatttaactagtactgcccgaacctaaacataagtaaagatgattaattttaagttgattatgaaagttggttaatgtaatttacttatattaattatatttagaaaataaac

SEQ ID NO: 1579 - DNA, 1337 bp, Glycine max
  Soy_ogl_17 Gm01:1269858..1271194 Cluster 6
cgtgcatcgatgtatgttttcagtgttcacacttcacacaaacctaatacaatcatttaataaattgttaagagcgtttccctatgttaattcaagattcatgttaacttgaattttgtttcatacatatgacaattcctaaaactatttaaaagagtagtaattttactgtgtcccataatatatttgtcgtgtaaaaagaaaaaaaatctaaaaaattattactttaatttttcaatataatattaattgcttcttcacttataaaattaacgatgatcaataaaaattaaaaataaattaacaatgataaaattaattttataaaaattttattctctcatctaatttattaatttttttatgtataaaataacttacaatgataattataatgaaacagagaaaataataaaatataaagtgtgtttttaatctctaattaagtaatctgacgtgatcaactagtccaaaaaaaatgagtaattaatgcactacattgttttgaaatatcttctaatgtaacatcattttaacccacaatatgcaaaatttttgttttatgttgtctcttagcgaaatcgatcaatagcaataattaccctatgtaatattggctaggctggagatagctaccaaaaatcaagctactagtgtcgactttggccgagacaaatatgaaattaatgtcagtttaattagggcgtttgtttaaaaactaaattttttaattagatgcatcattttagtattctagaaccatttgcagttcggtttggttcaagagaacttgctgtttgtttcagtctagtatgatttcaacaatcctagtaaccgctattttatgtgtttcttgtagtgattatagccctcacttattgtagtatgacaaatcttaattatatgacaaacctaacaaaaaaagtgagaaaatttaatcttcatcatacaatcatacataaatgattatttaattaaattttaatcttaattacatagatttaaattatttgattaactctttcctcacctcttataagcttcttttatatatgtgtatgtttttcttatcaataatattttgaatttatttcaatttctacccacatttgtctaacatttcttaaaataatcgtaacatttcgattaaatgaattgtcttttaaccttacgcaatctaattaaccaccatgcttatcgttcttctatgcgctcacgtacggttcacacaaacctagtacaacatataataagaaactagagtaccaatataaaggtgtttccttcctctgttaattaattcaatccattatgaattccccgaaatcagcattact

SEQ ID NO: 1580 - DNA, 1465 bp, Glycine max
  Soy_ogl_1156 Gm04:1106177..1107641 Cluster 6
gtttgaagagtgaatatcattttggagagataccccggttgtagtatatattttgcaagtcataaaatttccgttgcctcagttgtcttcattagtaaactgatccaattttgtatttggggcaaactatggtcttaaaagaaaaaaggggaattgatttagaatcagagggagaacgtggaaaatgccaaagaaggtgatcaaccccctttccaacaagacttacggattattaaaccagttgatgtgagtaagaggtttgattaaaggcgtttaggttacgatcccaaacgggctattcaagcaaagtatataaacatcaagaaaatgtcgacagcggcctagtaattaaaaatgacaaaatttattattattatttttttaatgcagaaatcaatcgagatttaaattttatatcacacaattaagagatatgaatcactatcatttatgtcaatcattattaactacattttctcacttatttaacttttaagatgaagtatcaagtagaaaatatttttagggtgaaaaaaaaataatgtgaggcatttgcaaaatatctataataagtatttaaaaaagttattgtaatttataggtttaatcatccttttagttcttatttatagctgtaacaaattttatttataattataatatttattttaaaaaatatttaatattatttaattttgttaatcccacacaaaacataagttttctttacaaataaaccttcgttggaatatgatataaaaaatcattgaaaataattttttaattaaatgaagaatattttagaattaatctcatattaaatataataaaattagttaatattatttatgtttgagaccaaaatatatgattttttttaacttatacttaagaccaaagtaataacaacattttatcgaacacgatattatatttatcttaaaatataccttaactataattatatatttctttgattattaattatatgtaatgttgagattaacatactatgtgaattagttgggttgaccttactctaagaagtaagcaagcttgagccctctcctgtggcagttcttgtctagcttctttggtagtagatcaaactgtataactagttataaagactgaagtctagacttttttatttaattgaatttcaaatcaatagatttattgatttgaaattcaattaaataaaaaaggctacccttccatatctattgagtcttggttgggttaatattgagtttacaatattcactatatcacatttcaatcttaataagaacacaggtaaattgattctcacctgtccaatagggagaaagagtaaacatacataatgagtataatatattttaaagaataatacagttattatattcatacaccttattacaaaagatgaataactatattattttttatataatttttttatttattttttgaataaaga

SEQ ID NO: 1581 - DNA, 1073 bp, Glycine max
  Soy_ogl_2153 Gm07:3233228..3234300 Cluster 6
gtcctcaatatttcaaacaaataacgataatagttactaaagaatagtggttcgaaatgaatattttcctaaattaaaatgtgaaacttttataaaataatttaatatttatgaatggatcgacgagaggaggaaaaaatgtatagtttccttcatgtgaggttaaaactttcaaatgtatcattgggtttgatatttcttatattgactttgaatattagaatcaatttagaactcgtattatattagtggtaaatataatttattttgttgataaattacttttataaatgattaccaacacgtgaaaaaatataatatttacaaatgaatattataattacagacttaaagttgaatttttttagattaaattattaatttaggtcttctaatatcattaatttagccttctgaacattatgtaatatttgagcatgggaagtcataaaaattatccttattttgatgcatgttatattgttggattaacgtggtccaagatggaaatggcttgttaatgcagcccattttcctttctttcattgcctaacggctaaaaagacttgggctcagggcctaccctctttttctgttaggtcaggtgcactactaaattgaataaaccgtgaaaaaagattatttttttttgtcaaatgtctaaaaggtaaatgtataacattacgaatttatttggataatttttcaataattactcattgtaaaataaaataagaataaaaagtaaaacaattttttcataaattaaaatcaagttaaaataatcttttagaaaaactaattgagagtgttcctacaaattaatttatatataaactaaattcaactaattgagggtgttcctataaattaatttatacgtaaactaaatttaactaattgagagtgttcttgcactctcatgttgcttcctgcactctttctaaaatattttcttaaaaattttattcaaacaaaacctaccttactattgtcaacatgggaaatggaccaaaacatctgtacttggacatttcttttattgggacctggacttcataggttattggagg

SEQ ID NO: 1582 - DNA, 1500 bp, Glycine max
  Soy_ogl_5225 Gm16:1137501..1139000 Cluster 6
tccaagatgcccaggaatcttaattcttaaacatataaacacagcttaaataatgtatttgtaattgaatatgaaaattcatattcatttcaatatgtagacattacaacatccacagaatctttaataactttttgctcttatactaaataagggatgacaaaattttcctgcattgcagataaaatatggttatatgtagacatattgaaaatacttagaaatttaggatttccgcattactatcaacttagttttgtatattctaacttttttggttgttagggaagctcaatcccatatttttacataccctaaaatgtcaatttagtgcatcaacagatttataagagcacacagtttaaattttccagttgaaaataaacctaaattctcaagtagaggttgagagctatggatattttttaatattgtcttatgtgagaatttttggaagggaataaagctttctaaattatatttcctctgttcatatctttagaaaattttagccacaagctatatatcaacttattagatctttcctactgatataggagttgtctatcaaacttttttggtaaatttacacatttagcttgcttaattaactaacggtgaaatgcaacaaaatgctagctattgatattttttttccattcagattaatttcaaataagcttcctgtgaaaatttaattatttatgaacttttttttaccctttcgcggtggagcgaatctcctttcatgaattttgttggcatagctttctacaaagaaaattgatgggaaaaaggatagctttacattgatttgaagtattcacaatcttttcatagcagtcgtcttcaaaagttaaaacagtcaaattcatctgtaaaagttaatgcaaattctgttacttttccattttgatttctcctctttgaacattggataaatgtattactacttacggggataatctatgaatgttctattgacaattgctacaaattcagcaacttgggaaaataattttttagtaccaaataatagtaacgaccttttatgtgcttagagttatccacgtctatgctcatgcattataccaacttttatatagaaagaaaaaaaaaagcataactactaataatcctttttaatggagtatctgaagtttcaactcggatacgttttatttaaaaatatttgtgtatttttatatttctcgctgagctaataaggcagttgatctccttgccaaatgggtgtttgagcaatttattattggagtgctcctcctgatggtgctttatatatacgtcttgacaaaggatagctatttgtagttttttctttgccttttatctctaaaaatgttttttttatttaaattttataaatctttatataattattaggcttaaatatatttttaatctctataattttgtgtgtgtgttttttttttaatttttcatgcttaaaaaattatttttttattgttaattcttaca

SEQ ID NO: 1583 - DNA, 1500 bp, Glycine max
  Soy_ogl_6828 Gm20:38051401..38052900 Cluster 6
tgcattttagttatataatatattttctgcgcctgagacaatgggtatcctctggacaaatgataattttgttcaatttgcaagcatccttagcttagcatgatgggattaacttccaaagtgttcggaaatataagatcggtatagtagtgagagggaggctaaagggtaaaggaagaggtagcatgtttgaatctttccactaacatttcttataaaatcatgttttcatagtgtaagaggggcataaaaaaatacataacataaacctgattctattatttattttgtgaacagaattttttgacacatttcttacacaatgagaacatgttttggttgatcaaatacttaatagaaatgtgattttgttgtatttttcttaacaaaaattcatttttgttgtgctaaacttctatcatttttttccaattaattatagatatatgtttgttaaagtaatcaaattaatgatgatataattatctttttttaaaattgaaattaaattaagaaaaaattaacttttttaaaagtagttagattatatatattgagaaaaaaagttatgcaccgatagtaatcatacaaaataattttttttttacattattagtgcataaatattaaactcataaaaattatatttttttaattagatagaaattatcatttataaaaataattaaattaattatcatacgaattacctttattaataataattaaattcattttgttattaatttatatcataattaatttgtttataattaaaaagggtaacttgtgttatcataattaatttgattactattaaaaaaaaggtaacatggatggtaattaagatttgtatcataattaattcaaaaatgattaaaaagataacttttttttaattaagaacaactttttttaaaaatttaacatacaaaaacgtattttagtttttagtttaaaaaagtattttagttaaataagagggagtgcaaaatatacacaaggaaaatttccgttgtgtaatgaagggtattatgagaatcgtatttttaaagcacgtgggaatgtaaatagtaaaagtggaagtgaatattgtaactccctaaacacaggatgaacattagtcctctttagcccacttacatagaaaacccataagcgcagcactattcattgtgcaaagcccacgaacccagagatttggagatatagaaaaatagaactgccagccagcaacacacaggtcgcctccaaattttttgagtgggagcaatatttgtaactgtaaatgtgcctgtgccatttgcaatcttgcactagttgtacgaagatgccctctgttccctttcacaagtcacaaccttgttatttctcgattgccccatatagaacaaaggaaaagagtgagttaatttcttgcatcctgatctagagtgttagacatagccacataggagtgaggcctagttccaccaaaaccactcatgcatacaggtcctt

(The sequence listing continues in the following parts.)

The invention claimed is:

1. A soybean plant, soybean plant part, or soybean plant cell comprising a recombinant nucleic acid molecule, said recombinant nucleic acid molecule comprising:
   a nongenic nucleic acid molecule of at least 1 Kb, wherein
   a. the level of methylation of said nongenic nucleic acid molecule is 1% or less;
   b. the nongenic nucleic acid molecule shares less than 40% sequence identity with any other nucleic acid molecules contained in the soybean genome;
   c. the nongenic nucleic acid molecule is located within a 40 Kb region of a known or predicted expressive soybean coding nucleic acid molecule; and
   d. the nongenic nucleic acid molecule exhibits a recombination frequency within the soybean genome of greater than 0.01574 cM/Mb, wherein said nongenic nucleic acid molecule has at least 95% sequence identity with a nongenic nucleic acid molecule selected from the group consisting of
      SEQ ID NO:639, identified as soy_OGL_1423,
      SEQ ID NO:137, identified as soy_OGL_1434,
      SEQ ID NO:76, identified as soy_OGL_4625,
      SEQ ID NO:440, identified as soy_OGL_6362,
      SEQ ID NO:43, identified as soy_OGL_308,
      SEQ ID NO:566, identified as soy_OGL_307,
      SEQ ID NO:4236, identified as soy_OGL_310,
      SEQ ID NO:47, identified as soy_OGL_684,
      SEQ ID NO:2101, identified as soy_OGL_682, and
      SEQ ID NO:48, identified as soy_OGL_685; and
   a DNA of interest, wherein the DNA of interest is inserted into said nongenic nucleic acid molecule to produce said recombinant nucleic acid molecule.

2. The soybean plant, soybean plant part, or soybean plant cell of claim 1 wherein said DNA of interest is inserted within 2 Kb, 1.75 Kb, 1.5 Kb, 1.25 Kb, 1.0 Kb, 0.75 Kb, 0.5 Kb, or 0.25 Kb of a zinc finger target site.

3. The soybean plant, soybean plant part, or soybean plant cell of claim 1, wherein said DNA of interest is inserted between a pair of zinc finger target sites.

4. The soybean plant, soybean plant part, or soybean plant cell of claim 1, wherein said DNA of interest comprises a gene expression cassette comprising an insecticidal resistance gene, herbicide tolerance gene, nitrogen use efficiency gene, water use efficiency gene, nutritional quality gene, DNA binding gene, and selectable marker gene.

5. The soybean plant, soybean plant part, or soybean plant cell of claim 1, wherein said DNA of interest comprises two or more gene expression cassettes.

6. The soybean plant, soybean plant part, or soybean plant cell of claim 1, wherein two or more of said nongenic nucleic acid molecules each comprise an inserted DNA of interest to produce two or more recombinant nucleic acid molecules wherein the two or more recombinant nucleic acid molecules are located on a same chromosome.

7. The soybean plant, soybean plant part, or soybean plant cell of claim 1, wherein said DNA of interest is modified during insertion of said DNA of interest into said nongenic nucleic acid molecule.

8. The soybean plant, soybean plant part, or soybean plant cell of claim 1 wherein the nongenic soybean genomic nucleic acid molecule has at least 95% sequence identity with a nucleic acid molecule selected from the group consisting of
   SEQ ID NO:639, identified as soy_OGL_1423,
   SEQ ID NO:137, identified as soy_OGL_1434,
   SEQ ID NO:76, identified as soy_OGL_4625,
   SEQ ID NO:440, identified as soy_OGL_6362,
   SEQ ID NO:43, identified as soy_OGL_308,
   SEQ ID NO:566, identified as soy_OGL_307, and
   SEQ ID NO:4236, identified as soy_OGL_310.

9. The soybean plant, soybean plant part, or soybean plant cell of claim 1 wherein the nongenic soybean genomic nucleic acid molecule has at least 95% sequence identity with a nucleic acid molecule selected from the group consisting of
   SEQ ID NO:43, identified as soy_OGL_308,
   SEQ ID NO:566, identified as soy_OGL_307, and
   SEQ ID NO:4236, identified as soy_OGL_310.

10. A method of making a transgenic plant cell comprising a DNA of interest, the method comprising:
    a. selecting a target nongenic soybean genomic nucleic acid molecule of at least 1 Kb, wherein
       i. the level of methylation of said nongenic nucleic acid molecule is 1% or less;
       ii. the nongenic nucleic acid molecule shares less than 40% sequence identity with any other nucleic acid molecule contained in the soybean genome;

iii. the nongenic nucleic acid molecule is located within a 40 Kb region of a known or predicted expressive soybean coding nucleic acid molecule; and iv. the nongenic nucleic acid molecule exhibits a recombination frequency within the soybean genome of greater than 0.01574 cM/Mb, wherein said nongenic nucleic acid molecule has at least 95% sequence identity to a nucleic acid molecule selected from the group consisting of SEQ ID NO:639, identified as soy_OGL_1423,
SEQ ID NO:137, identified as soy_OGL_1434,
SEQ ID NO:76, identified as soy_OGL_4625,
SEQ ID NO:440, identified as soy_OGL_6362,
SEQ ID NO:43, identified as soy_OGL_308,
SEQ ID NO:566, identified as soy_OGL_307,
SEQ ID NO:4236, identified as soy_OGL_310,
SEQ ID NO:47, identified as soy_OGL_684,
SEQ ID NO:2101, identified as soy_OGL_682, and
SEQ ID NO:48, identified as soy_OGL_685;

b. selecting a site specific nuclease that specifically binds and cleaves said target nongenic soybean genomic nucleic acid molecule;

c. introducing said site specific nuclease into a soybean plant cell;

d. introducing the DNA of interest into the plant cell;

e. inserting the DNA of interest into said target nongenic soybean genomic nucleic acid molecule; and, f. selecting transgenic plant cells comprising the DNA of interest targeted to said nongenic nucleic acid molecule.

11. The method of making a transgenic plant cell of claim 10, wherein said site specific nuclease is selected from the group consisting of a zinc finger nuclease, a CRISPR nuclease, a TALEN, a homing endonuclease or a meganuclease.

12. The method of making a transgenic plant cell of claim 10, wherein said DNA of interest is integrated within said nongenic nucleic acid molecule via a homology directed repair integration method.

13. The method of making a transgenic plant cell of claim 10, wherein said DNA of interest is integrated within said nongenic nucleic acid molecule via a non-homologous end joining integration method.

14. The method of making a transgenic plant cell of claim 10, wherein two or more of said DNA of interest are inserted into two or more of said target nongenic soybean genomic nucleic acid molecules, optionally on a same chromosome.

15. The method of making a transgenic plant cell of claim 10, wherein said DNA of interest is modified during insertion of said DNA of interest into said target nongenic soybean genomic nucleic acid molecules.

16. The method of making a transgenic plant cell of claim 10, wherein the nongenic soybean genomic nucleic acid molecule has at least 95% sequence identity with a nucleic acid molecule selected from the group consisting of SEQ ID NO:639, identified as soy_OGL_1423,
SEQ ID NO:137, identified as soy_OGL_1434,
SEQ ID NO:76, identified as soy_OGL_4625,
SEQ ID NO:440, identified as soy_OGL_6362,
SEQ ID NO:43, identified as soy_OGL_308,
SEQ ID NO:566, identified as soy_OGL_307, and
SEQ ID NO:4236, identified as soy_OGL_310.

17. The method of making a transgenic plant cell of claim 10, wherein the nongenic soybean genomic nucleic acid molecule has at least 95% sequence identity with a nucleic acid molecule selected from the group consisting of SEQ ID NO:43, identified as soy_OGL_308,
SEQ ID NO:566, identified as soy_OGL_307, and
SEQ ID NO:4236, identified as soy_OGL_310.

18. A soybean plant, soybean plant part, or soybean plant cell comprising a recombinant nucleic acid molecule, said recombinant nucleic acid molecule comprising:

a nongenic nucleic acid molecule sequence selected from the group consisting of

SEQ ID NO:639, identified as soy_OGL_1423,
SEQ ID NO: 137, identified as soy_OGL_1434,
SEQ ID NO:76, identified as soy_OGL_4625,
SEQ ID NO:440, identified as soy_OGL_6362,
SEQ ID NO:43, identified as soy_OGL_308,
SEQ ID NO:566, identified as soy_OGL_307,
SEQ ID NO:4236, identified as soy_OGL_310,
SEQ ID NO:47, identified as soy_OGL_684,
SEQ ID NO:2101, identified as soy_OGL_682,
SEQ ID NO:48, identified as soy_OGL_685, and a DNA of interest, wherein the DNA of interest is inserted into said nongenic nucleic acid molecule.

19. The soybean plant, soybean plant part, or soybean plant cell of claim 18, wherein said nongenic nucleic acid molecule is selected from the group consisting of SEQ ID NO:639, identified as soy_OGL_1423,
SEQ ID NO:43, identified as soy_OGL_308,
SEQ ID NO:566, identified as soy_OGL_307, and
SEQ ID NO:4236, identified as soy_OGL_310.

20. The soybean plant, soybean plant part, or soybean plant cell of claim 18, wherein said nongenic nucleic acid molecule is selected from the group consisting of SEQ ID NO:43, identified as soy_OGL_308,
SEQ ID NO:566, identified as soy_OGL_307, and
SEQ ID NO:4236, identified as soy_OGL_310.

* * * * *

UNITED STATES PATENT AND TRADEMARK OFFICE
CERTIFICATE OF CORRECTION

PATENT NO.         : 9,909,131 B2
APPLICATION NO.    : 14/531748
DATED              : March 6, 2018
INVENTOR(S)        : Sastry-Dent et al.

Page 1 of 1

It is certified that error appears in the above-identified patent and that said Letters Patent is hereby corrected as shown below:

In the Claims

Claim 1, Column 95, Line 50, please replace "soy_OGL_310" with -- soy_OGL_3536 --.

Claim 8, Column 96, Line 50, please replace "soy_OGL_310" with -- soy_OGL_3536 --.

Claim 9, Column 96, Line 58, please replace "soy_OGL_310" with -- soy_OGL_3536 --.

Claim 10, Column 97, Line 16, please replace "soy_OGL_310" with -- soy_OGL_3536 --.

Claim 16, Column 98, Line 11, please replace "soy_OGL_310" with -- soy_OGL_3536 --.

Claim 17, Column 98, Line 18, please replace "soy_OGL_310" with -- soy_OGL_3536 --.

Claim 18, Column 98, Line 30, please replace "soy_OGL_310" with -- soy_OGL_3536 --.

Claim 19, Column 98, Line 42, please replace "soy_OGL_310" with -- soy_OGL_3536 --.

Claim 20, Column 98, Line 48, please replace "soy_OGL_310" with -- soy_OGL_3536 --.

Signed and Sealed this
Ninth Day of April, 2019

Andrei Iancu
*Director of the United States Patent and Trademark Office*